United States Patent 9,328,346 (POLYCOMB-ASSOCIATED NON-CODING RNAS) - sequence listing, part 96

SEQ ID NO: 17918 - RNA, 216415 nt, Homo sapiens
aguucaaucauuccgcagcgagccgcggcggccgcacugggcaugcucagucuccgggcuccgcucggcaggcgagaggcguccuccggcucugggcuccggucggugggugccucggcucggcuuuccccggcgcuggcugggcucagcggccccugagcccaagcgacacacgccccgcgguccccgauccggccccugggagagccgcgccguucuggaacccgggagcccccaacuucgcgccaaguucggagccgccuucugagggagacaugaaaaagaugagcaggaauguuuugcuacaaauggaggaggaggaggacgacgacgauggggauaucggugagcgagggguccccgcguccccacccgagagcccgagccgacgcgggaagaaguucggggacugcgcgggggcgcugugcucuccgcgggggagguuggccgagacgcucggccgcuccgggcaggggaggaagcccgcuguccccggcugcuugcagacugaggccccggugcggccccugcggggcugaggcgcggggcgcgugguggccccgaggacaggcuccugacgggcgggggaugcugccccugaaaagccuggcagcugcggggacgccucugcgugcggaagucuccacucagaagcaacuuuggggucacuuccccgacucgcagagugcuaggguugcccaggagccucggcacuggggcgagcccccugggcgggguccggggagcaggcccgcauuuggaggacagggugugacccaucugaauccucguuaaaguaaaagccgaccgacggcucugggagguuugaggccuggcggggcggccccgggaagugauuuguggccgcuaggcgcgcgcuggaaacccuuucccaucugcggagcccaccggagcugugaucggaggaggaauucccccaggcagggaggaccgcagggccuuuuucacucguccugaggggcccuggggcuuggggagcaaaccuggggugacccauuucuaguuagaguuaaaaaugcauggaagugacaagacgaacggagggagagcuguuuuaagagcaaaaaaagaaaaaaagggcaaacaaaagggaugagaggaggugaggaaggggaaaggaaugagaggacuagagagaaaaucaggucccuaaagagaacacugucgggggaugaugauauaaugugucccuccagaagacucuaauuaaauuaccaagccagucuguuguggcgacucggcuuagucuccuggaugccaaaucaauuuuaaagcagaacauccugcugauguucuaaagcccuguuguuaucuaauaacuuuaaaaguaacuuaauuuuaggaguugggugugguuuuuauuucuguuacauuuugggcacggaauauuucgaucaaaaaaauuugguaacuucuugguuguccagggacaaaucgaauagaggagauuacacuccaugauuuaguuucacauuucauucauucauuuaagaacaauuuacuaguuauucaucuuuaaggagagagcaaauaguaguaguuuuuauaggagagaaaacugaagcgcacagguuggucugcccagcuucucacacuuucaaacccagguuuucugacuuguaaaaccagugaagauuaaugcucuuaccacugggucacucuggcuguuacuacuguuuagcaagauuaaguaguaccugaugauuacauaaaaauauaggagugaaauuuaaaaaguuacaauaaaauugacacagucuguuucccaggaaaguauuauugucuuuuauggugagcugcacuguuuauaaugaguauuguaaguaaauaagggcagaagcucaaauggaaacugaaguaagcaagaggcucugagcuuuguuuuacugugccagcaguagaucucaguuuagaaaguaauuuggucuagucuguguuuaccuauugaggcaucguauaaauucaucuuaagcguguggcaguaagcucuuuuuauuuuuaaugacaugucauucaugcuaguuuuguccagucaaacaguguagauagacuuaagaaaaaguuaaauaucucuacuccuccccacccucuagaaacuacuaauacuaauacuuuaguguuaauauuaguagggcauuucccacuauuccuguggggcccuggggucucuacuguaggggucaucucaacauauuuuacgucaagcagcagguaccauuuaaacaggucuuggcaauauuuuuuucuucucagugaaugaaaagauaugcugauguucuaacacccaguaucuaugaaugugauuucuguuucuuucuuucucuuuuuuuuuuuuuuuuuuuuuugagauagggucucgcucugucguuuaggcuagagugcagugauguggucauggcuuauuacagccucgaccuacggggcucaagcgauccucccacuuaagccucccaaguagcugggacuuuaggcaccaccauauccaccuaguugguuguuuuuuuggaaguacaaauuuaauguggguuguagugauuuuauaucagaaaauacuuaacuaugccaauguuaaguuuaugccuuuacaaaagaauaagccuuuuuaaagauuaccaggaguaggcugauagugguccaaagccuuuuacaaaauaauuauuauuuccaacugugggagaggagacuggugaaaugaagauaauuuuaaccucugccuuuaauuuugcaaugcacgucuguauuuacgcuauuaacuaauauuucuccuaguacuugauugucacugucaguaguuguauaauaguuugaaacccacuuggguacggaagauuucugugaaaucccucuauuaauauuaccuuuauaauucagacugggagaauuauuuuuagagacagggucuugcucugucaccuaggcuagaguguaguggcaagaucauaguucgcugcagucuugaacuccuggccucuagccauucugcugccuuugcuucccaaagcucugggauuacaggcaugagccacuguacccagccuuagaauuauuuugacacgaguuccuggguauaccauugggcguuauaauggccuaauuugcaagagaccucccccuccccccaaaaaaaaacuuucuaacuggauggggucccugauuauaucauagagaugcuuuauguauguauauggaaaugugcccucuaguagcuggaauuuagagccuuuuaaacaguggguuccugcuuacuuuugaaacacuguauuuuuauuguacuuuuauuuauucauuuagagacagggucucccucugucaggcuggagugcagugacgcagucacagcucacugcagccuugacuucccaggcucaagcaauucuccaaccuuagccucuugaguagcugggaccacaggccuugugacaccaugccuggccaauuuuuuuuuuuuuuuuuuuuuugguagagacaaggucucacuguugcccagacugguuucaaacuccugagcuuaagugauuauccuaccucggcuucccaaagugcugggauuacaggugugagccaccaugccuggcuguucaguacuuuaugucaguguugccuccuaguuuagaaugaacugaucuggagaaucaaggauaguacaucucacuauggaugucuuuuccuuguuuguuuaaguuacagccagcagaaauuauuuccaaaggcgugcuuguguggcaaccuguuggcauuagagcauuuuugcaauaggccacuuauuucuaaagcagagccaacaaccaaccacugaagccacauccaggcaguaguagugggaaaugugugguuugaagccccuguugugcugguggagaucacauauuguugcaagccccugggaguuagguugugugcuacccugccaagugugcaaaagaguguccuuggcugcuuuucgcccccucaucagcggauuaaauucagcaucucuucuuguucauguagaaugcuauaggaacagcuuuuguagccagaaugcagaaaucagauuaguaugcugcuuuauuuuguuucuucaauucuguucucuguggucaagcuuugcugaaggaggaaaagugguuccaaaaaagacuaucaggaacuauucagacuguucagauaaugagguuuuguuuguggaugguugguugguugcuuugaguuccuagucuguuuaugguaguuuacugucugauccccaucacuaauggucauguaugucauugagggguagacagaggacaugguccauuaccuuugagagauaaugauccagcuauuggcucccuuuucaacugucacauuuuuacauagacuuaucuucccacacccaccucucuuuccuuauuaccuacuucagguuuaaucaccuauaaaucugauacuagccccagucuuccuucauaaacauugauugagcaauccuucugugcuaguuucaggauuaggugcugggucagguguugggagacugaaaaugaguaagacauaccugugucuuccaggagaaaaguuccuuagaaccagacugugauauugugaaauauauaaggcauucuuccaguuucuuggcaugcaacuccuaaaacuuuuggaauuuucaaagugguaagugucuuuuuguaugcuaauaaguugacagauggcuggcagccccuagguagcuuccugaugggggcuggucacuggaaagaccaaggcaggauuaaagguuuggacuuccagccccaucuaccaaccugaagagggguaagagccaggcugaagguuaagcugaucaccaguggcuaaugauuuaaucaaucaugccuauguaauaaagccuccauaagaacccaaaaauucugugcgcugcccuggcaaauuaauggaacccaaagaggguguugcaagaaccucaauuuguagccggugggucagaaacccaggcaaaacaaccuggggccugugauuggugucggaagugggggggggcagccuuguaggacugagcccucaaucugagcucugaggcuuacugcagguggauaguauccgaauugaguugauuuagaggacgcccagcuggcguucauugcugaacaacuacuugcuugucaugugggaagaacucuucccacaucuggugauaaacguauucuguguugauuguauugagaguacagaaggagaaccugaguuugguuuucucugcaucaucagacagagauuugcaauaaaagguacauauaaaacugaagggagagacugggagagagcuucacagaagagauuuuugggucagaugcugaaagacuaggaaaauguagugcagagauggccggaggagagucuggaguuccaaauaguugccugcuagggaaggcagggagaggcuaugccgugaaggauccuccauacacuuuaaggauuuuggguuuuacucuguaugugauuuggagcuccugaaggauguuaaugaaaagagugauaggauuggauuugcuuuuggaaagaucuccaugguagcacguucuaaaauggguugggaaaggagacaguagagcuaagccuuuccaguaguuggggucagaaaugccugcaguggucauggaauagagaagaaugggucugacagcuuuaugaaagaggcgccaucuguggguucucagcugcugauuguuuccggcaagcagagaggagcccaggaugaugguggcaggaggagagaauuuucuguuccaacuagucuuuuaauuuuccccucugaccauuggcucagaccauucucccuccccgacuccuuuuuuuuuuuuuuuuuuuugggagacguugucuugcucuguugcccaggcuggagugcaguggcgugaucucagcucacggcaagcuccgccucuuggauucacuccauucucccaccucagccucccaaguagcugggacuacaggcccccgccaccacacccagcuauuuuuuuuguauuuuuaauagaggcgggguuucaccguguuaaucaggauggucucaucuccugaccucgugauccgccugucucagccucccaaagugcuggaauuacaggcaugagccaccacgcccggcccccccacuccagcucuguugcccaggcuggagugcaauggcucaauaucagcucacugcaaccuccgccucccggguucaaguuauucuccugccucagccuccuaaguagcugggauuacaggugcccaccacugugcccggcuaauuuuuguauuuuuaauagaaaugggguuucgccauguuggcuaggcugguuucgaacuccugaucucaggugauccgccugccucggccucccaaagugcugagcaggcgugagccaccaugccuggccagaccauuccccuucauaguaauuucagccucaccuccucuuuuucucagugguucccugugauauuaugacacauauguuuuuguccaugguuccuggcuuauaacuaccauaacucuugcuauaauguuggggugcuuuaggccucagaagcagaagcaggccucagaaaacaaucuccaucuuugaccugcccuauuuuuaccuuugucucuccaauuuuagaaacuaaaacuauaaucuuuccccaucuuucugugugagaacugcccauaaagaaauucucccaucuaccuugucugaauguaggccauaagacccccauuucagaagggauccugccccauacccuggaggaaggaaugcugcacagagaugccagaaaaaucugaucagacaggccuugcuggguuuccccauucagucuauuaguauuaaaucguaugcuuuuuguccaaucacuuuucaacaugguucaaucaugacuauccaaugaagucuccauaaagguccaagaggacugguucagggaguuucuggauagcugaacaguggagguaccugaagguagcuugcccugggagggcgugaaaacucagugccuuuucccgcauaccucacucuaugcaucucuucaucuuuaucuuuuauaauaaacugguaaacgggaaguguuucccugaguuccccaagccacuacagcaaauuaauggaacccaaggagggugucgugggaaccccaauuuauaaacaguucaucagaagcauagguaaaaugacccggggcuugugauuggcaucagaaguaguggggggcaauuuugugggacugaacccuuaacugugggaucugacaccaucuccagguaaauagugucagaauucacuuggaggauacccagcugguauccacugcagaauugauugcuugcuuguugcuggggagaaauccuugcacauuuggucacugaagucuucuguguugauuguugaauaagagaauagaaaaaacacuuaguguuuuucugcucacagccucccuccccucccaagucugucacaaacccagaaaguuguuaaugauccucuuagcccaaagugcucacaaugaauucucacuuauuuuuuuguucuaugcaguuagcauucauccuguauuuugucuuuguuauucauuaucuuugcguuuaucauucccauaaccauaguguacauuucuuggugacuggccuagguuauuuaagucuucuagagaucaugcaaaauaucuuaaauauuguacauauuccauugcuauaauuuuuaagaguugucucuuuuccucauucuccucuaaaauguaagcucccugaagacugguaccuuguguguuuuguguuuuaagcugugucccucauggcaccuugguaggagccaagcaaguaauuguggaaggaauggaugauuuauucuucuaagauaacuugauuaacauaaugccuagugguuuuauggcccuaguagaauuuucuucuucuguggcacuuugagauacccccaguuaucuguucuaaaaaugcugaguguauguauuuuaccaggcacucugcuagguuccagguucacuguucucuaguaccucacugucuagaaaggaaacggauaauuucaguaacuugugauuaauacuguaaucaagaucuguaccagguucaguggugauaccaaggagaaagcacgugaccuugccuaggggaauccaggacagcucuauuggggcagcaccugagccagcccuguugggaugaaaagacaggugagggcauggggcuaggacagcagagcguccugaguguuucuaaaggcaugaugauuucucaaaaauuaaaucuugauacacccuggccuuauucacgauggcaaggggaucauguuguguacauaucauaaauauauacacauguauaaauauguauacauuauauauacauaugugugugugugucuguaugcacacucucuaccaaggagaugacagcuaaaaacaaagcaaacuauccucaaacucucuuuuagaauagucuugcuucuuuuuauaaaccuuuuguuauuuucaguuucaaguccacagacaugauuuaucuugcacauucuuucaagucaaauaauagcuuuccaaaagguccuccaguauccucuuaaaauacuuuauuugguucugagacaaacacagcucuaaaagaauaagaguuacucuuacuuaauuuguauuuuagcuguauacacacucgucuuuucucaagggguugcagcagucacauaugucgauugcucuacauuuauuauuuuuucuuuugggagccuagaaauuuagaccaaaugcuccuaugaaaauuuccaucaguuauaugggauuuuaauucugauauucuugaagggagauuauaaaggauuaagaauaccggaaauaaagggccggacaugaugggucaugccuauuaucucagcacuuugggaggccaaggugggaauauugcuugagcgaaagaguuugaaaccagccugggaaacauacuaagacccaaucuauacaaaaacugcaaaaaucaguugggcauggcacaugccuguggugccagcugcuuuggaggcugagguggaagauucaauugaacccaggaagccaaggcugcagugagcugucauugugccacugcaguccagccugggcaacagagacccugucucaaaaaaaaaaaaaaaaaaacucacgauuuggcuuuaaauuaaaggaugauauugaucucuuagugauaucuguagcagaugauuaaaaugauuguauuuuaauaaguuuucacucuaauccuuuagguuuucuucuguuacacuuuacuugguguguauuuuguauuuuagcuguacaucuuaaccaaaaacacucgucuugaagcggggagaagauuucuuauucaucuuuguaucucacagccugaauaucguaauguuuuucacauaguagauguucaacaaaacauauguuuugggacauuuuuagauuuuuuuuuuuugagauggagucuuacucuuuuuccuaggcuggagugcaguggcaagaucugggcucacugcaagcuccaccucccagguucacgccauucuccugcaucagccucccgaguagcugggacuacaggcacccaccaccacgcccggcuaauuuuuuuguauuuuuaguagagacgggguuucacccuguuaaccagguuggucuugaucuccugacuucguuauccucccgccucggccuuccaaagugcugggauuacaggcgugagacauuuuuagauuuuaauggaagcuuugcaugccauaugauuuaagcugucugauuauaaugaauucagggcugggucugugcaagaguagucaauuuuagaacagaaaauauuuccaauuaccuuuagccaacgaaauguacuacucaacugauugguaaaucauauguaaagauacagauugaaggaauuuuauucagccaaaugauugucuuaugacauuauuuuuuuuucuuuaguuuuguauuuuggucauugcaacuaaaauuaauuagcauccaucccaaaaagcaguuugaagaauacugguagaugaguaugucaacaauagaauauuuuggacauggaccaaagagcaauucaaauacuguucagccaaaacacaucagauggaacacuugcauagaagacaaguugaaggguuaauaggcaacuuucucugccaugguaauuauuauugcccuggcuacauguuugaauacuaauugaaagaucuugcugcaguaaguuauucaucagccagaaauacaagugaaagaaaauguauucuuuugugaaguccaaauguugcuuuuauaucuaaugcuuucauaauaguacauuggaauucuacuauuucccacacuauuuuaaaguacaaauacuugaaauugaaaaaaaaagggacauuggcacuuaaaguucucuuuucuaauauuuauuauaacuuuggcagaacuuuagccuuaggucaaagccaugcaaauagauguucuuuuacagaguacaauuaugcaaauuacaggcuuauuuauaaagcuuguuuuaucuaaacuaagauuuuguuuauauaauugaauuuuuugugauuucuguagacauucuaucuagauguuugaaaaauaaucuuuggcuuugcacaaacaaaaugauggcuaaaguuuucuuguggugucacauagucacagucuuauacaugcuuuuuuucugauuuguacuaaauuuuuaagaaaaauauauuucccacuaaauucuaaagaaagauaauacauuuucucugcauaugaaacucaauaagauccuuaacauuauuuaaaaauuuuuauuauaauuuauauuaugauuugaaacaauugcauuguuucuuccuauuaaacaagcugugaaugccuaaauugcauaaaacauaagauauucuuuauuuaaaaaaauuaacaaaaauuaucauuuucuuuuuuuuuuuuuuuuuuuuugaagauggagucuugcucuguugcccaggcuggagugcaguggcacgaucuuggcucacugaaaccucugccuccuggguucaagcuauucuccugccucaggcucccgaguaacugggauuacaggugcacgccaccaugccuggcuaauuuuuuguauuuuuaguagagacaagguuucaccauguuggccaggcuggucuugagcuccugaccucaagugauccacccgccuuggccucccaaagugauacccauaguaaagaaaccguuuacugaucuuagaugcugcuuaagaagaaagaaaaguaaaaggaggaaagaugaacuuauauagguaauuggcugcuguugauauagaguguuaaggagugaagaggaaagucuuacggucagaugaccucaguuuauggucaccuagcaccuugugccauguccccuagaauugauugaaugacacaagcuucucagccucucugagccuguuucuucaguccugugugguugcugggaggaugcgaggugguaugcacaguacuggacaaggggcccuuuucacuuagacacuuaugagggcaguuacauuaucacccucauaauaaauucuuuuucuuuuucuuuuuuuuuuagauaaaacugucauggaaacugcuacuuuuaacuccugaucacuaagucuuuucccaucaaacauugcuguccauuuuuguugcuuucuaucauguuaugcauauaggaacugcucaauagugguauuaugccuguaggaacugcucaacaaguguaagugucagauuaaggguaaugacaguggcugugcugcagacacaugcauuuaaagauaaaggugguugaagaauugcaugugguuucugcaaagagcaaagcgauaauuauuguguguguuuuuuccuaucuugcagaucuuugggcagacugacaauauucuguugaugccaagaaacuauuuuagggggaaucucuuucagggaaaucuuagcaaaagauccuaggggcugacacacaguggcucccaauaaauggcucaugaauguagggauuauaguuccaucaguggucccuguggccuauccuauucuccuaggcuuuuuguguuguuuuuuuuuuuuuuuuuuuugacagggucucuuucuguugccagggcugaagugcaguaguggaguagcgcaaucauggcucacuguagcauugacucccagacucaauugauccucuuaccucaaccuccugcguaucugggaccacagguaugcaccaggcccuccuuuuuuuuuuuuuuuuuuuuuuuuuuauuauuagagauuggucucacuauguugcccagcuggucccaaacucuugggcucaagcaguccucccgccucagccucucaaagugcugagauuacaggugugagccacugcaccugcccaagcaguucuaauuaaaguaugcaugcuccuuugugucauuguauaguuguaugcacaaaaagugcggaaggaaacauuuaagaaguuauagcuuuuauuacaguucgagucuuuagaauaucacaggagaacagaggagggaagauuaauagugagaaucucgugguuagaguucuacaugauucuguucuuaggacuggagacauggaaauacggaggaaucuuucagagcucacuguucgcuagugggagggcaguauuugguggaggcagggcagucagguagcaccugggggaaaggaucuugacuucauguuuaaaaccuguuugaccucuucauccuucccacucacguuccaccuugccaguugucaacuguuguguaugcaggcagcaucaguuucugccccucauuucucuaagaaucuucuaaaauuggagauuaucuugggucucugagacaggaccuucuucucauccacccucauaucccugcacagucucagaacuaugguaaugcugugguaaucuauagccacuugggucuggaggggagaaggagagacuaggccauguacuggagcagauccaccuuccaagcccccagcuaaguguggguauuacagaugaggugaaggugaucuuuucucaggguccgggaugagaagcugaaaaccugaauuagauuauaaguacuuauggagauuaaaagaaaaggauacucuucucuguggugaaagauuauuucugccaucuguuacagauauagauagccucaccuuaauuuggccaaggguguggacaggcacccugcuguauguacuguggagagcuauguugaggaagaaaugggcuuccacgcuggccugugauccuuuuaauguucccaugucagccucuuuucuuauucuugggcugucuaucaaucuccucaguuuuuuuuauuuuuaguuuuuuuuuuuuuuuuugagacagugucucacucugucgcccaggcuggagugcaauggcgugaucucagcucacugcaaccuccaccuccuggguucaagcgagucuccugccucagccucccgaguagcugggacuacaggcgccugccaucacgcccagcuaauuuuuaugcuuuuaauagagacgggguuucaccauguuggccaggauggucucgaucucuuuaccuugugauccgccugccuuggccucccaaagugcugggauuacaggcgugagccacugcgcccagccuuauuuuaguuuuuuuaauucuaccucugucccauuauuuucaucagacagcuuagccuggcucugcacagagauggagaccugccacuacuuaagcuuugguuuuagacagauuugaguucaaauucuggccuagacauucaucagccaugugacccugaaugauuaacacaacuucccgcccaccccccacccguaagauggaacgaauguuagaaccuacuucauacgaaacgguuguaucaaaugaagaaugccauuuaaaaaucucacuuugcaggaugauggugccugauacagugaaagccuuccaauaauuauaagguaacauuauuaauauuguggguaguugcuuuuaccuaagucuuaacccagucuuaccucuuuuguuuuuuauuagagauuucgccuuucccccaaggcuguuccuuccacuuauacagcucauugucacuuuuugucuuuuccauuaaacugggaguaucuugaggaaaacuuucacuucagugagcagcauagugccugaugcguaguaggcaaucaguaaguuuuuguuaaaucuauggguaaaugaauaaaagauaaugauuauugaagagcuaugugauaugacugaaaaggaccuggucuugagcagcuucuuauaacuuuggggccuugguuuccauaucagaaaaauguagggauaauacagaagggguaaugauacucuacuuggacuauuauaauauuaauauguauaaaauauuuaacauauauaaaauauaaauuauauauacaaaauacauaauugauauauauaaaauauacaagggaugguuccuugcauggucauuguaaaacaacuaaacggagaaauauaagugaggucauuuaaauaaaauugcauuuuccaguagaugcauuucacaacagaauuguaucacuuuaaauauauaauuuuaguaugaaagguaagguucauaauagaaucagaugacauuuugauagucuuucuacuaaagaaaauaucuauggaauaagagcauuucuuaauuuagcaaauuuaagauuuuaaagugucuuguauuaaggucuaaaaaguaguguucuugauauugaucaugugaauuuuuaauaaaggaauauuuguaguuuuuacuuauuucaaugguuauuuuuaaaggaaaaauuuuaggcugggugcagcagcuuauaccuguaguuccccaggaguucaagaccagccugggcaacuugacgaaaccuugucucuacaaaaauauaaaaauuagccaagagugguggugcaugccuguagucccagcuacucgggaggcugaggugggaggacugcuugagcccaggaggcggagacugcagugaaccaauaucacaccacugcgcuccagccugggccacaaaacaagauucugucucaaaaaagaaggaaaaauucuaaaauguuuaauuuuccuacaaaacuagaauuuuuauuccuuaaguauuguuaaaguuugauaucaaauauaacuuauuaaaagagauuaauauaauaccaggcaaaaugaacacacaaguuauuacccugguaguuugagucauuucaaauuuacugauauaaaaaaugaaauacucucuaucuaauuugcaaaauagguacgugaauuaaugcuugucauuuuguaugcuugaaaguugggagugacucaaccuauaaccaaauguuagaacuuaaacacuggcaggcccucuucagcauuaucagaccuaagaaaaguuuagacauuccauaucauuuggguaggugagagcaaaaugaaaggaagaaggcuguuuuuauccccaaaugaaguagaguuuaagauuauucacuuuauauuuaagccuuucauaggaguuacuuuuucuaugaaagccaaaauuccaucuuucucuuacugcauuuagaauugcaguucucguuguccacuggauuucaggcuguacucuauuuggaagauugccagaccaucucauauuuucugccuccauuuaaauuuaaauaguacuuagugaccacuggguacaugcuucuauaacgggcauaucacagccuacaaaucauagaggagacaugaacauuuccaaacaggccuuuuaucugcuccaaggguaagcaaacacagcaaaaggcuuuugagccauggguaaucaugguuuuccugagaguuacaguugccuuuacuguggcuaguggccuguuuuauacuucaaaauacuuauuuggaagaguucagucaccaucuuuacuagauuauuuggcaaagaaaaaaaucaucugaaagcugacuggaauuugguagcaaugagucaucuucauaaaucaagcccacuacuuuuugaaaaagucaugugcauagagauuucauuuagcuuagagcacuggauuuaucuugccucacaaucuuuauucaguaaauaugugcgguauauuuaagguguagagauaaggaagcagauaggaucccaucuucaauagagcuuauauucuaauaagugauaaaauaaaaacuaaaaauguacacagaaaugcauucauuuaccugauaucuguucagcaccuucuguaugucagguguuguguuagguacuagaaauugagcaacaaagaagacugaaguggccccuguucucaaaguaggcagccuagcagggaagacaaacauaccaacagaauaacagcagauuauauuuaaagaucgugaaaaaagagacugaaccaggauagcugagaacagaaccugggcauauccaaaacuaguucaagggaaugggcucucacugggagauggcugacaagugcaccuguuauuuuuauaauucuaaaaauaacauggccuuagauuaucaacucuuuacaaaacaggucuaugagaaggcucaagauguacauuagauuacugcguaaaacaccacaaaugcuuucaggcucacaaguccagucguacucagggaauucaccaugcagagguuuuguuuauaaugauuucuacagcuguuaaugcaccuugcaaagugguacuauugcuagugguuccagugccccuuuguuccuugcugaaauaauagcccuggguuggaaggcaacaaaacucggucagucaccccaguucucuucauucuuucuuugcauuucaguuuagcauaauuaucuuccuuucuugugcuaaaggagaggccauggagagcuuggaccgcagcaauucuguguagcuuccggaaguuuccaaaggaggaagaaagagagggagcagguacaucuguucccugcacuccaucuuuuccucuugaggaagggagaggcagggagcuagaagccaacgggccucuggauucucagccagaaauggcucuccagacuucuacucuacuggcugugggaugugacucauuccugucuggaggaagaguuuaaccugacuucggcugggagucacaaccaagcacguagggcaugaaucacaaucugugaggguggaaaauaccuacugaugacucugauaugcuucucucaauauuuguugcccaugaaaaauccuaauauuagagaaucacacuggggauuuccuccccugugaauagccaaagcacccuaguaauagagugauauggaagaugcaaauuaaagcuugcuuuguuuucaguucauagggcaaaaaauaaaggguugcaaauucuguuaucacuugcuguuaaacaguccugugacuuauuuuucuguguagggaucuuucauaugugauugaaacuagcagguaauauaucuguauuauuguuauaucuaauaccucuaauuccuuucaaauugggaauauugucuuuauaaaugccauugagaucaaguauaagaaauauuaacauuaucuuuugccugugcucuugucugaacccucuauuccuaguacugcuuauuuaguccagugauauuuuugguuaacauuguaaaagcauauuuuacauauaguaaaauguacuguuaacuguuuaaguuaugacaguuguauagccaccacccaaaacaagagauggaggacauuuccagcacccuuguaccccuuucaugucaaccuuccuccacauggucccugcaagcacuuaaagacuuccuccauaaauugauuuugcccauucuugagcuucguucuaaagaaaucauguaaaauguaguuuuuugugccuggcuucacuuagcacaaucuuucuggggauucaucuguguuauagauaucaguaguaaucuaguguauuggaacuauaagaauaucuagaaaauguauuuugaauuaaaucuugaaguauucguuucuuauagguagcagacuaacaauccuuaaccuucuaauucuguuuuuacuuuaaagucagguagcuuuuggucuuaguuauuuuuguaaucucuuuaagcaguucacauaaugccuugccaauuauaggaaauuagcaaauguguucuuaaguuggaagagaaugugugaggaaaauucacuccuaucucauuuuacagaaauucagauuuuaauuguccugcuguaauugugaaacugaacugcacauucauucugaggauuauugcacugaugaguuuacugaugagugugacacugguucggagggaacuguuugcagacucucccuauguauaaggaguucauguguaauaauuuauuucuccagaaggucaccuuuuuuccuacugauuuuuuuuuacugguaaaaauauugcaaacagauauuguuagucucguuugguaacugaaagagcucugagaacggaaaaguuagagugaccuauccaaaugaaggagcaguucaguguuggugcaggauauuagauuccaaaauauuuguucaggccccuuuuccaaguucccagggaaguuacugacacugauguugguuucuuuuaagaaugacucaugauuuuucgagccugguuuccacucuuagucaucuucccugccugaguuaaaacaggcuuuaggcucucacugaauuccagccuugacagaaccccccacccccaccccugggcuuuugauucccacuuccuagcucagcuacauuccagucucuggaaccaauucugacuccaggcaggcaagaugagacaauucagcauuuacuaucaguccagcaguaaccuuucaguucuaauaauuuggcuuguccuuuuccuccucaguuguucagacuccuuucucagaaacaugccuaggaccucagucucuuuaguucuuuggauucuguguugcucuugucaguguuuacuaucaguccagcaguaaccuuucaguucuaauaauuuggcuuguccuuuuccuccucaguuguucaaacuccuaucucagaaacaugccuaggaccucagucucuuuaguucuuuggauucuguguugcucuugucaguguuuccuaaucacccucuugcccuggaaauaaaguccucuccaauguggugcuacuucuccuccuuccuguagcagacucugguuguggccugucugugccuacagauuuagugacaggagcuguacuuuucuguucccuucuuuagcugucauacuggugguaucuuaaaucuuagcccuaaauugugaugaaacuguuguauuuucacaagucuuccuuagucauauugugcugucuguucuaaguagggcugugaauaagagugggguacaguuuccugcaauaagagaugggaggcuuaacuucagcuuggcacguaagaaagaucaaauguuuacugcaaugugggaaaaccaccuccugggcauaauagaaauccaggccuggcaguaaacaauucuauucaaaagcagcuucucagggcugaggaaugaccuaguugaguggcaugacaucugagcagaacuagcaaggaggcuuggugguaugccgccuuuuaacuccagcaccuguggcucuugagcauucuccucauucuucaguauggaaaauggauauuuucucagucuugugcaaaaacagcuucaagaaaaguccccuagucaaaaauuccaguauuuggaaguguaccaggaguccaaaaaguugagaacuacuccuggcuuuuuccuucccucccucacacugacggcauuccugaacuagcaugccugucugucucuacauuucugggugacugccucaucccagguggccuuccuccagcugugagcuggguguguucccagguauuuaauccacccuuggggcaaguucuuccaggcagccuccagugccccuuccgggauccuggcuggaucaggcugacuguccuuggaagugaaagaggcuacauaugaaggggagaaggguccucucugccucaggagaaggaaauuaguuacaggugcaugcauaggcaaaauagccccaauccuguugugauauaacagaauuuagaagacaucuggcucaaauuuuaauuuucaaaaagugauaaauucugugaagagguaaccuguagaguuuauugucaaauuaaugguagagcuacuguaugugccacugucaguuguuaauuauuauuauuauuuuuuuaaguucuaggguacaugugcacaacauuuagguuuguuacauagguauacauguaccauguugguuugcugcaccuaucaacucaucauuuacauaaaguauuucuccugaugauaucccuccugcagccccccaccuucuaauaggcccuggugugugcuguuccccacccuguguccaaguguucucauuguucaauucccaacuauaaaugagaacaugaguuugguuuucuguccuugugauaguuugcugagaaugaugguuuccagcuucauccaugucccugcaaaggacaugagcucauccuuuuuuaugguugcauaguauuccacgguguauaugugccacauuuucuuaauccagucuaccacugauggacauuuggguugguuccaagucuuugcuauugugaauagugcugcaauaaacauacgugugcaugugucuucauaguagaaugauuuauaauccuuuggguauauacccaguaaugggauggcugggucaaaugguauuucuaguucuagauccuugaggaauugccacacugucuuccacaaugguugaacuaauuuucacucccaccaacaguguaaaaguauuccuauuucuccauauccucuccagcaucuguuguucccugacuuuuuaaugaucgccauucuaacugguguggguugguaucucauugugguuuuuauuugcauuucucugaugacgggggaugaugagcauuuuuucauguuucuguuggcugcauaaaugucuucuuuugagaagugucuguucauauccuuuacccacuuuuugauggugucauuuguuuuuuucuuguaaauuugaauucuuuguagauucuggauaguagcccuuugucagaugggcagauugcaaaaauuuucucccauucuguagguugccuguucacucugaugguaguuucuuucacugugcagaagcucuuuaguugaauuagaucccauuugucuauuuuggcuuauguugccauugcuucugguguuuuagacaugaaguccuugcugaugccuauguccugaaugguauugccuagguuuucuucuagggauuuuaugguuuuaggucuaacuuaagucuuuaauccaucuugaauuaauuuuuguauaagguguaaggaagggauccaguuucaguuuucuacauauggcuagccaguuuucccagcaccauuuauuaaauaaggaauccuuuccccauuucuuguuuuugucaaguuugucaaagaucaguugguuguagaugugugguguuauuucugaggccucuguucuguuccauuggucuauaucucuguuuugguaccaguaccaugcuguuuugguuacuguaggcuuguaguauaguuugaagucagguagcgugaugccuccagcuuuguucuuuuggcuuaggauugucuuggcaaugugggccuuuuuuugguuccauaugaacuuuaaaguaguuuuuuccaauucugugaagaaagucauugguagcuugauggggauggcauugaaucuguaaauuaccuugggcaguauggccguuuucacaauauugauucuuccuacccaugagcauggaauguucuuccauuuguuugcguccucuuuuauuucauugagcagugauuuguaguucuccuugaagaggucccucacaucucuuguaaguuggauuccuagcuauuuuauucucuuuguagcaguugugaaugggaguucacucaugauuuggcucucugucugauauugguguauaggaaugcuugugauuuuugcacauugauuuuguauccugagacuuugcugaaguugcuuaucagcuuaaggagauuuugggcugagaugaugggguuuucuuuuucuuuuucuuuuuuuuuuuuuuuuugagacagagucucacucugucgcccaggcuggagugcaguggcaggaucucggcucacugcaagcucugccucccggguucaagugauucuccugccucagucucccaaguagcugggauuacaggcaccugccagcaugaccggcuaauuuuucuauuuuuaguagagacgggguuucaccauauuggccaggcuggucucgaacucccaaccucaggugaucugcaugccucagccucccaaagugcugggauuagaggugggagccacugugcuuggcugaugguaggguuuucuaaauauacaaucaugucaucuacaaacagggacagucugacuuucucauuuccuaauuuaauacucuuuauuccuuucucuugccugauugccagaacuuccaacacuguguuaaauaggagugguaagagagggcauccuagucuugugccgguuuucaaagggaaugcuuccaguuuuugcccauucaguaugauauuggcuguggguuugucauaaauagcucuuauuauuuugagauauguuccaucaauaccuaguuuauugagaguuuuuagcaugaagggcuguugaauuuuguugaaggccuuuucugcaucuauugagauaaucaugugguuuuugucauugguucuguuuaugugauggauuacguuuauugauuuguguauguuaaacuagccuugcaucccagggaugaagcugauuugaucauguuggauaagcuuuuugaugugcugcuggauuugguuugucaguauuuuauugaggauuucuguaucgauguucaucagggauauugaucuaaaauucucuuucuuucuuguauaucugccaggcuuugguaucaggaugaugcuggccucauaaaaugaguuagggaggauucccucuuuuucuauugauuggaauaguuucagaaggaaugguaccagcuccucuuuauacuucugguagaauuuggcugugaauccaucugguccuggacuuuuuuugguugguagcuauaaauuauugccucaauuucagagccuguuauuggucuaugcagagauucaacuuauuccugguuuagucuugggaaguuguauguguccaggaauuuauccauuucuucuagauuuucuaguuuauuuguguggguguguuuguaguauucucugaugguaguuuguauuccuguuggauugguggugauauccacuuuaucauuuuuuauugcaucuauuugauucuucucccuuuucuucuugauuagucuugcuagcggucuaucaauuuuguugaucuuuucagaaaaccagcuccuggauucauugauuuuuuuuuuuugaaggguuuuuuguguuucuguuuccuuuaguucugcucugaucuuaguuauuucuugucuucugcuagcuuuugaauguguuugcucuugcuucucuaguucuuuuaauugugauguuagggugucgauuuuagaucuuuccugcuuucucuugugggcauuuagugcuauaaauuucccucugcacacugcuuuaaaugugucccagagauucugguacguuaugucuuuguucuuuauuucugccuucauuuuguuacguacccaguaauucaggagcagguuguucaguuuccauguaguugugugguuuugagugaguuucuuaauccugaguucuaauuugauugcacuauggucugagagacaguuuguugugauuucuguucuucuacauuugcugaggagugcuuuacuuccaauuauguggucaauuuuaguauaagugcuauauggugcugagaagaauguauauucuguugauuugggauggagaauucugcagcugucuauuaggucugcuuagugcagagcugacuucaaguccuggauauccuuguuaaccuucguucucguugaucugucuaauauugacagugggguguuaaagucuucuguuauuauugugugggagucuaagucucuuuguaggucuccaaggacuugcuuuaugaaucugggugcuccuguauugggugcguauauauuuaagagaguuaguucuucuuguugaauugaucccuuuaccauuauguaauggcuuucuuugucucuuuugaucuuuguucguuuaaugucuguuuuaucagagacuaggauugcaaccccugauuuuuuuuuuuuuuuuuuuuuuuuuuuuuuuuuuuugcuuuccauuugcuugguagaucuuccuccauccuuuauuuugagccugugugugucucugcacuugagaugggucuccugaauucagcacacugaugggucuuggcucuuuauccaauuugccagucugugucuuuuaacuggggcauuuaaccuauuuacauuuaagguuaauauuguuauguguaaauuugaucccgucauuaugaucuucgcugguuauuuugaccguuaauugaggcacuuucuucauagcauugauggucuuuacaauuuggcauguuuuugcaguggcugguacugguuguuccuuucuauguuuagugcuuccuucaggagcucuuguaaggcaggccugguggugacaaaaugucucagcauuugcuugucuguaaaggauuuuauuucuccuucacuuaugaagcuuaguuuggcuggauaugagauucuggguugaaaauucuuuucuuuaacaauguugaauauuggcccccacucuuuucuggcuguaggguuucugcugagagaugcgcuguuugucugaugggcuucccuuuguggguaacccgaccuuucucucuggcugcccuucacauuuuuuccuucauuucaaccuuggugaaucugacaauuaugugucuugagguugcucuucuugaggaguaucuuugugguguucucuguauucccugaauuugaauguuggccugccuugcuagguuggagaaguucuccuggauaauauccugcagaguguuuuccaauuuaguuccauucucccugucacuuucagguacaccaaucaaacauagauuuggucuuuucacauagucccauauuucuuggaggcuuuguucguuucuuuuucuucuuuuuucucuaaucuugucuucuugcuuuauuucauucauuugaucuucaaucacugauaucauuucuuccacuugaucaaaucagcuauugaagcuucugcaugcgucacaaaguucucauaccaugguuuucggcuccaucaggucauuuaaggucuucucuacacugguuauucuaguuagccauucaucuaaccuuuuuucaagguuuuuaguuuccuuggauggauuagaacauaaacuuuuagcucagagaaguuuguuauuaccgacauucugaagccuacuucugucaacucgucaaagucauucuccguccagcuuuguuccuuugcuggugaggaacugcgaucuuuuggaggagaacaggcgcucugguuuuuagaauuuucagcuuuucugcucugguuucuucccaucuuugugguuuuaucuaccuuuggucuuugauguuggugaccuacagaugggauuuugguguggauguccuuuuuguugauguugaugcuauuccuuucuauuucuuaguuuuccuucuaacaggucccuuagcugcaggucuguuggaguuugcuggauguccacuccagacccuguuugccuggguaucaccaguugaggcugcagaacugcaaauauugcagaacagcaaauguugcugccugauccuuucuguggaagcuucgugcuagagggacaccugccuguaugagguuucugucugccccuacuggaaagcaucucccaguuaggcuacaugggggucagugacccacuuguggaggcggucuguccauucucagagcucagacaccaugcugggagaaccacuacucucuccggaguugucagacagggauguuuaagucugcagaaguuucugcugccuuuuguucagcuaugccgugcccacgaagguggagucuauagaggcaguaggcuuuguugugcugugcuguggugggcccugcccaauuugagcuucccggucacuuuguuuaccuacucaagccucagcaauggcagacaccccuuccccuaccaggcugcagccucgcaggucgaucucagacugccgcacuagcagugagcaaggcucuggccgugggaccugccaagccaggcaugggagagaaucgccuggucugccaguugcuaagaccaugggaaaagcacaguaguuagcuggaguguccaguuuuuccagguacagacugucguggcuucccucgacuaggaaagggaaaucccccgaccccuugugcuuccugggugaggcgacgcccugcccugcuuuggcucacccucugugggcugcacccacuguccaaccagucccaaugagaugaaccagguaccucaguuggaaaugcagaaaucacccaucuucugcaucgaucacacugggagcugcauaccagagcuguuccuauucggccgucuuggaacaguaccugucaguuguuaauuuuuauuuacucucacauauaaauuucaaaguggauugagaaaaguuccccucugagugguuuuuucuuuuuucuuuuguaaauaagauagaaaagcuuacaauuuuucacauaccuuuggguaaaaaaggugaucaugacuacugacuuuuaaucugcaacuagaauagaaaaguauacaauaauuaauauuuugcaaacauguauagaaaaaucuaucuaauuucugcuguaacccugugcacuuguuacuuuauuuucuauaaguaaugagaaauuauuuggauaauaagauaguaauuguggccaugcacaguggcucacaccuuuaauccaagcacuuugggauacugaagugggaggauugcuugagccuagccaaguucaagaccagccuaggcaauguagcgagacccaaucucuacuaaaaauauaaauaaauuagccaggugugguggcaugcaccuguagucucagccacucaggcagcugaggcagcaggaucguuugagccugggagguugaggcugcagugagccaugauugugccacugcacuccagccugggcuccagagugagacccucucuuaaaaaaguaauuguaauaaguuguuuaauagcuuuuugaaguccaaaugaacuuacuuaggagcuaccuuggccaugcauucuaaacuucuaaaauuaccacuuucuuaguauuguccacccaugauaaccuggaguaaagcauuuaauuuuucuauaugucuuuccagguauauaaagcagugauugaauuuaccuguuugucuucugagagauguuuugugaauaauuuuuuuuuuuuaauuuuuugagauggaguuuuguucuugucgccuaggcuggagugcaguggcacaaucucggcucacugcaaccuccgccuccuggguucaagugauucuccugccucagccucccaaguagcugagauuacagucaccugccaccaugccuggcuaauuuuuguguuuuuuguagagaugggguuuugccauguuggcccagcugguuuugaacuccugaccucaggugaucugcccgccucagcuucccaaagugcugggauuacaggcaugagccacugugcccagccugaauaaauuuuuaguguaguuaauuacugcaaauuaacagagauucaggcauaguauagauugccuucucauuuauagcaacuugccugauacuaugcaguuugagaaaguaaauugaaacucauuuucucaugguaacaguguacaaagggaaauuauacuaagggcuguuuaccguguuuuauagaaauuacaaauaaauauaaaugcuauacagaguuuuucccaauaacuugaauuguugaacaagaaaauauaaucuaaaaucauauuugacuucugaugacagaaugugaaaguuucaguucauguucuugugauugucgccuuauuuuuguuguaaccaaaagaagaugaauaagugaaaguuuucacaguuugggaaucaggcuuuuuauaggagaguaucuguuagguaucuuugaggagacuuguagaagccucaggcauaguggauaaccuuuuugagaaaccgaacagguagaugcugguugucccauuaccguuuuucuuacugcccaagcagcgguuacuacauagggcuucucuauuugggggggggggguggucuguggaucugcaugggugggccuggaggaggaguauuguugaauccccucaacuguauggaaaauguguuuauuuauguacucgcaggucucuggugagaggaaucuauaguuuucauuagauucuuaagggguccuugauccaaaaggggacuggauugucaguucuguaaaacugggauaauuaugguacagaacucaugagucaagauuuguuaacugcauggugccguagaaauccuagcugacacugcugcguuuugaaacugaaagucucaguuuuccugugcugucaucaucaguucccauacugagguuucguaagguuugccugcuuuaaaaugggugcacuacaguggcuucccuuggguacugguggcaagacaaaagaaggaauagagaaugugugcguguuuaaacauuucuugacuuuugacuuccuauuaggaaucuuuggucauagcagggauggagagcuuacaucgaauggccugaacaauuaaugcggugacaaaaagguucagcgguaucccuagcuucaagagcuaguauugcucucaggcaccauggaagggaccccuuaacuucagcucucuccuugcaguagaguggcagugguaguuucucagcuaagaacugcccucuccggcccccaggaagaaaacguucugauagcuucucuucccuagaaaucucagcaaauggcucugaugaaauuauguaugugccaguuccugaaaccaccuuuguggacugaaguucccuaguaugcugaucagcacuggcugguaauggaguucuguaagccacauaaaugaaaaugggaaauggguacauuucuuuuaaauuuuuguauuauuuucuucuaaaguauuaaaugugggaaaucaucugacauuucuguguacuaaaauauaauuuuuaguauuaauaauuguuaauauaaauauuggaggcauaagacauuuucuauuuuucugucuuaaaaaacaaaaaacugauuuuuuuuuuuuuuuuuguggggagacccucaauagacucucuccuuuccuuggguuaguaguguccauggcucuuuauagaaaauguauuugcuugccugaaucugcuuuuucacuguuuuacaggcauuuuuuuuuccaucuauguccgguagaaagcaguagaaagggguuauuuucugauauuagaaugccugaauuaaaaucauuacuucacuacuuacugguuguacaaccuuaacuguuaaagcuuucugagccuuuguuuuucucauuguaaaguugaacugcaauaaugcacuuaaagggcuugguacaguguguggugcuaguagcuguuuauaguaguuaauggaaaucuuaugauuucaaguaaaauuauuguaauguguaaaauaacuuaauuacaggcauucaugaauggucccauggcugauuacuaugucuauagaaugaaucuguuaauuguaauuuugcguagauucucuuggguaggauuccacauguuagauugacauuuuagucaaaaaaaaaaaaaaacccaagaacauuauuaaguugauggagauagcauaugguacauuaauauuacuaauaagcauuacuuauguuaccgaauuagauucugaaaauaucaggagagaaauuagcuuaaagcacugaauugccaagucugccugaguguaaguacauaguaugucuuuaauugauuuuauuccucuggugacuuuauucaguuuauaccggggcucacuuuucauaauauuauaauaggaaugaauaaaaaugaauauauucauuuaccuucuaugauaaauaguucugauuagaaucauucauaagccacaguuuggagccaaugaguaaagacugaaacuuggugaaaguuuaucuugcgguuuuugguuuucuugcacuucccaguguaauccuuuuugaguucuucaggauuuuuuuaaccugggucaauagagugcuggaaguauuucuacauuugagcauucaaauuagaguaaacauugcuaacugcgaggaaagagcaauggagcugaaguugcugggcuuugaaagagaaaguuuaccagcagccugugauaauauagggacaccagcuguggaaguagauguagagagaauucugucagauuuagggaauucauuccuguaacuaaccuaauggcauagauugucaaacacuuaaugugguccgaauguagacuuguuucccugaaaauguuuacaaguagacaaggagugaucagugucugaucauuuggaugugucccugcuuccaauggggguagaccagaugacuucacaugggcuaguuccacccuacuuuuuuuuuuuuuuuuuuuuuuugagacagggucucacuguguuacccagguuggagcgcaguggcgcugucucggcucauugcaaccuccgccuccuggguucaagcgauuaccaugccucagccucccaaguagcugggauuacaguugugugccaccacgcgcggcucauuguuuuuauuuuuuuuugagacagaguuucgcucugucgcccaggcuggagugcaguggcgugaucucggcucacugcacccuccgccuccugggcgauucuccugccucacccucccgaguagcugggacuacagacguucgccaccacgacuggcuaauuuuuguguuuuuaguagagaugggguuucaccauguuggccaggcuggucucaaacuccugacuucaagugaucugcccaccucagccucccaaaagugcuggaauuacaggcgugagccaccaugccuggcaguuccauccuacuuuguaaugaaauucaucacuucagaauuuauugucuacucugugccuguuaaaaacuaagaaggugcauaaagacagcaacauauauuaagugccaggcauaauuauaaauacguguauugacacauuuaauagucauaguaaugcuaugagguaggugcuguuauauuacccauuuuugguugcuaagauuaaggaucagaaaaguaauuugccuaauguuauguagcaaucagaugguuauggcaggauuggaacuuaggcugaaucacugaggugguuccuggucagucuacuaucuuagucggcuaggucugccauaacaauguaccacagucucuacagcuuaaacagaaauuuucucaugguucuggaggcugggagucugggauuagagugcugccacuguggucaguuuauggugagggcacucuuccuggcuugcagaugaccacugugucucucuguuuccacaugauggagagagagacugugugcaugacugugugaacuccccugucucuuaugagggaacuaauccccuugugagggccccacccucuugaccucaucuaaucccaaugaccuuccaaaggccccaucucuccauaccauuguacuggggguuagagcuucaacauauacauuuggaaggacacaguucaguucauagcaucuaguuauagauauaagcaugaacagauacaauauggauaguauaaauauuugauuugcuaauguauugggaaauuaugaauuuuauaaucuauauugucucauuucuaugaguuuuguuucauucacuugaaaauccugcuaauaucaccacagauaaaagacugacuuggauauaacaaugaguuaauggaaggaaaaaguuucauaaauaguacuauaaaguuaauuucuuuuccugacaugcauguguaacaguaauagcuucauuuuguguagcuguaacacuuuacaguuaacaaagcacuugugucucacuugauucuuacaagagucauauaaaaccacccauuuuauggauaaggaaacugacaugcagaguuagccuguacuuccauugcccugccccacuacucaguuaagcuuucugccaaguagcacagcugaauuuucuucugugugcauaaggacaacagaugagguaguaaagaaaauauauuuuauaaaaaguagacuuuuuuuuuuuuuuuuuuugguggggacagaguugcucucugucgcccaggcuggaguggaguggcaugaucucgguucauugcaaccuccgcuucccagguucaaacaguucuccugccucagccuccugaguagcuaggauuacaggugcacgccaccaagcccaguuaauuuuuguauuuguaguagagaugggguuucaccaugcuggucaggcuggucucgugacccgcccgccucagcuucccaaagugcugggauuauaggugugagccuccacgccuggcacaaaaaguagacuuuuuagaaaaaacaaaaacaggaauuuggagucaacugaccugaaggaauauggaggcagaaucauuuuaacaaaggguugugcuacuaaauaguagauguggguccucacuuagugagucuuagaauucuccaauucagagauaccuggucugggcccauuuggccagccuuagccaaaaguaagacugccauuuauuguacuuuauuuuuugaugaaucugcuguggaaauggaagcugcuuccugagucaggaugguguagucuggugguguagcauguuacucagacucucugguccucagguugucuuaaaaucaucauaauauguguugguggcaccacauaggacuuuuucugaggaugaaauaacacaaauguuaaguugcuuugaaagaucucauuaucccaacugcuguaauauccugggccuagaaugccauauaaauacagcaacuuaguuugaacugaaacugcagcuuccauauuaaagaaacagaaucacaaaaugcaugacugaaaaaacuauuaucuaggaaauaguauguuacacaggaaauuuaccuaauuguaucauguucaugaaauguuugcaaauauuuuuaagguugugaugagcauuucaucuugaguaauuauucugagguauuuauucuuuagauuucugccuuuuaaaauuugguauauuaaauauucugaaaguuuauaaagguuuauaaauucaaaaaauccuuuugguguaauagaauucuucugauucuagaaggugcugucaugcauuugaaaauuaguguuuuacugauaaauaauucauugguagggcaagagguucccauuuuaaggcauuugagggaucucuuauguucaggauaggagauggaggauacagguuuauuaagugaagagagagccaucagauaguagagcugauuuucaaaaaucuuuaauauuucauguaaauuuagagaaaagcuucuucuggaugaaaauguuagacacugaauccccaaaaauaauucaaccauuuaugagccugugaccucuaguuacuuacagugcgcuagcccuguguaugccaauaccuuguguccuuuuccuuuuaaaacaacugccagaacuugucuuugaaauugucuuuucuuuauucauuaacaguuuaaugaacacaguauccaaaagacuaaugugcuuaaugagaaugcuucuuacugagcagaucauuaaucuucaauuucagguucauauggagccuaaagaucaccuguuuccuguaaacuguucacacaaaaggcuaaccuugggaagcucaguguugccuuuuuaauaaguaugccagcuaacuaaagaaauaaaaccaagaacuguguuacuagagauaauaaauggucauagguugucuuaacuaguuggagcaaaacaaugacuguauaaguacuaaaaaaguaacagcggcguuuaccugaagauguuucacaugaaaugggaaugaagaggugacauuucagacagguuuuugaggcuaauacuaaugucugcauugcugaaacaaacuuggaucagaaguuuuauuccaugcucuccaaauaguaauucuuucccaauuucaucuaaagaaaauguuuaagauaaagacagaagaaaauaugucagaauuauucuuaacuuuauuauuuauuuaucgagauggggucuagcucugucacccaggcuggaguacaguggcacgauuacagcucacugcagcgucgaacuccugggcucaagcauuccucuugccucagccucuugaguagcuaggaguauagguauaugccaccaugcccagcuaauuaaauuuuuuuguuguuguuguuguugaggggucgucuugcuguguugccuaggcuggucucaaauuucugaccucaagugauccucccacuucugccucugaaaguacugggauugcaggcaugagccacugugcccagccuuaacuuuuaaaaauggagaagauacaguacagccuuuauggacaugcucugguuacuuaaaaaaaaaaaaaaaaaaaaagagacagugucucacuauguuguccagacuggugucaaacuccugggaucaagcaauccuuggccuccugaguagccggaacuacaggcaugugucaccacaccuggcccugguacuuucugaguucauauaauaacaaaauaggcugggcaugauggcucaugccuauuaucucagaacuuugggagguugaggugggaggaucucuugagcccagaagguccaggccacagugagcccugacagcgcuucaaccugggcaacagagugagacccugucucaaaaaaaaaaggaaaaaaaacccacaaaaaaacccaaaauagugaaaguggaggugagauaugaggaaaccaagaugagcucuuugaaagaacagagcugggacccuagagacuuggauucuaguuuuaacccgauuacuaacuaguguccuuggauauacacuuaacccaucugggucuuaguuuccuuagaagcaaacagugggacuagcagaucuucaaagucucuuccaaauucuugauucucuguuacugcauggcaaacuauacuagagcuuagcgaauuaaggcaacagccauuuuauuauauuucauaguuuuugcacagagauucagccagggcucagcugagugguguuuagcuggcaaacagucugauucaagauggcaucaggcauguuucucugaccuuggugaggauuuggaaggcuggguucagauggggcuguacauuggagugccuacuugugaucccuccaucauggcagccccuguagugggacuuacuacagggcccagagacuaauguuccagugaagaagacagaagaugcauggucuucaaagacuuagccuuccaagucgcagguaccuuucucaucaugcacccuuggaggaggcauucaaaaggcugccuagauucagggggaggggccguagccuccaucaucuaaugagaggaguuuuaaaggcuauguuuuaaaguugauauagucccauucacugugugugguagaguuuguucaauugugguaaacuuacuguuuuaaacuuagccuucuugaacccuugacaaguugaaaagacagccuucugcccucugagugaauacugaugaucaaaaauaacacccuauacucuauuccuucuuaccuguucauucuccgauauaguauuugcaaacagacauuuuacuuguucaacuaacacuucguggccccucaaucacuucuuaggcuuuauuauuguuauuuaauauaaagaauacugugaucuugaaaaguagaguuugagaacaucuuccaugaguuuuaacauagaaugaagggcacaggauguuuuucagccauuucauuuccaauaaauaguuauuugacauaaagaagcuugugauagugccaguuucaccuggcagaacacaccaucacacacacaaaaaaauuuagcaguuggaaaauagcaauuuaugauuaaacaaccaaacugccugauuugaugcuuuuguguuuccauaaagugagauacuuugaagcuucucuccuggagacuuguauuuauccucaguauaacaggugguggcguaaaggguugaaagaaauuauuuaagcaaauauuacaggaaaguggccagaaaacuccaaauacaaacauaucugcaucuccaaagaagcauaaucauuuuuuuaaaagucuagguggguuuuuuuguuguuguuguuaacuacuguuuuuaugagcuguuuguaagaaaugguguaucuccguuguuucuuaggguacaugcuaaaauuuggcugacaaucaguguucucauuaaauacucauuucaccccugugaaggaguucuguuaccuggggucuguaaagcauuguauuguuggagcagagcacccuucuacugagccaaaacaguucucacauuuuucuaaggcucaaaguuaacaacaugaagguauuagggagaacagcauuuauuuuaauuuuuguauuucauuucuuuacguuuuguauauaaugguuuuggucaucaacauauguuaagucaaaauguaaauauuggcuccaagggacaaauuaugguaaggauauaaucuuauauuaaucucuuuaagucagcuuuaaagauuuguggaaaccuucacacaacagggaauugucaugguuccugacuuaccuggauguggauaucuuucuuuugagacuuccuuggggacagaaaucaucacugaauuuuucuugcuuacucucuguagauacugguauaacauuguuuuauuaaaagcuuaccaugucuacuuuuuaaacuguccccccuuguucuccugagaaauuuguuaauagugagacauauaucaugaucauugcagggagcagggaacauucuguaauucaggcuauuuaauaucauguuuguuuaauugcauaaguauuacauugucacuggaagaaaaugagaauauacagagaaaaugacagcaccuaauaaugucugaagucugugggaguccagagcuuguuuuucucaucucucuccaagcccccgccacugauccaguugcagagaagagaaaauagaauucagaauucuuaaauguauaaaguuauucauuguuuuaaauaguuuacaaaaggcauguugaugccauuaauaacaaugaaaugugaauucagggucuauggaagaaguacaggauuugaaauuuuuaaauauaucuaaaucugcacaugacuguaaauuagaagauacaugcaaacauuaagaaccuggguucaaaugaacaaccucuuacaacaaggauuuaaggccucaaaacaugaaaauguguaauugaguuguuccaccgauguuacaugaaugugcagguuacuuugagucaguuauuauuuugguuguagaugauagccaguaucauaguucacuaucuguaaaaugaggaguuuaggcuuagauuacauccaaaguucuucccagcuugcugaugucaugauuguguauuacuaaccccuauaaugaggcuagaaguguuugguuuacgcuuuagguuugcaaaagcuccucagaacucuccauguaauaauucaccauucaucaggaaaguucgccacggagugugguggcucaugccuguaaucccagcacuuugggaggccaaggugggcggaucaugaggucaagagaucgagaccauccuggccaacauggugaaaccccgucuguauuaaaaaugcaaaaauuagcugggcaugguggugugcgucuguagucccaacuacucaggaggcugaggcagaagaaucgcuugaacccgggaggcggagguugcagugagccgagauugugccacugcacuccaaccuagcaacagagcaagacuccgucucaaaaaaaaaguucgccauucuuacgaaugaggaaguuuguggaugcuggauggcacagagagaaggcaguagagaaagauuaugaauugaguugcagggccaggggaagcuuacuccaggauucugaagcccagcuuugugacccaguuguccauaccuccugaaggugggccaaggaauagggggagaggaggauggggauguuguggaucaucauugccuggggaggcaguaucugccagauccaugacuuuggcucagugaagguaauuuuucagaacagaaacaaaguccuguuuucugucuccuagaagacaggacugcagagcacuggaugguuuguugaaggcgucauagauacuaacaaucacuuguacuuacaggaccaacucuuugucacauuuuaaguuuguuuggaaaaucaguuaaguacaguuuaguuugguaauuugguuggauuuuuuaaaauuuggcuaaucaaauguuuaucacacuuuggagugaacauaaaauagugacagaaaacuuuuucauucgauggauacuuaugauuaaauggauucugaaaauuucccagaauuacagauauguaagauuauaccuacuuuguuaacaaugaaguagaaauaugaauuauggcuaaguuccauaaacagacucaacauacuugaaugaauaaaagagcaguuuccugguucuguuguuuaauuguauacuuuuauuugacucucaaaacaugaaaaaaaucacauuuuuaaauaacccucaucaagcuuugauucaaaauuuuaacucauauauuuuaugauugagaauaagcuaguuuuuaacuuacuuuccauauauaucucuuacauuauaaaugcuaaaagaauuaaguuaccauaauuuuugcaugucuauauuaucaaacugaacacagcuuuauuucuguuuacuagaauguucuuaauuuuguagcaucuuguuaucuaucauucauuuauaaucuccccuuuuauuauucugacauuugucaaguguuuuacauguuugaggcccuuaaucuuggucaccuuuaaauacuuagagauuagucaucauuagcgcaugcucccucugccuuggaauuuuuuucuucaauaaaagcaggaaugucaucuuggccaacauggugaaaccccgucucuacuaaaaauacaacaacaauuagcuggccaugguggcgugcaccuguagucccagcuacucgggaggcugaggcaggagaauugcuugaacccgggaggcagagguggcagcugagauugugccacugcacuccagccuagcgacagggacuccaucucaaaaaaauaaaaaacaggaauguugcugaaggagguuguaguggacauuacuccuuggauauuauuccuaaaggaagcaucguggaaucauaggauucuuaauuuacuaagaaucaucccaaagccauuuuuaaacaaaacuuuuugcucaaugagaacucugggaguuacaacuaguagauuguaauagaauuaaugcaacaaccguagaauacauauuuuaguggcagugcuuguuaagaggggaaacugugacuccaugagcuccuccuggauggaucauacaucuccaucuccaucuggccccagguuuucucccuggguguuuuuuuuuuuuuuuuuuuugagacugaaucucgcccauucgcacaggccagagcgcaguggcgggaucucggcucacugcaaccucugccuccuggguucaagcaauucugccugagccucccucccgaguagcugggauuacaggcaugcaccacuacccccaccuaauuuuuguauuuuuuaguagagacagggguuuugccaugguggccaggcuggucucaaacuccugaccucaggugauccgccugucucggccucccaaggugcugggauuacaggcaugauccacugcauccagccucucccuaugaucuugaagugacugcaucucuuuuuaugaucaggaugcuauaacauugaacaugcccauguguauacacaacacauggguagacacuguuggcagagaugaccaaauaugaagaauucacaguauuuuuuguuccuggccucaucaaacacugccacaguaaucauuuaagauucuggugcuuuccugguguucuaaaccacauuuacguauggcagugcagguaauuuauuuucauauccgucuguuugucauugcauugguaccuuggaaagguuaguguuuuccauuuauuugauuguuacuacuguuaaucauuacaaaaucuuauuauugcugcucauauauagaucaggacaagcaaauuugauuucuagcuuucuaaugugguaaaaaaaaucauagaggaaacuucauaugcaaauuuaaguaacugacagagaauauauauggacacaaacucuugcuauuauaaucauauugugaccucagccacccuuuguauagcccaaguaaugacuguuugauauuuauuauaaagcauauuaaauuccuugauuaacugaaccuuucauuccucuuuuuuguuucaugcagcagugaaaauagauuguucuauuaucauccuugccaggaaauuuauaaaauguauaaaauuauucauaaauguauuuuaaacugaagauauauuaauguauuauuggguguacugagcagaaaacauuucuuuucacauuugaauggcaggcacaugauuauacauucacuuccuacugaauauuaaucaucaauuccauguggcugguggauaaagcucugagaggcagccaggagaugcaaauucuugcccucaucauggacuuuuaaugugauuuuguuuaauguuuaaaaucaacugagagaccuuugaauuaaaaaaaaaaaucauucuuuccaagaagucuaggggcaguaugggcucaggauuggguuauuauaacuucuauugcucucuuggcgugccugcuucgucuguucaacuugaaacacuguuuuaauucaagcucuaaccuugguuggcuucuguucucacauuucuugcauguuuucugagggcagucucauucacacuugcaguuucagaucuguuccuagagcuucagagccccauccaggccaucuccaccagggugcaccccucugcccagccuaaucuccuugcucauuguuaaccccagucugcccguccuggggccaccccagucugaugugccacagacucuucagcacucagcauagaguaggcacuuggaaugauuucggugauuuaguucacaguugaacuuguuauuuccucccccacaccacaaguugcaucccuucugugugcucucugugaauggcauccccauuucacccacucucccugacuuccccuuuuuccucuaccacucugcuucgucuuuuugcucgauguccuuuaaauucugccuuccauguuuccugaggcaguucccugcccuccccaccacacaucacugccuugguucuaggcucuugugucucaccuggacuguggccaucucucuuaguuuguguuucagccuuccaaucucgucuccucaaaucugucuuccuucauacuguugccaaauuuaucuguccaaagcauauaucugaacaugccacccuccuaaacuuacaagucuucaaugaagaaaacugcaaacuuugcgaagauuauaaaaagauugaaaugaaagccaggaguuuuaugugcucucuauaugggaaaacaauauaguaauggguuugguuuuuuuuccagguuuauuuuuagguuuaucacaaugcuuaucaaauucccaaagcgauuuuucugagaaaauuggaaaaaguaauucacuuauaaauuaaacacaugagaauaaagaaaaaaaaugaaguauuugaagaaaacuugguuuggaaucucucagcucugcuauuaaauacauauuaaucagucgugugguguuggacacccuucccccaacuuuguccuccuaaaaaugaauuacaaugaauaauugugaauuacuaagaauuauuuugaggauaaugcauguaguguauucaguauagugccugaugcuaguaaauacuuaauuuuagcaaaaucaaaguagaauacaaaccacaguuacauacacaugcauacuuauuaacauaacacauaaggaugagagaauaguaauaauguugccucuauaugauggaguugugaguuugucgucuucuugccuuuucuccauuuuuuuacaauaaucauguuacuuuucuaaguagaaaagggagaaaaaaucuuucagugauuuucaccucugggauauguccacguucccuaccucauuuggugcccucuauccucauacuccucuuuacuucucucuccucaccucuuacaugugccuucugccucccuauuuagucaccacgaauccugaauuacugccuucccuguacacugugauucugcugcaugccuugcugucccccugccaauaauguccccaccuccacacaccaauuuugucuaguuuauugccacuccuccccuaagauuuugcuuaaaaaucacucaucagguuugagcauuaggacacuuguauuaaaauuaacugauuguguguuuguuucccccaaaggaauguuuuccuccagaauagagacuguaaacuacgagcuggaaauaaaagauuguuaaguuauaguccaugcccucagguugccgacagucugauagagaaagggaugugacugcaugaaaguaauaaauauuguaggaucucugauucaaguaucuucagaaaauggugggacaggaagaggggaguaauuugcccuucuuggggaagggguggauuagggugauggguucauaaaguuuccauuauuuucauuuaagaggugaugcuugaacugcagaauagauguuuccugggcagagaacauggggacaaguguuacaggcagaagcuuuacauggaacaaaggcaggauguuggaggacaguccagcauucagaauggugaagcauuaaguuugaggugguguccccauggugcuuggcacauaguacaagcucaaggauuuugaacuaaacaguaugcuuuuuccugguuucuguguauaggguuuagggguuuguguaucccuagaaguuguauguaauauuuugcauuuaugugcuuuugaaaauuuuucaggggagcgagucauuggauuucacuagauucucucagaggauuucaugaacuauaaaagguuaagaaccacgauuuuaacaguacacccuagaaauggauaaggugagauguagaggauagaaacugaugugaagacaaauaccuccagcugcaauuggcagggaugccccugggcauucacagggcagguacucaccugcuggagccacggagggccugguugcaguggguacuucugauaauggcucugcacacgcuuuuccaccuccuuucagcaaacaggcuuauuccugccucuuuauuugcuccaacuaagccauuauaguaugccuucucugauagucaaagcaacucuccagggcaggaaacaugaugggguugaaagacuggagagagaauggaaacaccauauguucuauucugaaaauaaaguaagagauaaauaugugaggagaacaggaaagcauguacagcaaccaaagcaauucaguggcaauggcauuaaauagacugcguuaaaaggcugcaacagcacuagccucccacaggcacuguaggucagcucauucauuccuccauggcgaguaaagagaugugggaauuauccaacuccucgaauccugcccaggcagauucaguguccuucuuugcccucugugcagcuguaauaaccuuguauauacuuuuguucuagaacauacugcacuguggcagaauuguugauaauucuuuucuuccauaaggaaaaaauggcugauuuuugaaagccgagcacuuagcgcugggcucaguacauguuuacugaaagaaaaagguugaguuuuauagcccaaagguagugaagucaguuuguacaguucagccuguacaaagguaaccuuaaacagcugaagauuuccauuauccuugcuuugucagcuucuuuccuccuuugcccagugaggcacucaaguaagagcuaaucaaggaaggaagcaggcagaucuuuugcaaagauaggggcugcucuuuugaagggagggauuuggugcaguguugaaucugaugcaaucucagacucgaucagcuugcuaaacaauguuggcaauugcaaggcaaagcaaaggacaaagguuaugggagcaaauaggagggcacugugggucacacuuggauuuguuucaggggcacugcacacccucaucagucagaaucaaguaaccucccaaagcauaauaauguguugcauuuuucagagcucucugggaugcaugaauuaggugcuagucuuaugcuaucacaaguccugcucagagggauucagaggccauccaguuaacagaauguagggagagcuugaagagaggauugagaggaaccacugauacguuuaaaggaaugaaagauuuuaucauuuguauugaguuuuuaguuuuauuuuuauuuuuauuuauuuuuuuuuaagagacgggguuucuugcucugucacccaggcuggagugcaguggcgccaucuuggcucaccacagccucaaacuguugggcucaagcaauccucuugcuucugcuucuugaguaacgaggacugcaagcaugugccaccgcaaccggcuguuuuuuuuguuuguuuguuuguuuuguuuuguuuuguuuuuuugguagagauaugggggucuugcuguguugcccaggcuggucuugaaauccuggccuuaagugaucccccagccuuggccuccccaaauguuacguuuacaggcaugagccaccaugccaggugugaaugaaagguuugaagagaaaccuaagggugauaucaggauuccaggcaugugaaggacacagagaauauuuuccaguuauugaggaacaaagaauaggaaaauugguuugcauuuuaugagggcuucugaggagugaaacucgaaaaggauucagaacaucuucccauucuccuaugauguuaacuguauuaguucuagguagagggccguuuuuaguauuucacuugcuauccuggauuggacacuugaucuaaagaggggaaaggaaggaaauuaaugauauugauuggacaacugcuguuagcacgcucaggguuuccuccagcucugauuugcaaauaucaucuuguuuacccaagagggaagcauuuuuauccccauuuauuugugggacaacugaggccaggaacacucacaguuguaugcaugauaaguggcaguccuggcucuguuacuucaguccugaguuuguguaacuccaaaggacuugcuucuaauuuauuuguaaauguaucaaguuuaguguuuauugaggccauuuggaugucucagucucuuugagguguugcagacuggcucaucacagguucugaaagucuuucaccucugagaacaacugugcauuugauccaguuggucacuugugugucuaaaacaaccaucaguugcugcuucucagccugagcaaagcauacuuacggugcaucacaucugaaaggcauacuuucuggcagagcaaaagcuaaauaauacauuucaauuuuaaaagguaccguuuucacuuaaauggcauguuuuauggacuauacagugaaggcaagcacaaaugauaugcaguauacaaguauaauacaucaaggaucauagcaagguaaaugauuuugauccacguuuaaccugcugauaaggaaaccuuucuauccaugcugcuugaugucuuuuuccaauuauacauauuauaugugagccauuguagaaauuuugggaaauacagaaaacugcaaauaaaacaaaaaucaccccaacacuaccccucaaagauaaaccaccaugaauauuuuaguaugcugcuuucccgccuuuuaaaaaaaugcaaauguaguuuuauaugguuuagaccuaugguauccugccuuuucacuuaacuugccucauaagcacucucuguuuaucucuuuuauuggguuaaaguauacauaacauaaaauuaaccauuuuaaccauuuuuaaguguacaauucaguggcauuaaguauauucaguguugugcaaucaccaccacuauccauuuccagagcuuuuuuuuuuuucuuuuuugagacggaguuucgcucuuguugcccaggcuggagugcaauggcgcgaucucuggcucaccgcaaucuccgccuccuggcuucaagcaauucucuugccucagccucccgagcagcugggauuacaggugugugccaccacaccuggcuaauuuuguauuuuuaguagagacaggguuucuccauguuggucaggguggucucaaacucccaaccucaggugaucugcccggcucggccucccagagugcugggauuacaggcgugagccacugcgcccggcuuuccagagcuuuucaucaucagcacucccuauauuuaagaaggcuucacaaaccacauuuaauggcugaauaacauuccaucacauaaaauuuacuuaaagguguuuuccagaagacauucaacagauauuuaguuugugcuuauuauaaacuauacuuuguggcgaaaguagugaacaaaacauggcuuuuguccuucaggaccuguuggaggaaauggccaauuaguaggcagguugaguccuguagaggggcaaguacauggucuaugggaucauguaggaggggaacuuaacuugagguauaauuugcauaaucauuccuugauuguugcagaucuagcaugcaucagauuuuuuugcuguuauaaauaauauugagagagauuuguagguauaaauauuugucuauauuucacauuauuuugugaaguucuugagaagugaaauuacuggggcacgcauucuaacaggggccgguacaagauguucuauuuuuuaucuugagagacagagucuuucucugucacccaggcuggaguacaguggugcgaucacugcaacuuugaauuccugggcucaagugauucucucaccucagccuccugaauagcugggacuacaaccaucaugccuggccuggccuuuuuuuuuuuuuuuuuuuuuuccuggagagaugggaucucauuuuguugccuggguuggucuuaaacuccuggccucaagcauucuucucaccuuggccuucuaaaaugcugggaucacagucgugagcugcccugccuguccuaaaauguccuuuuaggacacuaauaauuguuaccuacugugcuauucucaagguuaggagcugcaccaaggauuuccauugccuguuucaccuuaaaccucuccuaacuuuuuauagauguguguacaacuugccucuggcaggauuacaugaagaaugggggcugagaagugaguguauccaacugggaagagccaaggagggucagaggcaaagggauuguggcugaggcugagguuauguggcagguaacaugcacaccauccagguguuuguacucauuucagaggccuugguuugacaaaugcuuuagggcuguguucacugugcgugcugacagcuuggcucccuucugugaaauuucauucuugugaacuucaagucacugaaauaaaaguagccuauuuuuuccccuuuaaacguaucuguucaucgucuaaacaaacucccagucuguuaucagagcuggaggagaccuuuggauaucauaucaucuucccuguucaaacuaaaccuaaagauucuaagacuuagaaaaguuaaggaacauucggaaggaaaccgaggaaaccagcuugguggguguaaugagggguuauagcucauaucucuugauuuagcugcuggucaccccauuaccugcugcauguugucuucaggcuuuauucucuccuuaaaggaauuuuuucuucuucccacaucuugauuccugauuuugugcucugcucuuuccuucuaagauguguuauucgaguguugaauacauguaugucuuggcuaaugccugugaacuggaaauuaugcugauaaguuugcauuccuuauccuacucuguccuuggccuacuaauugguuugacaguugauuguucucuucaucuuggccucuuuguuucuuggaaaguuucuguugacucugguaaaaguaaucaguuaugucuuauuuagucccuuuggauaauuuuuugggggguuggcuuuuauuaauuuuaagaaguaauacacccaccauugauauaguaaguguggcaaccugucauggaccaaagaguaaaguuuuaaaauagaugauuaauauugagaguaggaauagcacagacaucugaaacauuaauuuuaccaaugguuaguuggugaaaccugacuguggauacauacauauuuauguaaauacaaaaaauuuuuugugguacaguaaaucuugcuucuaagaucaaauauacaaaaaaaguuagcauuguuuuguauuagacaaagugcuauuaucuucaguugaacuucauaucuguaucaugacacuaaauauaagaccuugggucccugauaauaagaauuagagaaaggaacguacaaagccaacacaccaaauuuggucugaggcugugagcuccaauaucaagugguaauugugcaguuggaaaaauccuguagcuuauauucucaacaauuucugaucaucagaguuucagaaacaauucagaguuaucaggcucugucauuuaugagugaaaggagcaauuccucauugacuguaagucuuuuauguuggcaauuccauucuuaaauuaaggcauuggcauuuucauuaugaaaaugguuuuccuggauuuauagcugaguccauuaauuuuguguuucaaaacugauuggcauuaaucuguauagugacuuuuauauaaaagcaacguaaaguugauuuuguagucucgauuuuaaagaucauuucagacaucucuuccucccguguuggaucuacuguauugaaauacgaaguuauggagaacuaaggaauaaauauagcacacuccauuuccaaaaagacagauggccuuaccauucuguguaagggacuugaggagacccugaagugaccuauauacccuggcuccacaccucacauuuguucuugcucauuuucuucuauaucuugcaguguggaaugauaauaauaaaugauaaugauagcaguuaugucuugagugcuuacugucagaccucguguuauguaccuuaccauccuuauuccauuuaauauucacagcagcccuaugaacagagguaguaugaugccuauuuuacagauuaggaagcugagacuuuacccagcugaucauccaguuaaccuucccgauucuugucauuucucuaccaccuccaguccauucugcacaucacugcuggccccaucaugugcuuuucuccuucagaaacaccuucguagacucuauacuguguagggauaaagcgcaaaccucaguguaccugcagguuggcuccaacuuuuuaaaucuuauguccugcaacuuccuuacaaaaauccugcaguauagaccuacccuaacaugagcaugcuguguguucaccuguuucccugccccagcuggcagaugccuacuauuugccaggcacuguuaggaucuuagggacacaguucuugccuucagaacaauauacucaaggauaaggcagaccugaacauaaaucacuucuccuuagcuuuuauuucuaaucccagauuggcuuagacccuauauccuuggugaaacuuccccuggccauucaaggcaaaagugauuccaccuuccucugaaugucuguagccugaacugccuguaccacauauuuaucuuuggguugugaucuuuucaguugucugcaucuuaacccacuuacaaaucuuugcaaguuaaagacuauagguuuauagguuaagccuuuauagcuuaaagauucuauaggcaaagucugugguucuaugucauugaucucuaaacuccaguuuuuaaaaauauucauaaauuuguaaaaaucuauaagauuuuauaaagaaauuuuagcccuggauuaccauacuuuuaaaaauauauugcauuguggucugagaccguauguauuaaaguauaaaagauuagguuggcacauaaauauggcauaucauuuguuuuuccauacuuguuuuaaacauuggugccaagucuuuuuuuaaaaaauugaauuaauauuacugugacacuuucccuuuucuuaguuaucagccuuuugacuauaagccaagcuuuuaaaagucacuaauaaaauauaugaggcuuagccugguaauauagugagaccucaucucuacaaaaacguuaaaaaauuagcugagcgugguagcaugcacuuguaguucgagcuacuugaaaggcugaggcaggaggauugcuugaucccaggaaguggagguugccgugagccaagauugugccacugcccuccagccugggugacagaacaagacccugucucaaaaaacaaguguguguguguguguguguguguguguguguguguguauaauauggcucuaguucuuugaguuaugggguuuguuaaaaaugacgaagugggaaacccauucaggucccagcuugagccacuuaacagggugaacaugauuuagucaguaacuccuguuucuucacaaagcagaugaggccaucagcaucacgguggacauagugggcuuuucaccuguugaagacucuugugggugacuguauccauguugugcuauuugaauugaaucauccaucuauuuaucuguuauauuaguuugcuggggcugccaugacagaauacuuuagacuggguuguuaaacaacagacacuuauuuucucacaguucuggaggcuaggaaguccaaggucaaggugucaauacauuugguuucuccugaggcuugcuaacgaccaccuuuucugugcccucacauggucuuuccucugugggcaugcacucugguaucuuucuguguccaaauuucuuccucuuuuaaggacaccagucugauuggauuagggcacacucucacacucucauuuucaacuuaaucaccucuuuaaagacccugucuuuuccaaauccagucacauuuugagguacuuuggguuagggcuuccacaucugauuuuuggggaguuaugauuccauaacaucuauuuaaaauagcacuuacuagccaggcaugguggcucacgccuauaaucccagcacuuugggaggccgaggcggguggaucacuugagggucaggaguuugagaccagccuggccaguguggugaaaccccgucucuacuaaaaauauaaaaauuagccaggcaugguggcgggcaccuguaaucccagcuacucgggaggcugaggcaggagaaucgcuugaaccagggagguggagguuacagugagcugagaacaugccagugugcuccagucugggcaacagagcaagacucccaucucaaaaaaaauagcacuuacuuguuguaaauuauguaugaagaggcuagcauaaagaagaaaccggaaauagcccuccacuuauuuagugccuauuauuaaaaggggaaggguacagguauaugaaaagauaagucaaaacuguauugaaggguauaaaagaaaaauaacucucucucccaacccucuccuauuuuaggaaacuucuuuaaaaucauuuacacaaauguuuaaaaaggccaggugcauuuuuuaauguauuagugugucagagagaguacagauaucucuauaucugcacacagauuaggcuuuuaaauaacuacauaguauuccauuguguauguacuauaauuuaccuaaucaccuauuaacaggcguguagauuguuuccaguucccccacuacuccauuacaaacaguagugcuggauuccuuuuacaaacccaggucugggcacaguggcucaugccuguaaucccagcacuuugggaagccaaggcaggcagaucacuugagguuaggauuccaagaccagccuggccaacauggugaaaccccaucucuacaaaaauacaaaaauuagccagguguggugguacaugccuguaaucccagcuacucgagagccugaggcaggagaauugcuuggaccugguagguggagguugcagugagcugaaauugcaccgcugcauuccagucugggugacagagugagacccugucucaaaaauuaaauaaauaaauaaauaaaauacauacauacauacuuaaccaggaugaaaaaaauaaugaagagcuaccuaagaagaauaacugggcucugaucuuggugaaaaccaucuuuguuuuucaccuuccuguuuauuggucuuuacaagaguuguugugaaaggcauuucauucuuuccuguccuccaguaccugaccacaugccaauaccucuucuuccugcaauaauaggaagggaaagggcuuuccuuggcaacauuaggucauaguccuccccaggaagaaaggucugucuggaucauuaacgggcauagacuauuuuuagcuaaggaaaacaauuuuucuuguaagaauugcuauuuccgugcucagggcagcacaugcauccuuucuggcugcuuccacccauuggcaaggggccagcucucuaauggaaugugagcagucuuacugcuaaucaagauuuaugguggagaccaggacgccuggccgcucauuggauuugcagacccuccaagcuaacagcggcagccuugagauuaagugcaaugcagaggcucuggugcuguucccaggcccucccuucuucucuggggccagcuucuuagccacagguaucaucuggcauuauuuuauaagcugugccauagugcagauguucuuuucugaggaauuacuuucauuucugacucauuucaggaaaugagacagucuaucagagguauucuucauuuccagaccccuggagaguucauuuucaccugggauuucuaaccacaugggggcagugcuuuauuuacccagaugugagaaauaacaguaaugaauagucuucuucuaaggcagcccuuacuucccugcagaauccagugugaaggcccagagguagcuuaugcccuuauuaguguaaauauuucugaggcuuugguuuugugaugcuuguggacaugcuguguguaugggcuuuggugcaggaaaaacauaauuuagcaacagauuuaaaagguagucuggaguguuucuaauuacuguuuguuuaguucaccauugccuaauaaguggauuuaaguaaccucggggguagggaauguaauguucauauuacagucaaccaugcaaaucaauuucuaacuaaguauugcagagaacacaccguggagccauuuuauagaaguauuccauugaaucuuaaauuuagaccugagagcauuuuggauugggcauuucccacugguugaugcacacagccaugugugguacagucccguuuaagauccuucgguggccuuuggcauuuaguuuucuuguuaauucaauguaguuuucuuuuuaauuuucccauccuucauugaccauaauagggaacugaaguauuaagagggcccagaacaguaguugucaaccuugguuguagcuuggcaucauucugggaacuuugaaauuacugaugccugaggccaccuccagagaucugguuuaauuauuggaaugcagccuccacugggauuucuaaaagcucccagaagauguuauugugcaccagggguagugaaccacagaccugagaugucaggguccugagagcucaucucauccagugguucucagcccuggcugcagauuagcaucaucuggagagcucaugaaagaagcacugaggucccaccaccugaaacgaccuuucagaggaaggagccauucuuuuuagaaggugcucaggugauuuugaugcacagcaagaguuaagguuaacugacaucuuagccaucccauguuauagauaaggaaaaugagagcaaaaauggucaaauggcuuguacgaggucagguccuuguuguuacagaggcaggucugaugccgccuccugcucugucugcagccuaacaccaucccuuauauuggccuguuguauuuauugaugccuccucauccuucaggugauguuccugccuccaggaggccuuuucugacuccucauacucaccucccauccagccuggguaagauccccuuccuuuguauuugaacagcauccuuccuucuuuuuccccuccgacugucaguuccgggagaacaggccugucuuuccuguuauuucuguaacaguagugggguuucagauaauauuuguugaauugaaguucuguaacuuuuuauuccucaguccacauggauugcugaaaauaauccauuccuauaugcaugcuucagaaaagaacuucagaaagcaaaaguuauuuuuuuuuugagacagucucacuccgucacccaugcuggagugcaguggugcaaucucagcucacugcaaccucugcuucccaaguagcuggaauuacaggugcaugccaccacacccagcuaauuuuuguauuuuuaguagagacaggguuuugcuauguugaccuggcuggucuugaacuccugaccucaagugauccacccaccucggccucccaaaguguggggauuacaggugugggccaccaugcccggcugcaaaaguuauuucuuaccugucuauggcucacuguacuaugggccaggaucuuaaaagcaagaaggacuucccacccugccuuccaggagagagaguuuuagcaaaaaauguuuggcaaggauauuuugaugacaaaauaaugaaaacaagauuucagugaccuuacauguuacucaagcuauguacaacauccagggaccuucgaauaacauacaaauguauauggcauaacaaaagggaguauuguggcauuaccuaacaacaaaaaguugucugaaguaaaugaugcuauuuuauaaauauacauuuuaaggacugaauuauuauuuggugcaaaaguaaaugaugcuauuuauaaaaauacauuuuaaggacugauuauuugaugcaaaaguaaaaguaauugucauuacuuuuaauagcaaaaaguacaauuacuuuugcaccaaucuauaauauuuuaaagcagccacauucuguuaguauagcugaauuaaauccuuuggcuucuuuggauuaauauguuuugucuuuucaaaugauuuuuaaaaacucuaucuucugucauugcaguguacuuaggaucauccuuggccaauguucuauuuuuacuggaaaaguauuuucagauuugcacuauuuacauuuacccuuguagcuguaccagagacuuuucuguaaaagcaagaucacagcuaguaucugcuuagccuacaaguggccaggaagcucacugcugagaugcugaaaaguaauaauuuucuugggugaaaaauacauaguuaaaauuuuuuggaacuaaaacugcaaacugggccucguuguagaguagaccccaagauguuaagauggugcaaacaggacagaauaauaauugaaaugugaagaaccucuuugaaauccuaagucuucauacuuucaugcauuauuuuuaagagccuucauauuggagagcaaaugguaauguggcaguguggaaguaaagucaccauauaucauggaaaaucuuccuaaaacaaauauucuugaaacuuucaagauaaagcaaaucaauuuaguuggagguaaauauaaaacguuuuuauauuaaauaacuuuuauuguuuaaagaugcaaauuuuuugugaagauaaaacaugaagauuugaagaaccaccuuuuuggguuuuuuuuucuuuucuuuuuuuuuugcugcuauguaggugaaaaauuuaacaaaaacuacuaaugaguaaccaacuucuaucacacaaacuucagaggcucagcagugcauucuggaagugaagagaagggucaggagagaaaaaaggguuuuuuaaauauguaagacugcauuuucaguguuuucaucuauguccugucaucaaacuuuuauaacuacccugcaaauuaggauuuauucugaccagauuuuuacauuuaccuguucacuagagagaggagccaaaauuuaaauccaaguaagucugauguccuuguguuuuuacacugaauauggccucucaugucauaagaagagagaauucuccagaagagacauuauuaacuaugagcguuuaccaugcugguggaagagggcuggcuuuagcuucccuuagaguucuuaauaaacacaaauaaguugaugagaaaaaguguuggcagugguauggaaaaaagggaauccuuguaaaccauugggaauauaaauugcauaaccauuauggaaaacaguaugaagauucuaaaaacaaaaaucaaaaauagaacuaccacaugauccugcagucccacuucugaguauauacccaaagggaaugaucuuaguaucuugaagagacauucacacuuuuguguucauugcagcauaauucacaauagucaagauauggaaacaaccuaaguauccauugauggaugaauggauaaagaaauuuugguccauauauacaguggaauguuauucagccuuaaaaaagaaggaaauccugccauuugugacaacauggaugaaccugggagauguuaugcuaagugaaauaagccagacacagaaagacaaauacuguuugaccucacuuacaugugaaaucuaaaacagucauaaaaccagagaauagaacagugauugccggggggcugggggaaaugagacauguuggucaaaggguacagaguuuaaguuaaagaggacuaaguucuggggaucuaauguacaguaugaauggugauggaguguguuaauuugauugugguaauuguuacacaguguauaucaaaucacauuguacaccuugaauauauucaaucuuugucaauuaaauauuuuaaaauggaagaaaggauggccaauuuugaucaaaagucauauagucagauagaauuuugugaucugacucccagaaacuacacauuugauuuggggaaggcagccaagcaaaauaguugauaauuugcucuuuucguuugauuccuagguuugagaaucuuggcuuuccuaccuacuagcugugugauuuugggcaagucacuuaaccucuuugugccuuaguuuccucauugguaaaaugggaaugauaaaacuugauugcuauugauuuucuucucacaugcugugaguuagaaaaauguaggaauuuguagaaugguucuguucugcuccaacaaauuggguucuuugcugugagccuuggucugcuuccuauuuacgccuccccauuagagccauuucuauuucacaggcacagggaucucuucuguugcuuccugggagaauccugaaggaggcuugccauggggugaggcuuccuuggaaacagaggcauaguguucuaaaugaacugaggguuacuaaguggucugaauacacuuauggguaaggaauguuaucacagaggauuguucauucaucaugagucacagagccucccagaacuuucucuuggagcucaugcuuaucucagcagcacggggcacaacugaccacucccugcuuccugaaauucuuuuuuuacuuggcuucaugaugcuacuuuaucuugauucugcucacugcucacuuguucuuucccaaucucuccugcuggauccuucucuucuucuggccccuaaacuuuggagcacccagggcuuagugcccugacccucuuccccaucuccacuccuuaggugaucucauucauuugcaaggcccugaaugccaucuguauguggaugacuuccacauacuuauguccacuccuuaucucucccuugcuuuacagcugucggcuuuacuucuucacuuaguuguuuaguagaugaguugaacuuaacauuuccaaaaccaaauucuugauuuguuucgugagucuauacuuccuccauuguuuuaaccuaugcagugauaccaccuagucacucaggccccaaagcugaagucauccuugauuccugccuuucugugacaccucguauucucaaauucaagcacccaacauccccugcgcccacaccuaaaucggagcccaggccacuacuaaguuuugcaaggacuccuguagucgcuuccugccaccauucaugcaccucuuggucugaguucauagaacagucacagugauccuucucuuuuacaccuuuauacugucuguaguggcuucucuacaaacaguauaaaauucaaacucuuggccauguacuguaaggccucugcuaccucuccauccucuucucuuccugcucugcgugucucuuaacugugcucuagccacaccugucccuugacaugucacuccuugccuggccacuauccucaucauccucuccacccucugucaccucccaacuccuuucucaucuaggaugcuugcugcugcacuuccuucaguucucacuugaaugucaccuacucagagcugucaccccugacuuaucuaucuaaaaugucacuguuacucuguauccucuuaaccugcuuugucuucaaaacauuuaucuccaacugaaauuaguauauguacauuuguuuguugucucuaucccaguagauuguaagcucuguaaggacauugauccuggugcucgauaaguuguaugacugaaggaguuaguaaauuaaugcucuggaaucccuguguuaaaaauacuaaagaaucaaacaccuuucucuagacccuuagauccgucuccaucucuuacccuguuucucugucuccuuuuauuuauuuuuuuauguuuauuuuuugagauggaaucuugcucugucgcccaggcuggagugcaguagcgccaucucggcucacugcaaccucugacuccuggguucaagcaguucccugccucagccucccaaguagcugggauuacaggcacccgcccccacaccuggcuaauuuuuguauuuuuaguagagaugggguuucaccacauuggccaggcuggucucgaacuccugaccucaugauccacacgccucgaccucccaaagugcugggauuacaggcaugagccaccaugcccggccugucugucuccuuuuaaagcaaaacuucuaaaauguugccuacauguacuacagcuucuucauuacucauuuauuuuucaaucuguuacguauggugucuuuucccaucacucuucugaaauugauuguggcagagucauucaagaucuguguguugcugcuuccaauggauacguuucuaucuuacuggaucucugaguggcuuuaagcaguuuucuauugccuucuugaaauuaccuucuaacuuggccuucccccuucccuacuggccauuucuugauccucuacuggcauuuccuucauuacuuggccuccugggaauguugagaauucuucaugcuaugguuuaagccauaccucuucugucuacaugcucaucuauuucaggggcuuuaaauaccauuaauuugcugacucuccaagguguauaucuccaacacugagcucuucugaguucuagacgccguacccuccucccuccuugacagcacuccuggauggaugucucauguucagggaggaacucuugauuugcuuccaugucccaucuaccccauccugccucugcgcucugugucuucaccaucucaguaaaugguaccaccauccuuccaauuuacaaagucagaaaccuguauaucauccuugguuucucuucuauuguccuuccucuccccccaguacuucuaccuucaaaaugauuuugaguaucuucucugucuccacuacuaucaucuuaggccagcuucgucaccuggacuucaacauuagucuaaugacugggucugucguuuccacuccugccacagaaguaugcucugugaugguguggugccaucccauuguuuaccugucaguguuuaccucacuuguuccccagccucucaugucuucacugcccugcagucacaccgaucuuugaucauaucuuugagcacaccaagauacuuucugcuucagaacuauggucuuguuuuuucuuuuuccuugcaugcucuuuuuuuuagcccugcauagccaacuccucauacuucaugucucaaauaucaccccucagggaggcuccugugacccacccuacccgaaauacuuccaucucuuaaucucugcuauaucaacuuguuuauuuccuucauaucuccaagcagagucaguuauuuuaaaaguacuuauauuuaguuuuuauuguggaauauaagcuuccuaaaaagggacauuuucuguuuuaucuucugcaucuagcacgugccuggcauauaguaggugccagaacagugauucuuacguuuauauguguucaugccaugagcuccccgccuuuuuuaauugggggagaaaugaaaaguuuuuauuuuagucaaaguuuuacauaauuaguuagaauguuuacauaacucaaaaauuaaauaauguugcagguuuuguuaugaaaaccagcugcaucaccuuuucuguucgcuguuccccagaggccaggauuuuuaacuguagcugauucuuuuaguaauuaccucuauaucucugguuaacauaauuaaauuauaauuuaucuauuuuucaguuuuaggcauuaucuauugaugcagaaguauuuagcucuuuuucaccuacuccagcccccuucccuucucucacaaacuuucccaaccccauucccucaauuguaauuguguuauaauuuugguaagaucaguaugcaguguuuacuuuauuauaacuauguaauacuuuccacagaugagcuauauaauauaguuugauuacuuuuccucuggagacuguacagcagauacugauauuauuaguuuuucauauaguuaugaauaauucaaccucacacuuuuacccaauuguaaaucuccucucaguguaaucagccaugcauggaauccugucaaauucauccuuugggggagauuccucccacagccuucugaucuccuccacgcugcccagguuggucuuuagaccucagccgagugagggauuccuuuucaccaccauccugagaacuuguauuggagcccuacauuuaugucuuauuuuuuguugguuuacuauuuuauuuugauggagcauauuucucagugucuuauguagaaaggguuaaaggcagguaauuuuuuuuuaaacuugcgggucugacaaugcuuguauuuuucucuggcuuucaguugacagcuugacuaaguauauaauucaaagguggaaauuaucugcucucagaauuuugaagccuucuacuuucaggaguugcucuugaaaaguuccugccauucugacuuaugauccuuuguaugaaaaacuuuuccgcucuggaauuuuguggauuuuuuucuuugaacgcaguacuuagaaauuccauaaugauuaguaugguggaaacucaggagacccuuucacuauggcaagccccacccaauucauuuuuuuaaguuaaaaaaauuauuauauguauuuuuuagagauagggucuugcucuguugcccaggcuggaguagguggcacaaucauagcucauuccacccucaaacuccuagcucaagcuauccuccccgcucaaaccacccuccaccucguagcuaagacuauaugcaugcaccacaccuggcuaauuuuuaaauuuuuuuguagagacagggucucucuguguugcccaggcuggucuggaacucuaggccuuaagugauccuccccaccuuagcccccagagugcugggauuacaggugugagccaccgugcccaacccccaacuccauuuuuuaaaggaaaaaaguguccuucaguuuguuuucagucgugggagaaagguguucuuuaauuccuaauccuuuucaauuuggggaaauuucuuugacaguuacuugccuuccauuuugucuaauccaugaauacgucuguuauuuggauauuggcuauccugaauugguucuccaauuuuccauguuuccuauuuuucaccucuuuuugcuuaacuuuauugaacauuuccugaauuuuaucuuucaagccuucuguaucauuuuaauuuccaaaagcucuuuuuuuuauucuuugacuauuucucucuuucucccucucucccuuugguaacaucuuguccuuauuucauggaugcacuuuucucaaucucugaugaugcaagaguuuuuuguuguuuguuuuaagcgucuuuuucaugugauuucucccucuucaccaaguugcuuugcuguuucucuguuagaugcccucucagugucugggaagucuugucccuucuaauuuuugaguagcugucuagaaagauggcuggaaguucuguaguaguggauggcauuuggcaauuaugcacuucacuuuagggugaccuguuuggcuguuuguuuaggaaacucuguuaguaauuuuaggccgucccuccacccaccccuccaaguuaaucagaccaagagaaaauacagcuagucagaaagcuaaguagaagucuaggagucucaacauucagcaguaaucuuuuguguaaucugucuuuucaguaugggauccccauccucaacugugccuaguauccucuugucugaagagccucuguucacucuuuccagagaauaccuuucaagucuuuuccuagguagggugggguugggaggcaaccacuugucuuuaagccuugaggaagggaaucuggagguccaacuccucaauaaacagacuuacgaccauucuccugcccuaccuucagucccacuuccagaggagccugugcugccagccucuugagggcuuauaauuuaaaugaaauugcuucgaggcuuuccuauuuuaguauuuagcuuucuccaauuggcuaaguaguugcacuugccuaacacaaugucuccccaaauuguguuacugucucuccuccucuauuuucuuugucuuuauugguuuauguucugguaguacuugaggagggggcagagcuaaaugcauauauucagucuuccaucuuuaaauaaaguuucaccgacaugaguuuuuaauuguuuacaaggcauuugaucacacuucugaaacaaauuucugugugaccucugaguccccauuucaccguaauucuuuuguuacauuauggggcgaguacguggaaagccccugggucaguguuuaggacacuuggguuccauucccacauuugcuacaaacucuuuaauccugggcauccugccuugucauuauuucuguuccauaagacuaaggaauuaaaaaugauuuuaagaucucuuuuuacgcauagauuuauuuccaagaaguugagauaauuguauguaacugaacaccggaauaggaaacagaguuguggcagccaguugaagaaaugugaaguuaaguuucuccuuguauuuuuuagucagucucaguaauucugacauuuucaaagucagguaaaauugcaacccacauuucaugaacaagagcuguuaaaagguuaaaaauuguggauuuuuuuuccucugggcuauuuucagcugauaacaguucagcuccaaagcacacuuggauucauguucucaauagccagauaaaauguuaguuuugaacagaagaacaggaaagauaauagaggucuauuuuuuccccuuuugcccucuggcaaggauggccauccugggagcacccaucaggaaauguguccuucccaucaaagccauguuugaaaagauaauacgcccaucucuguauauuuuuuuucucuuuucuaaguugcugcuucucagcuggauggaaagacaaaguggacauggcaugucaccgugacuuugagugacgaguuugaucaguaacccagugugcucagcuguggucaguacaaugacugaggagaaaaugugguugugagaucagugacccuguggccuacagaccaaagggcagugcuucacaaauugccauguacaugggacccaaccccucaccaauuacuagcacagaaucuccaucaggcaagguguaggaaucauuuugcauaguucuccugguuauuguuacacauuugauucuugcacugauucugggaaaacauugccuugggacaggaagccaaaaagaaaauuggagucuugaauauuuacagagcucagaagaaaaacccagcagaauggaaacugauccuggcacaccgagucagcagaugcucuccuaucaaucacagaaacuguuucaaacucucacugucuuccucuauuccacacccucuuggccucucaguagaucauuuucuuaaaucagaaaggaaaggaaaccugcaggggcuacugccucaacuucuuuuaucucccuuccuccaaaaaugcauauacauugugugcauguaaauuguaucauauauguguuuuuauauauauauagagagagagagagagaauauauguauauuuuauauauaaugcauauauaaaugcauguuuacauucaucuuugcuucucccaucugucaucuuucugauaaauguuaaugccuucaccuaugccucucuccaucagugauccuccuguguuuuucuuucacuguuuuccaucaacguguguauguguauaugugugugugugaauagguaauaugaauacaaguuucaucuuauaaaacaaggcacaaaaaaugaacaaaaauauaucuuccucaacccuaccuuauuuauucauuuaguaaauauguauuagggucaacuguguacaaagauucuggcuaacuacugagguucuacagcaaacuaaauagguacagcuucuguccucaugaugcuuguagucucuuuuuaaccagccuucuuuaaaaaucauuggucuuauuuuuucccauguuauuccauucuuguguugcuguaaaggaauaccugugacuggguaauuuauaaagaaaauaaguuuauuuuggcucacaguucugcaggcuauacaggaagugcacuguuggcaucugcuucuaggagggccucagggagcuuacaaucauggcggaaggcgaaggggaggcagcaugucccauagcgagagcaggagcaagagagagaggagaauaccauacucuuuuaaaacagccagaucucaugugaacugagcaagaacucauaagcauggggauggugcucagccauucaugagacaucuacccccaugguccauuaccucccacuagaugcugcauccaacauucgggauuacauuucaacaggagauuugaaggagacaaacagccaaaccauaucauuccccauuacagaaauaacaucuguuuguuaucuuaaauuugaaagugguuuccuaaugggaagcuauuaaaguauuuaaagcagaaaaguacugggucagaauuuuauuuucaaagauugcuuuggcuacugaaaagauaagugauuaaaaggggaugaaaguugcuggcaggugggcgggcggucaggagguuggugcaauagucccaauaacagaugcaaggggcuuggcaggaugagaugaagagaggaagacagucaagaacucuucagcaccauaggagagugaauguuuggcugugggggaugcggaagggaggcuagucaaggaugacaaccagguuucuggcuugaccagccaaauaagggggguuaccauuuaugcagacaagaaauauugaagaacagcuuugaguguguuugugguugagagggaagcauaaguccuguguguuaauacugagucugagaugccugggacauuuccaagucaagauguugcauaggcaguuggauaugugaaucuguggcucagaagagauggcugaaauagagcaaugcauuuggaaccuuuagucuaccuguguuaacaguugccagcagacaaagaggagcagggcuuggauggagcccugaauauuuucagaagucaaggcgcagucaaggaggaggcaccaauggaggaaaucagagaaauggaagacccucuaagagaaugaaaccaagaggagagagucuucaaaagaagucguggccagccgugucaaagcucauugagaugucaaguaaggcaaaaauguaaaaugggcauuagguuuagcagcaugcaagucacuauggaccuuagagccggcuggugacugaugggggcugaguccaugguagaggagugccagcguacuuugaccuuaucaguaguaguaaggacuauguuauaaugcaauaggugcaguggaaaggcugauuaaaguuguuuuaacuuuuuugauaaccuuuuaucuuuauuguuuuauucugauuacaaagcaauauauuuuacaaugagucauuguaaaaguucuaaacauuagaaaguauaacugagaaucaucuccauaauugcauucucucauauauagccacuguuaauaguuugagguguauccuucaagacuuuucuguacaugugcuauugcucgcucucucauacacacuuacauuacaaaaauuggcuuuauugcuaugucguuggccagaguuuguguuuuuguucuguauauuauagacauguuacucccuaaaguagaagcauacuauucuauugugcuguaguguugucuggauauuuuaguuuuacuuagaaauuuuggugucucucauaauguuacacucaacaucuuaacguacuuaugcauauuuauauuuuuccaaauguguacaggaauuaaguagaauuugugaggucgaaguauaugcacauuuaacauuugauagugauacauuuccuaaggagaggcuuuuuacuuuuuuaagauggaauaaaucugagcaugaaaaauguugacaaaggugaaaaugaagcguagguugaagucacaguaaaaagugcugaagucacaagaaguccugugggaaugggagucauggcauaggaggaggcuuugggcuaugaucagaagggauaugccaccucucccaugaggaggaguggguagaugggacaggauggggaaaggcaaaguccucaguuacugcuguauuuccagagcuugcccagugcuuacguuuagcaagagugccacaaacauuuauugguugaaggaauaaauauaauuugguugauucaguuauauaauuuaauguuuccauguaauagcaucuauuuuuucuacucugucuacauaaugggagcuaagauuuccugcugaaacuggugaaggaagaguuagauuuaaaaggcccuucuuacuuagugaacccaguagguaaagucagacaggacucguagucuaagcauuucucaucuuccuuuccuaugagccugcagggccuguugauucuaauaccuuaaugucaccggaauccauguauuucuguuuauccccacuaccaccaucacuguuauuccagccuggguuuuccuaucacaacaaccucuuagauugucucucacuuccucuuaugcauccauaaggacaugguuuaggggugucaaggccaaaggaaaacuuccccuuugcuuucugaagguuugcugaaaaucacugacaagaggcagauuaauaggauaaaaggcauacaaauuuauuugaucauaguuuuagaugauauggaaaccuucagaaugaagacccaaagauacaggggaaauuguccauuuuuaugcuuagauucaagaaaguauagacagccauguagaaacacaauuggaaaaaagggucugaucuaaugcgaauagacagaauggggaaacccagcaaggccuguguguccagacgcuucuugaccucucuaagcagcauuccuucuuucuggguaagacucucuggaauguggauuuuaaccuacagucaaacaguguagaucagauaaguacuuuauggccagaaucuuauggccagaauuucuuuaucuccaccuuucuguauaauuuuguaaaaaaucccucaaaaggaauucuggcuucuaaacucaucuucuaguuucuguggccagccucaggggagaaggggauugagagauacgcgggcaggagaaggucagagaaaaacuuuugcuucuaaggcugcugcuaaggccuuuauuuuaaaagggguguuguuugcugaugcccaccaggggcuaccucguccaacucccagccaggcugcuuuaggagucucuucuugggcucccccagccauuugcaggcaucuguucuccccagauggucacugguauguuuuauuuaccuaaagccuucacacguaaaauaccuuagugacuguugucguguaucuaagaccuacuguaaugcuuagcucauccugcaugccaaguaaaugauaguuauuaugugugaaagucugaugccuguauaaauuuggcgcauaaaaggaaaggacaaggacaaaagcaggccucagaugaaaccacaaaggaccaguaauuuaagacauuuaauccuggaacaagccucaggauuauuacucccuagggaggggcaaucugaguuauaugucauuucuguuauuucuguaauuaacauguuaagugcauauuuaagaaauuuuaaguagcuugaaucucuaagaugauuuagcuguagucagauaaucuguuuauuuuguaagaucucaacuaaagaacuaaauugugauauuuucuggaguaaaaauacuuaaauuuccuuagcuaugccuggccaccuggagaauauaaucacaugauugaaguccagguugggauucuagaagaaauggccuucacagaccuauuaaauaaagagcuucccaauuugaaggcaguguuccugccugccauccaucaccaugccccaccccaucuacugaggagaguaguaggaaguaguuaccaacuagcaccugaauauaauuuuaaguuacagaaucaacuaucaaaguauaaugaaagaagagacacgaggaguugauuauuuguggagaaaacagcauagauucaagccccuuauaaaaguuacauauucagaguugagaaaugcugcaguaaaaaggcuaccgaggccgggggcgguggcucacgccuguaaucccagcacuuugggaggcugaggcaggcgaaucacaggucaggagaucaccaacauggugaaaccuugucucuacuaaaauacaaaaaauuagccaggcguugugcuacgcaccuguagucccagcuacucaggaggcugaggcaggagaaucgcuugaacccgggaggcagagguugcagugagccgagaucgcgccacugcacuccagccuagcaacagaacaagacuccgucucaaaaaaaaaaaaaagaaaaagaaaaaaaaaggcucccaaguaauuguguggagcaccugcaucaaugggauggucuggagaggaggucauugugaguguuguaggcugaaagagaucagcacccuguggcacagggccaggugcuucuuucugagacuccuccuccccacuggaggucugaguuucccucagauagcugccuuauucagagcacuuggugaaguccuuaguuaagauagccauugcgguugcuaccccuucagcaguaagagaauggcuggggccugaucuggauauccugcuucugaaaaauuaccugaggcuacugggcuguggaagguugaacaagaaaaaggcuucuacugauagaguugcacuugacuccuucccuguuuuaccucugagcagcagcaacagcacgaugggcaguggcuggauaugaauuuauaauuuuuuaaagagagaucuccucguguugccuaggcuggacuugcacuccugggcucaagcaauccuccugucucagccuccugaguagcugagacuauaggugacugggacuugaauaugaauuuaaauaaucuuaaccguaaaggcauucaguuauauuuggccuaaaauaauacccugaacuaauaaaacauccauccagaaggaauuuuuauuguuucaguccauuauuuaaccgaugacuuaaaaaauauccauacauucaagauuuaaguaggggguaugauuuagaaauacaacagagaaugcaaaaaauggaauuuagauagagcuaauguguuuugaguucuccccacuuucaguauuagaccaaauuuacauaugguuuuccuuaucuucagugugaccuaacauuuaauaaacuaucaucagcaacuuuauuucucaacagcuaucuuccuaaagcuguauaccccucuuuuaaaaaugaaaagaacuucaggcaggauuaagcauaacauuuuuuccccucucauuugcaauacaaguagcuaauguuugucaaguguuuacuauguguaaguaaccaggcuaaacacuucacaugccacaacucauuuuauccucaagacaacccugagggguaaauacuagucccauuuuccaggugcagacacugagggggauaggaagguugaaugaucuaagcucccgugguuaggaagugguaggucugggauuugcauucaggucugucuuacuccagcagccagucuuauauuaguuaugcauucauuuggucagucauucaagagauuaaugauggaucgccuaacauggcccaggaacuauccuaggugguugggauucagccaugaacaaggugagaucucuacucuuauggaacuuacauacuuuaugcguaauuacuaauuaagugcuaaaggaaaguacagcagggcaagcuaacagaaugauggcucuucucuagggcugcuuaaauuagaauuucagggacaaccucucugagacagggauauugaacagagagcugaauaaugugagagagaaugcuaccuaaggccgagugcgcaguguaauauagugguuaaaagcauaaccugugagcuccgggguucacauuuugauuccacugcucacuagcugugugaucuuaugcaaaauaccuaacuucuccaugccucuucaucagugauaugaagguaacuguuguacuuuucuuaccuugcagaacugcugugagaauguaaugcguucauauaugaaaaggacuuagcuauagaauaggcacuggaaucuauugcacgcucuuaagugugagcuguauuauccauagaagcccugugggaauggugaaaaguagcuggcuccuggguagguuuugaaaauuuggcggacaggauuuacugagaaauuggauguaggagaauaaggaaaaggagucagggaugacgucaguaauuuuggucugguuaauuuggugaauuuuggggcauuuacugaagugggaaaggcaagguauagcaaaccucuuuugaagggaagacacaguggaggguagauaugcuaaaacugggaugcuucuugauguguuggucuucuguucauuguggaaaauuuggaaaacgucaaguauuaaaauauuaaagaucaccugacaucccacuacuccuuauccuuuugcuuacauuuuuuuaaccccauauaagucuuagaucauauaaaacauaacaauuuuuaaaauuauauacccuuuaguuuauuggaaaauggcuuauggcaagggggagaguuaaaguagagguaagaugauaaaagccccagcaccacgagaguccccuccacccgucagauggucguuauggacugaagccucagaagagcucucccuaaaggacagcagagcauguaguaggucucauuccugcucacccaucuagguguuagaaagcaccuacugccugguacagccuagccuacaacagcuaaaggauuauuuuuuuaaagcuacacuuuuuugugugugguggugcaauacacauaaucuaaaacuuaccauuuuaaccauuaaguguauaguucagcacuuaaaagcauuaaguacauucacauuguugugcaaccaucaccaccauccaucuccagaaucauuuucaucuugaaaaagguuguuacugaaacuaccaauuaaacaauaacuccccauucccccuucuccuggcaaccuccauucuacuuucugucucugugaauaugacuauucuaaguacuucauauauguggaauccuacauucuuuguccuuuugugacugguuuauguugcuuagccugauguccucaagauuaaucuauguuguaguauauguuugaauuuucuuccuuuuuaaagcugaauaauacuccauuauguuuuauuacccauuucaucagucaguggacacuugaauugcuauuguaaauguugcuaugaacauggauguccaaauauuuguuagagcuccuacuucuaauucuuuuggguauauauuauaauacauaacuuuuuuguuuguuuguuuuguuuuguuugacggagucucacucugucgcccaggcuggagugcaguggcacuaucgcagcucacugcaagcuccaccuccuggguucaagccauccuccugccucagccucccgaguagcugggacuacaggcgccugccaccacgcccggcuaauuuuuguauuuuuuuuuuaguagagacaggguuucaccguguuagccaguaauauauaacauuuuauaaucuacuuuuucacauagagauauauugcugaaauuuucugucaugaauauucuauaaauuauuuuaaauaauugcauuauauacagucauauagcuguacccuaauugauuuaagcaaucaaguauuuccuaguagaauuauaagaucaaaggguaugaauuauuuuuauuuuauuauuauuauuacuuuuuuuuuuuuuuuggacauggucugacucuguuucccaggcucaagugcaggggugcaaucucagcucacugcaaccuccaccucccagauucaagcuauucuccugccucaccuuccugaguagcucggauuacaggugccugccaccacaccuggcuaauuuuuguauuuuuucaguagagaugggguuucaccauuuuggucaggcugaucuugaccucaggugauccacccgccuuggccucccaaaguacugggauuacaggugugagccacugugcccagccgggugugaauaauuuuaaagcuuuugcuauacucaccaaauugcuacccaaaaagcuuauaccaccccacacugccaguguguuuauucccagcaucuuugcuaauauuagauauuaaugacuauuuucuguucauuuggauaauuaaaaguaguauaucaauucugauuuuccuuuuauccaaauuuaggauuuacuuucugaguuagaguuuauuuguagcugauuacugggggaaauacuaauuugguaaauacucaauuugugagaugauuagaggaaaugagacccuauggggucuuucccuuuuccagucaauuaguuuuucauuugaagguaauuggccaaccuuuugcucuguguguauaugacaagcagcuguacugagguuuuguguaaucuguuauugggugcugaauauauucguaguuauuacaggcucacaauuccuuagaauucaaacauccauaaagugcugaaaaaaauuuuuuugguaauuccuuugguuauaaaaccugacagagcugaacucauuugauguagauaucugaccucaaccaacacaagaccauuuacauuuuucauuauccucccccucaaaugaauauuuauauuaucuggcugcaaaauaugaauguguuuggguaaggcaugcuguuccagacuucacugggggugcauuaguaauagagacaauauauacauguaaaauuuuuuuuuuuuuaauucugaaaaauucugaauucugaaacacuagguuuuggcaucacagguuuuggauaaggucaugugaaccuauagcggcuuuuuuuuuccuuucauuuuuauguucucauuccuucuaggcagcaaaaacugguuuugaaaucaggccuacucugauagguuaagcaugaaguuaugacucaaauguacuuggagcugaaagacaauaggaauuuaaaaguggugucuucuuucauccccaggccaugugcaaucacuauaaucugggaacugacaggucagcgacuagaaccaaguuucagcuaagccacaaccaguugcaaacccaggauaauguugaacugagagccugagggucuuaggagaccugaaccaguuagacugugaagcaauaguaguaguguuccaagauguuauuggaacauauuucuacaauuaauacuguuugccauuuauagaauaucagcugucuaaaccaggcuuuuaaaauaccaaauuggcaaaauuaaauaauauuacucuucagcuaucuauuuuuaaugguaaaucuaaguuuuuaaaagucuguuuauuaaaugcuaaaaguugcagaaaugaaaaagcagauccacaauuucauaugagauggcaaguuguccaaauaccaaaacaauucugaaaaagaauaaagucagaggauucauggguucugauuucaaaacuuaaugacaaagcuacagugaucaaaauaguguggucuuggguacagauagauauauagacuaauggaauagaaucaagaguccagaaauaaacccacaugucaauggcccaacugguuuuugaaaagcgugccagauacacucaaugaggaaagaagagucucuucaacaaauggugcugcagcaacuggauuuccacaugcgaaaagagcaacguucaaucccaccucacaucacagacaaaaauuaacucaaaauggauuaacccacgugcaagagcuaaauucaugaagaaaacauaagggaauaacuguugggcaugguggugcaugccuguaaucccagcuacucaggagguugaggcaggaaaaucgcuugaauccaggaggcggagguugcggugagccaagaucgcgccauugcacuccagccugggcaacaagagugaaacuccgucucaaaaaaaaaaaaaaaaaaaaaaacacaaaggaaaaucuuuaugaccuggauuuggcaguagauucuuagauauaacaucaaaaacaugaacaaaaaaaaaauuaaaaauagauaacgggacuugagaaaauuaaaaauuuuugugcaucaagggauauuaaaaaagugaaggcagcuuacagaaugggagaaauauuuggaaaucauguaucugauaagucuuuaauauccagaauauauaaauaacuccugaacacagcaaaaagacagacucaguuggaaaauaggcaaaggacuugagcauuuuugauguuuuuccaaaagaauauguacagauaucuaauagcacaggagggaaugcucaacaucauucaccauuagggaagugaaaaucaaaaccacaauaccacuuuacaccuaccgggauggcuacuauuuuuuuuuuuaaucaaauaagagcacacaaaauaguaaguguuggugaguauguagagaaauuagaacccucauacauugcugaugggacuguaaaauggugcaggcauugugaaaacaauuuggcaauuccuuaaaaagcaaacauaauuaucguacgauccacaguuccaaauccuagauauacacccaaaagaauugaaaacagggacucagauacuuguauaacagugcucguugcagcauuauucacaauagccaaaagguggaaacaacacccguguccauccacagaugaaugggguaaauacagcguaguauaucuguacaacgaaguauuauucugucauagaaaggaacaaaguucugauauaugcuacaacuuggauauaacuugaaaacauuauacuaagugaaauaagccagaaacaaaaggacaaauauuguauaacucuauuuauaugaaauauauuaaauaggcaaauucauagagauagaaaaaagauuagagauaacuagggacuggggaaaaggggaaggggaaauggggaauucgugcuuaaugguuagaguuucuggggugaucagaaacauuuuggaaauaguggugauggcugugcaacauugugaauguaauuauugccacugaauuauauauuuuaaauggcuaaaguggcaaacuuuaugcuuauauauuacguuacugcaauaaauuuuuuuaagaugguaagagaacuaaugaauucacagugaaucugauagguuugcaguguacauugaguuuuucuauaaaagcauuagguaauccaguugugugugagaaucaguaaugugauaguuguuuccagcucuuccaaaggacgcauguuuaacuucuagauguauuuuuagagcugaacuguuggggcagaggaggcuuguaggaauaggggaagaguucauaagcagagcugaaacaacaccaaacauggaaauguuacaagguggagaaauugugcuuacugaaacucuucucagaaauauugcuguuuguggaugauagaaaucuucagaguugucacuuaagguagagguaggaggguaagaagcgucaaggacucaccgaauuguccauucccccuuuuguucugcuguggaauguuuugugcugcugguaagaacauguuccuauuuggugaguugcuggaacagugagcagugggcagagugccggggaggcuccuuuuuuauaaauauuguccaaauauuugaugaguauuuggucuugaagggacacuguauuauuagucugcuuugugugugugucacaguauggugcagugcaauaugguucuggaaauagaagcacucucuuauuaucuaagcaauuacauuuugaggaauugaagagcacuaguaacuguacuggagugacaaauuuauaauuaauuucaucauuuguuuauuuucucauuuauugagcaucuauaauaugcaagguauuguuucagguucuuggaauauagaguugaauaagacaauggcuugcccucuaggagcucauggacuaguggagaagaaaaacaaugaccacacaguuuucuugugauaagaaggaucaacaccuaucuuuuccccagauuuuaucuucuauagugguggguaguugucaaaaaguaaccaugugauaauuuugaauucuguucaaugugagcugcaaauuuugcuuauaaaaaucacucuuuaaaaaaaaaaaccuuuuuccuauaacuggauguccaacugaaaaaaauacuguauuauauuauauuuuauuuuuuugagacagucucgcucuguugccaggcuggagugcaguggcaugaucucagcucacugcaagcuccgccucccagguucacaccauucuccugcaucagccuccugaguagcugggacuacaggugccugccaccaugccuggcuaauguuuuuuuuuuuuuuuuuuuuuuuuuuuguauuuuuaguagagacaggguuucaccguguuagccaggauggucucgaucuccugaccucaugauccacccaucucggccucccaaagugcugggauuacaagcgugagccacugcgcccggccaaaauacuguauuuuaauagccaauaaugcaaugauuuuuuggcuccaccuauaauaauguggcagguuuuacuagacauccaaauuagugcuauaggagcaugaaguggaggcaaguaacuuaaccuggcacauaagcagugacauugaaagaaaaauuugaagaaagaguaacacaggggauaugggaaugugcauuccagguagguagaaaacacuuaagaugagguugaaaauaagaaggauauaauuuagugacuuaccaaaauauugauagugaaggaaagagaaaggucaagaauggcucccgcuuuuggauuggggaauugaacugaugauaauacauuauucaagaaggguagcacagcaaaggggaaccuuuugaggaaaagcauuuuuuaccagaaugcggagagaauauuuauuaauuuucuaaauugccaaauguauaguacuggacccuggccaugaguaaaaaauguucuuacccugacaaaguuuacaucuucaugaauaacuuucuuuuuccuucuuuguuuuagaagcaguggcugaagugguaauaauuguagaaauaucuuuguugagaagggggccaggugcagggagggagggaaagcuccugucuuaagauagaugggaaagacagagaacuguaaugaaaacuaucaauuugaauuuggaauuugcauucuagaaaugauuagaagagacugccacuuuuuuuguuaauguaaauaguaagucauugaguuuacuugccaguaacagacuggguaagagacugauccauccagauucagacauuuccugauugacauuucuuuucauuagaaacaaguaaccaacauugcccagaacguuguaguuauucgaaaaugauugcugaauuaauguuaucccuuucuaugcuuaaauuuauuuuaauauuuaaaaaggaaaugaaggacagggauugucaagauagaagucagaaggaaaaauuggugccuaaugaggcaaaggaugauaaaacguauuaaaaauugaagugaaaaauuaugauagccaauauuuauauaguacuuaagagucuucacgucaguuucauauauaugucagcuuauucuccacaguaaccuucugauguaggcauuauaaucugcauuuuauugaugaggaaacagacuaagcguuaagugaggugccugagccucagggcuaaaccauguagcgcucuuaugauucaaguccauuguccuguguagcaauacauagccaucaugcucuugaaagcuacgcuuuuggcuuuguauuuuauguuuuauuacuaacauucuuugcauuaauaaugacugaguggcucuauuuuaaaaucucguuguaauaucacaaggccuauacucugcaagccuacaaccucuugcuaauauaggaaguagaauuucucucaccucauuguucaccaaaauauggcaaauccuguuaaacugaggccagagaaagagauguuggaaccccuuagaacaauuaugacuaccagagaaugaugcaggagcagcggggcggggauagacucagcugaagugauguggggagugagacugggcaggcccagcaaucuggaaagcaugaagcgacgggaaauggugggcccuguauguggcugcuuuuacucucuuuuuuauuuguuuauuuuguuuuguuuuugagacagagucuuacucgguugcccaggcuggagugcagggguacaggggcccaauuucggcucacugcaaccucugcuuccugggucaagcaauucuccugccucagccuccagaguagcuagcguuacaggcauguaccacuauggcuggcuaauuuuuuaauuuuuaguagagacgggguuucaccacuuuagccaggguggucucgaacuccuuaccucaagugauccguccaccuggccucccaaagugcugugauuacaggcgcuuuuuaaauuuuuuuauuuuuauuuuuauuuuuauuuuugaaacagagucucugucacucaggaagcuggagugcaguggugcggucucagcucacugcaacuucagccuccugguucaagugauucuugugccucagccuccugaguagcugggacuacaggcaugcaccacuaugcccagcuaauuuuuguauuuuuaguagagaugggguuucacuacauugcccaggcuggucuugaacuccuggugucaggugauccaaccgugugguugcuuuuaaaauaaugacuggugagugcuggcauucaggucaaauauuagauguaugcugagauccaguuuucagaauggaaagaagaguuucagguacaagacagcguggcagaucucuagauaucgugcccaaucuggauaugugaacauguccucauucucaaggugauaugggccauuccuuugacauuucuuuaguugcguacguugacuagaucauagaauuccugagguuagauucuguacccuccuuaucuugauaucuguacuuacaucaucuagcucaaucccuggcacacgaaugucuuuaaccacuugccagaguauuguaucuguuuacccuguggagcuuucccauuaguucuaauugcgaaugcuauauaaauuucacuacauuguuuuuuucuuuuuuuucuuuuuuccaaauuguauuagucuguuauaucucuaucuggcuauauugaagcaguuauuugcugauuuuuaaaauuuauauacaauacuauucuaauuucuucuaaacuuauaucuaacaucaggaguucuuuggauuauucacagcagcucaggagacaaauuaauguauuuuaaaagaugugcaacuuuggaaucagguuuagauucccauugugucacuuugcuugguuaacuucaugcagccaauaaccuuaauuauucuucaucugugaaaacgagggacaaaaauaggauuaaauaagauaagacauuuagaaguaccaggcacaaaauaguagguacauuucugauuacgugacuucauaucauugagucuguuacaugaacuuaauuuguauuuauauagugcuuuauuuuuuuuuaacaacaugcuugugaauugucauuuauaucuuugcccaacuuugugagauaaccagggaaaguaacguuaucacuagcauuagauaaauaaacuugagaauaagcauugccaaggaucaugcagcuaagaaauuacagaaucagaacuugaacccagucaguccccucagucuauacccagugcccuuugugccaggccuugguauacuuuuacuugcucucucucuauauauucacuaucuuugauaauuuuaauggcaaccaaucccuguaacagaugagucauuggacccaaccaccugccaugcuagugcuaaguuggauaaauuguugaugccuaauucugauuaucuuuauuccuagggcacuaccuauuagguauuugggguuuuaaccaagaguuuccugagaucauuuuguguuuucucauagauaauagauugucugaguuauaaacuuguagacaauggcucuuuuuauuggccaguuuauauaagucucaaacaacuuugcuguauagauuuucucuuuauuuuacaauugggacaauggauguuaguuacuccauuucuaauugguagacaaguaaucaugugaacugcagcuuucuguagaggcuuccaguguugcauuauuaauaugacugggccucuagaaaauucuuuugggcuguugauuuuggacuaucaaauaagucagaagcaguaccaccaaggacuuuauugcuucaauuucacuauacuaauugcauugauaaaaauuuuuaaaguaugcucuuuuauuuuucacuguguuauauaauuaauucuauugaauuuaggaaagguagcuauuuaguggguuucuuuugaccgaaaucaucaauuauucaauguuuaccuauaguaauccaauugauaguauucuuacaguacuccauaaaucugucuaguguggcacuuagaaaugacacuaaaauuaacauuaauuaugucucugguuucuuucuucaagaaaacggaaccuugucugguucuucuuggcuucccuagggccuuaccacacagugugcaaaauauaaaguagauuuugauguuuguugaaccugauuuugaacugcacuuucauugugcauccaugcgaaaucccacugacguaucaagaccaagguuucugucaucauauuagaauaacuauuuuuuguuuucuagucagccguuugaugaacagauaacauagaggucucaaguacuguuguuccaagugcugaaauuaaaugaacuaaacaugaugccacugaagauaguacuuuugcuguauaaggcugaggcauagugacaggacuaaaaauacauuucaacauauuacguuaagaaaaacaugauuuauauaaggaaagaaaugaaauuaacauauuugccuuuuuagaauuuugucuugauucugcucauuuuaauacaaacccucagucaccuugauuuugacuauuuuauuuuugcugagaaaugaacuuuuucaguuguguuagauuaccauaaaugagaauaucaaacaguaacuagagccccucaguaguggggguagaauuauauuggccucauaaaucauuugcuucccagcacucuaucaggucaugagagcaagagcuguggcuuuguucuaccuagaugauguuucaauaaagccauuucuguuuuuauucacucagauuuacaguuuuuucuuuguauugacauuaaccagugaaucuauuaguuuccauuaccagcagacuaacuaaaacuauaaauaguucuaauuucuuucacaaauccauucaagcuacauagauaccguuuauuggauagaacaucuggguaaucuuguuuguccugucuuuaggcaaaaugcauacuuucuuaagcuugucuuuucauuuagaaaaaagaaaaaaaucaacuuuagcagcuccgucuguugaccuuagauaacagauaaauuggguaucuaaucaucuaggaaucuagauaagaugccaagucacuccaucggauuuauaauacugguguaaaaaaaaaaacaaaaaccccacaguauuauguuuccuuguuugcugguucugccaaaaaccaaaauaucauaaauaccauagauauaauuuuuuuaacaucugucuuaauacuauaaaaagauuaggucuuuucuuccaaauguaaagcaagcugcccagcacuaacuuagaacacacuuaucauagccucgcauauaagcacauuuuagcaaguuuuaaagauggucuguaggaguguaauuaucuuggacaacuguuguacuggaauaaccaguuuaguauguuacaacucucucaguguaacagacuguguggugauuacuauagcccuccaggaguucucagaggcaagcaccuuaauuuuggcaaugguugcagcucuucaagccuuugcucaucucaucuguuuucuguuucugcuuugguucacacauaggguguccucuaaugaacucaguuuuucagaagaguuagaaucacuugauuguacugucauuucuacuggcauuucuuuucaauucauaaguauacaaagaugugagguauuuuuuccucagauucugugugaaccuaaaauugaauccaggccggaagcggugacucacaucuguaaucccagcacuuugggaggccgaggcaggcagaucaugaggucaggaguucaagaccagccuggccaguauggugaaaacgcuucucuacuaaaaauacaaaaaaaacuagccagguguaguggcacgccuguagucccagcuacuugggaggcugaggcaggagaauugcuugaacccaggaggcagagguugcagugagcccagauugcgcuacugcacuccagccugggcagucaaggaagacuccaucucaaaaaaaagaaaaagaaaaagaaaaaaaauugaauccaaauauuaggagauuucuuagugaggugccaaaccuaaguauuugguaacugaauuggcuaaauuauuggcugauauuuugguuuuguaaacaaucacauagagaucucuuaugauucugcccuauaugaauguugaguuuucuucuuuugggucacugaauguuucuagaucaauaggaacccagccuucucuucuauaaaagcuuuuaauggauuaagggaaaacauaguaugcauuuuuaaaagucacuacaaagccgagauaaaucacacacaauaaaauuaaagcauuauuuauuucuuucuuuuugagacagaaucuugcucugucacccaggcuagagugcagcugcaugaucacagucacuguagccucaaccucccaggcucaagcaaucuuuccaccucaaccuccugaguagcugggaauacaggugcacaccaucacgcccggcuaauuaaaaaagguuuuuguaaagaugucuaaccauguuucccaggcuggucucaaacuccugggcuugugcacuccucccaccuuggccuccaaagugcuaggauuacaagugugaguuaucaugcccagccaaaaauaauuuuuuauaguuuuauacuuauuccauacucaaacucuccaguuuugaaaaauaaguccuuuauaacugguuuguccaaauuaggauccaguugaggacccuauauugcuagugguuauguccuuuagggcucuuuaaaucugaucucccuuuuuaaugucauugacuuguuaaagaggcuggaccuauugauaaaugagaauauuuauuuaaacuuacuuaaacauuaaaucuuuaagcuuacuuaaauauuuaagaauaucucuuuacauuuauucagaacauuuucuuacauagcaaaaauucuauucaaauuuuugcaaguuaaaaauaaaaaaguucuuugcaucucauuuguuuaaaccaggauccaauccagaaccacaugcugcaaaugauuguuuuguuaacuuggaacaauucguuuuauucaugucaguaacuuguugacaagaugaaacuauagcgucuuacagaaugaccuaccuucuugauuugguuucucuaucccucuaacauggcacuuguccaauaugguagccacuagucacaaauggcuauugagcuuuugaaauguggcuagucugaacugagaugcacugugaguauaaaauauacacuggauugcuaagacuuaacacaaaagagguaaaauauuucauaaauaguuuuuacacugauuacauguucaaaugauaauuaggguaguauggguuaaauaaauuauguuauuaaaauuaauuucaccuguuucuuuuuuuuuaaaaacgucucuacuaguaaauucuaucuggcucccauuauauuucuaucagauuuaaaauagccaggcaugguagcucauuccuguaaucucagcacguugggaggcugagacaggagaaucgcuugaggcuaggaguuugagacugauuagccugggcaauauagggauaccccugucucuacaaaagaaaaaaaaauguuuuuuaauguuuuuuaauuagucaggcaugguaauauacaccuguggucucagcuacuugggagacugaggugggaggaucacuugagcccaggaggucgaggcugcagugagcugugaucgugccacugcacuccagccugggugacagagugagaccuugucucaaaaaaaaaaaaaaaagaaaaagaagauugcuacccacaaagggacuucacagcaguacccuguaauagaaaacagaacaucaguaaaguguuucuuaguuagacuuuuguaacauuugcuugcuguguaccaguuaaaugauuuucagugguagaccuugccuagagaauuuuaagaccuaguguucuacaacccuggcaucgucugguagauccaauagaugaaacagcugcuacauauuuuuuaauauaucugauagcugaaaggguuaaauaauauaaaccugucaaugugcuaccaauguuaauaacccggugcugcugauuuaaaaguacagaacuacgugagccagugcagguucaugcuucauuuguuuauauauucauucguuuuuaguguuggaaaaccuuggacagacaauuguccccgauuugggaucacuggaaagucagcaugauuuucgaaccccggaguuugugaguacuauuccuuuaucuuaaauuuguauucuuaagcuaagagauuuuucacaaaaugagaaaaaaguucuuuuaugaauucauuccuucaauggcuguagauccuacauagaucuuauugcagggacugugcguucagagcucuggugucucuugggaauagguugcugaacuugauuguguaagcaucauggucuauagguuuguucuucauauuguucauguaauugcaaaugggaguucacuuuguaauaaaauagcaucuuguuucugaaacuccuguuccauucauugauaccauugcugucaguaucuguuguuaguaacucuggaaagcagucuuuaagcauauacagguauauugaccagugccagucacugguagcgaacauagucuacuuucccuuucauccuggagcuuucagugauacaaccuacauguaucuuguagggcuaggaauauucuguugguuguuucuaccagaagggaacuaaaugcucccauuaaauuggacucauuaaagauuagccaugguuccuacccuuaaggaauuaaaaaucuuauuagaagcuacuaugauuuuauuaaugccuuuuuuaaagaaaauuaagcacauaggaugccuugugcaaaauauccuuaguaaauagauuuuuacauuaggcucauuuggagggcggggaugggaacaaguguuucugugacucauguaccauauuauugcaccagauauguaggaaaaacaugccaggauccacuuacauuuccugauuuuugucccugcugcaaauggccuaccacuuuaggagugcagaaauguuuuuuuauuuauuuucaaugugauauacaaucaccacuccaguaauuggcagagcacaauuguauuauugguaaagaccaaaaaaaccucauuaugugcuuuuucuguucuugcucacucuuuauggauugccuagucaauucaaccaagaguaaagaaacuagagagugcucuggacugaaaagggauggcacauaaaacuguauccacaaugccauuuuauuucaaagugugggacuccugugguguacuagcagauugccuacugugaaaaucaccuggauauaauagaaagacguaguauucaaugacuucccuauuauauucaauaagauuucugguaaagggaaauugugcaugcccaccaauauuccugcaucuuaaaguagcagagcaauuuuguggguuuucuaacuuuugcaguuagagaccaaaagcagaauugacacagauauuucacauuugaguaugauacugguagacacucaugaagcugccucuuuuuuuuguuguuuuauuuuuggcuccuuuuguugauacuuuucaagcaacauaucuaaucuaaaaagaacugugugcaacaagguguuggugcgccugguaaaccuauacauaguucgcaccaauucccuaugugaaaauaaaaguauuuuccucaagaacagccuugaguguauugcgauguugcagacuggcaagucucggcaguuuguugccacagauaaggcagauacacugauaaucuuccuccaccuucagcauuaacuucuugaguaccacauuuuccuuuucaaaguggaagaagacagcuagucuaagcuagaaugcccagggguggaacuccgggcucacagaauacauuuaccuuauugaaagacuuguuuucacagugaaucugagaacacccaagcuggaaggagauucuugggcuaaauccccacuuuuuuauuuuucagucucacgcuuacagaauuauugagagucauauuguuagacugcauugauggcauugaaaacuguuaaucacaauaucccuguaugugugguugauaacagauuucuguauccuggcuauuaucuuucucuaguuauggguucauaacauguucgggagagaaucugggauuuucuugugcuucguagauuuucacacaucugaugcucauuaaggucacuucuuuguguaacauguaaauagcugcuguguuuucuccuuagcaucagcuuagccaguguacucccaguuccacaguaaacauaaacugcugucuccaugguaaacaaacagaagguguagaaguggugccuugagaacagggugcccagaggaaucaagcauuauauuuaagcucagcucuuuuuguaggcagaagcuuacagcgucagugaaaauggguggcucccauuguauaggcaggcaaaugccaggacaaaaucagguaaguugauucaagccacauuuuaaaaucagaaaugagugucacaguacaaaccugagagcagaaagaacccaaaggcaaagcaaaauugaagaaagaagacugaaaagaggaauaaaaggaggugaaaaaucaauauucuguuuuucuccaucuggcauuuuggaagguccaacugcaguuuguggaguugaaccgaaauaaagcaaagccuaguucauguuuacucgggccuuauccucaaauaguucagauuuuagaaggaucaagagccuaguguuuuuauacaaugggguguauuuauagaguuuggcuaacagggaaacuaaaaugcuuaucauuauuaguucauuuccuucagaauuucuguuuuucuuuccuuugaaacgagaccuaagagaacauugccaguugaauagucuuggccgcuggcaucauaagcacauucaaguuuuccuucacagcugaggugucucuaaugugacuaguuagguaaagccagcacugcuguauagugugcauauaucacagugaaauaaaugcugcugugaaccucccaaguggccuggagaccacagccuaccuugcucuuggcagcauccccaguggcuucuucucucacuugcugcggaguuuguccauugauuacaugucaccugcauaucuguguugcucuucuccagcuccugccccacuuugcagacugaggcagauaaguuuagcuaaacuaugcaaaaaugguaaguggugaauagagaugugaacauaaggugcauguguucuugcuaccccaaagcuuaggagcugggaauguguugaaacuagaaacugugacauagacacacuccaaaguaagauggguguguggguaagaguccaggugaaagggacccggcaaauacuggcauuagaaaguaacuugaugaucuugcugugguggaaaacugucccaauccugguucaguuuuuuguuuaagcacaaugaaaucuguuuuauaacucguuucauuaacauuuuaucuugaacguuuucccacacuguuuuguuuucuccaacauuguuauugucucugacauuauuuguugaauauauugauaagcauaacuaauccauuguuacuuugaaagcaguuaguucaaggaggauguagucaggaaaaugguggcauagccagauguucuggaacuaugugaauggugacuaucauuuggggacauggaugaaaauagauuaggugcaugaugacucuggggaagggaaucaguuaaagugaggcugggaacugaggaccagagacucagauaaccuuguagaguuccgucuuaaaaguagagacuucagaaauaggccaugugauugaaacugaggauggggaggcguccacauggugauggagcagauaaauguuguucugcaugugguugcaugcaggauaucccacacuucccuuaguuugcccaaucccaggucugguuaagagcaaaggagaucuaaggggcagucauggcgggcccauuagaccccagguugauuccaagccccaaggaguugaaaaaaaaauaacuggaggugcagggggagcaguaauggucaaggcuauuucuagaaacucugacucuguugacauugacccaggaacucagaugggccaguugccugaguacacaugagcugagggauggggugugggaaaggauucugaucuagcaguagugaaucugcuugcagcaagcuggaagauacugccauggauagaaaucaggcuguggucaacaugaaaacacaaggaaagagaaggccaaggaauuacguuuuaugaucugagacugacauuuuccagccuuucuagaacucgagguuauauauaacccuacugacuuuugagaagcuggaagauucuucuugccucugaucucaugccaaccgaggauguuuuucauugcuuagucucuacgaaauuuggaauaaauaauaagaaagaauuugggauggcaaaagaguauuagguuuauaauaggauaaaucagggaagaugaugagaaaccauaggauuuagaaaggcuaaauagaaaaauaggcucaggaagaugaagauuaaaggagaacaaauauaugucccauuaauuaagugucacagauacacagagaaggaagucugaagaguaauuaucccccugagauuuuguguaacugacucccuuuuugaaggaagauacuacuuuauagaaaaauauuuuugauucccugaaauucaauuuuugauuaucuucaaccauaugaaaacacaugugaucccaaggaagaguuaaaauauuaauuuacuaaaauauucauucgauaucuacuauuuuaggugaagaaacaggaaaaaaaaaaucccugcacuugugaagcuaacauuuugaugggggagacauaaaacacaaacgucagauaauccuguagagaaaaaguagggauuauuuguguguauguguuggggggguggugacaguuuuaaauaggguguuuagggaauaucucacugagaaguuccaagugaaaaaaccucaaggugcugcuggagcaaguucuuuggaaaucuggaggaagagcauucccagcagaaggaguagcauaaacagguuucgagguaggugaguuuguuagauacauuuaaggaaauggaagaccacuguggcuggaguagaaugaaagaucgagagaauaauagauaugaggacuucauaggccauuguaaagacuuugguuuuacucugaguugggaagucauuugagggugagccuuuggaggguaaacuggcagauuuugagcagaggagcaaccugaacugcccuguuuucauaggaucccuugggcuguccugagaauagauuauggaggagcagagcaggggcagagagaccuauuagacuuucucaggaauccaaaugagagauggugguggguugguccugaguguuaguuauggugauagagagacauacucaaauucugaauacauucugaggguagaagcaauagaauuuguugacagaucaaaugugagcugugcgagaaagagcagucaaggaaugacucuaaguuuuugacccagaagucuguggaaggagcaguuuggggagaggauaugcaggagaaaaaucaaaauucuguuuuggauauguaaaguuugagacauucagguggagaagucaguaugcagugggauaugugaaccuggaguaagaguuaaagaggggggcccaacccccgaugugagaguugucagcacacaggugauguuuaaagccaugggacgaaaugagagcagcaaggaaaggagugagauagaauagagaggagaugcuggacugagcccgggggcaccaguguuuacaggucacggagaugaggaaaaaucagcaggacaagcugagccaggaggagccagugaggugggaggaaagugaagagucuuggaagccaagugaagaaaguauaaaguaggaaggaaugaccacauucugaugauggagaauugaccauuguauuuaacaauagggaaaagaccaugacaggagggguuuggguugagugguagaauccaaaccuuauuagaaaggauucaaaacagaauggaagaagaggaacuggauacagagaauuuagguaacacuuccgugugugugucuguguguguguguguaauuuuuuuuuuuuuuuuuuuuuuuugccaagcaagaacacagagaaaagggguaguacccggaagggugauuaccgugaagagaguuuuaagauggcaggaauuacuguuugucagguagugggagcaguucaguagggagagaaaaucugaugaugcaagagugagagggaaggauuacuggaauaaugucccugagagggcaagaagggaaucccgucuauaaguggagggauuggccauagcuguagggacuguuccuucuuagaaguaagagggaagccagcauauugggacacagaugaaauuaguucaguagauuugauaggagauugcggaagcuuuuucuugauugguuuucauucaccagugaaauggaaagcaaggcauuagcuaagauugaagagggaaaugggauccgaagugaggagaaaggggugagacacucaucuggaagagugggaaagugaaugcacaggggaaauggaaugucauugcuggcagcaaugagagccuacucaaugguaguggucauggucaggguugggugguuguguguuuuucccauucaaauccagcuugaggggagcaaguguagaauaggcagaguuugauuuaaccaauuuggagagugagagaguaggcuaacuagagcaaccuggaaaaaguuuuaggauuucugggcuguggccagggccuguguggggcugaugauccugaauuuauaguccuaccacacugcccugcuguguggcuuucuccagcaucauucagacagcaagaaagcagauagcagcccucagccagaguuggggcuuuguagauggacauuauggagaguacaauauuggcaagaugucacugaaacagugugcucuggaauguggcccuaaagauggaaggaagggaagaaagaagaggguuggcagauugauuagaaaaagucgaggggccccuggggucuugugaaaugaguagguaauguaguuguggucagaaagagggauucuuaaauaaguucuuuuugaauauuucuuaaauaaaugcuucuugaauuuuucaggauggcaagggcuggggugggacuauggcauuagugcaugaaagggagaaggugauuggcaguaagaagugaggcuacugagaggccagaaugcauuggucaugucaugucucuggaugcauagguccuggucugaugaaggacacacauuggagaggaacaugugagcccagaaucagaauuucagugaaccaggagcagcagcugggaauuuggaaauuauagacuuuaggaagcuuugggguuguauucuauucacauggaccugaaaugaauuuucuuccaagaacauugaggaguaauggucuggaaguggcacuugggaaaagaacauuaaucuuacuuccuugcccugaggugugaaagguaugagagaaucagagccagcuacccacaggucuacaaauuuuuacuugcagguuuugucucaaaguggguucaaggaucuauuuucaccuuuuuuuuuuuucccugaguaguccagacuuuguuuugguuauuucugaagcaacugaauugguguuagggcuauugaaaaauauuuuggucuauuuuauggucaauccaagaccuuucuuggcuaaucccagaaacccaacuaaacucucaaggucugcccacagacuuccagaucuucaggaucagaaagucugagaauaaggcaguacccucuugguuaagcauuuuuucacuuggacuuacaaagaaauaugaugacuuugccuugugucuuuggccuuaagcuugccaaacuaaaaaagaaacucaaccaaaaaagaaaaccaaacaaaggaacauuaauuuggcaaaaggacucugaaaagggggaaaugagaucagagagaaacuggcuaguaagaauugcuaaauuggcccauuugcugugguaggaauucacauggcaucucaaggcugaaagcuuuuugugcauucaagaaccgaaggugauggaaugugcauuuuugucugaauauggaggaauauuuauuugcuguauguggcugagucaaaagcuaaauuuauggauuuguuaggauuggggaguaugagcaaaagugcagcaguuuaacaugugaagaugucauuuagaaauuuuuuggaauacagaauguuauuuucccagagaaacagucauaaauggugauuaaguugcugggcccagccagacaagaccugcuaaagccaauuuaacucagaaggcuaacaaaugaucauucuguacuaauaguccucuugaacacucuaaucuuauuuuuuccauucuuagccuaaaaaugugaguguaaaaugaaaguccugaguaagugagucaaggcuugugaaaaaaugcuuagcaugaucagagagauugauugauuuuugaguuaugugagaugaugaagaagcaguggucagcccacaguuuaaggaagucaguuuaacuguaugagaugaaugagaaaacagcuuacuagcuucuauauuacuuuugucuuuucuguuagugaaagugaacuuuagauugauaaugguuaaaggucuggugaagucuacagaagcucaugcugcccaagaauauuuuagaaaggaguauaauuguuccaaaugaguuaaccaggguauuaaaagagcuuguagauuugcuuugggaagugcagccggucaucucaaggugauacagggacugggacagcugccagaaucuaguggggcaaaugugacaguucucaaaaaggggugaaguuaggguagaaguugggcauaggcuaaauucccauaaauggagacacuggagcugaagcacuaaucuccauauuccagaaugagauguuuaagcagaugguuugugaauauuagaaaaaaggucauuaggagccaacaugaugaguucaauaaaauaagucaucccaaacugaauacauuacuuuuuuuucaauggagguuguuagauugacagaauaggagagggccacagacauuuuugguguuuugauuuuagcaagauguguggggaaaaaauguauuuaaauacaaaaugaagaaaugugugccuggugacagcaugcuuaucugggcaguuauucuuaaaacuguggaauaauggaugaaaaucaaucucuagaggagacaaaaaucaauaugaauuaaaguaaauuccugccccuaauucauaaauaucagcuguuuaaguaaauagccuaagagcagagaguaaugauggaucacaugaaauggcuggguauuugguuaacgaagcuccgugugaauugagcaugugauaacaaugucaaaagguuaaugaaaaucuaggucgcauuuguaccuguguccagaauaaaggaaauacuaggcuuuuccugcucaguauugguaaagcugccucucauucugagugcugacuuuaaaaggggagcauauugagagggaaugaucagcaugguagaagaucccgauauuuaggcaagaacaugacagcaagauuuaaauauuugucaagaguaauugguggauggcauugcaaaauguagcauuaagacccaugaauagaagguauauaugagcaacuagauuucauuucaguagaaagauuuugucauaauuaaaauaccucacaccuuggaggagaugaaauacagaugaaauggauaacaaucuagcauggagauaaugaaugcuugaaccaggccaugucagugggacaugacaauuggcaauuucuaauugauuaacuugguaacugauagaaaguggggaaugagggaaaagagguuucugugacaucucacccuauugaguuuuaugcaguucauugauguauuugcauugcuccauuuuauguuuuuuuccucauuuaacauauuauuagcagccaaaugauguaauugauuaaaacccuuucuccauauaacaguguucauucuaccugguuuuauuccacuauuuccagaaauccuuugcuguaaaaugucucaugaauucccaccccacaaaguaucacauuugaaauucagcaagcuauuuguuaucuggggaaugucaaaauuaauuugacaaaaacaugggugaggaaagcagggagcccuggacauucugaacaaagaugugauaucaguauuuaccauggaacucauuugauuauaagucaucuagaagcauaaucacaauaauggccaggaaagccacagaagcaaaauaauugaguuaaaguugagaguuugcuggcaaauaaccucaucguaucaugaccuaaaaagcagcauggauguaaaauguuguaauaaaaauuuaaagagaaagacagaacuuggugggcauguacacacaaugugaauucacaagauucccagaaaauugaaaaggagagaccagugggauuucagcuucugccaucccuccuguauuuugaacucuuaauuaauuuggaaggcugaagggcuuuggaaagaugauuugaaaucuuuuuauuucugaggucccauuaguuaacuguaguuuuccuuauuuuaacaaauaauaauaaaaaguacaucuuuacuauaagucucaaauguauuccucaaguaugucucuaguaagaaacuauaaauaugcuuuuacccagaaaacucuuaauggcuucuucaaaaggaaaaaguguuuacagcuccuucucccaagucacucuuugaaauguagaauaaugugaccugacagauuauaauaacuaccaaacagcaucuccauuaauuguaaugggcaaaccaauaauauggaucuuuaugauguuaacauguauuauaauauaucaagucaagaccauacuuguagcuggaauaaaauuugauugcaaauuuguguguuuuguaaaaugcaggauguguggaaaaauuguagauuuuuuccugacuuccuuaaaauaaaaacaaauaaugaaaauuuugacaggucauucagugaugcuaaugguaucacuaccaugucauguacuuucaucuaccuuaaguguuuuuaaaaagcaaauauaccaucugugagauaugaaggaagaagauuaaaaagaggugaauuagaugagguacuucugagacuuuggaaguguuuuuacuuauuuuuaauuuuccuuuuuuguaggugaaagcuauucugaagguugcccuaggaaguugaacauaagauggacuccagggaauuagaaacccuguuuuuccaugcaacccugcucucagaccucuguggacaagucgcuuuuccuuuuagaaccucaguuuccucauauguaaaaagcagaaagaucagcaguagauauccucacuggaguguuguucagugacugcacggugacugagaaacauuuuagcuaucuuaaaaugauguucauaauaauauagugaauagucuuaucuaacauuuauggaugcuugugguuggcuaagcacauuacagggaaagggcugccuaggauugaaauggccacagcccuacauuacucagcccugccauaccccguaucauucccuuucaaaugaaaucagaguguguugguaucaggaauuaguucuguucuucuuagaagagcaggcaagagcuuugaugacuugugugccugagaaaguacaguuacagacacuuaaguaccuaccaaauuaucaagagguugagaguuaaucauacccagcaauauuauaaaauaccaacagcacaaccuaucaauaaauaaauauguugagcacuuacacgugcuaauguaauuuucaaugaacuagaaauaggcuauuuaaguuauguacuauuuugaguaagcgacuauuagcuucacuaaauuuuggaguaaaauuuucauuaaauauuuauuaaucaguaugcuuagagaaauacaaagcagucuaucucaacuuuacccacagggccaagagugggcauacuguucaccucaggcuccugcaucaucuuauugucugacaguguuagucgugcaguugacgcugguugguugguugauugaaugaaagacuauaaggcaguguguacuguuuaaugaguucuguuaggcacuuaggaagugcuagaggaguucaguuaggguuguaguucucgcccuggcugugcaucagaauuaccuagagugugcuuuugaaauaugaaggcccaagcuccacuuucaugugcuuaucuuggucuuaguagaaccuaaguguguuuauauaacauuuaaaagaugaccauaauguacacccagguuuaagaaucauugccuuagaaaaaucagguuugggcuggaggccuauaauccuagcauuuugggaggccaagacaagagaauugcuugagcucaggaguucaaaaccagccugggcaacauaaugagaccuuaucucuacaaaaaaaaaauuauauauauauuauauauacacacacacacacacacauauauacauauauacacauauguguauauaucuaccaaauauauauauacacauauauguguacauauacauauauguguauaucuauauaaaaucagguuuguauuuuugaaggaaaugguauauagcucaaccuugaagacuacauuuugggagguacugaaaucugugccagaaucuauauauugauauaaucaggauuuuaccaggucuuuugacugacgucuggagaaugcccacacagaaauggagaguaaucuccuuuacuugaaagucaccugauuguggauguuaaccacaucuacaaaauaccuuuacagcaacaccuugauuaguauuugacugcauaauaaaugaguaccauagccuagccaagcugauaucuaacuaucacaguggauguauuacaggagggugcccaaauagcauuacaugaacauaucagugaagguggaaaugagugggugugcccaguuugcauugagccuagaguugaucuugggaagugggaggagaggauguuggaaagauaauguggaauguagaaauguuggacuaaagaguuugggcuuuugagcagaagagagaaagcaaugcuguagcagugcuguccaacagaacuuuuucucaugguggaaauguucugccucugugcuaacacgauagccacugaccacacauggguauggagacaacuugugaugcagcuauugaggccaaagaacugaauuuuuaauuaauucuuauucauguaauuucaauagccauguguggcucauggcuacugugugggaaagcaccacuguagagggaguauucuggugggaggaugcaugaggaacugggggagaagcaacgugcagacaguccaguuaggagaugaccauaauagucccaguggggacugggcagaagcagggaauauggaaaggagaguugggggugagggagaagcgaaucaaagauagucuuacauugaccauuucucuuucuggccacucccguuucacuuccugcccuaugucacccaagcacuuccuauccguuagauuccucagagcugagccccacucaucuuuucucacuuacucacucuccuccucacacucacuuccucagcuuccaugaugagcucuguguugacaacucccaaguuuauccuuuucuuaaaucuuuucucucagcccugcaugcugauacugccacauagaaaccucagggacuuagucuuuuccuccuaaucuuuuuucucuuccaguucucugaauguugauaaauguaaucaucauccucucagccgcucaagccagaaaccucaggaucuuugacacccuguugauaacugaggcucucucacccccguccaguuaaucaccagggucugcugauucuagguauaaauuauagcuucaaucugucccuuacuucucaucuccauugcuaaccuccucagguaggcuccaccuuucuucccuggacucauagucuucccauuaccacuuuugccacacacugagcuguucucuaaauaauuccuuuaaaaauaaaaaucagauuuauuuauuucuucugugagguguaauggaauuuucccgguaauuuaucugccacauuacagaaugucacaggauaaaggguuaauuaauuucaguuaauuuauuuaauaauauuuguccauuuaauguuuccauagcccuguugagcagguacuguugggaaauaucacuaaaaagauggcacagucuauaucccuuugaggcauauauuccaaugagaaagacagacauuaaucaaauaauuacacaaauaacucaacaauuaaaguugugagaagugacauuuaaggagaaguauaaggugugcugugagcauauaaggaguaaaccucagcuagcugcgggaccagggaauaucuccaugaagaggaaacggagcaaaggagauucuaggaagagggaacugcaugugcaaagauaggagggaaauacuuuucuucaauggaauacaauuuaaaauguuaauagaauauagaaacugacaacugcauuuagauggaauggagucuugaauuuucuggaaacgacuuagucuauugccaccuaauuaugaaacuugaauaaaaugguuauauuaaauacuuggacauguuaccucaagucaauucaauaaucuguuggcucacuuucuuagguguuauagauuaaaaguaaguauuuuuuccuucaguauuauauuccaauuaagaugauacuauauguacauaaaaauauaugacauauauauguauuauacuauuauaacauaugauguaaaauuaagagccaaaaugguauaaaaaagcaguucuaaauuuuuaauauucuuacacuucacacucuaaauagaaaaguaucgaccucagaguuuuuuuuuaauguggauauaucuguugauaucuacuauauuagaacuuaaaacacuuaaaacugagaaauuuaaaaaauauguauuaauucauguaaauauaacauacacauuaauauaaauauguagaaugucuucuaaaacaguaagaaggguaucauuuuuuauacauuuugcagaucucuuuaagaaaagacagcuggauucuuuuuauauguauauauauauauauauauuuauuauacuuuaaguuccaggguacaugugcacaaccugcagguuuguuacauauguauacaugugccauguuggugugcugcauccaguaacucguaauuuauauuagguguaucuccuaaugcuaucccuccccccuccccccaccccacaacaggcccccgugugugauguuccccuuccuguguccagguguucucauuguucaauucccaccuaugagugagaacaugaaguguuugguuuuuuguccuugcgauaguuugcugagaaugaugguuuccagcuucaaccaugucccugcaaaggacaugaacucaucauuuuuuauggcugcauaguauuccaugguguauaugugccacauuuucuuaauccagucuaucauuguuggacauuuggguugguuccaagucuuugcuauugugaauagugcugcaauaaacauacgugugcaugugucuuuguagcagcaugauuuauauuccuuuggguauauacccaguaaugggauggcugggucaaaugguauuucuaguucuagaucccugaggaaucgccacacugacuuccacaaugguugaacuaguuuacagucccaccaacuguguaaaaguguugcuauuucuccacauccacuccagcaccuguugcuuccugacuuuuuaaugaucgccauucuaacuggugugagaugauaccucacugugguuuugauuugcauuucucugauggccagugaugaugagcauuuuuuccugugucuguuggcugcauaaaugucuucuuuugagaagugucaguucauauccuuugcccacuuuuugaugggguuguuuguuuguuuucuuguaaauuuguuugaguucuuuguagauuuuggauauuagcccuuugucagaugaguagauugcaaaaauuuucucccauucuguagguugcuuguucacucugaugguaauuucuuuugcugugcagaagcucuuuaguugaauuagaucccauuugucaauuuuggcuuuugcugccauugcuuuugguguuuuagacaugaagucccugcccaugccuauguccugaaugguauugccuagguuuucuucuaggguuuuuaugguuuuaggucuaacauuuaagucuuuaauccaucuugaauuaauuuuuguauaaggcguaaggaagggauccaguuucagcucucuacauauggcuagccaauuuucccagcaccauuuauuaaauagggaauccuuuccccauugcuuguuuuucucagguuugucaaagaucaaauaguuguagaugugugguauuauuucuaagggcucuguucuguuccauuggucgauaucucuguuuugguaccaguaccaugccguuuugauuacuguagccuuguaguauaguuugaagucagguaaugugaugccuccagcuuuguucuuuuggcuuaggauugacuuggcaaugcgggcuuuuuuuugguuccauaugaacuuuaaaguaguuuuuuccaauucugugaagaaagucauugguagcuugauggggauggcauugaaucuauaaauuaccuugggcaguauggccauuuucaugauauugauucuuccuacccaugagcauggaauguucuuccauuuguuuguguccucuuuuauuucauugagcagugguuuguaguucuccuugaggagguccuucacaucccuuuuaaguuggauuccuagguauucucuuugaagcaauugugaaugggaguucacucaugauuuggcucucugucuguuauugguguauaagaaugcuugugauuuuuguacauugauuuuguauccugagacuuugcugaaguugcuuaucagcuuaaggagauuuugaacugagccgaugggguuuucuagauauacaaucaugucaucugcaaacagggacaauuugacuuccuguuuuccuaauugaauguccuuuauuucuuucuccugccugauugcccuggccagaacuuccaacacuaugucgaauaggaguggugagagagggcaucccugucuugugccagguuucaaagggaaugcuuccaguuuuugcccauucaguaugauauuggcuguggguuugucauaaauagcucuuaucauuuugagauacauuccaucaauaccuaguugauucagaguuuuuagcaugaagagcuguugaauuuugucgaaggccuuuucugcaucuauugagauaaucaugugguuuuugucuuugguucuguuuauaugcuggauuacguuuauugauuuguauauguugaaccagccuugcaucccagggaugaagccuacuugaucacaguggauaagcuuuuugaugugcugcuggauuugguuugccaguauuuuauugaggauuuucacaucgauguucaucagggauauuggucuaaaauucuuuuuuuguuguugugucucugccaggcuuugguaucaggaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaagcuauuaauuauugccuuaauuucagauccuguuauugaucuauugagcgauucaacuucuuccugguuuagucuugggagggugaauguguccaggaauuuauccauuucuucuagauuuucuaguuuauuggcguagaaguguuuguaguauucucugaugguaguuuguauuucugugggauugguggugauauccccuuuaucauuuuuuaucgugucuauuugauucuucucucuuuuauuccuuauuagucuugcuagcggucuaucaguuuuguugaucauuucaaaaaaccagcuccuggauucauugauuuuuuugaaggguuauuuguguuucuaucuccuucaguucuucucugaucuuaguuauuucuugccuucugcuagcuuuugaauguguuugcucuugcuucucuaguucuuuuaauugugauguuaggguaucaauuuuagaucuuuccugcuuucucuugugggcauuuagugcuaauaauuucccucuaugcacugcuuuaaaugugucccagagauucugguauguugugucuuuuuucucguugguuucaaagaacaucuuuauuucugccuucauuucguuauguacccaguagucauucaggagcagguuguucaguuuccauguaguugagcgguuuugagugaguuucuuaauccugaguucuaauuugauugcacuguggucugagagacaguuuguuauaauuucuguucuuuuacauuugcugaggagugcuuuacuuccaacuacguggucaguuuuggaauaggugcgguguggugcugagaagaauguauauucuguugauuugggguggagaguucuguagcuaucuauuagguccacuuggugcagagcugaauucaguuccuggauauccuuguuaauuucugucucguugaucugucuaauguugacagugggguguuaaagucucccauuauuauugugugggugucuaagucucuuuguaggucucuaaggacuugcuuuaugaaucugggugcuccuguauuggguggauauauauuuaggauaguuagaucuucucguugaauuaaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccaucccuuuauuuugagccuaugugugucucugcacgugagauggguuuccugaauacagcacacugaugggucuuaacucuuuauccaauuugccagucuggaaagacagcuggauucuuauaucugcuucugcacuuaaaaguugcaauauauuguuuugguugaaguaaaugaagaugauucagucuuacauagacagguagucaguaaaaggaagcguauuuuaaagccuuuucagauaauuguggauguucuucuuggauugcacaaugaaacucaacaagugguaguuuauaaagguuaguugcaauguggaauguugaaacuguauuaauaaauuuucgcuacuugccuugcguuuugaaaggaccuuuacccaagcaugauuuuugccaccaugcuuaggucaguuggaagguaucgauucacuaaguuaaguagauuuuacaaauguuuauucauuucauuauaugauaugaaaaaaaaucacauguguuaacauuaccuucagucucaacagaaaagucauugacaauuaagaagcugucaaauucacaguggugaauuuaauuguccuaaauucuaauauuugguugaaaacuuguauuuugucacuaacaggaaauguugucaguuguuuuccuugaaaugacagucgcguguuguucauuuucgagaaaguaucugcuaaauacucgucuguguaaccaaguuuugugucagucaucugucaaguaaaaaugguauucugugggaaaaaaaaggcaguuuuaaugcacaacucaaaaauccugcaaucccuuucccuugagacaaucaucauacuucugugugcaacagaaaugcugaauggguacuuccauuucuccccacagaauauuaaaaagauguguacucaaugcucaagauuuaguaaaguuaguacuuauuacugcgccaucaagaacauucuuaagggaagugacaacuuguuuuuuucacugugagcaugugguggugaagaaugccugguaguccagucuggugccaaugugggauugugcuaaggugcuggcaguuuuacccaccaugacuuuugcaccaucauugcagaugguaaugcaguuagaaaggcaaauaacaucuaguauuauuaugaaaaugguuuugaucuugcagguuccccagaggucuguggagcacacauccauuggcacagagggugauacgagaagagagaaagaaacaugaacccaaguugguaggaaggcuuggaaguucuuccaaggaagaacugagcuggaccuuaaaggagaguuaagauuuggauaggugguuaggagagcaggagaggauuucaggacagagaaaccaugggagcaaaggaguagagagaggaaggaccaugacauagucaaaagacuaaugagaaagauaguuggguuggaagguugggaauggggaguaaugguuuauaaaauguggccuauaaucagauuauaaggcauuugaaaaguuuggacuuccucuagagguugcugagaguaacuaaugguuuuugaccccuucugugacuugcugagcauauugguuuaggaacaucuuucugguggcaguguaaaagguaaguuggugaacaggagaacuggaugcaaggagaccaguggguuguuaauuguaaccucauuaguagcggucaagagcacagacuagaacgauggcaauagauggaacagauugaaagcuaaaguaacugccucagagguagaggcaauaugagaacuaaagaugaaaaagucaaaggucaccuauauuuuauauugcauaaccccaacugcuugccaaggacauugucuauuagggaaauguaaaaaaaauugggugcuuuuauauauggucccacauaugacuuuauccucccaaaaaaucagaaugcuuccuuuuuuccaauagcaggacuauaucauugaacguauuuuccuuuugcccugcugccaagaggcuuugugccaguuuucauguuaagaucacgacaacuacaauugucucaaugguuaguacauuuucuuccuccuaccuucucuggcucugguucuguuuauaauucuuuaaugguauuguauuuauucuucuugacaccagaugucuuacgucuucuuuugaaagaggcuaggagaaggggagaauacaauuuaaucgcucuuaacauauucuauucuuuuguggaauaaggcccuccucuuuaucacacuuuacucagaaucugaagaaagacuaaaagccucugauguccaaaaccaaagcacuacuccuuaauuugagagaauuucaacaaauucaguuaaucugguugcccaauucaaagcauguuagaagcagcagguaauaggguaacacaacaccuauuaaagacagcuaaaagaaguaaucccugauaaucugaguaacagcagagagaagaagcaagaugcagguggaaguuucugaugauuaugagcuaugugaauguacccaacacagguaguaaugaauaaagaacgguuaccuauuaagguagagaauaccauugugaaagcucacauuuauugagcuuuuacuauauuccagguuuugugccauugccuugcaugcaucaucucacuuaaucuucacaauuacccugccuuucuaugauuuucccuuuuuacaaaugagucaguuuaguuuuaaagagauacaauauacacacaaaggcacauggcuaguuguacauggcauaguuaagguuugaagcuaguagcucugccagauaccaaagucuguguucuuuauucucauuuuggacucuuuucauuuaccugcuaaauaauaauagcuuauguucaauauauccucuuuuaagagaguuuuguaagguuuuuuuuuuauuuacuaucuauagucagcugaaaacauuuuuucaucacuguuuuuuuuuguuguuguuguuguauuuuuuuuuuuuuuuuuuugagacagaauuuugcucuuggugcccaggcuggagugcaauggcacgaucuuggcucacugcaaccuccgccucccagguucaagcaauucuccugccucagccucccgaguagcugggauuacagacaugcaccaccacgccuggcuaauuuuguauuuuuaguagagacggaguuucuccauguugaggcuggucucgaacuccugaccucaggugauccgccaccucgaccucccaaagugcugggauuacaggcgugagucaccacgcuuggccugcaccacuguuuuaaaugagacauucauuuuuuaaaauuguguuuuggaaacaucugugcaucccuauuuccacaccacaaagaacagccauucuuguaaacugcuuuuugaguuaaaggaagaaaaguaauaucuauauaaaacaugaaucaacugguaggaaucgucacaauccuuugcuuugcugggcacuagguacucugauuuguuuuucuuccucuagcuuugaaugaaguugcaaacguugauuuccagagcagucgucugagauuauggcccagggguacaugugacauaagcgguugacuagggaauuacagauuaugacagcacucuugaguagcugaaaagcuaaaaauagcccagggcaguucuaagacuggaaauggaaaccuacuguaaaagaugaguucaccaaagaaauuguaccaggaaaaacccuuagaugacuuucaaacaugugucacuaugggagugacagauuguaacauuaagggaagcugcagaagaauuaucugagaaccuaguaaagaacccaagacuuccuacuuugguuaugcccccacuuacaccuuacuuaucuucuucaucucagcuuaagucuaaauagcuauagcuuaaaauuugagggacugcuaaccugacacaggugucuacuaacuugacacagucacaugugacacaggugacuuagaaaaggugggcaauucacagcuaucgauuuggugacugauuugguauuugugagucgugaccaguuuuguggucuaagaaccaaacauagguaagcuaaagauaguugaaguauauaauuaagaagaaucagaggaugagcagaggggaacauacaguuacgaagucaagcuacauuuguuguuccauaaaacuaaggaucuuaaaguuuguggauagaauauugugaaaguucacuaaaucauaaagaaucugguuguagcaauauuauuuugguuccaacugauuccagaauauaagauuggagcuauuucuuuaaaaguuuagaaauguaauuuaggacaacucucuugucuaaguggaaaaccuacagaucauuauuccucaggagacgguacaaacuggaaaugcucacagggucaaaaaagcuugaaguaagcauggcuggauauuaaguccauaguggauauuaaagcaagaugccuugaggauauuugaaccuuaagaguuuagccucuaggaggauaaucauucacucucacaaauguccuuuuuuaccaccugucuuguuuuauuauaucuaucuuuuguaaugcuuuauugggaauaucuuaaaguuugaucucuccuacauuucuuuuaccaacauuaccacuuccagaugagaacagugcaaauggaugaugaugucuucuagaaaaggagaguauaaaaacaaccacuauaggcauuuucacauuuuuuucuuuucauuuauugacuauuuauuguucugcuuuucugcagaucaccucuaaggaaggcuaaauugagauuuuuaaaaugaucaaaagucugugggaaaacaggaaagccaaauauauauauauuuagucaugcuaaugaaaauuacaauuauaacucuguggguuuacgaaaaagauucaguaagaguccucuaccccauaagaaggcuccuaacucagcaucuuccacccuuguuaauuaaugacauuuaaggaaguuuuauuuuaaaugucauuucaaaguucuguuuucauauuuccucuacccuuuuucagaaauuuaaagaauacugaaaauccuaugagaacuccauuugauaaaaguacugcuuccuuggcaugaacuagagggaaauauuuaauacucauuaugcucaaggcauugcgccuucauccuuaccagggucuaaaaugugguauucuaaugauagaacucuagaguuuaacacaggcaaauggaaacagagguaaaaucaggaagccauugauaugugaacauucccuugcauacaaggcauuucauggcacaaucuaaugguauuuauaagugaacuacaucuauccuugaugagaaaugacugaaaauaacaaguucaggacuaguuauagccauuuacuuauauaaaacacaagacuguuuuuuaagaauuucuacauauuuuaacuugcaacagaaauuauuuguguaccaauaauaaguaguauguuuugaaucuaaagaaauaugugagucaaaauacacaauugauaaccugguaguuaugcaggcggcauguaaauuauaauggaaagucggucaacaggcuggugcccuucuaaaauuagcaugccacauuccaguugaguguccacauuacagaaaacaugcucaccuugcuaaacccagggcugcuugacggugcccugaaauauuucucccuuuuccuuuugggacuaauuuaguaaaaaugaacucuuucaaggucacuguauacaucauuuccuauuuuguuuuucaugaccacaaccccagauugugcugggacaccauccacucccagcagcugcugccccuucugaagcugucuuauucagccaccuguucaaauggauaccaggguucacaguggcuguaaaucacaccauuucuggguuuggauugcuuggugcaagcaccauccagggaugcauaggaaccucucauaaccagucucuccauaacucagguugagugcuuaccuuugaagagauauuuggugcccucccccacuuagcagucuucucuuagcagacagaagucccauacugaaccacauggaaucauauaggccuagucuguauugcccuuuaccccacuuacucaguuaccugugugguuuucaggauuucaucaguaagaagacccaagacaaucuacugaaaaguguuuaaauaauaagauuguucaaauaagugaaagauaguaauaagcacuccacaaaaaaaaagaguauuucauuugggcaguauccauagcaaaguuagagcucucuaguuaaaagguguacaugaaaaaaacaaaauacauauuuugacuaucauauugggaaaaguagaaaacacugaagucaaaugaggguggagcaaagcacucauacccucugguggauacguugauuuuauaaauauuuuggaugacaguuuagcaaccaguguaucaaaagcuuuuaaaaaggcugugccacuuaaaaucugcuucuggaauuuaguaauugaacaugugcacagauacauauguacaaagaugcucauugcagcaguguuuauaaaggcagaaaauuggagacuacuucugugcucaucaguggaggaacuguuuuacuaaauuauauugcagcuauuacacauguuguaaagcuuucuauaaagcuagcaagugucuauaauagauguuuauaaaacaguauguauaauaugguaucauuuugguuaguguguuugugugcucuugcaugcauguauguccaucuaagccugaaaggauguacuccaaaauuuuaagaaacuuagcucaugucuaggagaugggauuacauaugacuuuuauuuuuucuguauacauuuuuggaucuucagaauuuuuuuguguugaguauauauuuuaucagaaaaaaaaauuuuauucuaagaaaaaaauaaaccugagcccuugaguucucagcagagaacucacggugaacaagccagaccuggccacuaaucuucagaagcugauagugugguuuaacagggcaggaagcagacagugugacuuguacaaaaaucauucugggccauuccugaguacaccuugaucaucauagagucacaaccaagggauguucuuggaacauccugacacauuugacucuaaaacagacuuggaguccaagcuucaggaugcauuuucauccuugaaugggcuccuuuuccacugugcuucuuugcugucugcacauuccugaaugccuggucaggucaaaaacaagcucauuuacucccuacagcacacaccauuuacugagcugacuuccuguguggcuccccuguguguccagaguuacuauguuacuuccuuuccuccccaccccagcuuccacaauacuugucuuuccaccuucggaagucagccuuccauaccugcaguucuuggcacuuuuuuggcucaauuauuacuguuuuucuugaacuuuguaguuugcauuuugauaaaaaugaaaaaaauuugaucuagugucuucuaucucugcaauauuuuugcaccguuuuguuggaaaaaacguucuacuuauuacucaugccuugacucugaugccugagcucugcaacaguuaggaaaaacacuuaggaauaugugucauucauaacugcauagcauguaaauaaaauuuuauuauguuucauauuuugagaaaucuaaauauuuacguaaaggcuuuugcuucuaaucuuuuguuucccuagaacuugcuauguaccuggauucacaauuuacugaaaaauagaagauuccauauuuuuacuuuaguaguugucuauuauuacaguuuuuuucccuuuguguucuucuuggaauuaacuacuuuuucuugucuuaaaaauuguagagagccccauguuuuuuccauauuugcacaucaguuacaauucaaauuaugugaauguuuugauacuuacuuuucguaguguaauucuucaacuuuauuguuagacaguaaaccuuucuugcauccugcuaggcguaaagguugagagaccauuaacccaaaugagccuggaauacucuccaaucucaguaaaugacaaccgugucaggggaggaauaggcuauuugggaauucccauacaguaagucaaucucacuugcuguccaaggcaacuuucaaacacccuuacacaugaacaagaauuugagcaaagauccuaaucugacugcuuuuauucagaucuuggacaaauaauuuaacuucagcauuuuaacuaucuguuuuuauuuaggccaguuccguuauuuguuacauauucuuuccaggcuagugauauuaguuucucccuuuuuccccauuaugugguagaaugucuucugccaagagauaggaaaccuggauuucacagcaguagagacuggcacucuuuucucuaguauugcauucuaauaguaccauauuggaguuugaccuacuuauuacacacaggcaaauguugccaagucagugagguuuuccuccaaauaaagggccauggucuugcaucacacaugggagguuugcaugcagaccagauuaucugggagcuaacugccaaccugugccacugugcaagggaagagugccuggagccauguacagaugugguucucauuccaggccuaauucuucagaacuuaacuuccgugagcuccugcuggacuccaccaaaggcaacagaaugugggcuacagagaacaaguugcuuuuuguacauuuuucagauguuugcaaugaugaccagguuuuccugacuauauuccacuggaccccacuuccccuuuguucuucugagaaauuauauauauauauuuuucuccaugcacaauuuuccucuagcaauagcccugguugucacccauaguauaguccucauugaaaguaagagaaauugaauggaccuaaaggacucuguggcugaaaugaaaaagacauggcucagcauuuucauauaguuuuaaauacucuuaaaguuuauugauuugaaauaacugaaauugcaaauauaagaauuggauagugauaucagccuaagacauggaugugucuuuguuuuccuagcccuuuauugcccuggauaggaaaggucucauggcagucacgcuguuugugcuuagaauuccugguuaaaugcacuggaugaaggugcauugagauggguuacaucagcagcauucauucugcuggugaaaaaaccugccaauuaggaacuucagauacugguaauaaaccuucauguguuccacaguggaaaaggggaaaggaaugauaaauaucacguuucauauaaguaucaaaaaauauguuuucaaaagugagaagaaaaggagaaaguggugugugguaaaauuguguagcuucugugcuaaucgauaaugaagaggagaauuaaucacauuuaaugaacacaauguacaaguuauacaaaugauugcaaaaugaaaucuuaucaguuuuuaaugaaucauagaaaacuuuucaguaucacguaguuaaaaagcagucgauucuuaacaaaauuaacaugagcauucugacaagcugugugagaacacaaauucaaaucauuccucagaguaaauuagaacaauucuauccaacuccauauguucacagguauuuuuguauuuggucucuguucugccaucauuuccuuuuaaaccauaaggauuuuaagcucuaaacuaaaggcuucuauauuuuguuguugcugguucuuuugguuuuuuaaaauuuguuugcuaggaaugagggacaucauuuguagauuaggggacgaacaccaaugacuagugcagcuuuuguuuauaugggaguaucuuuuggcauuuguuugaaguugucccaugauaccuucuauaaagcggugaaguaaguccaaaaagaagucaugaaaaaugguaaaagguuagaaaauaagacauaagaaggaugagauuuucaucaacagugcuuugucuuagauuuuucuucuuguuaaauaaacuucacucccuuggauaggcaguuuuuuuuacuauguucguuuucaaucuugauaugccuuugcugcuugaggugaaaauaauucugggaugauuguguuacauauguaauauugacauguucucaugaguuuauagaauaaugcuguacuguucaauucaaauacuuccuuucaccaagaauagaccauguuugccaugucagucauaguggccaugacuguuugguaagcuaacuaguaguggauguauuucucuuucacaauaaaccuauuaaagcuugaaaauuaacacuuauaagucagcauuuuuucaaaaaauuauauauuacaauuuguuuuucuguuuuacacaggaagaauuuaauggaaaaccugacucccucuuuuuuaaugauggccagcgaagaauugacuuuguucuaguauaugaggaugaaagcagaaaagagaccaauaaaaaggguacaaaugaaaaacaaaggguaaguuuuuaugcuauuuuccuuucuuuuuauuucuuauauuguaacaugaaaaaacugcuauuuuguauaaguaauaaagugaaacugauguugaaauaucauacacaaaacaguuucauauuuucucugcucauguuuucucaaagcauauuaacaaaacguuuuuuaaauaugaaucagaaacuuccucaggcucuuaaccucauuugguuucacagcugaaagcagacuuucuuucaaggaauuggacuuucuauuguacagaagagauuuaccuuaagcaugccuggcuauucaauuagguggcauaggaagcuaaugauuaauaaugacaaguguaauaacaacuagcuuucaaugugugcucacucagguauuguacauacauuugcauacguguucuccuuucauacagcaugaaguggguucuauaaucacaccauuuuauggaugauagagaugacccuuagguuagaugaauauacaaggucauggaaucuagucuagcaaguggugaagccaugguucaaacugucuugaauauggagacugcucuugaccucgcauuuuucucuguuaccucccuuucauucauugcauugccagucaagcugcucucuucucccuuuccuuugcaccaagcuuuuuuaaguaaaaggccaucuuuaucucaggauauuaaaacaguagggcagguuuauaaacaacucccuggaacguuuuuaccuguaccuaaacugcauuaaacuaaaacagaccaaaaaagauugcauauauguguuacuuucacccacuuuagaaaucauuccucauccuuuuuuucuuccccuuuucacauauaugugugcucucucccucucucucuguucucucucucucucucucacacacacacacacacacacaaaacuuuaauugucccugucuagacugucuccuugaaauaugccaacuuuaaaucuauugauuuuugcccauucuuucaaaucaagcgauaaaaccuuuuaaaaaaugaaguaaucaguacuguuuuauucaucuguuuguuucagaggggguuaaguuuggcauuuuauauuugcaugguggaauagaaugagcccagacuuuggaaacugaccuucaaguucuaauucugccacucuguuggaguaauucuaguuguaacaaacaagcucccagaugacagggacuuaacacaaaaacagaguguuuauuguucacgucaaggucaaauguagcaucccuguuuggcacauaguuugggguugggccucuguccuuugcaguuaucaagaaacccaagccugacagaagcucugccauauucgccagguagacucccgggucaucccgaauaucaacauagauaaaugguagauaagaugaagaaaguacucaugcugcuuuaccacuuuggccucaaaguaacuacaucaguugugcucauaugcuacuggucagaacucagaagaguggaaaguaucguuucuggcuggguagcuaugugacuuaggcaaauuuucaaaucaauuuuuuuuuucuuuuuuauguuugacaucucuaaaaucaguuggaucuuacaaaugcuguaucauaauuucauuguugaauuuuuucuuauuaauacauaaaauauuggcucaccauacaaucaauggcaucuuagauucagggaaauuggauccuaauacuuagccuauauaauuaugguuaagauuaaauaaaauaacauauagauguuacauaauuuuuuagcauuauuagaucauaaauuuuaauucuuguaucuucccauuugggauuuucuuaaaauaaugcccugauaugaaaaggcaugacuuuccuguuauuauacaauuuuaucacuaaaguaaaacagcuuaggguacuuuaauuuuccuguggacacuaagauauuuuaugcagucauagucaccaucaucaaauauucauuaaguauccauaugccaauggaucuggauugagcaauauauaaaguaaguuaaacagaucuaauacauuaaaguauaaaagaaacaguucugguuuuaaacaagagcuuuacugccaugaugaagggcccuagagcugcuuacauuaaucaguucugcauuugcuucagacagaaacauaggucccaagguaacucucauaaauaaggaggaaaaaaaucaucauuaauuuuggcaauccuugaacucauggauugauauaccuugauguucauuuuuauaagcugugcuuugaaguguuuucagacuguauuugcacauauuacuuaauuuauauauacuucaccgaaauucaaagcuuaacuuuggaaucauguuuuucuucauuggaaaaacauuugugaguuccauuguacuccuugucaggccuuauugaggauuuaggacaauaccaaggaaaggcaauucaaaauccuguuuucuuugaaagaaaaaaaacuuauguguaaaccauauugauuuccuaaagcaaccccaagcuugacuucaccagaguuuaucuaaaggauauuguuaaacacuuuauagggcuggagaaagauagaagugacagggcuacaaacaccaaaaacauagaguauuuaaaaggauguaucauccuuugagcaaaaagaaaauaauuuucuagccaaaccuccaaauaucauguaacuugggccacucauaugaccaaaaacacuuaagaaacauaccuuccuuuaaaaagcauaaaccauuuacauuuagauuuuacaugaggaugauuguaaguugcuucagcaacaaacgcucguuuagucuguacugggcuuggcacagaauguuugaauguuuuaaaucacaaauaacaggaaaaccaaacucaaaauggcuuaaaugcuaaaaggaaauaauuauuuucucauuuaaguagucuagagauacagccauuucuggauuaguuuauuggcucaaugaagucauuccauccuccugcucugccauccucaauauuuuggcucuuaaauugucuucccuugauuuuaagauggcugcugcaacuccagguagccagaggcagagagaaggaaugccccuucucagggcuguuuuuuaagagggaagaaagcuccucuggaagggcccuuugcagauuuccuuucacaauucauugucuguuacaagucucuuccuaaaucaacuacuggaaauaugaauggaauuauugcauaggauuggucuuucaucucuugagucaccugaucacagaauaccuaaagaacaagcaggcuuuucuuaguaauaaagaggggagaauggcuguuccguaggcagccagcaguaucuggcacaguagaugauuaaauauaucuaaauauguuugauccauauuguaaagagcaaagauguuuuacauaaaacaaauucccauauauuucuccaacuccucuugcucaguuuuguuaguaauugcugcuuucuuccagaacugcuaacaaucggcagaacugaucuuuugaauuuuguuuugucugaugcuugccuucaaaccgauguguuagugaccaaguaaugguacaauucagaugagggugaagauggggaagaggucuagguaguacaaaaacagugggaacaacccugaauaugauuuauuuauuuacuuuaaaaaaauuauccauuccuaaaaguuaauggaaaauuuauguccuugaaguugaaaaguuuauauauggaaguauauauuuguauuucauaucugaccuuaagaauucuuuaguguauggcaaaaggaucuggccaguggagacuguaggauagagaauuuuuuuaaaauuagugaucaaaguuaaauuuaucuaauuauaauuuaauucaaacuuucaaauaccgugagacaacuaacugguuauagagccugugagcuucuaaaaacuguuauccauuguuuuggauuaaucaucaugagaccagaacaguuuuccuagagucuggaugagaucucuugggaaauguuuaaaaacuuaccaaaaaguuuuacuaugaugaacaugauauaucacuccuuuuauugagaucuacuauccuuuaaguaaagcuuuauaauacagguuaagcaucccaaauccaaaaugcaccaaaacgcaaaauuuuuugagugcugacuugacguucaaaagaaaugcuuaguggaucauuuuggauuuucagaugugggaugcucagcugguaaguauaauguaaauauuccaauuucuuaaaaaguccaaaauuagaaauacuucuaguuccaagcauuuuggauaagagauauucaaccuguaguguccaugcagaucuuguacauuuuuauuaacuuuuuccaauuacugaaaauuuuuguugcuauugucagaggcauuuuaaaugcaguuaugauuuacuguguguaaaagaagucuauugauuucugugagugcuaagaaccuugauaagcucuuuuuaguuuuaguaguuucuaauacuauuaauuuucccaaaugaagaccauauugucuacaaaugaugacaauuuuguucuuucuuugccauauuuauacuuucuuuuucuugucugagugcaauggcuaugaccucuugaacaaaaccaauacacauaguagucacuauuguauuguuccugauuuuaaugggaauguuucuaaaauuucacuauuaaauauuacacuugccauacauuuuugauagauuucuuuuaaaaaguuaaaggaguucccuuuuaguccuagauugcuaagcauuuuuauaauaacuggguuuuaaagcuuaucaaaugcuuuuucuuauaucuauugaggugaucauauggcuugguuccucauuaagucuuaugcauauuaaguauuugguuauuuuugccuaauaagauaguauuauaacugauaguauaguauaacucaaagcauucauuuauuagcuuuaauauacaauguguacuuuuuauaguuauuagcacccuacuuauuuauguuaauacuacauuaaauuauuuauguauggucauaaguugcuuaaugauguuucagucaacaauguaccacauauaccaugaugccucuuaagauuguaacacagcugaaaaauuccuguugccuagugacaucauagcugucuuaacaugguagugcaaugcauuacucacaugucuguggucaugcugguauaaacaaaccuauuaggcugggcugcuagucauauaaaaauauagcacauacaaucauguauaguaccgaacgcuuguuaaugguaauaaaugacuauguuacugguuuauguguuuacuauacuauaauauauuuuaaaaguauacuuuuuaucauuauuuuagaguauauuccuacuuauaaaaaauaaauaaaaaaaggaaguuaacuguaaaacagccucaggcagguacuucaggagguauuccaaaagaaggcacuguuaucacaggagaugacagcucuauuucuguuccugccccugaagaccuuccagugagacaagauguggagguggaagacagugauacugaugauccugacccuguguaggccuagcuaauguguguauuugugucuuaguuuucaacaaaaaaguuuaaaaaguuaaaaauuaaagauagaaaaauauuugcaauagaauaaggauauaaagaaagaaguuuuguacagcuguagaguguguuuguguuuuaagcuaagugagcaguguuauaaagucugcaguagugcacauaaugucuuaagccuucagguucagucaccacucacuugcugacucacccacagcaacuuccaugccugcaagcuccauucaugauaacugcccuaaacugguauaccaucuguaaaauguuuauacaguauuuuuacuguagcuuuucuauauuaagauacacaaauacuuaccaugguguuacagcugccugugguguucagcucagucucaugcagugcaggauuguagccugagagcggcaggccauuccauauacccuagguguaugguaggcuacaccuucuagguuuguguauguucauauguacacucuaugguguucacacaaagaugaaaucacauucucagaacguaucccuguuguuaagcaaugcaugaaugaauuuauaauuuauuaaauaguauucgaugcuuacauauugaguguaaaaaaaguugaauucauagaaguagauaauagaauagugauuagcaggggcuggaggugagaggauguuggggagauguuggucaaaggauacaaaauuuuaguuagauaagagggauaagauuaggagaacuauuguacagcugacucuauuugauaauauauucuugaaaacugcuaaggaguagauuuuaaguguuuuuaccacaaaaguuugugacguguaaaugcauauguuaaucagcuugauuuuggcuuccauuauauaugcauauuuuaaaacauguuauacauaacauuuuuauuuaucaauuaaaauaaauauaaauguuaggagggaaguggaaaaaaaguauuuaaggucaccuauggaaauauaucaagaaugaaaguaauuaaagacuaaaucaggguaaaagaaauauaaaagccagaaaaauaaaaugaagccaugugucagaguaauaaaaugauuuauuaucaaccauaaguucuuguucagaaguuagagaucagcugcaaauuugccucucaacuucuuaguugccaaagaauauaagaggauuuuauuaauaacauaauuuaaaguuucaucacaauaaaaacaaaacugguuguuccaaagcaacacaguguucugguaggaaagauccuccugagaaaaauuugucucaugaauccucauaaagaggaaggcaugauugcauagacuaaaaauuggcuuaccuucuucaaauugaagaaauaaagggacagcagaaggugaggggcacuaugaggaaucagaacagcguggaaaguuugccugggaaugacauuugcaacagguaguucaugaauuggaaacuugagccucauguuaagauaggcucaguaagagauauggcagccaguguugggugguuuuacuucccagcuaacuuuuggcagguguucugucuuuuguuuuagggagugaagucagaucuaucuuuagcuccuaaauauuuuagacuaaagcagggaggucuuuauauuuuuaucuuuucccuugcuuuacagucuacuuguuuaugcuaagauuguagguaaaaaggaauaaauuaaauuagaaucagcaguuucaaauuacagcuaugaaaugcguugcugguauaagcacauuugguuuuauuuuugaguauuaccaccaagagcaaugaauccaauucuugcuucuuauuuccaaaaugggaaguaucucugggcugaagccuuaaaaacagagaggacaaugaaauucugaaaagcaagaccugauuauucuauuuuauccuacugggggaauuaacaacgaguucacaaagacauggagaagagaaaacccuuuuucugauugcuccuccugaggucuggcuguagguugaaugaagaggcugucauuuaccugguaccagcagggcaaaugugucaccuuuuuaaaagaucaucuguaaagggguacagcaggauuggcaaaaaucagcuauaccaaauucucucauaaaacaggcuugacagggauaaaucaucacaaaagaauagcugcuugugugcacuuguacaugcauauaugcacagaaaaagguguguccuagaaaauaggauuuacuaaacuuguccuaugagaagucaccuggguugcuuguuaaaaauagauuguccaggccccaucccauacaugcugagucaguacuuccaggggagagguucaagaaucuacauuuuaaauaagcucuccaaaguuguuccuuuaagcagauaaguuuggaaaacacuuuacugaaaaacuuuauuguacacuuaauuaauagaauaguuaucuuggcagugaauuauggguguuuauuuuuucuucuuugaaaauuuguuuucuguguuacucagaaugagcauuuauuucuuuugugauuugauuuaaaagucguauuuggaagugaacuucagcuaaauauucacuccauccuauguuuaucauuuaaaaugcucgucuguuuuuuguccccuagugaacauacauuacucaguugaguaaauuccucaucagaucaguccacuaacauuaaauguuuuuaucaccaacacgugaauuuaaauuaaguucugauuaaauaauguauucugcuuaccaaaccuucgggagaacuaauaaauagcacaguaauuagacuaauuuuuuuuccacaaauuaaguaccuaugauguauuucucuugcguuuuuguagguuaaaaaaagauuggcaaguugaaaauacaaugacagcaccaucaauacuuugccuaacaaagcuauaagaauauuugaaaucaaucuauucauauauuucauuaaucccaacugguuucuacuuuaucaucauaguauauucauuaauuuuacuacuuagacauugcagucccugcuuuuuacacugaaaaagguggguaauagaaagaaaaugguagauauuuguguuuacaaucaguacuauuacuguguaauucgcaaguaaguccuucacaacaaugacuuuacuaagccaaaugagauguguaauguguaauguguaaucuagggugcguagggauagaaagcuuccuuaauuaugccagucuguccuuugugauuuugauugcuuuauucuuuauuucccugacagcuuuauuaaccucucaaaagagguaugaauaagauacugguuucuggaguguggcaggugcuuuuguccuuuuucaccuugaaccuccaguaccauucuccaccaucaguaauagaaucacaugcaucauuuugugauguaccuagguccucagugauuacagucacuuuggcuuuacuagaauucuaguagguuaaaaaauaaaaugugguugcacugcaaaugaauuugcucccauagagauguacacauuuacaacacagguuaauuuaugacuagccuuuuuuguuuuuuuagucagugagccucguuuaaacauuuuaugcugccaaauaaagaucauagacuaucaguuuagguucuuauguauaagguuuccaguaaggcacauagauaauuuuuacuuuaaaauuguguggccucagguauucauuuauucagcaaauauuuauugagcaauggcuaugucagccaauaugcaauauuaauuaucuuucauuuuuaacauggaagacagcucuacccuaauuuuuuaaaugucaagaacacuguuacuuauccaaguguaaauucuacagugaaguaaagaugauuucauguuaaagagacuuaagcaaucuuuucuuaaguaagcaguccuuuccugauaugugccuauuugacaaauauagcacauaugcuaauuuacuuuagcuaccugacaaaccaagaaaacugguuugaucaauuuuuuaaguauuccacuaguuauuugugaauugccaugccaaaagaaaauaacaagaacugucuuauuaaaguaacaccaaggugauauauuaauguguuuaagcaaauaaaaauguccuauccuugauacaacuguuuuaaguauuuauaguuggugguaaaauggagggcauuauaaaccaacuccaaggucuaccaauuauccugagagaaaucagguaaauaucucaggaguucuuuguaaagaacuaaaauagaauaaauuaguacaaccuuucuggagggcaguacagcaauacauauuaaagaacuuaaaauugaauacacucuuuaacaauuuuacuuuuaggaccuuauccugaggaaacaauaauggaugcacaagauuuuucauaauagcaaaaagguagaaaccaccuaaauauccagccauuugaaauugguuaaauaaauaaugguacaucucucugagagaauauuaucaagcucuuaaaaugagauugaagggaaguauuucuaguguuuucugcgucuaugauauucauaugugcuauacauucucaucagugaccuaccuuauaauagacaugaggcaaaagagaagagacaaaaagauauguucacauccuucagagaaggaaaagauagauauccaucagauaucaaagaagguagccugaagaucaggauagccaagugguguagaagagucaagggggagucuaggugacucucauaguguuccuguaaaaugacguacuggugucccacugcagggacgaagggucauugggugcaugguguagaggcagagugagugggguugccuguuuugucagauauuugguauuuaaaacagagaugagccucuaagcccugcagaacagagagaauuucuuuuuuuuuaaggaauaagggaagucgagcauguuaaaaggcagagagaagguaauggugauggcugacauaucuacagcgcuuaucauaugccaagcaucaugccgagugcuuuaugcccaugaucaugcuuaauccuuaaaacaaucccaaaaugaagcuguuuuuucccucuaucuuuuagaugaaacugcugaugauuauagaguugauuauuugcccaaacaucacagagcuaguaaauggcagagucaggauuuccauuuugacucugaaucuagccacuaugcccaggaguaacaggaaaaccaaaacugcaagagcuacaggggcuguuuguuggaacaaaauccgagaagagagagucccuugaaggugaugaguuguagccucaguuuagaaacuccaucaagaagguacaugucugacuugcacuauucagcauguugcauucauagcugauacagcugauacaaccaagacagaaauauuuuguguuugguauguuugacagaacugcccucguguggggcuggcucauucugggcugucuaagccucauuccuuuugucaucugguaauucaaauucugaagcguccaggaaucacuucaugcuguggaugccccuaugcucucuaucugguguugguguacuucagaauuaaacugcaucucucuuucuacaccauguccuguaauagccauaaguaaaaguacauggaaaauuuggggggcucagaaaauuuggggggcugcaguugcugcacugcagccauuuacacuccuuaguucauuccggcuuaacaggcagucaucgauccacuauucacucaguuuauucauucaucagacauuuauugugugcuuacucuguuauaggcuuguuuuaaguguuaaugauaucaagauuaaaagacaccacugaaguaagggcaguaauugaacaguaggcagggccaugggaggauuuaauauucuuaacauugggaaacauuuaagguguuuuuuggcagaggaguaagagcaaugaagagaaaaaugggagguauugcccaaguaagcucaagaagagagaugaaaggauagacuucugacaccaagaagagagguggugcccaacuacugauagguagaaagaaagagacuggcaggaauuuccagugaguggcugcccuuuucucuguaaggaaggaggugaggucacuugcgagcaugcugggcuggaaguuagguaaugagcguaaggagcaccuuaaaaguuuggaacagcucccuaguggauagcuaggggccaggaaggagacagcccaacugugaugggaaccaugaauuuguaauaaggccauugaacagaguuacaugauuuuuuucccuaccagcacuuauuguuaaaacacucaucaagccacuggagaagacccucuucugacugauucuccuacucuucuaaugaagacauuugucuccaagagcuaaaauucuugggccugagcuuucacaugcuaacugaaauucaugacugaauuuuagaggauaccaaagacacaggcauggauccugcuaugaccugcuagugagaccaucuggguugcccuuuguacagccucagggugagucaucuccccugaaggaaagaaugucacagugucugguccuuucagaauacuccaucccucuacuguaccauguuuuagguuuuggucuaacacguuuucccuaguuugcaaccacucuguuagucaggauucuuacuuaccaguaucauaaaugagcuguaauuuaagcagaucaggaguuuaucagaaaaauguuagagaacucacaaauucuccugauggguuagauaaauaagguuagagauaggcagccagaagcaguaccuuaaauccugccacaggagaaaaagcacaguugcuguccugagcacagggcugcugccagcaccgcuggcaccacugacuagcaguagcuauggacagcuccugccguaaccucuaccaucucuggaacuggcauuugcucucucagccaccccagaauguauucugcuuggccuggcuuugcaucacuagcauucaauuuggagccuggagccagguagucugguuggcggggccuagcucgagugccaguagcugaauuucaugggagaccacgaaaaggagugucuguguuuuuaucugcuauaauggaugugggcucuuguaggaguuuaaaauggguguccauaaagaaugacagauguccauuacagugccagaaagcacaugaauaaacguuucagucauucuguaucaggagaaagucuuaggucacuggaugcuaaguuucucuauauuuccucuguagcagacuauuuuaaauucuuucagucuccaguacuuugcaggaugccugcaaaauaaaaggcacucaagaaauguuuguaaaugaacuaaugcuuguugaguauauucuuucaacaaauauguguuaggcauuguauuaguugucacauugcuauaaagaacuacccgagacuggguaauuuauaaagacgagguuuaaauggcucacaguucugcaggcuguacaggaggccucaggaaacuuccaaucauggcagaggaagaaggcacaucuuacauaucuggagucggaggacaagagcaaaggggagaugcuacaaacuuuuaaacaaccagaucucgugagaacucacuaucacaagaacagcaaggggggaaauccgcccccaugauuaaaucacccccaucaggccccuccccuaacauuggagauuacaguucgacaugacauuugggcaaagacacaaaucgaaaccaugucgggcauauacuggugaaugcugucugugggaucaaaaugcuuuacccaauaauaaagagguaaucagucagaaauaaggacugggcuccuauguaagaaucaaaaugagaggauuaggauuuagagggaaggaguacugcuuagauaagaaguagaaugaaucugagucaacuuucaaguucaaguugggaauauggugggucagggguggaaagugcugaagaacuucucaggaugaauugcggagcugguggggaaggggacacccagagggaacagucacuuuuggggagcggaguaggaaagcuauaccucaaacucuccuuaccccuaucugaguggggcauuucuaggccauuugcuuguguuuagggaaguuauaccacuugcugguuuccucugcuacucuauuguauguucaaauugcagccaauaguuaaauguacuauaucugaacagcucuuagaacagugucuggcauguuuuaaguacuguacaaccauuuauuaaagauauaaaaacaaagcaauauccuuuuucugauacuucaacacaauacaucagggauuccacuuggacucaaauguagccaaauaccagguauauucuuuuacuuuuugaccuuuggucuuuuuccugcagcuucaccuacuucuaguuuaugggauuuuuuuuauguucuaggcccugugcauagcacagcaacucauccccacucugucccuuuagagugggcagaucaugaguauuguucccuggguaaagugucugacugccagacccacuagaugaucucgaccuggaccuagcaguuccucucugucuuguuaacugcugugcuaaauauuccacccagcguuuucagcugucuucaguguaaggcuugccccaaguuaccuuuugucacuauuggaaaugaaaauucuacuucaugugcuuuauguaguuuaaaucauaucuucacaagacccuaaaaaggaaacaaguggguuuucuuaguucuacagaugaagaaaaaugaggcauggagaguuuaauuuucuugucaugggucauagaguugaugaauaauaaaucagauuuugaacccaggaagugugguuacagagcucauucugguccauuuugugcugcuguaacagaauuccacagacuaauuuauaaagaacagaaauugauuggcucacaguucuguaggcugggaagucugagaucaagggggcuggcaucuggugaggacuuuguugcagugucacccccacgguggugggggagagagaggugguagggagaaacaaaaauggggcggggggguuagaaacaaaagggggccaaacuuuuauaaggagcucauuccaugcuaauaaacucccuccugugauaaugucauuaauuuguuaagucugcccuuguggccugauuacccuucaguaggccccaccucucaacacuguugcauuggggauuaaguuucuaacaugauuuuugggggacauauuuaaaccauagcagagcuuguguucuuaaccucugugucuacucauuuucuucauuucacaaagcaguauaaacuguuuugucaugaaaagcauucuuuuuaaaaggucaaacaagucuccaucuuugcaugcuucccuuacaacuuugggcacagcuuggcaaaagccuaggcaucuagaauuuaauauccauaaguguaguauauucuguaucuuuugaaauggccauguaauauagauaucaauuuaguucacuauuuuuauggauuuagacauagcuucacaaacaucucagucuugcagagagaaaaaaauuaucugaauuuugccaaaauugccuguguuguuuuauugaauuuggucaagauaugcagggaugacgcauacacauccaguaauugaaccauuugaaugucugguauggaaaccaaauuuuuaaaaucuggaaucuucaacucugaaaacucguaucagugaauaggacucagaaagcucaauuuguaugcuuuuaugagccaaaaaguacgugggauugugucaaagcaggauacuguuauuuaccucagaugacugaaaccacaccaggacagccaagggccuuccagggugccagggcaucgaaguacccuccacggcauucucuuggggauccaacacuuacaugucaccagcagcaagagcugcuucauuucuucuauuccauuugcuugaccaaaugcugaugcauuucuuuuucagguccacgcuaguuugauuuuguuauuaauauuguuuuaaaaaaugccuuuuucugccuuugguaaacuaaaggucuaacauauauuccaacuucuuuugacagaggaaaagacaagcauacgaaucuaaccuuaucugucauggccugcaguuagaagcaacaagaucaguaaguacuggucccuuuucagcccucggcugaccacuguucucgggcagcuucgugccacuuggaauacuugggugacauuggaaacaugcagcccuggccacaucuuagucauagacugggagaggagucaaucaaaaucugcauuguguaggauguauucuuuuuuucugaucaaaacuagcagaucuuuuuuaauagccaacgaauuuuacaaugaaugcauguaugaaugauuauuuucuuucuuuaagaaacuucuaaaagcuuuuuuguuauacaaaaaauaguuuaugguaaaaaauuagaaaacauaagaauaaggaaaauaaucuguaucuuaauuauccauaaauaauuuugcaguccuucugagcuguuuuacucaaaaauauauauguacacauuuuuuaucuuucaaaaaggagaaaauuaccacuucacaguuuuauaauuugcuuuuucccuuuaauauauagcaaauggauuuaugucaauaaauauaauucuuugacauuuuuaacagccacauaauaugauauugaacagauagacaauaaguucauucgagguuuagaaaauuaaaaauuuuucauuaugcuagcacuacaaugaauauucuaguguuuuuacuuuaagucaauaauuaggguagagugauagacaaauaaguuugguuuucuucauuuuauaaauuauuuucauaguuuuaugaacuaugaugauuugaauuacuuccuuaaugauucaaaccaagaaaucgucuuuaagacaaaaauuuaugaugguuugcaaaucuguuuuuauuguuaucuucacuuuuagugguggucucuguauuguuuuuuuaaagcuaccaacaacauaagaaaaaucuauguguuuuaaaauugugaaaagaguugguuucuuguucugcguuuuuauuuuuccaauauagguauuggaugacaagcuuguauuuguaaaaguacacgcaccaugggagguguuauguacguaugcugagauaaugcacaucaaauugccucugaaacccaaugaucugaaaaaccgguccucagccuuugguacacucaacugguuuaccaaaguccucaguguagacgaaagcaucaucaagccagagcaagaguuuuucacugccccauuugagaagaaccggaugaaugauuuuuacauaguugauagagaugcuuucuucaauccagccaccagaagccgcauuguaagucuaaaccaaauuuaguugcugucuugggguaauuuggaaccugcuguuuugugguuugguugguuugguuuuauuuuuaaaaacugcacaaaaagaaaagaaauaugccagcagauuuguguuacaguaguaaacaaugauuggauugguuaauuacacuauauaaaccgcauacucuauuuuggaaucuuuuuagguuuacuucauccucucucgggucaaguaucaagugauaaacaauguuagcaaguuugggaucaacagacuuguaaacucugggaucuacaaggcagcuuucccacuccaugauguaaguuaaaaggcaaaaaugaacuaaaaggccuucuguauacucugguguugacaauagcaaagggcuaacuuuccugacuguaaguuucuuccucaguaaaaugaagggaacauacugcaagauuacaagcucauuuaggguaagaacuaggucuuuuguucacagauggaucccaguuauaaagauacucaguuuuaaaggagcgaaugaaugaauggacaggaccucucucacaguuaauguguaaagcaguauagauuagcaguuaaucuguguuagcauuucugagaccaaaaugccugcccugccacuuucuagcuggaugaccuugugaaagucauuuagccuuucuuccuccauuuccucaucaauaagcuggggauaaauuauuaccuaccuccuagaguuguuaagaggauuaaauuaauccauuaaauuaauccaaauguuagucccuagcauauaauaaauacuauuauaaguguuagcuguuuucauaauuacuaacagauguuauuaucaaccagaaaagauuaguucuuugucagcaaaauacauguuagaccuucucauuuaucauuuucugcaacauagacuuuucuuccucauuuggaauacgauuuucaaacuguccccuggaauaucccugggcuuuuaaaaaggcaucugucaggguuguugugacaauggcaguaccccagaugguugacauuuuuuuaaggacuacauucugagaccacagcaaccccucaaauucaagaguacuucucuagccgagaacaucucucgugaaaugaaauuuuuaaaaugugaccacuguaaaugcagggacauuauaacuaaagcuguuuaaacucugucauugaaauaaauuaaauacuauauuauauugcauuauuacuuuguuauauucacuaucaauuuaucugacuguguaagaccaaagaaaguaaagacugagauugguaauugcuacuguguaguacauguauuuguggauagagacgauauugaaauguacugaauaacauaauaaaacuaggacacuaaacagcagcuugauacacauggaaaaguagagaacagggagcugggugagguaaauacugauccuaagagacccaauguagccauccagccugagaguccauguguuuuacuuuugugccccacugaauuuagcuaauugcgaauaacaggacaugaauuuugaggccacuugcaaauagcugucacgaauauuaauuugggaugccaggguucucuaacaguugacauuugcuuuuggccaugucuuuuccacuaaagccucuucuaauugcagugguccuguauucaggcuaacaaauggucccaugugguauuugagagggaggugugugaaggucagggccugugcccugauuuggcugggugguaaucugguucuagugccagaagaagaaaaaugagucagaaaaaaaggcaacuggauuuaagcaggaaguuuuguuucuugaauaagcuaaguguguaacaugauacccagcuuuauuguuuguuuucuguauguuaucacagaauaacugcugaacugggggcaaagaagccuagguuuuagaauugacccugcugcuaaccagccaaggccuugguuuccccauuguccaaggagagggguggguuaucacguguuccucugguguggugauuugggcacuuggguggcccaauuuuucauuguguaggacugccccacuuaaagcauuuuaagcaucucuggggcccucacagagucccugcagugcuccccaggauuguaacacccaaucguucaucccugcccacauucauaaaugacccccaaggaggguaguaccaugccugguuaagaaucacuaaaaauuagaugguauuuccacccuuuccagaaggugaggaccccuuguucacaauugacuaucaaguauuuguaucacauuuaagaagcagauuugugaaaacacgaugauuauggugcuuacauguucccuucugcgucacagugcaaauuccgccgucagucagaggaucccagcugcccuaaugaacgguaccuucuguacagagaaugggcucauccucgaagcauauacaaaaagcagcccuuggaucuuaucaggugagggguuguagggaguacuccagggggaggcacucaggguguuacccccacagcaucugaaugugacaguacucaucaagacucuugccagugaagggagcugacccagagugcugagcuucguuggccaggguuuuuauugaggcuuaauuaugugggcaugauuaauugaaucauuacccaucuccaguaucauccucccccuggaagauggccaguaauauguggcucaaagcuccaguucuccaaucacaugguugaucuucuggcauggccagccuccacccugagucaucucauuagcacaaacucucuagagguccaccaugagccacuucacuggcauaaacuaucaggcguaguccuagggucccacugugaauaaaaaggcacuccuaucucucaggaaguuccaaggguuuagagguuacccaccgcccaggaacugggaugcagacccaccaaauuccauauugcacagaaguaaauguuagauguaguuucuauuguaugguaagacauguacauuuucacucuuuucuuaugucugccucuagguucuauuucguuguaucucacaagauacaaugacuagcucaagaguuuuucuucccaagguacccuguugguuuuccuccagaagcuuacguuguuugggcagggcugaggauucuggcuugugggagauagaccaagaacacccaaacaagccaauaaaacaugaaaauaaauaaacagaauuucuaauggaagugaagaaaauaacagagcaauaggaugggagggcagagugggaagugaguugagggaguuaucuuugaggaggugacuuuuaagcugagaucggauagugaagaggagccagugcuuugaggacuuggcagaaguccuucuaggaauaggggcagcuuguacaguggcccugagaugcacacacauuuggcaaguuugaggaaacaucagagaccagugcuagugagaaacagagcaagacaugaaguuagagggguggcaggagcgccgaaaagaguuuagacuuuaauugcagugagaagcaguuguaauauuuuaaauguuuaagucauuguauccuauucacguuuugcagauaauguggagaauggauuauaagggguacagggagcagggagaccacuagguaggaggcuguuugagccaggcagaagacugugggagcagauuugggauguguuuggggagucgggucgacaggacuuguuuauggauuggauguggagagugacgaggagaggagaguuaacuucaugucugucuggagccacguaccuguuuuuuuauggugucucaacaccccaugcacuugccaccuacuugagaaaacuacuagaccuuaaaagugagaguuuuaaacaaaugaauguuuguuuuguuuuacauuuaccgugggaaauuuuaaauauauacagaaauagaguaucauagcaagccugcauucaucugucacccagcuccaaaaauuauaaacucauagcuaaucuuguuucacuuuuacucccacuucuuucccuccccacuccacuggaucauuuugaagcaaauuccaaaugucacgucguuucauuagcuucuauuucuaaauaaggugucucuuaaacauaaccagaauacccccuuuugaaaaggaaggcugggugagaugacucauuccucuaaucccagcacuuuaggaagccaaggcaggaugaucgcuugaggccaggaguucaaggccagacugagcagcauagugagauccagucuuaaaaaaaaaaaaaaaaaaaaaagccaggcacgauggcucucacaccuguagucccagcuacucaggagacugagaagggagaauugcucgaguccaggaguuugaggcugcagugagcuaugauugugccacugcacucuagggcaacagaguaagacccugucuccaaaaaaaaaaaaaaaauuauuuaauaucaucagauaaucaggauucagauuucccuuauuguccccaaaaaaacuuaaugguuuuuuaguucaaagcaggauccaaacauggucaagagguugcaguuaauacaaucucucaaauuucuucuggucucaguuucacuguuuauuucuuguuuuccuugcucuuguugaaagaaugccuuucauucccuauuuugcugauuucauucucuccugugguguuguugaacauguuccucuguauuugcuauaacuaaguaauuuguguaguugcauuagcuaaguaguaauuggauccucaucuagaagcuuaaucugauugagguuagauuuuauacaagaauacgugauacguggaguugaguacuuauaucagaagguauauaauguucaguugucucuuuuguuaugauagcagcuaucaacgaucauuacuuagauucauuauuucauaagagauuucauuauuuuauauggucauacucggauucccuugucauucauuuuuaucaccgagauuacagucaugaagaggcacuuucauuaacucuguuuacccuguaaaauaagauuuuaaaagauauuuguacauauguaaauauuugagguugacauucaugugaaguuuccauuuuauuaauuuccuuuuauguuaaaccaauagcaucugauaacagagugauggguucuuaaucauuuuuuaugugcucuuuuauuuuuuuugcuuuaguaaagaaaacuucccaacuauuuuaaauauauuuugcuagaggaaaugcauuuacuauccccugucccugguccacauguucuuucccuucauugcuucccacuaguaaccccuugagcauucaggcuauuaaaccucaucuaugguucccagggauuacugaagggaaaaugggcucuuuccauuuuguucccaaaaagcaaaccaaacuggaaacagcaaccuaggggaaccagacuuugcacagguaaaaaagaaaaguuucccuccaaacucccguuuuuaccuccagaguaauaaaagaaaauaggguauucacaagacaagggcaggguccuauaaaaaaggauuguugugagaauaaaaucuagcucuuggaaacugaaaaugugauuagacagaaaaacaccaauagaacgcauuagaaaaaugaaguugaagaaauuaugcagagcauagagcaaaacuuauaaagggauagaaaagggggaaaagauaaaaaauuagaucaguccaggccgguacaauguauaaauaauaggauugugagaaaccaggggagaaaaaauguagggaagaaaucugagaaguacuuccagagaaguaucugaagaacugaacaucaugagucucuagguggaaagagccugcugaguacccagccuagaggaugaaaauagagccacugagucacuccaacacagcagcucagaacgcuggggacaaagcaaagauccugcuauccuuuggaaagcaaaaugaaaagaaaaucauacaaaggaucaagacucaauagcauugugcuucucaaugacacuacacacugaaagacagcaguaacuucacaugucuaaggaaaguuugaccauauauauguaacucuauguaugcucaaacuguuaaguaugaggaauuuucacaguuuagaugugcaagguaauggaggaggugcuccaccaagaaggaagaccuaagaguuaguaaacaggaaaugcaggaaaugccagcacaagagagagggacagagagaucccaggugacacaguucugugauggggcuuggagagucaucagucaagguuggaggaggucugagggcauuuauucaaggaguugaaacugaaagacaaucucauguguuugagccuacugagaaaguuacacauuaggggagagucugggguugaauugcugauaaguacacagaaaacuaagcaaugaaccaucaagacaauuauuaacucuagggagaacaagauauugagcagggaggaaaaaguaauuauagcagugacuugauucagcugugaauaguguuuauagaaucauaauaauguaaagcaagaauauuaaucuaaccaaaaacuauaauguaacuaugucaggauggcaggaauagagauguggauguuuagaugaggcaaggaguugaaagagagcuuaauccacaucuuccagaauagaaagucaauaggugaugcauaaaacugaaaaaucaauaaacagcacuucucgcauguuauuuagagauagggaaguaaauauucuaagcaucaacuauaaaaguuuaaagugacugcuucugggcagcaggaaauaggggaggggguaggggacugcuccuuuuuauaaccagccuucuagagcuauuagacuaaugacuguauacuuguaacuuugauuuaaaaaaucaaagcugaauuuuguuaaauugauuuuaagaguugggagguguuuggcagagagggacaaugaucagaaaauauugcauuugaaggaauccucauuauuuccagcuuuucagcaagaacuaagagacagauuuccuuuugagauuugaaaaaucuuucuggccuugccuacaauguaacagggaugccuuagaaaguauugaacuccuugucacaguaaauaaccaagcagagacugccugaccagcucuuuaaauacagcaggauuuuuuuuauuauugggagcuuggaccaggcaacuucuaagauucuuuccaauuuaaauauggcauuuccaggauggauggcugaugaaaacuuauuacagaaagcauaaccaaaaagaggccaaggcgucucaaacccauggccagacuucucucccgggcuguauccugaaccugccguuugccugccuuccaugagccagagagcaaagcuccggucacgugaaaaucagcccacuguguuccucccaucucccgauuccacccucaggucugucucagcucuuccuuuuuucccuguggaugugaacuacacccaggccugugacccauggaacuggucucagaccuucccugugagugcuuguccagcccagggauguuccugucugaagucucccaggacuccagguuuugcucagagcuaaguccccacgaggcuaagaccaaggaguucagcccagcuccauacugagccugaagucucacguaggccucagaguuaaguaaaucuccuuaucguacagaucaagaugaaggcagaaaugagucauucuuggggaauaucagcaacagcagcagucaccugaaccaucucuucauuccuaaacucucuuucugccuaacuguacuugaccuuccuuucaggaacaauuuuggcacugcuucuuggucagccugcccucuuuaaucuugccuacguggccucuucaguuuuaccccagaguauaccauuaaccaguuuuuaaaacuuaggaaaaaauagaagagcuagcuauaaggaauacagggugauggauuccucaaucauaugcauccuucccucuuucauucucacaugaguuuugcaaaaauuuuggucagagagacauuccacuacaaauuagugguuuuuuuucuuauuauuacaguugccccuugaacaacacagggguagggcagugacacccgcacacacauacagucgaaaaccugcauauauauuuugacucccuuuaaacuuuuaauggucugcuguugacuggaagucuuaccaauaacaugaacaaucaauuaacaaauauuuugaauguuauauguauuacauacuauauucuuacaauaaaguuaagcuaaagaaaagaauguuauuaagaaaucauaagaaaguauauuuaccauucaccaaauggaaauggaucaucauaaaggucuucauccuugucuucacauugaguaggcugaggaggaggaaaaagaguaggguuauucuugcugucucaggggugaugggggaaagagguggaggaaguggaaggggaggcaggagaggcaggcacacuagguuuaucuuuuauugaaaaaaaauccacauuuaaguggauccguacaguucaacccuguguuguuuaaggcucaacuguauuugugacuuacguuacauuuucuccaaggaacuucccuaguuaaguaaaagcaaauaacugagcagauuguucauguucauuugucucaugcauauaaagaacagucuuuuggagaauguguaaaauagugcuggucuuuacaaagaaugauaguaauacucuguauuuauuccauaaucagcauuuuucucucccuugcuguauuuuaauguacuuucaccaggcaaaccagcaauagugaucaguucuuccauaauguguaauauacuuuuuguuucaucguagaauucagggucugcugugaaaaugaauguuuuaagggugaauugagucagauuuaagcuuaaagccucuccuuuauuuaaaaucagaaauuaauauuaggaugaagcuacggaguaauuauuugcaucuucuaaaaauaauuucugucuuucuucaggaaauacuauggagagaagauuggaaucuacuuugcuuggcugggcuauuacacucagaugcuucuccuggccgcaguuguaggaguggcuugcuuucucuauggauaucuuaaucaagauaacuguacauggagguaaccucuguuuauuccuuguugccaugcugaaaaguuuauuagacauaaaauuauuuucauggucuuaaacuguuuugguaagacaagacugacugcagaacauucauugcuugggaugauauaucccuuuuguucugagcacaauaacugagugaaauggaaaaauuuuuuucuuagauaauccaacccagugucugacaugaauauuaccccuaggaaacacuccaauauuuuaagacaauauuuuguuugaaaaagaaaggaggacuggaggcgggaggauugcccuugaacuuuuggccccuagaggaauguacacucagcccugcagaugugagccaaaagcagcucugauuucuucaggguuccacugggaaaauuagugagggguuuuguuuuuuguuuuauuuuguuuuacuuuuagaaaugauuucuuacuacuaaaaagugcuuguuuaaaaacucaauaguuguuuugguuuuuacauuaaaaaauaguucauacaauguuuaaaaaaauguagugaaaaauuaguuuguacugagguugaaauucaaacaccagcugcacucucuaaagggacauaugugggugccagagcacucuaaauuucaccaucacuauucugaaugguauuauuagaccucugcuuuugguggucucaacuuccagcagggaugcagcacggaaccaggauuuucucuugauaucuggcugcuauccaggugugccagccagauaaaaauuucugggcaccagcaaugagcugauaaccaaauuuuucaagccugaagcaugucagccugcuccugaguuagguugcuuacauggcagcccugauggauagacauaauuacgcuucgauuuaacagaggauucugagcauguuguacccauuauggcuucuuagcuugaaagcugcagauggcuuuugaaguacucuucccuccucacugaaaaagaguuuugggccaaaggcugaauguuguuaccuuuucucuaaauuugucuucagcuucucuguugguuuguacauuguucuaguuuaaaaaaaaaaaaucaaaaauacauuucaaagugcagaaguugcauuuuuauaagguccucauggguuguucuuguuauaacuuauuuuacaaaaucaccaugauaguuacaccacauauuuccuagcauuucacacagauuaauuugcagaaaauagagggaaguucuuggggauauacugccugugcucaaaacuauuuggcuuuaauuauuuaauuaugagauaucuuuaaaauaucuaaauuauaaauauuuucaguuacuuuuauaguuucuaucaaauaccuguuuaaagcuuaugucccuccuuuuuuuuuuuuuugguggugggggcagucuugcugugucgcccaggcuggcgugcaguggcgccaucucaguucacugcaacuucugcuucccagguccaagcgagucuccugccucagccuccugaguagcugggauuacaggcugcgccaccacacccggcuaauuuuuguauuuuuaguagagaugggguuucaccaucuuggccaggcuggucucgaacuccugaccucaggugauccgcccgccucggccucccaaagugcugggauuacaggcgugagccacugugcccgguccuuaugcccccuuuuaaaaauaacaguuauauagagacauuauuuauauaccauaaaaugaccuuuuuuaaagugcacaauuuagguguaccccuuucccuuagccccuggcaaccacuaaucuauuugcuuucuguuucuagggauuuaccuauucuggacauuucauaaaaguauuuaaauauuuuaaauguuuucuauucuugugaaucuacucaguauguaauaaaauugaaaauauuaaaaauguguaaacaauucagguguuuuaagugcauucaccaaguugugaucaccaccaucuaauucuagaacauuuuuauugcccucaaaagaaaccagugcccauuagcacucacucccuaaucccucuuucccuuggccccuggcaaccaacagucuacuuccuguuucuauggauuugccuguucuggacauuucauaaaaguggaacuauacauuauaaagccuuuugugacugucuucuuucauuucaccuacuguuuucaagguucauccauguuguagcauguaucaguacuucauucauuuuuguggccaaauaauacuccauguguguauaaaccgcauuguuuauucauuaauugauggacauuuggguuguuucuacucuuugguuauuaugaauaauucugcuaugaacauucauggacaaguuuuugugcagacacaugguuucacaucucuugagaauauaacaaagaauggaauuguugggauauacaguaacuguagguuuaacauuuugaggaacugucauaguauuuuccaaagugacugcauauuccaccugcaauguaugaggacaauaauaucuucacauccucaucagcacuuaaaaaaaauugccauucuaguugguaugaagugguaugucauugcaguuuugacuuuguuuucucuaaugucuacugauggugagcaucuucucauguguuugucauuuguauagcuucuuuggaaaaaaauuuguucaaaucccuugccuauuuuaguuguguugucuuuuuauuguugaguuguaagcauuuuuuauauauuugggauagaagucucuuauuggauauugucuuagucuguuugugcugcuguaacacaguaccacagaccagguaauuuguaaagaauagaaaucuacuuuucauaguuacagaggcuggaaauuccaagaucaaguugccgacauuuggugucuggugagggcugcauccucugaaggagaggaaugcugcaucuucacauagcagaaggcauaagggcaaguggggagaacuccccucaucaacuccuuuuauaagggcaccuaaucccauucaugaaggaugagcccucauggccuaaucacuuguuaaagucuccaccucuuaauauuaccacacuggcaauaccuaaauuggaagagacacauucaaaccauagcagauacauugaaaauauuuucucccauucuauggauuguguuuucacuuuccuaauagcauccuuugaaacaaaauuauuuuuaauuuugaugaucuccaguuuaccuuuuauucuguuauuugugcuuuuggugucaugucuuagaaaccauucguaauccaaagucauaaaguuuuuuuuaacauuuaucuucuaagaguuuuauggauguagguuuaugauuuauuuugaguuaauuuuuguaaaugguaugagauaggguccugcuuuaucauuuuccauauccggguauaccagcaccguuuuugaaaagacuguucucuguuuaauuaucuuggcacccuuguugaaaagcaguuggccaaaaauuuaagaguuuguuuauagacucaguuguuuuccauugaucuacaugucugcauuuuaugcaaguaccacacuuuauuuaucacuguaacuuuguaaacuucaaauuuucguuuuucuuuuucaagauuguuuuggcuguucugggucuuuugcauuuccguaugaauuuuaggaucagcuuaucuauuucuaggauuuugauaagaauaauguugauuccauaggucaguuuggagaguauugccaucuuaacaauauuaagucuuuuaaucccugaacacaggaugucuuuucauuuauuuaggucuuucauuucuaucaacaauauuuuauaguuucaguguguaagucucauacuuguuuuuucucuuaaauuuauucuaaguacauuguucuuuugaugcuauuauaaauuguuucguuaauuuaacuuuuggauuaccuauuguaguguauagaaauguaauugcuuuuuuguauauugauuuuugugugugugcugcaaccuugcuaaacuggcuuauuugcucuaauaguauuuuggguggauuccuuaggauuuuuauauacgaugucauacugucugugaacagaaguaguuuuacuucuuccuuuccaauuuggaggacuuuauuuuuucuuaccuaguuguccugacuagaaccuccaauauaaugaucuuaggaggaaagcauucagucuuucaccauuaagugugauacuagguguggguuuuuucauugauacucuuuaucagguugggaaaguucuauuccuaguuuaugaguguuuuuaaucauggaaugauguuggauuuugccagaugcucuuucugugucuauugacauuaucuuguguguaguuuuuguucguuauucuauuaauaugguauauuacaagaauugauaacuuuuguacuuugaaucauccuugcauuccuggauagaucccacuuggucauaguauguaguacuuauuuuauauggcaggauuugguuuucuaguauuuuauugaagauuuuuccaucuauauuugcaagagauauuaggucucuaguuuucuuauguugucuuugguuuugguaucagcauaauaccagucgcauagaaugaguugagaaguguucccucuucuuuguuuuuaaaagaguuuaugaaacauugguguuaauucuucuuuaaaugguagguggaauucaucagugaaaccaucugagacugggcuuuucuuugcaggaauuauuuuuuuucuguuaguccagucucuuuauuuguuaaaaauaggucuauucaaguuuucuauuuuugcuugaguuaccuuaaguaguacauauuuuucuaggaauucuuccauuuuaucuaaguugucuaauuaguuggcuuauaauuaugcauaguauccccuuauaauccuuuuuauuuuuguaagaguaacaguaauguuucccuuuucauuucugauuuuaacccuuugagucuucuuuuuuucuugaucagccuagcuaaguuugccaauuuuguuaucuuuucaaagaaccaacuuuguuuaguugauuuuuuuguuacuuuucuguccuguauuucauuuauuuccacuuguugccuuuugauuuuaauauuuaguucauuuauauuuaauguaauuacucaugaaguaggaguuaaaccugccauuuugcuauuuguuuuccaugugucuuuuugucucuuguuuuucuauuccuucauuacuacuuuuuuuguguguuaaauagauauuucuaguaugccauuuuaauuccauuauuguuucuuuaucuuuuuuuaguggcuucccuggggauuauaauuaacaacuuaauuuaaaauaauauaguuugaauuaauggcaauuuuaauuucaaauaguacacaaaaacuuuacuuugguacagaucuguuccuucucuacuccuuugugguauuaucaucaugcaaauuacaacuuaaugcauuauaagcuuaccaacaguuucauaauuguugcuuugugucuuuuaaauaagauagaagaaaauagagacauacaaaaauauacuacuuuucauauuuauauauguaguuaguucuaucucugcuuuuuuuuucuguagguggauuugaguuacugucaugugucuauuuaagccugaaggacucucuuaguauagguuaaguguuucuuguccacaaugcuugggaccagaagcguuucagauuucagauuuuuuucagauuuuggaaaauuugcauuauacuuaccauuggagcaucccaaauccaaaaugcuccacugagcauuuuccuugaauauuaugucagcacuugaaaaguuuuagauuuuggaccauuucagauucagauuuuugaauuaaagguguucaaucugggcugagugcgguggcucacgccuguaaucccacaacuuuugggaggcugaggguggcagaucacgaggucaggaguuugagaccauccucacuaucacagugaaaccccaucucuacuaaaaauacagaaacuuagccgggcauggugacaugcgccuguggucccagcuacuugggaggcugaggcaggagaaucgcuugaacccgggaggcggagguugcagggagccgaagucacgccacugcacuccagccugggcaacagagugagacucugucucaaaaaaaaaaaaaagaaaaaaggguguucagucuguguuucugguagggcagcugauaugauuuggcuguguccucacccaaaucucaucucaaauuguagcucccauaauucccacauguuguaggagggaccuggugggagauaauugaaucaugugggcaguuuuccucauauuguucucaugguagugaauaagucucacaagaucugaugguuuuauaaggggaaacgcguuucacuugacucucauucuuucuugccugccuccauauaagacaugccuuuugccuucugccaugauugugaggccuucccagccauguggaacugugaguccauuaaaccucuuuuucuuuauaaaugaacuagucucagguaugucuuuaucagcagugugaaaacagacuaauauagcaggucucugccaacaacagauucuuucagauuuuauuuaucugggaaugucuuaauuucuccauuuuugaaggauggguuugcuggauauagaauacuugguugacagucuuucuuucagcacuuugaauauaucaucccacugccucuggccuccaugguuuuuaugaaaaguuagcugcuaaucuuacugaggacccuuuauaugugaugaaucacuuuucucuuccugcuaucaucauucuuugccaugauuucuuuggcuuugucuuuacacuuugaaugugauacuccuagguuuggaucucuuugaguuuauccuacauggaauuuguugaguuuccuggauaugcaaaauagugcuuucauuaaauguaggaaguuuucagccauugauucuucaaauauuauuucuguuucucuccuuuuuucucugggacuucuauaauguauguguugguauauuugaugguaucccacuaauuucugagacuguguuccuuuguccucauuccuuuuuuguuccauuucucagauuggauaauuuuaauauuccuagcuuucaauuugcugauucuucugcuauuucauaucugccgaggagcccuucuaaugauuuuuuuauuuuaguuauuguacuuugcuaauugguucuuuuuaauaauuccuaucucuauugauauucucuuuguugugcuuccuuuaauucuuuaggugagauuuccuuuaguucuccaaauauguauaacugcuaaauauaaaaagacuucaucuaauaaaugcaauaucuggguguccucagggacaguuuuacugacugcuuuuuccucucuguguuaggaccauaguuuuccauuucuugguguaucuuguaauuuuacauugagaacuggacauuuuaaguauuauaauguagcaaaucuggaaaucagguauuuucccuguucaggguuuguuguugcuuccguuuauuauuaucacuguuacugcugcuucccuuuguuuacuuuccugaacuacuugucuuugucaugugugaccacuuaagucuguguucaauaaguuuuguuguuagcuaaugauuggauuagcuggugacugcauuaaaugccuaguaccaguaauuuucguuucucugccuuugccucaucucauggcugugugugaguguguauugaggaaauguguuuaacgcuccagcagguaguuuucagcucuuccuuagcuuuuuuuucuugccagugcagaaccucaaagucagccagagguaagggauuaagguuuucucaugucuuucuuggccaugugcacuguccuacacaugugcauggccuucugcaaucucaggaauauguuggagcuuuuuagagcccccugugcacaucucauuuccuaauuuuuccuuuuaaguucuuugguugaccucuuguuacgguaucacugccucaagcagcuacaauguaaaauaauucuugccgauugcuuucaacacuuuggugauagugcuguucacaguaugagcucugaguaugagguuuaaaaagaauggcaaauccugcgcauggagcuuuuugggggagcugcuaggcaggucaaauaguaagacuucucugaggaugggguuuuggggguagcuuuagacuacuucuucccccuucaguggcugcuaggcugcuauuuuucacagcuucuauaguuacaaggcuguugguuuuuaaggcuaccaugaagcuagggagauggggaugggaaucagugagguuaacaggugucaucauucuuauagagauuuagccaguuuuccucaaauaaaugcuccucagaugacaucaagcacuugcuccucagaugacaugaagcacuugcuccucagaugacaucaagcacuugguuaauuuccagaguucugcaaaggcugauuuugacaauuuuugccaguguucucauugcuuuuauggagggagaggguuuuccaagaucuuuacucagcuauucuaggaaagcuucccauuccuauuuguuuuuccuuaguuauuuguaagaccaccuaacugcacagcuccaguccuaguuacauacaagccuagccuaucugaauggcuucuccaaagggagcagcgugcaauguuacuuggguuuuuuuuuuuuuuuuugguauuaauuuguaggaguccuuuaaauacucugacaaauaauccugucauuuuuaugucugcaaaacuuuuaccaauuuguggcuuauauuuuucucccuuuaauguuauuuuuuaaugacauucuuuuaaaauaucuugaauguaucaauauuuuucuuugugguuuaugcuguuucguuucuuguuuaugcaauucuccuuacucugagguuaucuacauuuuuuuuucuaauaaguugguacguuggcauucucauuuucuaccuggaauugauguauauagaauaugauuacagguucaauuuuauguuuguucauauggauauccuguuguaccagacccguuuuauugaaaugucaguucucacuuuacuaauuugcuuggccagcuuugguauaaaucaguuuuuauauaggcaagaggucuguuucugacgucuuuauuuucuucuguuggucaauuuuucuuaaccucucccauaaugccuuugucuucagaaguauuuugacuguucugagccuuugcuuuuccacugaauuuauagcuuaaaugggagauaacuaauaucuuuaaauauugauuauuacaaauugugaauaugguaguguaggccuucuuuacugcauuucagaaaaauucuauuuucucccuauaaaucuuaacauaguuugaauuagauuuauucuugaacacuuuauauuuuuuacacuauugaaaugguacuuuuuaagaauuauuuccuaaugauuacagguguauggggacauaauuccuuuuuguaucccuguguguauuuuguauauugauuuugcauccagccaacuuuacugaacuuauuuuuguuuuguuuuguuuuguuuuuugagacagagucucacucugucacccaggcuggagugcaguggcaugaucucaguucacugcaaccuccaccucccggguucaagcaauucuccugccucagcuucucgaguagcugggauuacaggcacgcaccaccaugcucugcuaauuuuuguauuuuuaguagagacaggguuuugccauguuggccaggcuggucuugaacucaugaccucaggugauucacccaccucggccucccaaagugcugggauuacaggcaugagccacugcaccuggccuuuacucaacuuauuaauucuaauaauuuaucuuuagggucuauuaagucaucuauauagauaaucauguaaucuguuaguaauaacaguucucuuucuuccuggccuauccuuguggccuuauuuuacuugacauacaaugcuggcagagaccuccagcugaaaagaaacagugauagcagaaucuuuugcuuuauuccugaccuaaaggaauuacuuucagcguuuuaccauuuaguaugauuuuuaaugaauuuuauguaacaaaguuuuauguaacagaaguucacuucuguuucuaguuuuacaagaucgguuuaguuuuguuucuuauugugaauggauauuagauuuuaucaugcugcuuuaaauuuuuuaaaauuaaguuuuauuucucucuuuuuagcaaagaaguuugucauccugauauugguggcaagaucauaauguguccucagugugauaggcuuuguccauucuggaaacucaauauuacuugcgaguccucaaagguaauuuuugcuauugccaauauuuacaccuaaugaaagauuuuuuuucuaaugcuaauuuagauaaaacauaguauuguaucuuuuuuccucugaggaauuaagauauuuuucaacuaaccuuucaaacauucuggacauuaauauacaaugcuuuauuccucuuuuacaaauaauaaaauugugauuuaagaccuuagauaaaaucucauagagugucagugagauaauaguggaaucuaaacuauuugaguauuucaaguaaucaaagcagaaaucucaaacccauuuuaucuuauaaauacuuuuuaauagauucacuacagguugaguauucauuaucugaaaugcuugggauccaagguguuuugaauuuuggauuuuggaauauuugccuuagacuuacggguugagcgucccuaauccaaaacuccaaaaucugaaaugcugccuugagcauuuccuuugaacauuaugucaguacucaaaaagcuuuggauuugggauacucaaccuguguaaguauuuuccuuaauucaauuaaguggaaaccugaaaucuguacuucuguuuucccccuuucaacauaugccaaaacuaugcuuagauuguaaagacccugauggucagauuuagacugucucuauaacuaugcaugagaaggguuuuauaugugauaaaagguauuugucuuaaaacauugccagaaaacacaucuagcucuccuuauacaugcagauggucgugagcuuuaugacuucuuaaaauuugggagguuucagacgagcaugaagaauggagggagcuuacugaaagcaggcuggaaacucuggacagauagauggucagcuuauuucagagcauuuuccuuacaauccugaccuacgcuucccuccgaugaucuucucucuauccccuuguucuaccaugagaguuuaggaaucauuaguaucccuagaacauuguagccuacuccauguaagucagauuuuaacggaauguauugcuguuauacugaugccacuuucuauaucauacuuugcauaguucuuauacuuaccacuuuugacauauacaacaacccugugagauagacagaacaggcauuaucuccauuuuuacagcguaaaauacuggcuaucugggagaucaaauaaccugcccaaagucacccgccuaguaacuggcaaagucagaaauuuauaagaaaucugcauuucuugucauuaccauauucuuugccagcugacauugcaggcacuuuacucagauccagcucuguuugagaaauuguuucacuacuuaguuaagcugauugcaggguguugucaacagauggauuuuuacacuuaauuuagaaauuaagcccccucucccaaaccaacacaaacucuagacuauaaauaucuguuguagaucacacagaguaaaagacuugaagcuaguaagagggaagcugcuuccagugaugcugacucagaggcuaaagggcacuaguuagcuguacccugaagcacuggcuuuaaggcagaugccagcaauaagaccagaggcagauugucaucuacaaagaugcaaguggaaguuucauuuuccuuaagaaguucucucgacacuccccacacccaccucuucuucuuucuucugcuccaccuacccuccuuaagcacaugacuuucaaauauaccccugugugcauuuuuuuguuuugaaaaaaaaaaauugaaucuuuaauucuauucuaguuuccugaagaaucccuugagucuugucagaaugauuuucaagaagaaagaaacaugaaagaauauaaguaaggggacuaaauggaaaaaaaaaaguuugaaaaagaaaaagcacuuuuucuggcuuuucuguuugugaauuauuuuuuccuucauacauuuauuuguguauucauuuacacaucuuucuuuuggaaagaguacuaauuuacagauaugcuuaccuuuuagcaaauuaaaaauagaaauaugaaauuaggaaacaauuacacaaauaauaaggauucauacuguuuuugugauuauugaauaagauucuuagcuuucuagcuggcaagauaaaagggaaacaugguaaguucuaauauucugcucauaaaaacauauuuaguuauaaaauuuugacuuugcugcuuuccaggaagaaagcauaacaaauucucauuuuuuucccccaaaauucuaguugguuucucugcuuaaaaucaucuugccuacauaugcagcucuuucuuuucuuuccugcucuaugugacuaaagcaguaugcugauucagaccgcucuuaacacagcugucuugcccucucugugccaucccaccuagcaagcuaagcuaggcuucuuacccaguaagcuccuugcuuccuuuuucccuuacuuccugcuuccacauaguccauggaacacagagcaaagaagucagccaucuuauucuuucucaagcguccaggauucucacacauguggcaagaauacgaacuucauccaggccuaacucccucucauaagagugcuaggcauguccaucaccuugagcaaggcagcuggacugaucuugacauuggcaguacacuugcucuuucauaaugcucccauuuuacccucuagcacugacagauguguuuccauugacauuuucucaaaagaguagagcuaagaauucacagguggggucuucuuuuuggaguaggugggcagaagugucaaggcaaguagaguguugucaaauacuuagaagauugcauugacuccuaaaauggaaguggcauuggacagaaucuucaauaauaguauuacaacaugcagaacuguuuuuuaugggaccuuucuuauaauuuuacaauaaaggauaaggcauaacauuaaaacuuaauuuggagaagaugguuccauaagagucaaagguaaaagauuugaaauauguggucuuauggaaucccuggacaagaggaguagguggaaaggauuguuccccagagcaggcacgcauuuauugucuuccuugagguuuuuuagaagaaugauugggaggaggagccaagauggccgaauaggaacagcuccggucuacagcucccagccugagcaacgcaggagacgggugauuucugcauuuccaucugagguaccgggcucaucucacuagggagugccagacagugggcgcaggucagugggugcacgcaccgugcgcgagccgaagcagggugaggcauugccucacucgggaagugcaaggggucagggaguucccuuuccuagucaaagaaaggggugacgaacggcaccuggaaaaucgggucacucccacccgaauacugcgcuuuucugacgggcuuaaaaaacggcgcaccacaagauuauaucccgcaccuggcucggaggguccuacgcccauggagucucacugauugcuagcacagcagucugagaucaaacugcaaggcggcagcgaggcuaggggaggggcgcccgccauugcccaggcuugcuuagguaaacaaagcagccaggaagcucgaacuugguggaccccaccacagcucaaggaggccugccugccucuguaggcuccaccucugggggcagggcacagacaaacaaaaagacagcaguaaccucugcagacugaaaugucccugucugacagcuuugaagagagcagugguucucccagcacgcagcuggagaucugagaacaggcagacugccuccucaagugggucccugaccccugacccccgagcagccuaacugggaggcaccccccagcaggggcacacugacaccucacacggcaggguacuccaacagaccugcagcugaggguccugucuguuagaaggaaaacuaacaaacagaaaggacauccacaccaaaaacccaucuguacaucaccaucaucaaagaucaaaaguagauaaaaccacaaagaugggggaaaaacagaacagaaaaacuggaaacucuaaaaagcagaacgccucuccuccuccaaaggaacgcaguuccucaccagcaacggaacaaagcuggauggagaaugacuuugacgagcugagagaagaaggcuucagacgaucaaauuacucugagcuacgggaggacauucaaaccaaaggcaaagaaguugaaaacuuugaaaaaaguuuagaagaauguauaacuagaauaaccaauacagagaagugcuuaaaggagcugauggagcugaaagccaaggcucgagaacuacgugaagaaugcagaagccucaggagcugaugcgaucaacuggaagaaaggguaucagcaauggaagaugaaaugaaugaaaugaaaggagaagggaaguuuagagaaaagagaauaaaaagaaaugagcaaagccuccaagaaauaugggacuaugugaaaagaccaaaucuacgucugauugguguaccugaaagugauggggagaauggaaccaaguuggaaaacacucugcaggauauuauccaggagaacuuccccaaucuagcaaggcaggccaacguucagauucaggaaauacagagaaugccacaaagauacuccucgagaagagcaacuccaagacacauaauugucagauucaccaaaguugaaaugaaggaaaaaaugugaagggcagccagagagaaaggucggguuacccucaaagggaagcccaucagacuaacagcggaucucucggcagaaacccuacaagccagaagagagugggggccaauauucaacauucuuaaagaaaagaauuuucaacccagaauuucauauccagccaaacuaagcuucauaagugaaggagaaauaaaauccuuuacagacaagcaaaugcugagagauuuugucaccaccaggccugcccuaaaagagcuccugaaggaagcacuaaacauggaaaggaacaaccaguaccaggcgcugcaaaaucaugccaaaauguaaagaccauagagacuaggaagaaacugcaucaacuaaagagcaaaaucaccagcuaacaucaucaugacaggaucaaauucacacauaacaauauuaacuuuaaaugucaauggacuaaaugcuccaguuaaaagacacagacuggcaaauuggauaaagagucaagacccaucagugugcuguauucaggaaacccaucucaugugcagagacacacauagguucaaaauaaaaggauggaggaagaucuaccaagcaaauggaaaacagaaaaaggcagggguugcaauccuagucucugauaaaacagacuuuaaaccaacaaagaucaaaagagacaaagaaggccauuacauaaugguaaagggaucaauucaacaagaagagcuaacuauccuaaauauauaugcacccaguacaggagcacccagaucauaaagcaaguccugagugaccuacaaagagacuuagacacccacacauuaauaaugggagacuuuaacaccccacugucaacauuagacagaucaaugagacagaaagucaacaaggauacccaggaauugaacucagcucugcaccaagcagaccuaauagacaucuacagaauucuccaccccaaaucaacaggauauacauuuuuuucagcaccacaccacaccuauuccaaaauugaccacauacuuggaaauaaagcucuccucagcgaauguaaaagaacagaaauuauaacaaacuaucucucagaccacagugcaauaaaacuagaacucaggauuaagaaacucacucaaaaccgcucaacuacauggaaacugaacaaccugcuccugaaugacuacuggguacauaacgaaaugaaggcagaaauaaagauguucuuugaaaccaaugagaacaaagacacaacauaccggaaucucugggacacauucaaagcaguguauagagggaaauuuauagcacuaaaugcccacaagagaaagcaggaaagauccaaaauugacacccuaacaucacaauuaaaagaacuggaaaagcaagagcaaacacauucaaaagcuagcagaaggcaagaaauaacuaaaaucagagcagaacugaaggaaauagagacagaaaaaacccuucaaaaaauuaaugaauccaggagcauguuuuuugaaagaucaacaaaauagauagaccacuagcaagacuaauaaagagagaagaaucaaagagacgcaauaaaaaaugauaaaggggauaucaccgccgaucccacagaaauacaaacuaccaucagagaauacuacaaacaccucuaugcaaauaaacuagaaaaucuagaagaaauggauaaauuccucgacacauacacucucccaagacuaaaccaggaagaaguugaaucucugaauagaccaauaacaggaucugaaauuguggcaauaaucaauagcuuaccaaccaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauucugauaccaaagcugggcagagacacaaccaaaaaagagaauuuuagaccaauauccuugaugaacauugaugcaaaaauccucaauaaaauacuggcaaaccaaauccagcagcacaucaaaaagcuuauccaccaugaucaagugggcuucaucccugggaugcaaggcugguucaauauacgcaaaucaauaaauguaauccagcauauaaacagagccaaagacaaaaaccacaugauuaucucaauagaugcagaaaaggccuuugacaaaauucaacaacccuucaugcuaaaaacucucaauaaauuagguauugaugggacguauuucaaaauaauaagagcuaucuaugacaaacccacagccaauaucauacugaaugggcaaaaacuggaagcauucccuuugaaaacugacacaagacagggaugcccugucucaccacuccuauucaacauaguguuggaaguucuggccagggcaauuuggcaggagaaagaaauaaaggguauucaauuaggaaaagaggaagucaaauugucccuguuugcagacgacaugauuguauaucuagaaaaccccauugucucagcccaaaaucuccuuaagcugauaagcaacuucagcaaagucucaggauacaaaaucaauguacaaaaaucacaagcauucuuauacaccaacaacauacaaacagagagccaaaucaugagugaacucccauucacaauugcuucaaagagaauaaaauaccuaggaauccaacuuacaagagaugugaaggaccucuucaggaagaacuacaaaccacugcucaaggaaauaaaagaggauacaaacaaauggaagaacauuccaugcucauugguaggaagaaucaauaucgugaaaauggccauacuucccaagguaauuugcagauucaaugccauccccaucaagcuaccaaugccuuucuucacagaauuggaaaaaacuacuuuaaaguucauauggaaccaaaaaagagcccgcauagccaagucauuccuaagccaaaagaacaaagcuggaggcaucacauuaccugacuucaaacuauacuacaaggcuacaguaaccaaaacagcaugguacugguaccaaaacagagauauagaucaauggaacagaacagagcccucagaaauaacgccacauaucuacaaccaucugaucuuugacaaaccugacaaaaacaagcaauggggaaaggauucccuauuuaauaaauggugcugggaaaacuggcuagccauauguagaaagcugaaacuggaucccuuccuuacaccuuuuacaaaaaucaauucaagauggauuaaagacuuaaacguuagaccuaaaaccauaaaaacccuagaagaaaaccuaggcaauaccauucaggacauaggcaugggcaaggacuucaugucuaaaacaccaaaagcaauggcaacaaaagccaaaauugacaaaugggaucuaauuaaacuaaagggcuucugcacagcaaaagaaacuaccaucagagugaacaggcaaccuacagaaugggagaaaauuuucgcaaccuacucaucugacaaagggcuaauauccagaaucuacaaugaacucaaacaaauuuacaagaaaaaaacaaccccaucaaaaagugggugaaggauaugaacagacacuucucaaaagaagacauuuaugcagccaaaagacacaugaaaaaaugcucaucaucacuggccaucagagaaaugcaaaucaaaaccacagugagaugccaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggauuauaaaucaugcugcuauaaagacacaugcacacguauguuuauugcggcauuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaaccaaacaccgcauauucucacucauagguaggaauugaacaaugagaucacauggacacaggaaggggaacaucacacucuggggacuguugugggauggggggaggggggagggauagcauugggagguauaccuaaugcuagaugaugaguuagugggugcagcgcaccaacauggcacauguauacauauguaacuaaccugaacaaugugcacauguacccuaaaacuuaaaguauaauaauaaaagaaaaaaaaagaauauugaaaaaaaaaaagaagaagaaugauuggaugacagacaauuuaggauuaugcuugcuuucucaucacaaucaauguggacgauugagggggccuugaaaauuagauggaugagaaugucgcuauucuuuuaugaagauaacuaauauuuuuacauagaugaagguuuauccacuuuacaugaguaugaagagcaacccaaaaaaucaccuaaagcagacuuuucuacuuugaagcagcuuugaauuuucuuucagcauuugaaaagguuuuuuuuuuuuuuaccuauagcuuuucuacccagucccuguccuuuuauauuaucugucauaaaguagauauaauaugcuugucacuuuuuccauuaucuuuauaguaauuuuuaggaaauguaaaaaugcucacuaaugaaaaauuaguaacgaauuaaaauauuuuccaggaacucauagagggagauaggcuacauauauaauagcaaaaggauaaaacuuagcagaacuaguaaauaaagccuuauuuggccagauacguuauuuaucauucaugaucauuguauucauuguaauguuagcaaaagcaccucugcauccuuuauuccaauagaagcaucugucagugaugguagaaaagccaucauuggguuuaagaaaacagaguucuccuggaggagagccacuucgagauaaaccucagcuuuguacgucucuuaacaggaaaaacaggaauucugaaacuuacccucugaccagggugggaugaugauaaaauguaaaucauauaucuaaaaguugcuuagggaucauuguauuuguagauccauacugcuuccucaaauccauuaugacagcucauaagaggcuguuauucaagcccaauggaggcuuuaaacacaguggaauucuaggaacuauaccuguuuccuuauugggauaugcagaguuucacuggaaaauacacugguuaauacagcaaagacuuugcuuugaaaagaaucaaauuucaucuauaaguauguaguggauacauugaaugauguaugaucauagaugauuguuaaacuaggcaucaccuuugaaaagaacuucaagacuguagaauagacaaagcauuucauauuuacugaauccuaauaaguggaggauaugacucauuuauaugucauuuauauuuuccagaaauugugcaucuucgacaguuuuggaacccuggucuuugcaguauuuaugggaguaugggguaaguuuuuuuuuuuuuuuucaugcacucaauuugauaguauuacacaguuuuauguaggcuaucaaaguaacccacuuuuaggaucuuguauugcccaggcuucaacuccccuagaauuccauuuauaacugagggcauuuaucaguuaacuuuuacuauauuaaaaucugcaucaaaauauaguggcuuaaaacaacaaacuuuauuucucauguuuauuauuucucaucauucucugggucagcugagaguucuucaggcauggguuggcucagcugacucuccaguaagcuggcagcuccacuggggauagaugaucuugcaacuagaaacccgguuuggucuguggggcucggcugggaaggcuucucugcuccacauggugucucaucuucaaguaggcuagcccaggagucuugguuucaggguuccaaagagaagagaggacaagcuucagugcauaugcauuuuuaagccuauuguugcaccaaguuagcuaaugucccaucaaccaaaguaagucauauggccaaaccagcaucaauguggggcggugggaguacuacccaguggcuuggauguaggaggcaugauuuguuggaagccauuauugcaacagcccucacagugugauacaaccuaacuuuuauggggguggagaucaggaggaagcagcaacacagugauuaugggugagcuuucuuucucauacacuucuaugugagcggauauuuaaugaguaucugcuacucguauaauaacaacaaacucuacuuacuaacuagaacagauauaauucuacaggaucuaauucccauaugggaacuuuaccacuauauauuauuuacuuugggauagaaucauuaauacaaugaggcaauuaucauuuucuuuaaaugcaaacuuuaaauguuuaauugaucugaauguucuaacguagaagaaaaauuuccauuuucaaaauuagaugcauuuccaauuucauuguguaaguaugaggaacaacagaauucagguuauaggaaggcagaggaaaaaacugaaccaaguuucuuauucuuuaaaagacaacacgucaauguguguaacucacagaaucaguuauuuacgguguccucagcaguauuucuguuugguagugauugugccuaugaagaauuaccaaauggaucacagaacagacaauccaguuauuuugcucacuuuuuagagauauuuguugccgcuccacagauaaagugcacuguaagguggccaaacaucccagucaguuacauuggcauucagccauuuagcauguuuuggcuggagaccaaacucugacuaauauuugacccauagaagaauaaagauugaauguauguauuaagauccucugugcuccuccauuguaauacaccuuucuccgcccuccccuuccgcccaguaagagcuuaggugcugaacacaugggucagcauuuuaacuauuaaccguacucucagcguugaaucauaauguauaacauucuaacacaucuacuaaacugcauauacuaauggaugcugauagccccaauuaaagaagacauuugaaauaaagcaaaaaauguuaauuuugacacuagaaagacaagccucaaauuuacuagcuaaccuuccuuucucugaucauuaacuacaccaugguuauagaacugacuuacacauuagcugcugauuuuaucugauuuuugaaugcagaaaguauuucagcacugccuauagcaucguauguauauuuuuaaggauauguaugauaaacuuuaagugcuuuguguggcuuuccuuguuacuucugcuuugagaacuacugcugugaaccacuuuacagaaaguuugaaauugcagaaccaaacaggcuacagccucuugugaaguuauucauaucaccaccauuauguuccugcagcaucuuuuuugugcccagacgcauauggcacuuauuuuucugcucccuagaaauuaugaaaguugagaguagaaaaccuuuuguaaucaauauaauauaaaucauauacguaccuuaaaaauguccauccuuucaggacaaggcagcccaccuguucauacugauucauagaguccuaaacaccaacccaugguugaaguaaagguucuaaacacauccugcccacucccuuccuuguugcaucuugccuacuuacaccugauucucccuggaucagacuuggcugcaugacugcaauguuuaauuuucaccuuugaggggugaguucuaaacuaggccuacuuauuuccagaaaaccaccagucaucuggcucacuaaggaucuggggaaccaggaagccuaacuagcugcacuuggggaucagaaaacagcugcugugacuguuacuuucagaccugugcugcuucugcuagguccacaccagcaaaauaaugcaucuccugcuaccaccacccugacucuguucagcccaguuucugacuuaagugacauacagaugcuucugagaggcauuuuaaaaaaucagaucuggaacccuagcugcaagagaguuucuagcccuugaauuaggagguuggaauaaacggcugggugugguggcucacgccugcaaucccagcacugugggaggcugaggcagguggaucacugaggucaggaguuugaaaccagccuggccaacauggugaaaccucgccucuacuaaaauacaaaaauuagccaggugugauggugcacaccuguaaucccaacuggaggcugaggcacaagaauugcuugaauccaggaggcagaguuugcagugagccgagaucacacuacugcacuccagccugagcgacagaguaagacuccaucuuaaaaaaaaaguugcaauaaaggcugaggaaguuaaucuaacuucucugccucuguggguuacgaggccuaaaugguuucaaggcguuaaaacauccuagaccuucagcagcaaacucuuacagcaaccagaacauucccaucuaccagagugugucucauccuuagacaaugcaggauauaacaccauaacacuuuacugcucugaaaccuuuuuauguauaugugcaucuucuucaucugaugcauauuuuguuuagauacaguaauauccugauuaagaggaagagcuguuauugauccccaaguuccagacaaccuuucucuuuucuuauuauauguugauguaagaguuuuaacugugccuaaucagcuagcaccucuggauugccagagaacagaaguguguugcucccugcugaaguucuaucaguugucuuauugcagggggagagagcaaaagauacggaacagaaauuucugucugugaucaugcacggucaccccagggcuuggugcccucaaucugggacacacagcauugugagucagcacuggcguggcccaggaguacuccaaaacacuggaugacuacuagguuagcagugccuuccauagacccugcagaaucuguggcugagugaaauaaggaacuaaaacacucaccugucgcugcaauucccagggguuuuccuucaaggcugaggauuugcuaacaccagacuaugucuugcuugcauugcaauccuaucacuucccaggcagaacugcuuccuauaguucagaauuucguaaacagaagcauuuuacccaguauguucaaauucagggaggagggaagaggacauccacuguucuucccuuauagcaccgacuagaguugcuuauguuacucuuugugagaaaaguuaagaauauuaucaugaauuaucuccuguugauaccuuauagauacugagauagauacuagauagguacugaguaaaugaguggcuaucacacuccgauuuuaaagaugaagaagaugacacucaggaagauuaagccaauuaccuaaagccccacagacagaaagugacaagcauagaauaagaguucugccaauaauuuggcuauuaucagucuuuagauugaugacaaaauacaguguauauuaaugaaguugcagcaagcuuugagaaagaugcagaaauaauuugguuuuuacugacauaauugcauuauuuuuggugcugugaaaaaaaugagaauggguuagaaaaugucaguuuagucuccuugguucuaccucaugugacacaggugcagacccuucuuucuaucggaaaaauaagaaaccacccaucuuccagccuaauuuuaacaggcuuauaaguaccaguuuuucauuuaugccuguaggugucaaagugcaacaagauuuuaaugugcuuagucacaacauacuuuaaaaaaugguuaugcuggaagaguauguuugcagucuguaagguagaagaguacccaugauaauuccuucagcauguugacccuggacuccuccccacagucaaggugcuaaagcuugaucucaccaguaaacugucaaugcuucaugguauauucuccaucuaggguuauccuggccucuugcuagguacaggacuaccucagagauacuguggguaagguuccagaccaccacaagaaagcgaguaucacaguaaagggagccacacaaauuuuuguuucucagugcauauaaaaguuaugguuauacuauacuauagucuagugagugugcauagcauuugucaaaaaauguacauaccuuaauuaaaaaauacuuuauuacuacaaaugcugacaaucaucugagccuuuagagaguguuaaucuuuuugcugugagagggucuugccucgauguugauggcugcugacugauuagguaggaggaugguugcugaagguuuagguagcuaugcaaauuucuuaaaauaagacaacaaugaaguuugccacaucaguggacucuuuuuucacaaaagaguucucuagcaugugauacugugugguagcauuuuacccauaguagaacuucuuugaaaauuggagucaauccucucaaacccuacuacagcuuuaucuacuaaguuugugugauauucuaaauccuuuguugucguuucaguaaugacagcaucuucaccaggaguagauuccaucucaagaaaccacuuucuuugcagauccauagaaagcaacuucucauuccuucaaguuugaucaugagacuacagcaguucagucacaucuucagacuccauuucuaguucuucuugcucuuucuaccacaucugcagugacuuccuccacugaagucuugaacuucucaaagucauccaugaggguuagaaucaacgucuucuaaacuucuguuaauguugacaucuucaccuccucccaugaauuauaaauguccuuaaugacaucuagaauggugaaucuuuuccagaagauuucugcuuauuuugccaacaucuagccaaauaauuacuaucuauggcagcuguggccuuacuaaauguauuucuuaaauaauaaaauguaaaaggacuccuugaucuaugggcugcagaacggauguuguguucauagccaugaaaacaauauuaaucucuguacaucuccaucagaguucuugggugaguggaugcauugccaaugagcaguaauuuuuuuaaaagaguaauuuuuuaugaacaaugggcuuaaaauaauucaacacaccauguuauaaacagaugugcuugucaucuaggcucuauuguuccauuuagauuacaggcagaguagauuucacauaauucuuaaaggcccuaggguuuuuggaaugaucuaagagcguuggcuucaacaugaagucaccagcugcauuagccccuaacaagagagugagccuguccuuagaaguucugaagccaggcguugacuucucucuagcugugaaagucccagaugacaucuucuuccaaugggaggcuauuucaucuaccuugaaagucuguuguguggcuaccuucaucaaugaucuuagcuagaucuucugaauaacuugcugccaguuagcacuugcuacuucaccuugcacuucuaugcuauggagaugauuucuuuccuuaaaccucaugaaccaaccucugcuagcuucaaacuuuucuucugcagcuuccucaccucucucagccuucauagaguggaaggggguucuggccuugcucugaauuaggcuuuggucuaagggaauauuguggcugguuuggucuucuauccagaucauuaaaacuuucuccguaucagcaauaagguuguuucacuuuuuugucauuuguguguucacuggaguaguacuuuucauauccuucaagaacuuuuccuuugcacucacagcuuggcaaacuggcacaagaggccuagcuuucgauaugccuuccucacuaaacuuaguaauuucuaguuuucauuuaaagugagagaugugugagucuugcuuucacuugaacaccuugaagccauuguaggguuauuaauuggccuaauuucacuacuguugcaucucaaagaauagagaggccagaagagaggcagagagauggggaagcagccagucaguggaauggucagaccacacacauuuguuaauuuugcugucuuacauagguggacuucauguugccccaaaacaauuacaauaguaacaucaaagaaagaucacuuaucacagaccacuauaaaagauacaauaauaaugaaaaauuugaaaugugagaauuacuaaaaugugacacaaaguggguacauguuguuggaaaaauggcauugauagaggcucaacgugggguugccacaaacaaucaauuuguaagaagauaaaaacacuaucuguaaagcacgauaaaucaagguacaucuguacaggagguacugaaggcccaaguagacuagcauagcaggaaguaaggacagugggugguuauguguagaggugagcaguuggagucagcugggaccucugaguggauuauuccccaggugguggggguccuccaguuucugggugguuuccuucaguuuguucauucagugcauucauucguuacaugccuacuaugucguagugcuucugcuaugaacaaaaccaaaucccugcacaugugaaggugacauuccaguggguaugauagacaguagaccuagaagcagauauagguugggaugcaugagugcuauguauuaauauuuugaagggcagaagaaggguugacaaagggaauaaaaugggcccuuucugagagaaugcacaugaccgcuggaaugauugcauaauuacagagugggagacagagcugagggagcuucaggggugggggcauaugcaauacuggcaguaggauucuugguagauuaaaaaguagaguccucuguugauggagauguaugggaguuuaucaaggggaugcagaaccuugggcuuugguaagugggugguguauguuaugcugcuucauaugcagccuagggaggguuggcucauggguggcucauuccucccaacagggucucuuuggggaguaucugccaccugagaccagcauggcucagcugggcaccaagaccagccagucacaugucaguccacaaaaggacauggugcccucuagauuuccaucccauugacaaagaagccaauacucacuucauuuccccuugggcagguacagaagcacaaaugucuggguuguuucucaguagccaucacccucuauauaaaacacucaacaauuugauccugauuccaacauccagguuauuucuacucuaacuuacuggaaaaguaguagucaaaacaaacacugcuaggaagugagugcuuuuaaacauguucaguugucuuugccauuggggaguguuggauucuugcuccuuacaggugcaucccaagacugccuccugcauuucaggcugccugcugcagggucugcaggauuucauucuggcucucuucacucucuacuucagugagucuccacccugacugcguauuaaaccuuaaaaacaaaacaaaacaaaaacaaacaaaacaacuaugcucaggccccauuccagaccaaaaaucauaauuuauaauuuacagggugguaccugggcucaguauuuuguaaaagcucccugguccuucuuaccugcagccagggugugauuacuacccugcaucucauuuaauggucuuauucucucauggccccaauugccacuuaaaacaaugaaaauccaucucaauccagaucuuccuccuauguuguagacuuuuaccuaucuacuggacauuucuucuugaguaguccacauacauugcaucugaucauaaccaaaccaggugucuccucuugcacacuugaccuucuuaagacacuuccuauuuccaaggaaugccacuagaauuuaggauauugccuaagucagaaaccuggcuagcauccuucugucauaccugcauccaucugucauaccugcauccauccgucugccuucucaacgucccucaaggaucuugcugcaucauguaccugccagcaggucucccugccccuagucucacucuagacuaccuucaaagucuccuccaucuguacguuaaacucucuaaacuccuuucaaagcacagaaaacccuuugugaugugccccugcagagcucuuaccuggcugccccaccuccaucacaccuuucacuuacuaccagauuauuugcaguuuugggaaaguaccuggcccucuggccuccgugccuuugcaugcgcagcucccuggggguagguggccuuaguguuccacccaccaccaccuucaccugaucagcucugaggcaucucaggacucaucacugugguccccuccucugggauggccuuccccgaaacacccaguuaaauguucugguucugugugcccagagcaaccugugcuuaccuuuaucauagcccucuuaauaaucaacuauaccugucaguucaaggacagcauaauucucauaugccuaggagcuccuugaagcagggacugugucuuguuuucucuuuauucccagcugauaguagacacucaaagaauguuuguaaauagaagaguggugauuacagaauuuuuuuauaggaaggacuuaggguucgcagucugauuagaagaagggcaugggguauuuacccugaaacugcauuuuuucaauuaacauuuaauguuuuuauuuacuauuuaaaguuaaaaauucugaaaaaugauuccuaaaaaauuauuuuagucauacauuauauaagauugagaaaaauacuaguuuuccguaugaaugaauauuaauuuauuugggacauccuaaaguauuccucuuccccuguaggcccuuaggaaggaaaggagaguacaagaaugagggcacggggaaaagcagaugaaggauggaucaugagcuccuuuggaacugugaucauuauuuguguuuuaguuggcaauaaggugcuggaacauaugcuucagugucagacauacucacaugucuucugaccaucacauugccuuucccagcaucuauagucuauuucauaauguuguaaauuaccaacauuuuucuuuaaaaucauguuuuucccuuuuaaauaguaguaucuccuauaauuuagauuugauuugccauauacaaaaguauuauggaugauaugguuuggcucuguguccccacccaaaucucaugucgaauuauaauccccaugugucaggggaggggccuggugggaggugauuggaucaugggguuggauuucccccauccuguucucaugauagugagugaguucucaugagaucugaugguuuaaagcuguggcacuuuccuccgugcucucucucuccuauugccauguaagacguguuuugcuuucccuucaccuuacaccaugauuuuaaguuuccugaggccuccccagccaugcagaacugugagucaauuaaaccucuuuccuuuaugaauuacccaguccagguaguucuuuauagcagugugaaaacaggccaguacaauggauaauuaauauuauucaguacagauuucugaaacaucagucaucauugaaaauccacacaagcucuucugucucucuguuaguuaccuuguuuuuggaguuuuggaagcgacgccaggcagaacuugaguaugaaugggauacuguugaguuacagcaggaagaacaagcccgaccagaauacgaagcacgauguacucacguagugauaaaugagauuacucagguaagcagggucguauuuaggugcaguuuaaucuacuuacugcugugguucuccuccuuggccgcacauuagaaucacuugggggagcuuaaaaaauauugauaccugaguuccaucacuacauacucugguacuuaguaaccuggggguauucugagcacagggguuuuuuuuaaagcuccuuugguaauucugaugugcagccaaagugaagaagcacugcuuagaacaguagacacaggagauaaauggggccccuucuuucauaaaaacaguaaaaauacaaaaaaauaauuuuuacugugacauagugauauaaggaaagaggcacugguuuuuauaguugauucucaauuuuucacguauacuuucauuauuccagccccuuauucauccuagaccagcugccccuuuaucuugcaguaagccucagucacugcuccaccuucugguugggaugugcagaaaauaguguggccuuuauccuaaaguuggagaaaggauggaggaagaaggaaaguauuuuuugagguccaacucuguucagguacugugcuagguauuuuaugucauuggaaagguagauuugcugcugcuaccacuacuccaaagauaaaaaacuauauucugucuguauaaauauuccaaagucccugaaagaugauuuuuaaaucaucugcauucuugcuucuuuccaucaacacagaaaacuuugagcugauuguacuugcagucaucagcauaagaacaguagguucugaauacgaauagcucuuggaaagaaaaugcuuuuaccaagaaugucugaaaguguucccaacuauagguuuuauaaauugaaucacagauuuacaaaauguuggcacuaaaaggaaccagagggaacaguucaaccucuuccuuuuacaaaugggaaaaaacgagguucaauuaccaguagaaagugacauuugucuuucgcaauguaaaagcuucaaauaauccccauuaugaauaguuccugcuguuuacuagagaggacagggucaaagcauauguuguugaaagauuguauauucagaaaugaaagccaaaacuuaaacaaaauuagauguuuaugaaguaguuugagcacuaaaaaaucuuauaauaccagcaacaugggaaaaauacugaagaaaagacaauuuggucauuuaaaccugccaauuuuauaguuaaaauugccagcuuauaaguuaaauuucccuugaaguguuacuuguuaaaacauugcaagugaagguuccuuuuucuuuaugguuauuccucguuucacuuucauugcccacauacccucccuuuguuuagagaggccuauagugugauggugaagucucugaugccagaguucaugucugaccacagcaacuuacuaguugggugaucuuggaccaauuaguuaacuucccggugccucagugaccucaucuauaaaaugggaauaauacaguuguuuccucaugaucgcagcuaaggauugaguuaauguauagaagcuacuuagaauagugccuggcacagaguuaaauacucuuaaguauuugcagcuguuauuaggcugcucuuacaauacagguaaaucauguagaggguugauuucuacucuuaagaauuuaaauauauuuuuaugaacuauaaaauggaaauccucuaaaaauuuauucaaaguuaauauauaaagcccaaccaagaaacacauaguggauaccuaguauuugcagacaucuaggaaacuuuuuguccugccugugcucugcgcuaucaucacagcgauuucuaaaaccuaagacaagcccagaaguauagcuuugcagcuuggcaccaucagacacccagauuccugagcucgggucguggccgauaaacaguuuauucaugcuugcauuuuccaaaaacuuauuaaaaugaacacugcacauguuuugugaugugugacuuugaaauuguuaacaaaaaagugcaauuaugaguaaggagacuaugcuugcaaacuaauuuuuuaaaauuaauucuaagauuuauuggcgagucaggagaaaaauaauuuuauuacaguaaucccuugauugacuaaacuuuuuuguuuuuguaauuaggaagaagaacgcauucccuuuacugccuggggaaaauguauacggauaacccucugugccagugcugucuuuuucuggguaauucuaucacaaaaauguuuugaaugauuaaaaauguuuuuauuauguaacagauuuuuuuaauaucuaauuuuaaauguugaggaaacuaaaugcugagccuggaaacuauauggucucagagagacagacagauauuuccagauaacuauuuuagccaccacauagagcaacucccaagguucgagauaccuuaucuguucacagagguucuucuaguucuuuucaccucaucuguuaaaucagugauucaggauuuuccaguuucuggugaagaccaaauggaaggcauuaagaauucuaaaauuuuccaacagcaacaaucaaaauaaaauguuggccaggggcgguggcucaugccuauaauccaagcaccuugggaggccaagguggguggaucaccugaggucaggagucaagaccagccuggccaacaugaugaaaccccgucacuacugaaaauacaaaaauuagccaggcaaggugucacacaccuguagucccagcuacucgggaggcugaggcacgagagucacuugaacccaggagacggagguugcagugagugaaaaucacaccacugcacucgacuggguaacagagcaagacuccaucucaaaaaaaaaauaaauaaaaugucuaggaauacccuuaacaaaaagauaauaggaacuaucaaagaaaacauaaaaacucuugaaaguuguaaaggaucugaaugaaugauaauuaaaugaaugauucuagauagaaacacauuuucuguaaaauaucaguacuuacuaaguuaguuuuaggcuuauugauggaaucauauuagugauguaauaauuuagugugaguuuuaauggcucaagaagagccagauucaagaauagcacaugaagccuagaaauagccccugauagcaauaaaaauguaauaugucagaaaagaggcauuauaaauccaucagacaaguggagauuauucaauaaauaguaauggaauacuuguuagcuauuuggggggacaauaaauguuaaagucuuacuuuaaaccauauacuauaauaaauuucaaaaacauuaaaaaaaaaauuaaaggccaggcaugguggcucacgccuguaaucccagcacuuugggaggccaaggcagcagaucaccugaggucaggaguucgagaucagccuggccaacauggcgaaacccugucuuuacuaaaaauacaaaaauuagccagguguucaccugugaucucagcugcuugggagacugaggcaggcgaauugcuugagucuaggagguggagguugcagggagccgagacugcaccacugcacuccagccugggugacagagugagacucugucucaaaaaaaauguuaaaaaggaaguugccaagauggccaaauaggaacagcucccaucugcugcucccagcgugaucaacacagaagacggguaauuucugcauuuccaacugagguaccugguucaucucauugggauugguuguacagugggugcugcccacagagggcgagcugaagcagggcagggcaucgccucacccaggaagcacaaggggucgggcgauuucccuuuccuagccaagggaagccgugacagacuaucuggaagaacgggacacccccugcccaaauacugcacuuuucccaaggucuuagcaaccagcagacaaagugauucucuaccaugccuggcucagugggucccaugcccaaggagccuuccugacugcuagcgcagcagucugggaucaaucugcgagguggcagccuagcuaggggaggggcguccaccauugcugaggcuugaguagguaaacaaagcggccaggaagcucaaacugggcagagcccaccgcagcucaacaaggccuaaugcauccagacuccaccucugugggcagggcauagcugaacaaaaggcagcagaaacuucugcagacuuaaaugucccugucugacagcucugaagagagcagugguucucccagcacagcguuugagcucugagaacggacagacugccuccucaaaugggucccugacccccguguagccuaacugggaaacaccuaccacugggggccgacagacaccucauauagggugcuaccucucugggacgaagcuuccagaggaaggaucaggcagcaauauuugcuguucugcagccuccgcuggugauacccaggcaaacagggucuggaguggaacuccaacagaccugcagcugagggaccugacuguuagaaggaaaacagacagacagaaaggaauagcauuaacaucaacaaaaaggucaucuacaccaaaaccccaucuguaggucaccaacaucaaagaccaaagguagauaaaaccacaaagaugaggagaaaccagcagaaaagcugaaaauuauaaaaaucagagcaucucuuccccuccagaggaucacagcuccucgccagcaacggaacaaagcuggacagagaaugacuuugacaaguugacagaaguaggcuucagaaggucgguaauaacagacuucucuuagcuaaaagauaauguucuaacccaucgcaaggaagcuaaaaaucuugaaaaaacguuagacaaauggcuaacuagaauaaacaauguagagaagaccuuaaaugaccugauggagcugaaaaccauggcacgggaacuuuguguugcaugcacaagcuucaguagccaauucgaucaaguggaagaaaggguaucagugauugaagaucaaauuaaugaaauaaagagagaagacaagguuagaggaaaaaguaaaaagcaacgaacaaagccuccaagaaauaugggacuaugugaaaagaccaaauauguguuugauuggcguaucugaaagugacagagagaauggaaccaaguuggaaaacacucugcaggauauuauccaggagaccuuccccaaccuagcaaggcaggccaacauucaaauucaggaaauacagagaacaccacaaagauacuccuugagaagagcaaccccaagacacauaauugucagauucaccaagguugaaaugaaggaaaaaguguuaagggcagccagagagaaaggccgaguuacccacaaagggaagcccaucagacuaacagcacaucucuuggcagaaacccuacgagccagaagagagugggggccaauauucaacauucuuaaagaaaagaauuuucaacccagaauuucauauccagccaaacuaagcuucauaagugaaggagaaauaaaauccuuuacagacaagcaaaugcugagacauuuugucaccaccaggccugccuuacaagagcuccugaaacaagcacuaaacauggaaaggaacaaccgguaccagccccagcaaaaacaugccaaauuguaaagaccgucgauccuaugaagaaacugcuuuaauuaacgggcagaauaagcagcgaaugucauaaugacaggaucaaauucacacauaacaauauuaaacuuaaacguaaaugggcuaaaugccccaauuaaaagacacagacuggcagauuggauaaagagucaagacccaucagugugcugaauugaggagacccaucucaugugcaaagacacauauaggcucaaaauaaagggauggaggaagaucuaccaagcaaauggaaagcaaaaaaaagcagggguugcaauccuagucucucauaaagcagacuuuaaaccaacaaagaucaaaagagagacaaaauaggccauuauguaaugguaaagggaucaauucaacaagaagagcuaagaauccuaaauauacauguacccaauaaaggagcacccagauucauaaagcaaguccuuagagaccugcaaagagacuuagacucccacacaauaaucaugggagacuuuaacaccccacugucaauauuagaucaacaagacagaagguuaacaaggauauccaggaccugaacucagaucugcaacaagcagaccuaauggacaucuacagaacucuccacccaaaaacaacagaauauacauucuucucagcaccacaucacauuuauucuaaaauugaccacauaauuggaaguaaagcacuccucagcaaaugugaaagaacagaaaucacaacaaacugucucucagaccacagugcaaucaaacuagaacucaggauuaagaaacucauucaaaacugcacaacuacauggaaacugaacaaccugcuccugaaugacuacuggguacauaaugaaaugaaggcagaaauaaagauguucuuugaaaccaaugagaacaaagacgcaacaugccagaaucucugagacacauuuaaagcaguguguagagggaaauuuauagcacuaaaugcccacaaaggaaagcaggaacgaucuaaaaucaacggccuaacaucauaauuaaaagaacuagagaagcaagagcaaacacauucaaaagcuagcagaaggcaagaaauaacuaagagcagaacugaaaaagauaagagacacaaaaaacccuucaaaaaaucagugaauccaggagcugguuuuuugaaaagaucaacaaaacugguagacggcuagcaagacuaauaaagaagaaaagagagaagaaucaaguagaugcaauaaaaaaugauaaaggggauauugccacugaucccauagaaauacaaacuaccaucagagaauacuauaagcaccucuaugcaaauaaaccagaaaaucuacaagaaauggauaaauuccuggacacauacacccucccaacacuaaaccaggaagaaguugaaucucugaauagaucaauaacaggcucugaaauugaggcaauaauuaauagccuaccaaccaaaaagaguccaggaccagaaggauucacagccaaauucuaccagagguacaaagaggagcugcuaccauuccuucugacaccauuccaaucaauagaaaaagagggaauccucccuaacucauuuuaugaggccagcaucauccugauaucaaagccuggcagagacacaacaaaaaaagagaauuuuaggccaguaucccugaugaacaucgaugugaaaauccacaauaaaauacuggcaaaccgaauccagcagcacaucaaaaagcuuauccaacacgaucaaguaggcuucaucccugggaugcaaggcugguucaacauaugcaaaucaauaaacguaaucuaucacauaaacagauccagugacaaaaaccacaugauuauaucaauagaugcagaaaaggccuuugacaaaauucaauagcccuuccugcuaaaaacucucaauaaacuagguauugauggaacauauuucaaaauaauaagagcuauuuaugacaaacccacagccaauaucauacugaaugcgcaaaaacuggaagcauucccuuugaaaacuggcacaagacaaggaugcccucucucuccacucccauucaacauaguguuggaaguucuggccagggcagucaggcaagagaaagaaauaaaggguauucaauuaggaaaugaggaaaucaaauugucccuguuugcagaugacaugauuuuauauuuagaaaaccccaucaucucagcccaaaaucuccuuaagcuaauaagcaacuucaacaaaauauuaggauacaaaaucaaugugcaaaaaucacaagcacuccuauacaccauuaggagacaaacgaagagccaaaucaugagugaacucccauucacaauugcuacaaagagaauaaaauaccuaggaauccaacuuaaaagggauaugaaggacuucuucaaggagaacuacaaaccacugcucaacgaaauaaaagagaacacaaacaaauggaagaauauuccacacucauggauaagaagaaucaauaucgugaaaauggccauacugcccaaaguaauuuauaaauucagugccauccccaucaagcuaccaaugacuuucuucacagaauuggaaaaaacuaaaguucauauggaaccaaaaagccugcauugccaagacaauccuaagcaaaaagaaaaaagcuggaugcaucacgcuaccugacuucaaacuauacuacaaggcuacaguaaccaaaacagcaugguacugguaccaaaacagagauauagaccaauggaacagaacggaggccucagaaauaacaccacacaucuacaaccauuugaucuuugacagaccugacaaaaacaagcaauggggaaaggauucacuauuuaauaaauggugcugggaaaacuggcuagccguauguagaaagcugaaacuggaucccuuccuuacaccuuguacaaaaauuaauucaagauggauuaaagacuuaaauguuagaccuaaagccauaaaaacccuagaagaaaaccuaggcaauaccauucaggacauaggcaugggcaaggacuucaacaccaaagcaauagcaacaccaaaagcaauagcaacaaaagccaaaauagacaaaugggaucuaauuaaacuaaagagcuucugcacagcaaaagaaacuaccaucagagugaauaggcaaccuacagaaugggagaaaauuuuugcaaucuacccaucugacaaagggcuaauauccagaaucuacaagggacucaaacaaauuuacaagaaaacaaccccaucaaaaagugggcaaagcauaugaacagacacuuuucaaaagaagacaucuacacagccaacagacacaugaaaaaaugcucaucaucauuggucaucagagaaaugcaagucagaaccaccaugagauaccaucucacaccaguuagaauggugaucauuaaaaagucaggaaacaacaggugcuggauaggauguggagaaauaggaaugcuuuuacacuguugggaguguaaauugguucaaccauuguggaagacuguguggagauuccucaaggauguagaacuagaaauaccauuugacccagcaaucccauuacuggguauauauccaaaagauuauaaaucauacuacuaugaagaaacaugcacauauauguuuauugcagcacuauucacaauagcaaagacuuggaaccaacccaaauguccaccaaugauagacuggauuaagaaaauguggcacauauacaccauggaauacuaugcagccauaaaaaaggaugaguucaugucuguugcagggacauggaugaagcuggaaaccaucauucugagcagacuaucacaaggccagaaaaccaaacaccgcauguucucacucauaggugggaauugaacaaugagauaacuuggacaccguggggaacaucacauaguggggccuguugggcgguggggggcuaggggaagcauagcauuaggagaaauaccuaaugugaacgaugaguugaugggugcagcaaaccaacauggcacguguauaccuaugugucaaaccugcacguugugcacguguacccuagaacuuaaaguauaaaaaaaaacuacaaauaaauuugaugacuauaugaucuuuagaaguaaaaacguuuucuaaauguacuagcaauagaaaacguuucagaggaaaacauuuaaauauuucuauacaucaaaaguauccuaaauguaaacaaaauaccagaagauauauuuguuaacaauagggcaaacaagaggucaauaccuuuaauacguggaguccagaucaucuagaagauaacaccaaagaucucaguggcuaaagagacagaacauuaaugugcaauuacaaaggaaaaaaauaugaugaccaauaaccauuacaaaaugccaaaucucaauagugauuaaauccacucacauuaaagugagauaugauuuuucaccucuugaaugauaggacucagugucugugaggaugaaguacaacagucaacuacuccaauacaagacuauuguaauucugcacugcuccagcuucguagaaggcagcuuagcaauuguguuucaagucucaaaaauauucauaugcuuuaauccacuaauuuagcucuuaggacuuucaaucaggaaauauuugaaaauggucaguaaaaguaagauuuuuucacauacuuaucacaacauuuauguauauauuuauauacacacauauauacauaaacauauauaucaaccaaaauauucuacuucucaaccuucaaacaguggaauguugugcggcgaugagaaaguauggucaugaagauuuuuuaaggcacauaaaaaugcuuaugguuuaugauagguuuaagggaaggauaaaauauguaaagugguuuuaaauaugcauacaaugcauacauaauccugaaggaauugugcccacauguagauaguagauaaauuuuuuccuauuuaauguuauuuuuguuagaaaucuuugaguuaugcuuggcagaaaaucggucuucagucgguuuaaacaacagcaaaagagggggaggugggauuuauucuuuccaccuauuuauucucugaaacugaaaauuccaggccugagguauggcuccagucaaagcuagauaacugcagaccagauauugucaagggcuguguuuuguuccuuucauccugugucagcuggccuccugggcauggugggucuggacacuuccuugugguagcagaauggcugaagcauuucagaugucacaucuuccaagccaagggagguuuuuuguuuuuuuguuuuguuuuuuguuuuuuugagacagguucucgcucugucgcccaggcugaagugcaaugcguggucucagcucacugcaaccuccgccucccgcguucaagugauucuccugucucagccuccccaguagcugggauuacaggcaccugccaccacgcccagcuaauuuuuguauuuuuaguacagucgggguuucaccauguuggccaggcuugucuggaacuccugaccucaugaucugcccgccgcagccccucaaagugcugggauuacaggcgugagccaccgcgccuggccgaggucuuuuuuuuaauggcuuucucuauugaugggugaagcuucucuuucccaugggcacuaacagaugucuccucacuucucaguggcuguuacugaguuaugugucaaucccuggaucaguugcugaguccggugggauguuacauguuugucucaaaccaaucagguuguaccucuggagcacaucagggcaaucccaccuaaaccccagggcuaaaaacagaggaguucuuuccccugaagcaaaaucuggguucucuucuaggauggagaacagacccaggcuagcaaaagcaaucaguguucacuacaagguacuuucagauuguccacagugaccuuauacuaaaguuaugaucagaaaaguauuaauguuagaaucagaaauaaguuauaaacuugaggaaaaagaauaaaaagcuuccugccccuaugaagaaauauugaaguaugggaagcaccccaaagaaauaugggaacuuaacaaguuuguaaaagcucugggaugaauuagaauucauuucauaaaccacgugggaggcagugccauggagaggugagugugucuucagaaucuuaggagaccccaauucuuuuuacuaguuaucuaaucuuggacauauugcuuaaugucuuugagccucucuuuucucaucaguaaaagagagauaauauuauacuaccuuccucacaagccuguuaugagauuaaacaaauauacaugugcuaaggugaacagagagcacuuaaagaauguuaucuuuaucauuaauaauaaacauuauggagauaauuuuuaaaaacacauaauaaacacccuguauguauugugcuaagagaggaugacuugauucaucuuuuuaauuuuucucagccuuaucuaauuuuuacauauacacacaaaucuuacucaucucacaaguguugagacuuaacugcgaaaggaaauagauuacaggagaaauguaaugccuucucuacaagcagauuucuuaaagagcaagaaaaacaucuuuuuuaacacuuaacuuugguugcuauaaucauagcuaauacuuauuuggugcuuuucauguaucugagcuuaauauucuguuuuuaccugaaguaacucauugaauccucaacaacuccauagguuaggugccauaguauuccuaauacacaagagaagauauugaagccccaguggagcuuguacucaaauagagaaaucuagccccaggaccauccuguaaucacucccuuuacugcucuccacaggugacaacuggccucuguuacuaucaacaacaagauaugguuugcuugguccucaguuucccuucucugaaacuuuucugucaucacgagcagucacacaccuugagugcaugguucuggagaaaguagauguaggggaaacaguuuaaagaugccucuccaauagugucuaguacuguguaucaaguaaggaaaauucauggcgccuuuaaugugcgucguugaguggugagaaaucugcuuacugagaaagugaaaaucucuuacuggggauuaugcagucaaaaauacaguggacuaguggcgugaaucuuguggaaauacaaguacaaaugacugccaguuuaaggucguaagaucugagugugaaaagugugugaagcuuuuaucagcagagaccugcugccaguaccaacaguuagcucagggcaccucugugccagcuucacuggcagugcucagacucuccccugcuacagugauuaagacaaaagcuagcaccugcugacacuucaauuggugauagcuuuucuguugcaaggaaauguagcucccucauggaguaugagugagcaaaaaacauuaacucacaacuuaaauaauuuaguaauuguagaagggauguuuucuuugguucuacacucauuuuuuuccuucuaccagaguaugcuacuaguuguuccauuuuuaugcugucugaagauacucuuuuuuaaauagacuuuuuuuagagcaauuuuagguuuacagaaaaauugcacauaaaauaguuuccaguuccuucccaccacccccugcacccaguuucuccucuaguuaauguuuuacauauguggaugcgccuucuuuucacuuccaucauuccuuuuucuuuuuaaaaaauuuaacaugccagacuuucuaccaccgcugguaucacuuaugugagauuuacaucacuuuacacacacaccuuguuaagugugaguucaguuuuuaauaguacaagugcaguuauuggugagucucaugcuacuguguuuguugugcuuucagauccuauugaucaucgcuucaguuauugggaucauugucuauaggcucucgguguucauuguauuuucugcaaaacuucccaagaacauuaauggaacagacccaauccagaaauaccugacuccacagacagccacguccaucacggccuccaucaucagcuuuauaauuaucaugauucugaacaccauauaugaaaaaguggcaauuaugauuacuaacuucgguaagguccuacuauagcuuagguaacuucugacauauuuuuagaaccugccaaaaauagagacuguuaucuuuuaggcguuucaauuccaguagguuacaauuuuuagaaauuuucaaguguaaacauauuuucucuagcauguauggaaauaaauuaucuacagcuuugcauuaguaaaagggacaaagcaaagacaaucaucauaacguccaagcucucuguaaacagaucagugcugaauaauauuuucaauuacauuagaucauguacucuauuguugaaagucaauagucucuuuauugcaaauaaguggaauagggucaugguuccgguggcaaauauguuccucgguugcugagaggacaagcuaucacacugcuacgugucuucccugugcugugcuguucauauuaauauaauucucaucagcccuugauuuuuuaauguguuucuucucucuggcuuguaucccaggcagcuguuuaguggccaaguuaagugcuucccacacugcauacgucugagucguucccugaauggccugcucggugaucaucuaaaaugaucaaacugaugcaaacuccacacuaggaggaugaccuauuuuguuuuucccaaaugccucuagcaaguuguaccuugguuugcuuguuuucuucaauagaccuaccuuaucgcaauucaggaaaacaagagaauaucauuuagcaggcaguucaaaaauaauuuucugucaauuauacccauggcaguucuuauuugauaacacuggacuuguaaauuuuaaggaacaguugauuuuuuuguggggcaggggggaacaugugggcuauuguauuccuacugugagggagaacucauaacaaugugcaaacuuggaauuaacacaguggcuauauuaaggaauucaaaacagcuuaaauggaaacagugugaauuguauuuuuuuaacguguuuaacguguuaacucauguaucaguauuuuuuauuagagucucaaagcuguucacaauuuuaaaaucuuauuucucuuucuuuuaacuacagaacucccaaggacccagacugauuaugagaacagccucaccaugaagauguucuuauuccaguuugucaacuacuacucuucaugcuucuacauagcauucuuuaagggcaaauuuguaggcuauccaggagacccaguuuauugguugggaaaauacagaaaugaagagguaugaauauauaauuguauuaucuugccaguuuaagcugaguuuucucucaguugcccaaaugaauaguuuuuuauuguaaauuccuuagauuuauuuuuuagccuaaacagaacaaaugucagaaaaauagaaugccuauauuucaaguuagauccauugaauauuuaaaugguauuuucuuuuuaaccuucuagugugacccagguggcugucuucuugaacugacaacucagcugacaauaaucaugggaggaaaagcaaucuggaauaacauacaagaaguauuauugccgugaguguuaaauuguauagccauggguaaaaggacaagggauagaacagcccauccacacaaaucauuugccuacauagccacauagccacauagcugcauguccaccucuaaauggaucagaaucuguugucauuaaaggucuccagacaacauaguccaaccaacaaugcaaauguauccaggaucuaauaauuguauuuuaaaaccuucauuauauuuaauguaaauccccaucugcuagaguuuauaccuacugggcuauuguuggugacugacuaaucacaacccuuugagcgacagcacugguuagagcugugaacuguguauuuccacaauuucuuauauccucauauccuucuccucucuuuccuauauauuaugcauuuaaaagucaguaugaauuccagucacuauauuaagugcuauauauauauauacaucauuuaaucuaccaaacuauccuuauuuuuaucuccuuuuuacuaaugaagaucugugguuuaaagagguuaaaugauuuacccaguuucacauuagcauuaagagacuacuguaggauucaaauccaggaucccaugaguacaaacuuuuaagaauagagguucuuucaugauccuaaggcacuaggauauauaauguuuuaagaaauaauugucuaaaauaauaaucacaaaggcuuugacuuacuguuguuuuccuaaaaaaugagaacaacagaauaguuguacuucaaauguuaacuaagauuucauugcccuuuacaauuuucacuuaggcccccuccacuaucaaaguguaaaguccaacaccaucugcaauuucugcaaauuucagggagcuuuuuguuuggguuuucuauugcugcuauaacaaauuaccccaagauuaaugggauaaaaauaacauguaauauuuuauggucccgggggucagaagucucacuggacuaaaaucaagguguuaguggggcuguguucauuuccaagggcucuggggugaaucucuuugccuuuccuagcuucuggaggccaccaucuaugcucccugccuuguaaccucuucuccaucuuaaagccagcaaaguuucguguuugugacuaucuucuguagucaccucucccgccuucugucuucuucccccuguccuccuccucucaucucccccaccaccucuucccuuguuuagaaauaaaaaaccucuaccuuuauaaaaagucuuuuaucccacuauauagcugggaauuuuuuaaaauuuaucacccuucuuuacaggcucucgccuccugccauguugcccucuugccuccaucacauacaacuucucucuccuuucuucuccuacuccuggcuuuuuucuccccagucaccaaguuucuguucauucucuuuauugagcaguuaacucacuccggguuucagugccuccuuccagauuucuuuaacaggucuuauucuccaucuucaauggaaacugucagggucuuucucuaaacaaagaucucucuccuuccucuucccccacccagaaagggauucuggcuuuagcugugaaauucuuuuuuuuuuuuuauccuacuccggagaaaacaacccucacuuucauugagcucauauucagauuuuuccagauaaguaaaaguaggucaugcauaaauaguacuguguuucuagaugaaaacaaauauauaaaauugaggaaagucuuaauccauucugagauuaaaaaggguuuucugaaaaaaguagguuaauuauuuaacacuauguuucgguaacauugguuuuuagcagcuauuuccuaaacuggaauugagaaauucauaugaaaugaaauuuguucacaugaaauauuuuaaaggaugaauuauacuauccgugguuuauacuuucacuucaaguaagcucauuguugaaaauuacagugauaugaacuuugccuucaaauuucucccccuauguuuucuuguuugaaaacugagaaugcugaguguuagccaaauuagagagugacuggugcugcuucucuuuguguaggugccaguuuucuuaacuuuuuuauacaaaguccuaauuuaucaaagauauaucagccaggugcugugguucacacugguaaucccagcacuuugggaggccaagguggucagaucaccugaggucgggaguucgagaccagccugaccaacauggagaaaccccaucucuacugaaaauacaaaauuagccagacauuuggugcaugccuguaaucccagcuacucaggaggcugaggcaggagaauugcuugaaccuggaggcggagguugcagugagccgagaucgcaccauugcacuccagccuaggcaacaagagcgaaacuccaucucgaagaaaaaaaaaagauauaucaguuauccuuucuauccaaaacuauacccaccccccaaaaauagauagagaaaagccuuauaagucagcaguuguuuucacaucguguaagugugucaagagaaacauggagaaauguuucaccacacauguacccuccucuuccuuccuuccucucccgccuuugggcccauaccccuugacuaggauucuugcaacaaggaaaggagcauaucuggcucagggauccagguuccuuuuggggccuccccaguaccuggcauaugacagggacucaguaugaagcagcugagugaaugaauaagugccuuguaugcuucagauacaucacaucaguaaauuacagaguugucagugagacccggagagcaagcucagagcccuuuggccuucccagcuccaccuuaguguuuugauauuuaagguauuccuggggauuuuauucuguucuuaauaaaaggcuaguauaauuccuguguuaacucacucuggagaaauuuuuauaacaaaaugucagagauaauagaauuaaggauccaaaaugucuguaguaucaauuguuugguauuuaguagauagcuauaauuuuccuuuauauacauuuauacauguauauuguaacauaaacgccucuucuuauauaaauaaguauacuuauuuauauaauaagaaaaaagaacuguuuuaggagaaaaugucccuucucaggauaggauuuggagagaagaugagcuauaggcaaucagaguccuaaauauaggugucccucacuauccacacuuacucucuagguucagaaacaguaaacugacacauaaaauagauucagauagugaaggaugcuuguauuucaaaauuagcaagugggaauacuguagaacguccuaaacagaaaugaugaucaucuccauuauguggauuaaaugugauaauggaguugaagaggaagugagauguaaagugcuucucaccauguuuuguacaaaauaaggaccuaguaaagcauaacuuaugauguggcuaugacaauacacaugguaaauuccuauggaaauuauuuuguaaccccugcuucuagccuuggccagggaaaacguaucugguguguauauuuuucuaaaaguucugugggugauucucaugugaagucaagauugagcucccugcacuagaaacacagaccaauagaaaacccaaacaugagugguucaacucaggaaaaccaaacaagaggcucagcaucuguaacucagaaaugaaagcuaguaagaaagacuucuaagaugaccugauaugagacggaagcgccagcugacacaaguaguugccaggacagaaguuucauccugaaucugagcuuugaugugauuuagagcccagacagaaaaagaccugcuucucugagggcauggaaaggauucagcaagaggcggaggcuagaaguuugggaggcaaagcaaaguauaaacaaauagaaaccacacccagugaccuuagaguucggugucaugaagggugauggacaugugugguccuuggugcuaccugagucacccccccccccccccccggaaugacugcaaaacugcagauucuggagcuuaucucagaccuuuuaguugggagcacaggaagcugcacuacucacaagcauuccaugucaugcuuguaugugcugaagugggaaccacugauccagguggccuggauaacugagccaagagucuacguaauauaggccauauuuacacuuggccucagccagugcagccuguauugcucaacagaaaaucccauucagcagguuuugauguguuaggaaacgugcuacauccguuaccuauuuugaaucauuuaauccugacagcagcccugggcaauguagguuuuaucaccccguuuuauuuuuuuaccaaaguuaaccagcuaagaaauagaguguggauucagauucaggggugucugaacucauaucccauccacuuuccacagccuccugcugccucucuaacaucaucaaaaagaaagaaguggggaaagauugugaggucagagacgucuccuguaguagagauaauuuccccugaguaaagcuucaguagcagucagugaaaagugagcccugagaucaauagcagugggaaacccagcagagugagccguuuguacugccugucuuaugcuggcugggugugcacgugugcacaugugauggagaggaugagggucugccugguuuucuugcaauaacuguccuuaaccaucaugcgaugccuucucauugucagaguuugaaguccacacccacauguuuaaucagccaguguauccagauguuagaucuguauuuggaguuguuguuaugccucuucugaugacuccacagguaaaccacaagcuggcaguugcuugaggggacaacaguucucuaugccacaggugcacaccucauuuuacugccaacucagauuucuuuuccagacaaauugccauaaaaaggggggaagcacuuagccacaaggauucugagauagggaaaaaaacaugacauaaaaaagagacaguggguagcucagcggggcaguauccacggguggacagagcgcugggacgcaguccaggcuguuuucuccuagcucugcacuaugaccuggaggaggcguuucacuccucugguccuuaaaugauucagcuuaaaauaggaauuggaccuauuuuaucuaaagucagauuaugucacuuuccuacuuggugcccuccaauggcuccucauuucccuccgaggaaaaaaaugcccagauccugacaguggucucuuauuccuacccugcgugcugucugugaaccauggagaccugcuccugccucagggucucugucaucaccguucccucugccugggacuucuucccccagguuucccacuccuuugucuccuucacauccuuauucaacaucauucugaaggagaccuucacuggccaccucccuagacacaaaugcaagcacucccugcccugcuuaguuuucuccacagcacuuaccaccagcucacauacucuaccuuguuuucucuguugauuuucauacuggcaagacuauuuugaaugauaagggggaaaugaaaaaacaaacaacugaaguuaaucaaauaaaggaacaugccuuuuaaaaauuaagcugcccauagggaaaaaguaggagaaaaaaauaguagcagcugcagcuuugguaaacccugguguguaguccuauuuuucaaaauauuuuggaauaaggaggcagaaauaaaaacaaauuuagcaugcaaacaaaaaaauaguuuauugggaagauuacuugugcagcuuugagauagcagcaaaauauuuuuaugaccuuggccugauaauauucguucuaauuuauaaauuguucuuuuuggcagcuggaucaugaaucuaauugggcgauuucacagaguuucuggaucagaaaagauaaccccacgaugggaacaggacuaccaucugcagccuaugggcaaacugggauuauuuuaugaauaucuugaaaugaguaaguuguuagugaaguuuuuagugauauaaaacauguuagaguauguuguggauaccaaaagcaucuguuauugagccauauuaacauuuagcauauugaaaugaagaagaguauguuuuucuccacuagauaaaauuauacaauccagcuuucagauaagguggucauguaugucuuugucaauauuuauguuguaaaaagcuagaaauuuauuacugggcaaugaaauggaauauucauugagguacaucuuuaccauuaauucuuuuuguuuguuuuuuuugagacagagucucacucuguagcccaggcuggaguguggugguacaaucguggcucacugcaaccuccaccucccagguucaagcaauucuccugccucagccuccugaguagccgggauuacaggcaugcgccaccacacccagcuuauuuuuggacuuuuaguacugacaggguuucaccauguuguccaggcuagucucaaacuccugggcucaaaugauccacccaccuuagccuuccaaagugcugggauuacacgcauaagccacugggcccggccaucuuuaccacgaauucuuaaagcauucuaaucauguugucugagaaugaacucagcaacuguaauuagaugugauucagcuuggccuggaguccgugcaggcacagcuguuggccgauacaguucugaacugagucaguuaagcaagccugcaggagcaugcagcuucguggcaggaauggucccgggaugcccacuuucacaucucaugccugccuuugacagccuauuucuucuggccagugguuucugccugguuccuugagugacuucauggcucauaacuggccugaauuuggaaccauugugcuggucuggaauuaagauuuagcacagguccucucuuuccuaaaugccuugguccauuuuuauauuauuugcuuggacucuuaauucuuuucaguagaacuugauuuugaccucucaguugccuuuaaacggaagcaucucaaaauagauuuccauaggaaacaccaccuuuuguauuaugcaugacacgcuuauaucuaauagauggcuaacaauuuacaugguuuuuaucugugcccuuucagcuaaccauugcauucaauuacaguuuuuuuuaagcuuaggagaauagaaaaagaaacacaucauuuuuguugacaggcuuugcauuuaugcacagggcuuugcauguuggcaaagacaccccuuugugguuccuguuuacaagucugcaguuagaaggugguuuuuauuaaaucacauucuauauauaaaauaauugcuuuuaaaaauauacauuauacauggaaacacaucugcuuccuucaaugaguaaaagguucaucuuguggcuucuuuagucaacaguacuuugcagcagccuggagccuguuuugaauuucauuuuugcuuuguuauguuuugugaccagguuuuauuaaggguguagcugcaguacauauguagaagcuguccuuaguuaguuauuauucugcugauuuucagaaggacuguaagacaauuaccuguuguucaaaaaugagucauaauuguaaauauuucuuauuggaacuauuaacagcauuuuuaaaaauccuggggcagaaugucauuuauuauuuuuaaaaaguuauuuuucuguaguugauuagucaaauaaaugacaucagaagggaaaguuauauggucaugugcuuuggggagaaguugauaggacuuuuagaguuucauaggcucuuuaaaauaguuaucaaccaaauaauucugccucauccugcccuacaagaaaguauagaauaacagcuguuauagacagauuuuuagguuuauuagguuguuuuccuguuaucuaaauaguaucuaaugacuuagaaaacuugauuucugaauuucugggaguaggcagucugucacugugugggcaacaggagagugaaaucuguguuuuguccuucuagucugugagagacauaauuuccaagugccuuuugaauuguuuucauuucccuagaaauaaacauugagugccuuugguauuggucucaccaccacacaguccccuccuucccauuuccccauauuccuuaacaacaccaccaucuaccuuuuaaauuguggcucuaacugcuuaagggaaacaucuuccggaaagcaagccuccaggcuugcuuggccuugcacccaggcucaacucucuuuccuucuuuccuaccugacaaguccugcugagccucagcugggccccugaacuuuucagacagcuuugcugcucuuuucuucuagguguuagcagcaccugcugccugccguggugguauacgcucugugccugccucucuccccauugcaccgagcccgauggaggcagcuacugcguccucugcuagagcgccagugccuggaaccuuauacucauaaacauuuaagcaacuugaacuuggagcuccaacacacauauaaaacuguuaguugauuucacauuaacauccuucacccacuucucaccaaguucuguaugaccuguuugagugaaacguuuuuuauuuagugaauuucccaccauccuuugagauuauuggaguaacucugagcuguuaacccaaauugcuucucuaagaguguuccugacuccaaguacacagacacagaacauaauaaacguaguugucuguauucaaaccuggaagccauaaauacuguuuuguacucaguaauguacugcagacacagguguccugagaacuugaugaggccuuccuggugggcaagugccauaaacagagugcacugaagugaugagugggcccuguuugucucuggcacugccucuuccacccuugccgugguaccuugaucucacuuucaucugucuccaaguuaauuuuuuaaaaucugcuaaaacaaugaccuucauauaugauuuucuccauguaaugaagaucagcuauucuucagcagcuccucguaccccuuucuuuuucuuccuccuaugcugaacccaccgaugccucugcugcacucuccaggacucaggccuucuucccuucaugcucucaucucugcuugguucgagcccaucaccugccaugaagucuccuaaccuuugcaggaugagcuuuccaaaagggcaacuagguaauugggaggauuugcaguccuccagcucuucauuuguucauucauucauucacucauucauccauuaaacauuuauuaagcacuugcugugccaaacacucucaguugcuggggauaccagggcacuuggucccuccccucacggagcucagcgcuuggugcaugguuaaggagaaugcuaaucagacuuccuugagcaggugauauuugaacuggauuuugaagggugaauggaaguuaguuaucuaaaguauggugaagagaauggacauuuuguguggagagguggacauauuuaaaaguacaauagcuugaucaaagaauggcaagugaacaaaggacucacaggugggaauaucagguaggcaggggccauaucaugaugggucuggugugcuuagccugaggacuugaacuuuauucuuaaagaaauuaggauccacuggaauauuuguaaacaagauaacugcauaacauuuauguggaauaagaucaaucacgcagcagaauggaagauaauauuuuggaugagauucguggugggagggagaugauuuaggaggcuacagcagguaacccagacaacaagugauaggugccuaaauagugggcauaggaguagagagagggagauggauuugguaaguguuaaagcggugaauugcauagcagaugaggaauaaaauuaagauaacuuccaggagaccauauaugcagggcagaacauaaggagaggagcuguucucuaggaaaugccuaaguguuggauauuuuuagcaugaaaacaucugaaaggcaauguccauuagaaaguuggacacaacagucaggagcucagaggagccaugggugaggccacgagggugaaucaggcaugccuagcaggaauaucaagagagauggacagagaauugaugaugaggcccggggguaaagggacauuugaagagugaagagugagggaggcucacaaagaaaaagaagagcagagcagugggaagaagucuagcagaguugugucaacacagagaaggcuugggagaugauaacguugcuucagaggaauuuggacaugauggaaaaggggcauaaugggaaauacagagggggaagaaaggaagagccagcaccuacacaaguccuaauugcuagaccuggguugggaaguggaagcagugcuauagcuagguagggcuuuuuuaguuuuuuuguuuuucaauauauauuuugacuuuuuaaaacuaaguaaaaaagaaaucaaggggaaacaaauauuccacagcagggggacuguuugaccaugucacauaaaucuuggccguacauuucuuauggccauguuacaagaaaucacaaaaaucaggacugaaaaggaacaucagcuuaugaacaugcagccacuggcaaaguuagcaagaguagguccagugcaguggugagggucucagcaggaugcggggcuucagggaguaguuacucuaccacuuguugugaagguggacacuuccuucagaaaacucaacuguaacauguagaagcaagcagagaaagcauuagagagcaguauaggauuaugaaaaaguugcaggcaaggguuguuuuuuuuucaguggguguuuugcguugacuuuuuguuguuguuauucuugguuucaaaaguugcuuauaaaauuuuucucacuugaauaucagaacaaauuauaugggcuuuuucugguguuuuauuuuuaauauaauauuuuuaauccaucuggaauuuauuuuggugucagaagugauggccccauaccaauuuuucccaugacuuagcuagcugugucaauacuugcauccacugcuucaaaguaucacuuuauaauauauaaaaacccaugaauauuugcaucuccucuuaaaauucacccugguuaauucauacuaucuauucauauacuaguucuaaacuguuucaauuaccauagcauuauaauacacucaauaucucccagagcuaucccauuuuauuuuuucacaauguucccaauacugucuaugcaaacaucccuguucauuauuuuaccuguuuauauuucuugaagaacuuuaguaucacuuuucagcuuuucuuuucuuucuuugaaagacagggucucgcccuguugcccaggcuggagugcaguggcacaaucccggcucacugcaaccuccgccuccucaucuaaagcaauccucccaccucauccuccuggguagcugagacuacaggcucguaccaccaugcccagcuaauuuuuguauuuuuuguagagacaggguauguugccuaggcuggucucaaacuccugggcucaaauaauccucccgccucagccucccaaagugcugggauuacagagauuagcugccaugccuggcugaccugucagcuuuuuuuucuuaaauccauuugggauuacuaacagaauuuacauuagaauucuaaauuauuuuguggaaaaaaaauuugauaugucccugaauucaaguuugcccaaucaagaguuuggcacauccuaccacucauucauucaucauuauuuguuuuuucuuaagucaauuaucauaguggucuuaguuuucucauuaauuuauuucuaaauaguuuaugcuuuuguugucauuauaaaugguaucuuuucucuuuuggauuuuuaacaagguuuacugauaacauaauccuaaucucuggcuucucuugaacaaucaggagaucuggcaacauggagcccucauuccaacauggcaacuaugagcugucccuuuccauaggacacacgcuugcuaguuuaccacaguugacgggcugacuccacacauggcuauuacuugcaugcccugcgggcugaugaguuauuuaggguugggugagucauagggaaguugacaucacugcuuauugcugcugcucaugacucuguagcaucaccaacucugguccuugccuggcugacuucucugcaugaguguuccugccuggccugugggacuuacuggauccuucuagcccugucugcucuucugcaacaugcccuuuggcucucugaccagaagcaaaugccagcucugcuugccucgccacacccuccacagccuugcccuuccugacagagucaucccugccccuugucugagcaugaggccuaauggaacucuauguuuuccucccauccacaguuuuaguuacauaucuguagauguuuccucugaaggucugccaguuaggagggcagggucuaaaacuugaggauauuuucuuacuucuuccucuccgugguaucacuuaccccaaaaucucugcugccccauuuuuaauaaggccgugucaauuacaaacaaggagaaaagaacuucuaagccaccacucaaauuuugacuuauuaugaccacaaggacugcaacuaacuucaagauucuuaaggaaggauauuauaauuuauuaagacacuuuuaucacauauauuucugugauuucuauuacugucaaauucucugaaugcacugcauuugcauuugcagacucaggggagcucacucauuugcuuguucucagcauauuucuucuaacguucucuaaguauagccuucccauggguccauuucuuuuugucuuuaacuuguuagauaaugccacaauauuucuuuuuucuuaaaaaaaaaauccuaaaccacaaaucuucuuucaacauucuauuucaacacugagaaugaauaauaugcuuaugaugucucaaguuuauuaccagcgaauaauucugguugacuaaagaugucuaaauauauuguuccuauuaaguguauacaugugaaagaaacaggcuauaauuaaucuucuuuccagagauuuuauauuuguguuuuguuugaauucuuucacuguugaacacuaaauuauuauuuaccacagauguguuuucucucugggauuuaguucguuugccuuucucuuucaagaguaaaggaaaauauguuguccuuccauccaccaccacuccaugauguguguccauuccauugacaguuauucaguuuggguucgucaccuuauuuguggccucuuuuccacuggccccucuguuggcucucgugaacaauauauuggaaauaagaguggacgcauggaaacugaccacccaguuuagacgccugguaccagagaaagcccaagacauuggagcauggcagcccaucaugcaaggaauagcaauucuggcuguggugaccaaugugaguagaccuaagcuuuacagaguaaagaccuugaagaugcauuagauuugcuaccuaaggaaucaaauguuuaguguuuuuuaaaaugagaggaagaugcuaagucugucauccacauaaaugauauaguugcuauauauaaccacuuguuaaauguauuuucauuuuguauauaauuauuuuuaacugucaagaccuccuauacagguacuguuauugcucauuugcuaaaguuuuuauucaguaugaaauaugguaaugauaagaaguacuaacacuuuuaauccucacauaacuauaaaaggaguuaucagaaaauguuuuuuuuauaauguggguagaaaucuguucauuuagaguuugagggcccuaaaauaagaucauucuaccauauuuuacuacuacauauuccaaagcaucacccuaaaauauugacucugauggugaaguauaaacacuuugugcacuccuaauuaccuuccuugacuccagagcagcagcucuuaaaggaggaagguggguggguuucaucacccuucccaccccacccuuaggucuuugcucaccaugcuuuggucauuggcugaagcagccucaugcccuguauguaucccagcugugaggggacagaacucaguuguuuacagccuguauucauugauuaugggccaucugaacagugucauuuuuauguacaggcacacaggaaguucucaggcaaugcaauuuucaugccagcccauuagaggaccaccuucccaagaaguaucccaaaacuagggccauuuccucccauauuucacugacagucucacucccaggugaaccucccuaacaaagugauuccccaguuuuguuuucuuaagccacaucuucccugaguccccagccaaaacaacagaaguuggcagugccuguaguuuaggcucuggaugagggaaguuacugagcacuguaggcucuagagucagguagacccgaacuccacuucccagcacuguagcucugagcugcaugaucuugagccaggccuuaccacuccagagcccuauuuuauuauuuguaaaauuauuaauucccuaccacauaucauaagaauaguacauaccaaccacaguguuagggaauucauugaguuaaugcaugaagccucguuucuauugaauguuagcugcuguuauuuuaucaucuucauuacucaucauuguuauuaacaguaacgcugugaggacucugacagguaccccaauuggaggcacaggaauuccaaaagcaaccacugucuggacaaugguuacaguuuuauacaauaaaacaaguuaucuggaaccuagcugucaucccuaccccagaaccguacauuuaucugaauugcaugcuaucuguacuauuuggagaaaguugcaaaucgcacacaaaaaccaacuacugggguaugucaguuuccuuucacccagguaccccacaccuucaacaucuacugugcugcaaaaugaagacugcuguuuagaaaaauggcagugaggccuuucaaguuccucagucauaaaacaaugaacaugacagcacguucaauaugcucuaguacacuaagcuggacaagaacauggacuugugugcuuuaagaaaauuuucagcaacaaaguuugaaacuaaaaggguuuuuauuuuaccuucaacuaaccagaaaauucaguugacucaaacucucccuauuccucaagcauucuagauugauuguauuagguaccuuuucccagcauccaugccauggcucuacuccaugagcacagauggaggauuggcuguuuccaaggcgacucaguguguguauguguacagacauucacucuggcuaauuggugcuauugguucuuauccaauaauggcuuuuucuuaucacuuaaccuaggaaaacugcuuauuagauuugugacauugauuaaacuaugggcaaucccuuuuuccauauuaggauuuguuauacuuccaagauggcaguuauacauccacauacauagacaucuauguuuauaugugugcuugugcaagcauuaaaugugugucuuauucccucaaacacccaguguguaucucacaaccuacugucuacaaaaagagaauaaccaccaggaugagagugggcaucaagcaggaauuugguauaaaaucauucauuuuaaagcugcugguucaauaaauaagcugaauugacauuguuguaucaugccagagcaucuguuauugaagaccaauuuuaauuuauuuuuauauaaauggaaaacugugugcagaacagcaugggaaaugaaacacacugcauuuauuugugcucuugcagcaugucucucagagcagcucaauucaggaagaaaaguaucuugucagaagacaauagaauuaucuuccuuguuggaauuuuuuguagcuucugaugcacaucugccagugauucuauaaaaagauauaguugaguuaaaugauaauagcaaaauuuaaucuauugaaaucugagggaaaaaagguaaaauauucguguggcuccccaguacugacaggcagaaacacacucauauguauauguacauuuuucacaucagaggaaaugacaaagcugguucuagugagggaaauuuuguaauagaaaagcccccuaauuguuuuuucuugcuuugccugagauuugguuuguggucucacuaugccuaaaccauauguucagaugaauacuauuaaaaaucauguuaagccaaaaacaugucuacuuuucugcuucaucaaugacaaucauuuagcuguuuuauucacauagaauuugguuuaaaguaaaaauccuuucuccuuccuuccaaccaguuuuacacacuggagaguuuaaagcccaaauuaaagaauuuuagagaaaauucauauaauucagaauagcuuuaccuccuaauagaugucucucugauacacagguuuaugauuggcccauauuuacuccuuuuaucuaggaacauacuaaauuuucuguauguuguuguucaacuuauaauuuucauaacuucauccacuuaaucuuuuugaaguuuagagacuuagauacuagaucagacuaaacagacauuauuguuugacuaugaaugggacaaccccaauauaauucuacuacccaaauuuuguuaaaauuaauaaaugcucacacucuauaaugaagcaacaaacauaaccauguacugagaguuuaaaacaaaucaggucaugguuugacuuguguaaacaagucauaauacuauacaggaaaaaagugaacuuagaggucauuauuuaaauuuagaucaaggaaaacaugcaguuuaccuucuguguuuaugaaaagagcuaaaucaauuauauaaagcucaauuauuuucauaauguugacucugauuacaugugcaagucuucuaggcugagaucaguggcucguaccuauaaucccagcacuuggagaggcugagaggauugcuugaggccaggaguuccagacuaggcuagacaacauaguaagacccuaucucuacaaaaaauguuuaaagauuagccaggcaugguggaguguaccuguaauucuagcuacucaggaggaucacuugaaccaaggaguucgagguuacagugagcugugaucaugccagugcacuccagccugggcaacagagcaagaucuuaucucacuaucugcauauauuuugcaguuaagaaaaaauuaagauuucugaaucuuuaaaaaaaauugacacgaugaaaauaguaauucuggcauauuuguuaaccugaccuauacaaacuauaacuucggccaggugcaguggcucacgccuguaaucccagcacuuugggaggcugaggugggcagaucaccugagaccaggaguucgagaccaggaguucaagaccagccuggccaacaugacaaaacccugucucuacuaaaaguacaaaaauuagccaggcgugguggcacgugccuguaaucccagcuacucaggaggcugaggcaggagaauuuuuugaacccaagagguggagguugcagugagccgagaucgugccaugcagccugggcagcaagagcgagacuccgucucaaaaacaaaaaacuauaacuucauuuucgcuuuguuuuucucccaaaauaggccaugaucauagcuuucacgucggacaugaucccccgccuaguguacuacugguccuucuccgucccucccuacggggaccacacuuccuacaccauggaaggguacaucaacaacacucucuccaucuucaaagucgcagacuucaaaaacaaaagcaagggaaacccguacucugaccuggguaaccauaccacaugcaggcaaguucugcuuuacuuguuuaaaaaugcacuucaucuuuaaaaggguuuuucuugugacuuaauucuguuuggugucauuuuuaaaauuuuuauuucuuuauaacuucaggaucaaucaggugcuuuggugucauuuaaaucaagcugcuagagacauuuuuuccccauagcuuucucuugagugaaacucagaaaauguauauauauguauauuuauuaaaaaguuaaugaagacuagggguaaaacuuucagaccagggguaaaacuuucagaccaaaccauaaagauuuaaaguugagaguuucaaacgauuacagggagauugauuccaaagaaaagucauagaaauagagaaacuucaagagguccaagaaccaagauaauucaguuguuaauacuauuguguuauucaagcacaaucugaagauauugaaugauggcaaacuagcaccucacauaacagggacauacaaagauaagagaugugaaaucucagcugaacaguauuaucuaaaaauauuccaaaguucucugcaucgauuuuaauggcuggugaguucaacaguggacaguauguaccagguaaauuaccaauugauaaaguuugugaacuguaggucaucaaccuuuuuuccuggaccauagaguuuuaccuaaaauaggaggcuuuaaaguuuauuuaguccaacuccucaaagccuucacuaacucagauucucaaugaugcaaccaggaaaccagaaauaagcccaaaauaaauguuuguguuacaccuaguggagccucuuuacaauucugcaucaaaucugcuuauucuuacuuuccacaauucuaaucagaaauuaaacucuucuagguuuaauagcuuacaggcauaaaauuagagauguccuaccugaggaagauacacuaacagcaguuaacacuugauaucugacaacaaagaauuagguaaaaaauuauaacaagcagauagcacucuguaugaggagagagagucccauagcugagugaacccugaugauaccauuauauaaauaaauuuauaaauaugauccccaaaacaggaauuguuuugagaaaacagggauaaauguugggagaacaaauuuaaaacuuuaguucuuuuauaaagauggauucuuuucuacaaagauggaccauguuauuaccaucauucucugauuaaauauuaaaugaggcacuacuguaguuauuuuggggcuuuguuaccaaauugagcuuuaagagaaaauguaugugauguccaguuuaaaagagcauugaaucaaauaugacuuuuuuuuuuuuuuuugagacagcguccugcucuguugcccagacaggagugcagugacaccauaucagcucccugcaaccuucaccucucggguucaagcaauucucaugccucagccaccaaauagcugcgauuacaagcacgugcuaccacaccuggcuaauuuuuguauuuuuaguagagacgggguuuuaccauaguggccaggcuggugucgcacuccuggccucaagugauccacaugccucagccucccaaagugcuaggauuacaggcaugagccacugcacccggcaugaccucuuuuuaaauggggccuuuguuuacaguauucagucaaaaagauuugucucccaauaugucuccauuuuguuuucagguaucgugauuuccgauacccaccuggacacccccaggaguauaaacacaacaucuacuauuggcaugugauugcagccaagcuggcuuuuaucauugucauggagguaggaaaaguaugcuuucaaacaguuuauaaggauguguauuugcagaccuuccauuaaguguugccaacuccauacuuaacaugugugauacuuucuucuuaucacuugcuaauauuuuaggaaauauguuaaucaguauugaccugaaaauacucaacuucauuaacgagagcauuaucugcuuuuaaaguuuaaaagcauguuaugcgcaaaggggauucaauuucauucauuacuaacuuuuuaaaauguagggcacugggcagcauguugggcuaugaaagggcuuaugcaagauggguacgaugaugugaucucugccugugagaaacuuuuauugcugggagaguuugaaauugaccagcucugaaaaauuacuaaggcaacuauaaauuuguaauugaucuagccaacugugcuuccuaugcagagugaguuaacuacugccaaauuacaaaguaucagaguuuaauugcuuaauugguaugguagauaggauuguauuaagcugcaagaaacagaaaaugcagucuaugguggcuuaaauaagguugauuccccuccccacaaccuauaugauagaguucaugaaagucugugguugcuccugaaucaaucaauaccaguucacugauggaagcagucuauccaauucuuggguuugcucucauauauguguccccuuuauggcugcugaaauuccaguuaaaaaauuacaugcaaagcaggaagaagggcgaugcuaaccacauccaguccuuuuugucaggaaagaaugcuuugccagaagccccuacaguggacuuccaccuacaucucauugaccagaacuauagcaugugguuuuccuagcagcaagaggggcugaggcagguggauuucauuugcucugaauaaaaccaaucagcagagaagaagugggguagacuaccuggauuuuugguacuuauacuaguucuuuuuuuuuuuuuuaaauagcuaccaaacauuaaacagggaagacaaguaacucacgguuaguaucugacucaugucaguaucugacauaucagcaagagucacagguuucuauuuaaacauguaguugaugaagugauuggccuucuccuuuugauauugugguagauuauauguuguccuuacauaugcaguggaccauccccacugcaaaacuucuagagccagcuagauaauuccuuugcauugcugagcccacuggaagggaagagaaucuacagagagagggaaaacuaggugauggguuuuuuuuuuuuuuuuuuuuuuuuuuuuaaagacagagucucacucuguugcccaggcuggaguaugaugccaugaucuuagcucacugcaaccucugccuccagguucagccaauucuccugccucagccucccaaguaccugggacuacaggugcacacuaccacaccuggcuaauuuuauauuuuuaguagagaugggguuucaccauauuggccaggcuggucucaaacuccugaccucaagugaucugcccuccucggccucccaaagugcuaggauuauaggcaugagccacugcgcccggccuaggugaugggcuuuaauagggcagugagcaauaagcacucuuguagugcuggaggucucaaagagcaagcugguacccaucagugccucuaucuuggagcucaaggagaccaugccuugggucagaagggagguggaaaaacugagcuugagauuccuggauaagccagagacccaaaacagggcugcauuugccucaguagaaagaaguguguaucuucucuggagaaaaauguccccagguuuuucucagaucaagcuaaucaaauaugagcacacaaccaaagauggucaauaacaagaggugauuuaaaaaaaaaacaaaaaaacgugugagguucagcaggaaacaacugauuuggacccucaguaaccucaaggguuuguuugaacugucagauaaggaauauaaauuaacuguaugugaaaacauuuaaauaauuauggguagaauuuaaaaagcaagaaacuaaaaauuauaaggcaauuuugaaaaaacuaaauggaacuucuagaaauuaaaauaaaaucauuggugaaauggaaaaaaacauggauuaaacagaaguuuaugcaaaucugaagagagaauuugugaauuggaagauaggucugaaaaaauuacuccugauauaucacagggagauaagaaaauagaaaauaugaaagagauguuaagugauauggaagaaugagaaauacuaacuuaaagaagcugaacauggauaaaagaaaugaaagaguucacagaucagaaagcaugacaugcaucaaacagaauaaagaaauccacuuacacauauugcaaggaaaaugcggcacaccaaaaauaagaccuugaaaguaaccggagggaaaaaacugaugacuaacagagaaaacuaaggcgagaaugggaguaagcuuuucaacaguaacaacggaagccagaagagaguagucuaucuccagaaugcuaaagaagguagcuauaaaccuuaaauuacagcagaaguuugaaauauuucuacaaugaaaacaccagaccaugugguuuuuauuggagugauaccaagcuuuuuaaaacagaucauuucaauccuauacaaaugccuucagagaugagaaagaggaaauacucuccaacucauuuggugaggcuaagaguagccuaaauccuaaaaucagacaagaagagagaaaggaaaaugaagccaacccuauucauuacauagaugcaaagaucuuucuaagauguguaaagugagaugauggacauguuaauuuguuccacuauagaguaaguccucacuuaacauccuuauuaggcucuuggaaaccaugacuuuaagacaacaacuucuaacaaaaccaguguuuuuucuaaucaaugcuguaacgaaacagcauugaaggaaaugacguuauucaaggaccuggaguugcaguuuccaggaaccugucgaugauguugagggcucacuacauacaugugucuuacaacaucauguuguauaccuuuacgcaaaauuuuuaaaaauguacaaaucugaaucuagcaauauauuucaaaaagauaacaucaugccaccaggcuuuaagcuggaaaugcaaggguggcauaacacagaaauuccacauaucuauaaauauucccuaccucagaaauagaugaaagaacucuuuccuacagcaucaaccuuugucgcuuuacuauauaauuuccauuaucacuaaacacacuaauaucucucacaucucaaaauucucuccauccuuaccucaccaguccugcuucacuucucuuuuccucuuuguggccagcgccguugaaugaguugccaguacaugcuguccucgauuccucuaucuuucuaucaugcuuucacccccuccacuucacugaagcugcucuugccaaaguuagcagcagccaccacuuccccaacccuccccucaccugacuuagcaacauuugacuuagcaaaaaucugagucaaauuuuugcugaaaaucugacuucagauuuuccucaucacuugccccuggaaacuccuccucacugggcuccuaggaaaguacgcuuuccuccugcgucccuggccauuccaccucagguucuaugccagucacuuauucucuuagugauccugggacucaucccuugguugucaucuuuucucucuccuuggucuguugaugaucuccuggagucugcuggcucuaaauaccaucuguaugcuaaaaggaccuuaaaauggcuguuugcagagcaccccucuccugaacuccacccaugaauccaacggccuaccugaccuuucugcuuggaucccuaauagaugucucacaucugcugccccacaugccuauauuuuccuccauucacuccaaauguucuccucccaacccagcccaaaaucucucccauccacaguauuucccucuugauuauggcaacuccaucucaacacugcucaggccagaauccuuggaacccuaaugcuauauccaaucugguuggcuuuuccuuuaucagugagcacuucagaccaauugugcugcuaccaccaggucagagccacuaucauuuuuugccuggauuagggccagagucuccuagcugggcuugcccuuccucucucacucagagucagagccagaguccucacaguggcacacaaggccucauggauccagccacgccccagugccccucagacaucacuucucuucucgucaccugcuccgcaccauccuugccuuuucucgaaugcauucugaggcuccuccaaaccagcucugcauuggcuauucccuuuaccuagaaugucuuuucuucugauaucuguagggcuuguucccucaccuccuuaaaguguuugcucacuuaggcauauccagacuaaucuacagaagaaucucuucaaaguacucaucacuuuuuaacaccaugaauaauuuguuuuuaauuaugcuuauauuaucucucuccccuugcuaggucagagauuuuugauugauaaauuaaaaaaugaaaagguguuuaaccucauugguaaucaggaaaaugcagaguaagaccaaagggaaaguccauuucauaaucacuaaguugguuuaaaaaaaaaaaaaaaagccugauccagccugggcaacauggcaaaacccaaaauuagccgggcaugguggcagguaccuguaauccagcuacucagguggcugaggcaggagaaucgcuugaacccggaagauggagguugcagugggccaagaucgcaccacugcauucaagccugagugacagcaagacucugccucaaaaaaaaaaaaaaaaaaaaagguuugaugauacgaagauguagagcaacugaaacuauugcugcugugggaguguaaguugguauaccugcuuugaaaaauguuuugguaucaucuuauaaaauggaacauucacaugacauagagucucagcagucccacuccuagguccacacucuugagaaacuugcagauaaugcucuaggauucaagcacaauaauguucacaacagcauuuuuccuaaaacaaaaacuggaaacaaccucaaugccuguucauaggggaacaaauaaauuauaguguagucacacagaagaauauuauacagcagugaaaauuaguggacuaguuuuauagaauaacaaucuuaggaaauaguuuugaacaaaagguggccuggcgugguggcucacaccuauaauccuagcgcuuuggaaggccaaguugggaggauugcuugaggacaggaguuugagaccagccugggcaacauagcgagacccuguuucuacaaagaaauuuuaaaaguagccaggcaugguggcauacuucuggaucacuugagcccaggaguaggaggcuucagugagcuaugaucaugccacugcacuccagccugggugacagagugagaaccugauccaaaagaaagacagcaauuuccaaaagacugcaugcagcaucauaaaggugaagucaaggaagacuauauuuuggggguauauauacauauuuugucaaacuuuuuaaaaaauaagugagaaugauacacauauacuuguacagauaugauagcacugacuuuuggagaagugcaaggccauuagaaaaagagacacaaaauacaacagcauugucagcauccuaguuuuuaaguuuaauggagguuuuuugagguauucauuuuuucuuuauccuuuauaaccauuauauguguguauauauacuuuucuacauaucacauaguauuauuuaaauguguaaaguaacaguaacugcuagagccacacuguugauuagacacaauggcauuagcgguugguuguguguguaaaauguccacugccuuguccagauaaacugccauaaugacaagcaagaaugaaaggaacucgguguucuccuccauuucuuugugagugacauuuuucuucuucucuuccccagcacgucaucuacucugugaaauuuuucauuucauaugcaauucccgauguaucaaaacgcacaaagagcaagauccagagagaaaaauaccuaacccaaaagcuucuucaugagaaucaccucaaagauaugacgaaaaauaugggggugauagcugagcggaugauagaagcaguagauaacaauuuacggccaaaaucagaauaagagcuuuauguucugagaagcacuuuaaggaauuuagcuuugucaaaauauauuaggaaucacuaaugagaauguguaaguuaaaucacuuuggcaaauaugagucucaacuauugccauuuccucauguauuauuuuucaguuucagcuagcgaugcagaaacuggaaaauguaaaacuuagaucaugaagggcauaaaacuuaucacccggaaaaccucaauguuaccuuuuucugauaaauuggaauuuuacagaaaaagucccucagugugcuuaaaaaccaccccuucuaaaguagaauggauucuuuuuuuucuguuugauuauuuucauuucugucuauucucaggcgcaugaucuccuuuauuuuuaagccauguuucauuucuucacuuggcuagaucuguuccagggucaucuuuuccuuacaguaccaucauuauagauuuaauuuaauagcuuucaugugauuaaaaauagcuaacuagacucaaggauucacaauauuuagguguauuuucaauaccuccagaaaggaaaccucaguuaaucagaggaaauaguuucagucuucauuugagcaugucuuuccaucucaaaaaaauacucuuaguagguuggagugaagauagcaagguuuugaagcauauuuguccuaauccacagugacacuuuuuaucuuccaggagcacuccuaggagguuccgugccuaaucaauguugacugcuuugcagaucucaagggaauaaaaugacaaaagcagggaaaguuacagauucaaacagcauuuuaacucauguugaucuggauaauuaaucuuuucuaaagauguguaguuucuuggaaaacagugauaucacaugauuaaaauuacauuuuuaucaacauaauugucuggaaaagauaagccccucaauuuucuaccaguugacuuuuauucauuagauacagaaggugcaguauuacacaucaccagcugccuuugugaauggcucacuacacagccauugggguacaacugugugcaugggcagaaacagcaagugcccucauuguggucauuggguggggagugccuuuugucaaggagucugcaggaauuggcuuauuucuguaugccaaagugaucaacacaccaaagucucugccauaaagaauguggcuuccuugcauccuccauccuguuacucugggcccaguaauuugauguaacugucugauuguacuagagacaggaguauacccagcuuauucauaaucaaguaaagagacucagauuagauuugauuuuuuagccuccucuagagccaaucaggcaguuaagaguaauaaaggaaaaggguuuggucacaaacccuaccauuaucuggagauuacuuccugcugcacuccugucuugccaugcacgucuugcccccucacuuuugcucagccuagcagucuacuucacuuuauugccuuguaagugucaggccuccugggcgcucuggaaaagacagggagccaggcccucucaccccuacugguaacaggucauugcugggugcacaagagggaggugauuugcaucauggucaugcugcaugggcuucacugggaugcuguuaaacaccagaggagccaaccuaucagaaucccagcagcaaaggaaaacucagauuuuagaggcuuuuuacaauaaaguagcguaacucuaggucaugauugauuucaaaugccugccaugaaugauuuguaaguaauuauguaggauccaucaaagcaguauuguaggcuuuugaauugucccaguggauccgggaccccauuucacugucucucuugaucguguuaaugaugcaaucagaguucaagacaggccccaugaagucugacugcacugggauggagaaaugaauuucuucccacugaaggaaacucuuucucauucgcagccaagacgggagugccacuguuccucucuucacuccugagauacugcuucuggaagcgggugucacuuccucucuaguaccucuucucuucucugaagugugugacuaucuccuaguguuuaaauuuggcaguuacucgccauguaugucagcauagaaaaggaaauguuuuuaccuuaucuccuguauguaugauagaacuuaaaagaaaugugcauuuguuuucauagccccagcagagaaaauccucuucauagauuaaaugugcugcuguggacaggaggggaaaaaaaacccucuacauauugaaaggcaccaaauguaauaucugacacuguuaagaugcccaaaagagcaaaguuguaguggagaugcagggucauuuccccaugccauccacaguguuuguuagugaguccacggcugacuugcagugauaaagaaaagcauggagcugugucugcagacaaugguggcugcaucuguaaguggcuucagaggcagcagcccuggggaaauugauggguguggcaguggaccugugaagagggagaaucuagccuucagccuguccaguguuaaccacuagagaaacugagcuuuauauccuuuuuuaaugccugugaauuuuagcauauugaaacauuagagcaaauacucaggggauuuuucauuaaacaucccucagauaauuuagcuauauaucauuagaaagggaaagcuaucauuuuuauuuuaaaacuaaacaaggccaucuuauaaacugucaccaaagucuucccuuuuuuauugcaugugugccuugaauuucauaaaacauuaauucacaaugggggucagaauguacucuuguugaaacacuucuuguaccauuuuauguucauauuauguuugagaggguaaaaauguaugagcagcuuaacugaaguagaacuauucaugaugcuuuucacacauuguggcauaagauguaaaguuuguaauuaauguuaauuucugugcauuuuaauauucuuuuauaauuauuaauguuaauuucugugcauuuuaauauucuuuuauaauuaugagcauuuuaauaaauucauuuuuacaaacaauaguauggucuauucuauauugucuuaacguuuuuaaggaagagaacauauaucugcuauuuacuaguggccaguuguguaucacuuagauaaaugugugcuuuuguguaga

SEQ ID NO: 17919 - RNA, 2484 nt, Homo sapiens
gaucccaucuucaauagagcuuauauucuaauaagugauaaaauaaaaacuaaaaauguacacagaaaugcauucauuuaccugauaucuguucagcaccuucuguaugucagguguuguguuagguacuagaaauugagcaacaaagaagacugaaguggccccuguucucaaaguaggcagccuagcagggaagacaaacauaccaacagaauaacagcagauuauauuuaaagaucgugaaaaaagagacugaaccaggauagcugagaacagaaccugggcauauccaaaacuaguucaagggaaugggcucucacugggagauggcugacaagugcaccuguuauuuuuauaauucuaaaaauaacauggccuuagauuaucaacucuuuacaaaacaggucuaugagaaggcucaagauguacauuagauuacugcguaaaacaccacaaaugcuuucaggcucacaaguccagucguacucagggaauucaccaugcagagguuuuguuuauaaugauuucuacagcuguuaaugcaccuugcaaagugguacuauugcuagugguuccagugccccuuuguuccuugcugaaauaauagcccuggguuggaaggcaacaaaacucggucagucaccccaguucucuucauucuuucuuugcauuucaguuuagcauaauuaucuuccuuucuugugcuaaaggagaggccauggagagcuuggaccgcagcaauucuguguagcuuccggaaguuuccaaaggaggaagaaagagagggagcagguacaucuguucccugcacuccaucuuuuccucuugaggaagggagaggcagggagcuagaagccaacgggccucuggauucucagccagaaauggcucuccagacuucuacucuacuggcugugggaugugacucauuccugucuggaggaagaguuuaaccugacuucggcugggagucacaaccaagcacguagggcaugaaucacaaucugugaggguggaaaauaccuacugaugacucugauaugcuucucucaauauuuguugcccaugaaaaauccuaauauuagagaaucacacuggggauuuccuccccugugaauagccaaagcacccuaguaauagagugauauggaagaugcaaauuaaagcuugcuuuguuuucaguucauagggcaaaaaauaaaggguugcaaauucuguuaucacuugcuguuaaacaguccugugacuuauuuuucuguguagggaucuuucauaugugauugaaacuagcagguaauauaucuguauuauuguuauaucuaauaccucuaauuccuuucaaauugggaauauugucuuuauaaaugccauugagaucaaguauaagaaauauuaacauuaucuuuugccugugcucuugucugaacccucuauuccuaguacugcuuauuuaguccagugauauuuuugguuaacauuguaaaagcauauuuuacauauaguaaaauguacuguuaacuguuuaaguuaugacaguuguauagccaccacccaaaacaagagauggaggacauuuccagcacccuuguaccccuuucaugucaaccuuccuccacauggucccugcaagcacuuaaagacuuccuccauaaauugauuuugcccauucuugagcuucguucuaaagaaaucauguaaaauguaguuuuuugugccuggcuucacuuagcacaaucuuucuggggauucaucuguguuauagauaucaguaguaaucuaguguauuggaacuauaagaauaucuagaaaauguauuuugaauuaaaucuugaaguauucguuucuuauagguagcagacuaacaauccuuaaccuucuaauucuguuuuuacuuuaaagucagguagcuuuuggucuuaguuauuuuuguaaucucuuuaagcaguucacauaaugccuugccaauuauaggaaauuagcaaauguguucuuaaguuggaagagaaugugugaggaaaauucacuccuaucucauuuuacagaaauucagauuuuaauuguccugcuguaauugugaaacugaacugcacauucauucugaggauuauugcacugaugaguuuacugaugagugugacacugguucggagggaacuguuugcagacucucccuauguauaaggaguucauguguaauaauuuauuucuccagaaggucaccuuuuuuccuacugauuuuuuuuuacugguaaaaauauugcaaacagauauuguuagucucguuugguaacugaaagagcucugagaacggaaaaguuagagugaccuauccaaaugaaggagcaguucaguguuggugcaggauauuagauuccaaaauauuuguucaggccccuuuuccaaguucccagggaaguuacugacacugauguugguuucuuuuaagaaugacucaugauuuuucgagccugguuuccacucuua

SEQ ID NO: 17920 - RNA, 398 nt, Homo sapiens
gcauggacuaauuucuaauguuaauuuuuuggcaugggaauuccuagacuacgaggguuauaugauuccaguccuuagcuugugcgagguauagaaccaggguuuugauuucuuagugacauauauguuuuuucacugagcgaaagucuuucuggccuucucccugcuucacugaggggugucccuuugagauucuugguuuuacagagagauuuucaguuucaacuuuaccucacauaggccugaaggaauuaccaucuaccucuccuuaggaagugaaacucaagaggauuauggagacuaauaaacaugccuuggacuaucacagcaucugcucacauaauuaccacccuaguuuucaguuccugcuuuauuucugcaccuggaguuuacccccu

SEQ ID NO: 17921 - RNA, 14609 nt, Homo sapiens
cucaggauuaagcauguauuuauuuuaguucaguuaaaacaaacauacauuguuucauugaaacgguguagcacucuuugccaacaagccauacuagaauuguuggccucuaacaguacaguggggauauuuacacuauauacacaaaguuaauacacccagguucucaaaggucuuccauuacacuagaucacauuuuauuucauuacacuagaucacauuuugauuacugcauuuugaaaauguauuccuuauuuaaauuuuaaauaagagaucugaauuuguaccaagauuucaugaaaaaauuugauguuguuuauugcaaauacaauuuaaacaaguuuuuuuuaguguuuguacacaauuugucaauuuuucaauauucaauuuucuguacagguacuuuugggacaauucuuauaguuacauaaugugaauucaucaaaaugcaguuaagaaacuuacaggaauauauacacuugaacccaagacccaaaccugacauuauauacaaccuauuuacaaauacauauggacagacaauauauguacauagauuaucauaaauauugaaaaauagguuagcuuuaauggauuaauguuguucuauaaauaacauuacaguuguaacugaaacauccacggaagacaguaaugcaaaaugaggugacaagacagugguuuuaauacugaagacugcucauuaaugggaauucauuguucaggaaccucaagguagacaagauagcucccagaaaaucauccauuggaauuuucccuaggcacuugauuuugaaccuuaaauagccagaggauuggaggagcuuccucacauuaauuugcuguagagaaaagaauuuuuuuuccauuccuuccugguugccacaguaucuucucccauacaaaaaaaaaaaaaaaagucuguagaaacaacucuugguauucccuggcaggucuuagauacaaagucagcaacucuuuccaggagcucaugcaaauuugccaauucuuggucucaacuagaggugagguucugcauucgaauggagugccuaaagcccaauuaaaugaaagcagugccguagaaucugucuucccacugccuuucuauuucuagauggcccccaauuauuuuaucuucauagaaacagacaaaaauggaccaacgguuucacccaauguagcacuacaagacgucuuccaguuccauaagggucuuuaauuacacauguaucuuguuuguaaauuuagucacauauaauacaagaaugcguaacaaaaaccaugucuccacauuucuggcccuugccccaaacaacauuuuuaguucaagggcaaaccuuacagccagaugaccaauugacaauuccauuauuugcuuccuucaaccacuuaauggaauuauguauauuagauuuuagacauuaugccugaugagcgaaguaccacauuauuuaauaauauauucaccauacacugugacguacgauaaaugugcucuuaaagccaaguuucaaaguaauuauuuucauuucuaacugggauugaaauggaaggguugacaugcaguuggaccaaaaugacuacuaacacucaguuugcacuguuuucccuagcuaaccauuuguuggauguaaacaaguaauucuacguuguacaagaaugagaugacaguccagugcaaaugaguuuuuauaaagcuuacugcaugagaaacccaguggccuacgcaaagagaacuuauaucauaucaaacauagguguaaccuguggauuagaccucuacuguagacaaaacaugaacacaacuaagccauacauugucaaguaauucacacuuccaguaggugagcauuuugaaaaaguguacucucuggacacaauaauuuuggccuauugccaucaaaugcccauuuuccacugcuggaagcaaugucaaaaaagggcuggcccaaaaaaagacccagagcugucaauacaacacuggagacagaugcaacugaauaaacccuguuuuacccaauugcacuauuugguaccucaaaauuaguuauuuuauuucccacagaaauaucugcauuaucuuccauucuaauaaguugaagacacaaacauuucagucugaaugaaccaaauuguuuggggacagagaagaaaagugaugaacagaguucaucugauuugguauagcaauaaucaaucaucuuuuaaguaauggugacguuuaaauggaaaaaacuaugcuccuaauucaugguacaauuuuucauuacaucauuuucucuaaaaauuauuuuggguaaaaaaguauuuggcuuauuaugccuacaaaaaggcaaaccauuucauuauauuaauauucauuuuuaaauaccaaugacauuauuuuauggaauuuauugauaacugcuucugaauaaaguucaaaaaagcaauuucuuaaaaguaaaagagugcuucugaggucuuuaaguauuuuugguacaaaaaauaauaguguuuuugucaaugguuauucaauauuuugcuguaaauuaaaaagaauuguuucucacaucaaaugguuccauuaggcacauucaaguaaaaucauaaaauauccaaguuaaacaaugacacagccaagcauguggcuugauaaaaguuaagaguuuguccauucucuggaauggaauaaaauugucacuucccuuaacccgagacucgugguuuuguuguucauauccauuucuaacauacagauaaguuucuuaaaaaaacaaaacaaaacaaaaaaguucacuuauucugcacucagaagaaccagcgaggaaucugcacuucaaaaggaagugaaacugaaaacauuaggugaaauuucauaguaguugaguuuacucaacacuggcaucagauggacugaguuugaguuugaguggugccaauuaauggccaccuccaggugcauuguguacccaauccaaaacaaucaaggccaugcuuccggucaucaccaguacaccacuuaacaggaagaacaaagccugcaaagagcauagagaaaauugaucagcaaguaauaaaacauauaugcuaaacauuucuucuauuuuuugaaaugugcuuuaauuacuaaaaucuauccacuauauaaucuauagaaagaauauuuaacuugcuaaauauaaacuccuaagugaucaguauguuaucugcaguacacaauaacuaccuuugaggccuucugaacuuuuucacuuuuucauuccuuugucucaagugacagggaauuuucuugcuaaacaaacugcuucauauagaacuggacuggauuuuuuuuugcaauuuuuuagaaugaaagucaagucacaaaaucaaacccaaaucauccuaaaaugcagcaaaagucaaagccagaggucuuuccaggaaauacuaauuccuaaauccuacccuucaauacugccacuauguaauuuagaguaaaacaagaugacaguuguugguuuauaaacaauucuaguacuuuaaucagagcagaaugaaggagaaaauaaugacuaaaaagcagucuuuuuccuaaauaucaccaccaggauucugguucuaggaaccacaucauuugugguuagcacaucauucucugucaccaacugguacuacacuuuagaguagauacauaauaguaaacaccaugaagagacggccucccugagagcuucgcucugaagauggucagucucauucaacuaaacagcccuuccuucucuuuuauauauucaaugcccauuuaagugccugucacacaguaggcaguccagugaaaacugguugaacaaauguugaaagcugaguaucucaucuagucuucaucccuauuccuaucuccaaaguaucuaauaacuuuauugcaauuaauuuaaguguucauuagauggcaaacuaucuuuccccuucccucugcaaucuuccaucugugaaguauaccauuacagaaauguuugcuggaaacuuaaaagugaaaccauaacaaauaacagcuaugagaauaaaauuaaaaucaguuggggaaauuuaugauauuauuacuguuucuaugguuauaaucuuucacucaccccaaucuuuuguacagauuucauagguucuuucuucaccaacuugauauagaaggcagaaggaagaauaaaaaucaacauagaagcugcagaugcaccuguaaaacaacauuuauguuucuugaggauucaaugaaccacucgucauucauucuuuaaaucuuaaaaucccugauguuugaauccacuuggauacuuucuaaaacuuaccaauaaaaccaaagauaucccuaauaguugggacaaagaugacaaguaaauugguaaaugccaagauagacacuguaaugagacuaugacgccaccaacugaaaucuuuugaugcacacaacaagugaguuacagaacuccggaucugcaaaaaaaauaaauaaaauguauuuuaaaaauagcagcaauauaaaauuuaaaaauccagcuucaaugaaugaaaagaaugcccaaguaacaaggaaucuauccaaaauaguaacuauuucuaaauaaaacugugccucuuucucugcuguuuccugaacaucugaacacuuaaagaucauuuuauaucuuauggugaaaaaaauguccccaggguauuuugaaaauauacacuguauuuuuaaaaagccccuucaaaaccaccaccaacuuaguauuguucuacugguguuucccuucuuccagaagaugaaaaucucaccaauauucacaugucuaaaaacuccuuccuacugaaagcagagcaagugauuacuuacugggaaaauaacuacugguacugucagggucacagccauuaacacagccagacggacaaugagaagaagaauaucaguucccaagauagaagaguagguaugaagcaauucugacucaacauguucuacagggaaagaccaaaaaaacuuugauuggcuguuuucauuggacaccaaguagaaaauuuaacagcaaaaugugcaccaguuauuuagcuacucacaaaacgacuauaaacuaagaggcuaauaagauuuguuuggaauuauaguuaaugcaauuaaaguaacauugaaggaaaauuuuucuaaauaccacagagauuuagccacaugacucccauuaaaaacaacaggaguuaagcagcuaaaucuccuggcuuggcuugcaauuuguguuuguguuacauagucugaaggugaugggagaggagacaggcaauaugaacucagaggcuggcauaucauacaaauaugccaucaaaugauuaaugauauuuucaaaccuggauucuagaaauuacugauuaaauacacuacagaaaauucuaagcucuaaauuuaauuucucaucacaaauaugaaauauauuaaaacagacuauuuuuaaagugauggaacuacacauagaaaacuagcagcuucauuucaauaagcguuuuuuuuuguuuuuguuuuuguuuugguaaaggaggcguuacuuaccguaaaauguuagguauccaaagagggcggcaagcagauacaugagaaacauagcaaaaaaugaaaucuuggacacauucaucauucuucuacggcugcggcuauguaauucaagagaaaauucaaauauauauuucagcagcaguuacagcaauugucuaauauuuucucaaauuuauguaaaaaugaaauacucacucuuucaguucuucauagaugggaagaacagcaggaugacagacaaaugaaaagaucagaauuggcacagcauagacagucugaaagaaaacguaaaaaucuacuuaaucugauguaacgaacucaugcugucacauuuccgcagcauauauuuuauguaaacaaucuuagaaucaaagccuaaguuuccuuuguguaauuagcuuccauucuucuaaucuguucaugaaguaugaucaauauccucacuucugaaugugucaauuauuagcaccauaugauuaucucaauucucaaucuauuuucagauguaaaccaaaacuuucuucacaguccucaauaauuagcuaaucacauguuuucuauaaagcaccuauuauccuccucccuuuacccugggagugaauagcuucccucuuuucuucccuaaacucuucuuuugagaaaauaagcauauuuaguuaccugugaguugaaaauaaaauagugaggucugcaagagucauuuucagucacguuaugugacaaagcagguacaagagcuguuggcuguguuaaggugguguuuauuguuucguuaauuaucaaagcagcuuccacaggacacggaaccugaaauuucuugcaaaugaccuaaaaauauauuauuuugcauguguuaaacuaagugacauggcagggcuuauaaaaaauuuuuucuaaaaaaaaaaucauacccaccacaaucagaaagaacaccauacacaacaaggaaaggccacugguauaucccaaauauccuauaaggagggguggcaggaaucaguauuaguuuaaugaaacagauuuaaggcaaauaucuuuuucccacugaauaacucaauucugcugggaagacuuuaggcacuaaaguauguguauagcacuaaauuucuaauucuuaugauacuaaauuauagauuuauuuaaauauacuugucauaacccaagcuaauaaaaacuaucauuugcauuauuucuuacaaagcacaacauauagugucaauuaaauauuuuggcuccuaaauuuugcaugcuguaagucccaaagauauaccuuucuacuuucuagggcuuuuucauucugauuaauuucuauucagagaaagcccaacuaacuggugagaggcucauuucaauucucuuuagagaugaguuugcucaccuaaauuucuaaacagcgacaaaggaagaaugaccaccaaugacaccaacagaaccaaauaguucccguucagauaccacaaucuaaagaaaacagaaacaaggucaaaacagucacaaauauccucugaaaaauauacacaucuucuaacaggacucauuucauaggaauaccaugaaaacaaacacacaaaaaagacauguuuggaaaaaguuuccccuguucaagauaggaauaacuuuuuaauuuugugugcuagaugaacauuuacucagguuagaagucggguauaaaacaguguaacuuuugucccacuacuugcucugggaaggcugccagcugauucauaacacaaaaugcuucucaaagacuugauacuaaugcagggaacaaagcuuguuuguuaagccaguaaucuuaucuuuaagcacuuucagaaaaauuguacaccaacuuugguacagcuuuagcauguaauuucuaaugcuggaaacuaaaaaauuuuaaaacaaguuuuuuuccagaugcguuagcaaauauuauuaaauauuucaaugaggaaacguuuucauaaaaugcacaggcaaacugccccccccauaaaaaaaauuauaaaacucagucccccaaaccaggacuuauuccagguuaucagaguauguugugacaucuugacccaccuuuaacuccaaagacagccaaaaauaucccuuuugaacuuuagaaaacauuauguauauccucuaagccuuuuucuuuuuagguaaaucaugaauugcacugucuucuaaaucacuauuuucaaauucuaauugccucaugaauucuguucacuucagcaguaagcacucugcagaacaccaacacuuaaagaucagcuuaaaaaauuaaauuucuaaagccacaucugagauaacagcacuucucuauuuugacguaaugagcugcacauagggugggaaguaaauuauccuuccccauguuuacuuuagauaaauaccugugaguucacugggaugaguaacuuugcuagaagaaaaugguuucuauagcaugcccaaacauuuucuggcacauguugaguaucccuuauucaaaaugcuugggaccgaaguguuuuggacuuuggaguaccugcacauacauauuugaaguaucuuggagauggcacugaagucuaaacacaaaauucacuuauguuuccuauacaccuucuuaaacccauagccuaaaggugauuuuauacaguauuuuaauuaauuuugcacaccugucacgagaucagguguggauuuuccacuuguagugucauguuggcacucaaaaaguuuuggauuucagauuagggauguccagccuguauuuugcauugaacagauuaagucuuaagaauuccaaacuuacaaaaauaagacggauuaauuuuuaauguaauucaaagcuucaguccucacuuaggauauauauuaaaaacaccuauaacuucuuuaaguaugaacauaaagacagaaagcaaguucuagaaaaccuguuuuagaaauuaagauauccaaaauuguagggcuagcuacuaucuuucggccuuuccuucuccaaaguucgaaucaguuuacggggauggggggccuucuuggucaguuucaaaaggaacauuuauggauaauuaacuaaucauuuuguauacaacuuugauaaaaauguaucuaaccacuuuugacuauaauuguuucuuaugaguaaccuuacuuagcaccuacccaguuuuaucuucaauguucguuaaugccuggaucaccaaaggcaacucauauuucacuaugaagagguagcuugacauagcuggaggaaaacaaaauuauaccauuacaagugcaaaacgcggcacgugacacuaaaacgcaugugucaccauucugugcuccacaaugagcauaaagucuacccaaauaaucuuuugaaaaauucuuaccuccaauguucugcauuguaauugauccagaugcugcaagcuuuccaacuaauccaaaugccuuauaucccaauuguucauauaauaaagacccuacaauuugaagacagaagcaugaagccaaggauuuuaaaagagaaauaaaaugauagguauacauuguuuuagaaaaaucaagaaugcuaucauaccuccuucauuggcagucuucaaaaggagaugaacagaauacagggaaaauauugacacaaaugucaagagaauucuggugagagaaggaaaaggcauaggguuauaaauaagcauggcuauauuuaaagacaacucuuucuggauguuuaaauaacauuaugugugcaacuuguccuauuugugucaaaaugcccugaagaacuggcauuuccucuccuacuaacuggaauggcaacacugucucuuggcuggcaguaaaaacuugcaucauuucucaggugauaguucuacagcauugguuaggaacaaggaugucuacccacugagccaaacauagcaugagacacuggaaagcucaacuucccagugauggaguuugaaacuuguauuuugauucuggcaccacaauaaugagcuguaugcuugccaccuuucugcauuucaguaguuccccuuaucuguaaaauauuaguaauauccgccacuaaacccagcccacaagguucuugggaaauucaacugagacacguucaggaaagguuuuaagaccacauggaccguauacacaaaaacaggaaugacaggccaggugcaguggcucaugccuguaaucccagcacucuaggaggcuggggcaggaugacugcuugaggccaggaguucgagaucagcuuggacaacauaacauagggaagccacaucucuaccgaaggaaaaacaaaaagccagcuguggugguguacaccuauagucucagcuacucaggcugagguggggguaucacuugagcccagcaguuugccacugcacucagccuggaggacaaaaugaaauacugucuuuuuaaaaaaaaaagaaagaaaaggaaaagaaugguaagggggaaaugacacuaacaugauacuaacauuuuaagaggcacuacaagcuuuacuaacaacugggcacaaaucagagaacuaaccauugugaugacauacuacauugcaccccauggcaaggaauacaggcccacuauugucacaguuaaacaaugucugugcuagaacaaguaggcuaucagcuugacugucucuaagccuuuccucccuugacccuuucacuuggauugagcaacagaaaaaaaauaaauaaauaagguaacauagagugacuaaagggacccuaaugucaccuaauuuuccuuuaggguaaggguucucccucauuccagcuuuacuuuccuuccaccuaggagagcccagagauacagacuaauuuuuuaaagaaauuaaauaacaaaacagggaaacucauagaaaaccuugcaaaggagaagaguuacauguuuuuuaauuccguaugaacaaacugcacgcaguaccauguaaggugcugacaaagaaacugaugucuauuaguuaaacagaggaaguggcuuuacacuaccauucuaaaugccagaaguuuuacaggaccuagucugaagugacacuaucaaccucacuucuaacuggagaaaauauguugguuuaauuaaaaacaaaccaaauuaaguccuuccaugucuuauacugaaaugacaagggaugaauagacuuuauaaccuuugaggucacuuucaaccuucagauugauucuacuuaaacagguuagcuacaggguugcugaagugcaccguggcagccaugugguuuuuggcccauuuuccucuauaccucuaaauauaaaguaaguacugaugaauaaaaucacacuuuagcaaucuuauuuagccauuaagcaaaaugguaaaucaaugacauaagcaccuauuaaaguauaauuccaagaguacaaggguuacaucagaauuugaccuucacuuaugaaacagaggugccauuuaguaucauuucaauucuuacuuuaacuacacuggcugcacucuaaaacugccuccaguuuuuauaccaagugcuaacaaggauuucaaauauucgacagugaugccauucagguucuccacuaagaacuccugagauucuaggauucuacguaaaucgcugguccuucaccuuaguaagaguucucucaaaaagccucauccuaauugaagcaagccagagugaauccuagcaucuaguacucaaagccaggcuuaaccucaguguggaauuucacaaagcagagauuugcaaaggucugcuuuucuuuucaugaacauucuaucgugcuggagaaaauaacuugaguagaaggcaccaaucagcuaaguaaaacacaucugucacaaagggacaauuccaugcuauauacauaugguuuccuuaucuguacaaugaagguauuaaguuacacaauccuccacagaaauugccuuagccagggguccacggguacuuaaacuuaagggcuaugacacaaacaucacugaaaaauacaugcuuaagauugcauguauuuuuguuuugugcuuuuucccuggaaauaagauccacauuuuucuaucauauucuccaagagucagugacgcaaaaauggcuaagaaccacugcucugaagucuucuguaccuccaagagucuauccacguauuuaugcuggaaagcacagaaguaauuaagucuaacugugcaacuguggggggaaccauuuaaaaauaaguacuuacuaaaguauucauuuuuugccacaacauguggcaaucgaacaggucugacaaaagcaaacauuaaaaaaacauguauggauugcuuuucaggguccagaaaauuaugaccuccucgucuuaaaacaaacauguuccaggcuggguaaauaccaccacaccuuguauguuuagagaaauuuucuuuuccuuauucacguaaggggccacagguccuuaagaacugugucgauuuaccaaaaugauuuggagcuuauuaggauuuucagcuucugauuugccaaaacaaaauuuauaccuacccuggcuuuagccauaguuuuuuuaauaucuaccaucuguuacaauuuuguuuuaacuauucccacugacuuagaagacuucuggcuuaauuugucaguuuuaaggacugcccuauuuuuuucuaguuggcuuucuugauauugugcaguauguaguagaauaaagagauuuuuugggguuucucauacuuuuaauuuuaagcaaguaacuuuugagucagcuacuccaacuguaaauucaguuucuggagccaaaauauguuuuaccauaguaacugcccugcauggcagacucacuacuuacacauacuuacauaaaaagagcaauuccaguauuagccauggcauaagaaagcccaaggauuccacugcccacaaucgcauugcucagauuaaauacugacauuccaaaggaaguaguaccuggaugcuacauagagggaaaacgauaaccaaacauauaacaauaauuaaauggagaaaaccagcuuugggcaaguuagauuugaauucuaaaaguaaaacuauucuuuuacuccauaaagccacugacagacaaauuacuauuuuuaacuuacaaauucuguuucauacuucuucuuccccaaauucgauucaaguaaaaaguucugguuuucaggaucuacaucugcauaauggcugcaaaaaauauagacauauauaauuguaaacuggauugaaauaucuaucauuacacacaagacugcuuuaacauaaaauacccuccaacagcauagcucugauacaacaucuuuacuuaauguauaaauauuaacuaggaguugacuuucacaccagcuaucuugucauuacaacaagauaaucggauacucuuucagagauuacgcaccuucucuaaaugcuauagcaaauuaaagcaauggaagcagaguccuagguaacucccugaacccaacccaugcaagccguuuuuucaaaagugucacaacuucucccaccuuuucagagcagcuugcuuggugggguaggaguaguugaagucgcuguuggaacuguagcugcugcugucuucauccggggaaauacugaaucgucccauuucggccuucuucaugcuaagcacugggaggaaucgggugcagcuaguagcgcugggcuccuuuuguccuuggcggugggugcagcggcccgcgagucggccugcgaaaguagaggcggcgcgucaggaccgcagcgccagcccgccgcggucacgugacgccgcccggaggcgcagcgcggcugauucaucccaggccaggcgaguggaaaaguaccagccgcgcgcgaggggcgggggcgcgccgaggggcggaaaaguacagacggcggagccgcggggagaacaaagaugaugccaccgcuguguugcggccgucgaggcccccuacuccggcagauuucaguauuucacccucucuauugucccucgucggaguggagggggcgaggggggguucuguuuugcuuuuucccagucgcuccaaacuugcacaggcacucagggcacacauccagccccgacccuggcucgugugcaugcaaccuaggcgcacggcuuuccguuucuagcauuuggaacagcaaugcugcguaaucuguccuuuacugcccggaguccccacacggagaaaugccucugccgcagacagccuuccccaggaggcggaaagggccgacacuacuccucucucgaggggggcgaacgcccgggccccgggagcuggggguuuguuuacacacgcgcgccagugcccucaagcacacccguccacaggcagcuggcccgcgagugcuacgcccgcccagccccuccuauguccggaaagaaaacugaugcaauaucgaucgucgauugucaaauguucccaacucgucuuccccaaucuuggccucuccuguaauacaugcccaagcccaccuccgccgcccccagauuccuggcucccuggacuuaauuuuuuuuuuuuauuaaaugcaaaucagucacaagacuugccgcagcagagccgcuggccgggcuagcuccccucccccuaaugggaagaugcggcuccgcaccgugcaggcacgcggcccccgcccagcgcccgcucuccuacccacgucgcgggcgcgacacccgcgcggcgggccaggguggaaggcuggccagcccaaccgacaacgcccgccucgaaaggaaacggaccccgcggccgccuucccgcgcggccccucccggaagccccucccccacucucgcccgggccccgcgcccuucccacagacgcccccccgcacgcguuaccucgguggucucuauucucacgcagacgucuucaguggguuucucucagucaaauacaaaucauaaaaaacaaacaaaaaauuuccccaaauccaacaacaggcaggaaaaauaauuuuaauaaaaaaggaaaagacaaauugccgccccaauccuccggcguccgccgugucaagggaaaggcgcgagcgugcgguaacgcguggucgggcugcugcuagcaguacuggaaaggcguucuaaggcggcggcgucgcgcggcuguggagcagcccugcgagcggcgg

SEQ ID NO: 17922 - RNA, 446 nt, Homo sapiens
uguuuauucauucauuccaugaacauuucucucuccuaaggggucuuuguuuccugcaagggagugagucuugccuuucccgcagcaccaauuuuuccacagcgaagggucccccuaguugccuggcucagcaagaccacacacaucaccauugaagggaaaggaccaggcuccgcagaaagcgccucagacccgcauucagacaaggcagugccuuugcccggggcggcgguggugggauaagagaagcaacgugucagcgaguggaaaacuggggacucccaaacggccuuaggagcgccgggcuccccacuggggccucuuucuaaggggccuggcuugcuggccaaaagguagccuuuccgcuaguccaguuuccauggccguacaaaaagcacaucccgaaaaggagcugcucgccgaccuccggcuaguuuugaagagug

SEQ ID NO: 17923 - RNA, 3444 nt, Homo sapiens
cugcccgcaggaggcaggacgcgcaggggugggaccggcgccccagcccgucucccggccccgggcgcgcgggaaccccggguccugcagccucccgagugcggagaggcggggccgcccgcugccgcccggcugccugcgcccccucccgcggccccggcucugggagcggggcgccccgcgcgcgggcacacggcggccagagcgccgaggcgguaccuucagccugcaaugagaggaacccgggagagcccccgggagccagcgaagagcuuggcugcugcguccagggcugcugcugccgccgcggcugcuugaaacuccucaaaguugagagccggcuagagggugccgcccgccgggagccggagggaaaggaagucggaaggugcaagagugacagacacggacagacggacgcgcagaccuucggaaggcacugcguaggcagccuccccggagcccacgaggcuccccagcaccgugaguuuuuuccuggaugggugguugcuaaguauuuccguuuaauuguuuguagcguacguuugcguauaguugugucuguuggagggaguuuaaaacaacaacaacaacaacaacaacgcaggaugcaccuuaggaaaaaauugaguuucugauggugggugagacgguggguuguauggagagaaugugacuguacauuuuuauaagcaggacuaacccaggaaagaggaaaaaauacauuuaacagugaagaggcaacacagagcucccuauugugaaauaaaacccauuucaaaaguuauuggaaagaaaguaagguauggcucuuauggguuaacuagugguagucaguuucugcuuuuuacucccucugaauuauuaauuguuugccagguucacuggugggaggcugagccgguggaaaagacaccgggaagagacucagaggcgaccauaaugucguuacguguacacacucugcccacccugcuuggagccgucgucagaccgggcugcagggagcugcuguguuugcugaugaucacagugacugugggcccuggugccucuggggugugccccaccgcuugcaucugugccacugacaucgucagcugcaccaacaaaaaccuguccaaggugccugggaaccuuuucagacugauuaagagacuggaccugaguuauaacagaauugggcuucuggauucugaguggauuccaguaucguuugcaaagcugaacacccuaauucuucgucauaacaacaucaccagcauuuccacgggcaguuuuuccacaacuccaaauuugaagugucuugacuuaucguccaauaagcugaagacggugaaaaaugcuguauuccaagaguugaagguucuggaagugcuucugcuuuacaacaaucacauauccuaucucgauccuucagcguuuggagggcucucccaguugcagaaacucuacuuaaguggaaauuuucucacacaguuuccgauggauuuguauguuggaagguucaagcuggcagaacugauguuuuuagauguuucuuauaaccgaauuccuuccaugccaaugcaccacauaaauuuagugccaggaaaacagcugagaggcaucuaccuucauggaaacccauuugucugugacuguucccuguacuccuugcuggucuuuugguaucguaggcacuuuagcucagugauggauuuuaagaacgauuacaccugucgccuguggucugacuccaggcacucgcgucagguacuucugcuccaggauagcuuuaugaauugcucugacagcaucaucaaugguuccuuucgugcgcuuggcuuuauucaugaggcucaggucggggaaagacugaugguccacugugacagcaagacagguaaugcaaauacggauuucaucuggguggguccagauaacagacugcuagagccggauaaagagauggaaaacuuuuacguguuucacaauggaagucugguuauagaaagcccucguuuugaggaugcuggaguguauucuuguaucgcaaugaauaagcaacgccuguuaaaugaaacuguggacgucacaauaaaugugagcaauuucacuguaagcagaucccaugcucaugaggcauuuaacacagcuuuuaccacucuugcugcuugcguggccaguaucguuuugguacuuuuguaccucuaucugacuccaugccccugcaaguguaaaaccaagagacagaaaaauaugcuacaccaaagcaaugcccauucaucgauucucaguccuggccccgcuagugaugccuccgcugaugaacggaaggcaggugcagguaaaagagugguguuuuuggaaccccugaaggauacugcagcagggcagaacgggaaagucaggcucuuucccagcgaggcagugauagcugagggcauccuaaaguccacgagggggaaaucugacucagauucagucaauucaguguuuucugacacaccuuuuguggcguccacuuaauuugugccuauauuuguaugaugucauaauuuaaucuguucauauuuaacuuuguguguggucugcaaaauaaacagcaggacagaaauuguguuguuuuguucuuugaaauacaaccaaauucucuuaaaaugauugguaggaaaugagguaaaguacuucaguuccucaaugugccauagaaagaugggguuguuuuccaaaguuuaaguucuagaucacaauaucuuagcuuuuagcacuauugguaauuucagaguaggcccaaaggugauaugacucccauugucccuuuauuuaggauauugaaagaaaaaauaaacuuuauguauuaguguccuuuaaaaauagacuuugcuaacuuacuaguaccagaguuauuuuaaagaaaaacacuaguguccaauuucauuuuuaaaagauguagaaagaagaaucaagcaucaauuaauuauaaagccuaaagcaaaguuagauuuggggguuauucagccaaaauuaccguuuuagaccagaaugaauagacuacacugauaaaauguacuggauaaugccacauccuauaugguguuauagaaauagugcaaggaaaguacauuuguuugccugucuuuucauuuuguacauucuucccauucuguauucuuguacaaaagaucucauugaaaauuuaaagucaucauaauuuguugccauaaauauguaagugucaauaccaaaaugucugaguaacuucuuaaaucccuguucuagcaaacuaauauugguucaugugcuuguguauauguaaaucuuaaauuaugugaacuauuaaauagacccuacuguacugugcuuuggacauuugaauuaauguaaauauauguaaucugugacuugauauuuuguuuuauuuggcuauuuaaaaacauaaaucuaaaaugucuuauguua

SEQ ID NO: 17924 - RNA, 1358 nt, Homo sapiens
cagauuuggcaacauacuaagcaaagaggggggcuuaggaaaagguagccggggggacucuggccacgcccuacccacuggacagggacucacugggccgccagcuuaaugaacuuccugagcagcugggcccgggggccgggcacggggcagagacacagcucgguggccacccaguacugcagcucauugaagcggcgcaugaagcgcuccagguuggcgguggugacaucccgcagaugcugggggcccagcacauaguggaucagcuccaccuggguggggucagcaggagaggucagcgagugcugagccgagccgggcgccccgccgccugcucuccucccccagcucugccucccauaccugguggauacuguugaagaggcuccagucgugguccgucagcuggccugccagguccuuggcacucaccagguccagccccucagcagagcccacagugggccccagcuggucagggugugggaucugcgggugggagagugcucagggggcugccugaggaauccagggaaaggcacaggguagggggagaggguuggggcaaggacucuaugcucguguuaggaggaggguuaggagggcaggaguggggaguagagggucucuaggggcuauagcagcuggaggauagggcuccccagugcugagaccccuccuuuugggcuccugucuccuggggaaccccuaacuagggcagguccuccucuuucuccuugggagcucccaaccagugcuaccagccccugcccugcacuaucuugggaauucccccaucagcugaggcccacuccuuugugugcugaggacccagcagcagccagagccaggccccuccucccucuucucccugggacccuccccagaauccaccacugccacacucaaaauagaucuccucccugggcccuggcacccugccuggucccuaccagcucaugcacuuccuguggguugacaacaaagagacgcucauugagccccagagauguggccacaccacgggcaucuggcugcaggccaauggcaucugcaaagacagcagaggcggacugggugggggaagggagggaggccggggaccagcuggaugccaggguggaggugcuguuugggaggcugagagguuguuucuccuaguagcgggguugaaguccuggguggugcucagaauacacaggugcaugugcccacgcagccacgcagcccagggaagcacauccaagaggaugaggaaagauucucagugagucaggaagaaccugggcagggucugagccucccucagccucacuuucuucccugguaaaauggagacaauaagacuugcccca

SEQ ID NO: 17925 - RNA, 1358 nt, Homo sapiens
uggggcaagucuuauugucuccauuuuaccagggaagaaagugaggcugagggaggcucagacccugcccagguucuuccugacucacugagaaucuuuccucauccucuuggaugugcuucccugggcugcguggcugcgugggcacaugcaccuguguauucugagcaccacccaggacuucaaccccgcuacuaggagaaacaaccucucagccucccaaacagcaccuccacccuggcauccagcugguccccggccucccucccuucccccacccaguccgccucugcugucuuugcagaugccauuggccugcagccagaugcccgugguguggccacaucucuggggcucaaugagcgucucuuuguugucaacccacaggaagugcaugagcugguagggaccaggcagggugccagggcccagggaggagaucuauuuugaguguggcagugguggauucuggggagggucccagggagaagagggaggaggggccuggcucuggcugcugcuggguccucagcacacaaaggagugggccucagcugaugggggaauucccaagauagugcagggcaggggcugguagcacugguugggagcucccaaggagaaagaggaggaccugcccuaguuagggguuccccaggagacaggagcccaaaaggaggggucucagcacuggggagcccuauccuccagcugcuauagccccuagagacccucuacuccccacuccugcccuccuaacccuccuccuaacacgagcauagaguccuugccccaacccucucccccuacccugugccuuucccuggauuccucaggcagcccccugagcacucucccacccgcagaucccacacccugaccagcuggggcccacugugggcucugcugaggggcuggaccuggugagugccaaggaccuggcaggccagcugacggaccacgacuggagccucuucaacaguauccaccagguaugggaggcagagcugggggaggagagcaggcggcggggcgcccggcucggcucagcacucgcugaccucuccugcugaccccacccagguggagcugauccacuaugugcugggcccccagcaucugcgggaugucaccaccgccaaccuggagcgcuucaugcgccgcuucaaugagcugcaguacuggguggccaccgagcugugucucugccccgugcccggcccccgggcccagcugcucaggaaguucauuaagcuggcggcccagugagucccuguccaguggguagggcguggccagaguccccccggcuaccuuuuccuaagccccccucuuugcuuaguauguugccaaaucug

SEQ ID NO: 17926 - RNA, 1283 nt, Homo sapiens
gccgggaacguggucagccgcggucgcugccaaggugauaucgggugggagcaaugacgcaacuccgguuuccacuucggccccccgggauauuuuacccuaaucugugggaucaggcugagcuuccuggcguucugcagcaguaacagguuggcgagcggagcccgggauuucccauucgugcggagcuagccgccggugccagucggcaggcgccccccagcgucccgcggacgacgaaguccuggccuggucagcccaggugggggugacgcaccuggcucaggcguccgcagcaggcuggguagaaccacggcaggaaggguggggggcugcauccccgauuaacacaggcugaagcggguauccgcaccuauaaucaucgacaacucugucccacagagggcagaagcgugccuugcccuauggacgacggucgaugaaaauuucacgaguuagaguaucuaaggcuacagcguggccuauagggugguugauuccaagucaagaugguugcagcgccaacggagcuccuggcaagagaggacuggaccugugggcggggcggaggggcggggcggggccggggcggggccugaccgagaggcggggccaggugcugggcugucucugcuugucaaaaggcggcagcggagccgugugcgccgggagcgcggaacagcuuguccacccgccggccggaccaggugcgaacccgggagcagcgggaaagggggucucaggauagggacucggggucggggcgucugggauaccggggccugagcgcccggcugcgagcauuagagucuaagucucagcgguaaacuuggcuacugagguccgggcugucgugccaugaggcugggacacuaaggggcacugagguuugagaaagcugaaguucgugccaggcuggcgaggggagcagcgacauccucggcgcuuaggagaaaugcuccgcuaacacagugcuuagcacuugggcaacaagaaguauuuguuuccuucuucugucggggcgccuuggcauggaguggaggaauaagaaaaggagcgauuggcugucgauggugcucagaacugcuggaguggaggguguguaaccuuauuuauugucuuacagggcccagguauggucaccugugaugguggaguugggucuuuuaaguaauuuuuuuuuuuuuuuuuuuuuuuuuacuuuucuuugaacuaccaaugaguuuagaccuaauuggcccuauuuuuuuucaggacagccugucaauagauguucagaggaa

SEQ ID NO: 17927 - RNA, 5340 nt, Homo sapiens
gcgcgcgcccgcguucuccuggcgggcuugguauuuggcgccugcgcgcugagugcgugccgcuccgccgaccgaagaggcugguaaguccucaagcuggcagguggucgggggagcggccggagaggagcugccgggaguucgugcccugcaggucugcgacgcuggcguucgcuccugccugggccacuuuggugggcucagagcaucgcuuuuugccaaggggcgugaccugagcccgccuccuggggcugggggguggagaggaaugggaaucguuaaggccgguuaucaauuuggugccuguuuguugcucgaggaggggcauagagcuuacaaauagugaagaggaaggggcgaggcuggaccaggugggagcgggggugccccaagucccagggcggugaggaucgaggcaggugcgugaaaggcaggccccguucccccuccccacccccgccggcuguguguggcggguaagaggagaguggguagcacuacuacaaaaugagggucccgauagaaaucguacagguguugggaccacacucagggcggcaacuugucauuuuugcguuuuuaauuuucuuauagaaacaagcgauuucugucgugauucacuggggccgcuaacgugcacucccucuuuucaucuuaggacaugacaccaguggcauaucacggccauggggucucagcauuccgcugcugcucgccccuccuccugcaggcgaaagcaagaagaugacagggacgguuugcuggcugaacgagagcaggaagaagccauugcucaguucccauauguggaauucaccgggagagauagcaucaccugucucacgugccaggggacaggcuacauuccaacaggugaucauggagggaugauucccugaugagaaucccaagguacccucggaguucuccugucugcccagacaacuuuucuucuaggcaguaauaccauaauagagacagugcccuggacaggagccagcucaacugacuuaauacacuugggcaguucugcaacuucucuuccucuccuuauuuuuccaacccuuucuuuucuuuaccgccacucuuguucuuuuccugagguuuggaacauucaguucgcucuguguugugggauuuguugacaggcacauuucuuuaucgcugucacaaggauugggacagcuuugcgggggaaccaucuuggaagcugcuuuucaaggaaauggguagcuaauccuuaacagccuaaggucagaaaaauauaucaggucaagagagagagacaaauacuuagccuugguacaggaucaucuauuacuauuaacaaauuggcccucagaaagucuuuaacaguuuagcuggagagucacagaaauuuagagcugguuaggaccuucaaaaucauuuacuccaaagcuuccauaugaaaggcaaggaaaccauggccuugagagauucgacgacucugccaagcccaugcaguaaagccagaacaggaucccagguuuuucaacuuccacaucacuacccuggcagcacugauagauguuuuauaauuuguggcacucucuuguuucuuguucauuagacccaacaugugaauuucacuaguauuuuuuaaaaugucucauuccagaagaauauuuguuguggcaggcucaagugagacgugaaggaaguacugccaacacaugggauuuacaaaauaauuguuuggcucuuuucuagagcaaguaaaugaguugguggcuuugaucccacacagugaucagagauugcgcccucagcgaacgugaguuaccugcuucucaccuguuaauaccuacuucugucccuaaucucuuucuguauguaugaaugccaguuaauucuuugaaaacuacacauguucuuauaaguuccccauuuuccuuauaacuguuugcccaagcaagauaucucugcccccaucacaaucuggggaaagaaacuugaagcuggaaaugcuuugaaggucaaggaauggaaucagaagaaacugggaaaguggaguguucugggaggugugggacugucucuguccacauagcuccuuucuucagcuuuucuucccagagugcaaacaguguuuaaaggaguuuuaaaagguuucuccugcuucacugcuucuuaacugguuuaugguuccuggcucuuggaacuucccuuucagcucccuucucuuuccugguuuuguguuuaaucuugacacauugaaccuugauaucugacugccugggucggucaugugcugugucauuugcaguaagcaauauguccuccuguccauccugcuuugucuccuggcaucugguuuggugguuuucuuccuguuuccgcauucaguccuuguggaugaugacggcaucaaaguggugaaagucacauuuaauaagcaagacucccuuguaauucucaccaucaugguaagccuuaggguuucauucccuggguugugcaccugccaggcugggacccaggacacuuacacuuguuuccugacuugcccugauguaggccacccugaaaaucaggaacuccaacuucuacacgguggcagugaccagccuguccagccagauucaguacaugaacacaguggucaguacauaugugacuacuaacgucucccuuauuccaccucggagugagcaacugguaugcuguucuuuuaggaaucuugccccacaggccuaagagaagaguagggggcuguaggaaugccauagcugugucacuuuccuuuuugucuccucauuucuacuuguaggaacuggugaugaggaagaccuguugggcccuguaauuauaaauaauugugagaaaaaacagcuaucauuuaagcauuuggggagcagaauaauuuguaagagacaaagauuugcuacaaaauaagaagcagcaguguuacagccugagguccauuggccucucaaaagggaagagguuggcaguaucaauuagaggcucauagacuauauuagggacaaucucagggaaguauuuugcaugugauggaagaaugacccaaggucuuuggauugcuaauaauaauacuguucugugucaagccugcuuggccacagaccaacucugguaucuuauuuucaggugaauuuuaccgggaaggccgagaugggaggaccguuuuccuauguguaguaaggacacuguucucucugugugugcucucuacuggaggaaagggauucaaagucauacuccauugauuggggccugguccugccuuagaucucagcuuuugacuuauagguucccuggcuuuggaugucuugagauuuauuugaagaauguauuauuauuauguguguauuugaagaauguauuauuugauaugugacagaagugcuggaauuucuaaaagagaacauuaagccacuaaaaacguuaccaagcuccagcacuuaugugauggguuugaaaaaacagaaagugguaugacgcugugggaggaugaaaaugacaguggcagggacugagagcugacaagccuuggcagcacuuaggucggaagggggaggggggcaccccaaacaggacaguguaacucugcacucuucuacugaggcuuuaaaaaaaaaaaaacugacuauuuccauauuugcuguuugguagcuucuucugcacgguaccugagauccuggugcacaacauagugaucuucaugcggugcgucucucuucccuaucccgauggccuguccggccaugugagccuaccaccuuugcucaggaggccccugugugaccacagggcagaggcaccuagcccgaggggacacccugugccucacaggcacagauacaguagacccuugguguucucuaaacacaguguccacaugcccuucacaaaucaccagucacccugagcagucaaacauuuucuccauaaaaugggucuaguuuaacuaaacacuugauccccucagaauccuaaugagacagucaugaacagaaaagcuuucucaagauguuaaguacugggcauuugaccagacuuccucucuagccacacaaauuaccacaugucauggaccuuuaggguuguuuucuggaagcauggcuguuaaauuugcaagugacaagacucugcugcagacaugaaauaugagggguuagagcagaguuucucagccuuggcacuacgaacauuuugggccagaccuuuguuguagggggcuguucugugcauuauaggauguuuaacaguauuccuggcaucugcccacuagaucccaguaguaaacccuccaucccuuaguugugacaacccagaaugucuucaggcauugccagaagucuccugugggguaaaaucauucucgauugagaagccuuguuuggaaggccaccuccuggcacaguaucucugugaaaguggaaagaucuucuggccuccugguuacauaaccaugaggauaugugccuggggcccguggguauuguucucugaacuugcaaaaaauuuccugggacauuuuucuggcuuauuucaucccccaaacauaauuaauucuucuugguuuucuuuucccuagaacuucagugaagauuucauacauuggccucaugacccagagcuccuuggagacacaucacuauguggauuguggaggaaauuccacagcuauuuaacaacugcuauugguucuuccacacagcgccuguagaagagagcacagcauauguucccaaggccugaguucuggaccuacccccacgugguguaagcagaggaggaauugguucacuuaacucccagcaaacauccuccugccacuuaggaggaaacaccucccuaugguaccauuuauguuucucagaaccagcagaaucagugccuagccugugcccagcaaauaguuggcacucaauaaagauuugcagaauuuaauacagaucuuuucagcuguucuuagggcauuauaaauggaaaucauaacgugguucuagguuaucaaaccauggagugauguggagcuaggauugugagugaccugcaggccauuaucagugccucaucugugcagaaguggcagcagagagggaccauccaaauaccuaagagaaaacagaccuagucaggauaugaauuuguuucagcuguucccaaaggccugggagcuuuuugaaaagaaagaaaaaaguguguuggcuuuuuuuuuuuuuagaaaguuagaauuguuuuuaccaagagucuauguggggcuugauucacccuucauccauuggcuggaacauggauuggggauuugauagaaaaauaaacccugcuuuugauucaucugugucuccu

SEQ ID NO: 17928 - RNA, 35933 nt, Homo sapiens
aacugauagugaagaugaauuuccugaaauuacagagguaaguuacauacacuuaauuucuacacuacuaaguaucauguuuagaaagaaucccucggaugaguuucaaacauaaaagcaauaguggucaggcacgguggcucacgccuguaaucccaucacuuugggagacugaagcggguggaucacuugagguuaggaguucgagaccagccuggccaacaugguaaaaccccaucucuaccaaaaauacaaaaauuagcugggugugguggcaugcaccuguaaucccagcuacacaggaggcugaggcaggagaauugcuugaacccgggaggcagagguugcagugagccgagaucaugccaccguacuucagccugggugacagagcaagacuccaucucacauacacacacacacaaaaagccauagaacacguguuauuuaaauuuucuuguauauuucagcuuucgcuuauuuuauauaccaaucugggcuuuauuuuuaaaauauugaaaauuuaugaaagaacuauggguggcuuuuaacaguuucagugaagaagcauuuaauacauuugucuuucaugucaugugcauuuuuacuuaaugcacacauacaauaguuugaccucaaauuguaagcugagauuugcucuuuuuuuaaguaauaaaacccauuauagaaaauuuggaaaauacauggaggucuguguacauuuuuagauaauccguuucuuuauccauacuucucuuugaaacacuaccauguagcuggugagcauaacacacuuauuauaguuguacugaauuccauacuuuacauuuaaaaaaaaagaucucuaagaaaguaauuucuaaaagauacugccuuuacucucuuacuaccuuuuaugaaaaauucuguuucucaggaagucauuuggaccagagauauaaaauacaguuaauuuuucucaugugcuuagaaaauuugauagcggaagguuguuccagacuuuaggaauuaauauggaaacaaggaucugaauguugugcugaaaaagagaagggaggacuagaugaaguggaaagaaguaaucggggauuacugggaaggaauagaaaccaaaauguuagaaguaaacugauuaacaguaaauuuauaaacaaucgaauggugauaaauauagucugaggauuauaugggguuuggugagaaauacgguuuuucugaagccacgcguguuugaugucuugacaccuuuuguuuucuuaggaaauggagaaagaaauaaagaauguauuucguaaugggaaucaggaugaaguucucagugaagcauuucgccugaccauuacacgcaaagauauucaaacucuaaaccaucugaauuggcucaaugaugagguaauguugcaucuauuuuuacauacaaauaguaaacauuaaguggcaguuaaauuaaggcauuaucucacuuuuucucaaaaugugguccauggaugaccugcauuggaaucaucucucauaggccucuucauucuuguaacuaugagggagugugguggagacaggcauuuuuaacaaacaucucagguguauuuuaaagucugagaaccacugaauuuaccuuuucuuguugaagauuugaacauugaagaagacauucacucauugguauucucacucuuuaaggcuccuauucugcaguucaucucuucugaacaaauaaguauuagccgaccauguugcagcaugagggaauacugugggauuucuuuauaggaauccaguuuuacuucccuuucuaccuaaguucuacucauuuuagaucacuuauauuacgaaugacaagcuuuccaaaaucgccuccauuuauguaugauauuuuuuaaauggacauugaaaaaguuauauuauuauuaaauauuugagguauugggggagaaguuacggucuucaccuccuaacuccaauuuauuuuaaguauauuaauuacacuacaguuuuuaaacugaucuguuccuaagccuaaaccuguagguaccuguuuuauuuuagaagguuauuuuuacagcaaaagaaaacuggguuggguaucuuuuccuaaguaccuucuuugcauaagcaucccuggcuaaucuggguauacucaagcuucacagcuguggaggauuuuuaguuucucaguguaguaaucauuaaauauuuuagauauccauauccuguuuuuguaugaucaagaccuuccaaauaauauuugccaauaacuauugaucauuuaccucauuaguacgauucauguuuuauguguuuuauucuuguaauagucaucauaucuuuggaaguagauaugauaguucaccauucugcagauaaagaaacaaggcauagaaagauuuaaaaacuugcaagguuauacagcuaguaaacagcagagccaagauuaagacccaagcauugggucuuaucuacuauaucuuaacuaccucagaaucuuaaauuggauacuggucuuaggaucagauauauagaacuuaggagccauauaucauguccaggaugcuuuuuuucucuggggccagccccauucuuuuugccacugguugguuuauaagauaaaaauuucagaagcucaucacucccugaauaauaucugugaccaagaauaauaaggaaggcaugguuuguuacugucuuucuuuagaagaaacccucuuugccucuuuuggcucagauauuagaacauugguucaaauaauggaaaaaaagagcucaccaaaucaaaggaggaaauuaaaucaaggauaguuauaaguauccacugauaaguuauuuuugaucugugguccuuugccauuuauuuccugccauugcugguggugcgaggucaguuacucuaaagggauaguaggcuuuaguuuguuguaaaucauggaaaaccuccuagagggcagcaaucaguaggauaugagcugaguucuugcuauuuacuguggcauuuaccucagugagauuccuuacagagacagcauucaucaggacauauuuuccauucccugggcccaucagaggcuggauuuuuagcaagcuaaguuaauggaaauuacauuauuuuagaggagaugagaagaaggaaagauucuuugucuacuuuaucccuaccaccccuagccauaacuuuuguagaaggagugcauuucuucucaguucagaaugauguuauccuugaaaaugagugccaguucacauguccauaauaaugaugggagcuaucuuaaaaagcaccauuuucaaaguaccauacuucguaggcuuucaaaguuacugcccuugagaagcuaacauccugauggaguauuauuagguauccuuaaguauugauacucauugaagaauacuuaauuuuggccagacacagugggucaugccuauaaucccagugccuuggauggcuaaggugagaggaucaccugaggccaggaguucaagagcagccugggcaacauagcaagacccgaucucuacaaaaaaauuaaaaauuagccagccaugguggcauaugccuguagucccagcuguucaggaggcugaagcaggaggauugcuugaguuuaggaguuugaguuuauagugagcuaugacugagccacuguacucuagacugggugacagagcaagacucugugucuucaaaagaauacaaaacuuaauucuguuucucaguugugaacuaucagucuuuugcaaaugauuuguccucuguucaauccucuucuucccucaaguagauauuuucauuaauaauaauuucucuucuuuuucuguuuccugcuuuauaagauguauuaaaacuuucuccaaaauaggugacugauacauuguucuuaucauuuuauaaacaaaguaccauacuuuguaggcuuucagaguuaaaaaguaauauaagagcaaggaaguaaaaggaaucagauucaguuuauaaggaaaauaaaauccagaaauccuauguuugggauauguauggaaagccauuaggauacccuguuccuaaaagaagagugaccacaguaccuauucauacaguagguuuuaagauuuuuuucauaaauggauuucucuauaggucaguuugguuaaauucuguacaacuucaaaggacuaaugauugacaggauuaauauaauaaaacgucucaaaaauggaaugugggaacuggcugccauauaaagaauacaaaaggaggcaagaagacuguuacaaucaagacaccguagauggggauuucuauacugggucaggagauuaguuacuaauagaaauaucuaauuaagggaagggaggauagaguuaaagagaggagaaauuacacugggagcaguggcucaugccuguaauccgaacacugagaggcugagguguaaggauugcuugagcccagguugucaaggcugcagugaguuaugauugugcaacugcacucuacuacagggugagugacagaacaagacucugagauccugucuguuuuuuagaaaaagggagagaggaaaaauuaguugcaaaaguagaaguagauugaagcagucaagaaacagaaggaaauauuuucaaaugggugucauuauuagaaacuauguauuaauuccuggagauugaauuggaugacuucuggaaucccuuccaacuuuaagauucuagguguauuauccugaguacugcuuuaggcuuuguguuucucuuuauggccaaaugguucuccuuugagggacuaaggauuguuuuaaaaggcaucagauaaauuuagaaauacauggauauaauuuagguauacaaguaaauaaaacuuacuuuugcuucuggucaugauaaaggaaacaagauuuacccuuucaacuuaacuagaaaauuagacaaaagaugaaacaacaauuuucagacauuggauaacagguaguaccaggcagugaucccugaggaagggaaauaaaagguauguaugcuauaauauccccagcuuucuagggugggguguguguguugugaaggagggacugguagagucugugcagaggggcuucccuccagucuuuggcugaguaccaauuugugcauguaugaaaagaagcuaccagaggcuggggaaagaaccaccagaaagaaggaaucagcagucuuagagccagcacaggugucaauaguuuauguuccaaccaguuaagaguagaaaaaccuccuaagucacagggcauugaauagaaucuucagagggguauugccucagaaauagggcaaaacugacccuagaauaaaggcugcucuggacccaccaucacaaagccuaaaaacaaaccucaaaagccugaaacugauccaaauaaccuauaucccagagaaaagccaacaauguuuaaaggaauacaacgaauuccaucaacaacaaggcccagcauaaaauuugcaauauccagcauccaacuagaaaugaccagacauacaugaggcgggaaaguacaauuuaugaugagggagaaaagaaacacucagaaaugaccaaaauaauagaauuagcagacaaggauuuuuaaaaaguuacuauaaauaucuuccacauauucaagaagauagaagaaaauggacaucaugaggagagaaauggaagauauuuuuuaaacaagaccgaccuugaacuucuagaaaugaaaaauauaucugaaauaaaaauauauaagguaguauuaauagauuagacacuucauaagaaaaaauucguaaacuugaauagcaauagaaacuugaauaugagacacacaaaaaaagccaaagaaagauaucaagagcaucagugagcugugggauuauaccagacagguuaagcauauaauuggagucccagaaggaaaggugggggcauaggugguguuagaaaaaguauuugaagaaauaaugauggaagauuuuccaaauuugaaaacugaacugacaaguuugagaaguuauccauaccccaaguagaagaaacaccaugcuaaaauguauaguaaucaaguuguugaaaacuggugauaaaaauauuaagugcaacgagaaggaaaaaggcacauuaaguacagaagaacaaagauaggaauaacugucggaaacgaugcaggccagaagacaauguagcuacaucuuugaaguacugcagaagaaacaaauuugucaguagaaauucuauacccagcaaauauaucuuucaaaaaguaaggcuguacuuuuccagacaaacaaaugcaucaccaacagaccuguaccagaagaaauauuacguguucuucaggcggaagaagaauaucaaauggaaaugucagucuacacaaaggaaugaagaguggaauugcucucauuuuuucauaccucuagaagacaggugacuaaggcagaacuaaaacaacauacugugggauuuauaacauacagaaguaaaauauaaucacagcacaaagaaggagacaaaauggacaaauauacuguuggaagauccuucuacucuacauaaagugguaaaauguuauaugaaggaagacuguacguuaaagccauaguaaaucauagaguaaccacaaaaaauaaaaauuaaaagcaagauauauuuacuaagccaauaauggaggcaaaauggagcuuuaaaaauacaaaagaguuggaaagaagaaaaaagauaaaaagaacaaauagaacaaauaggaagaaagagcaagaugguagauuuaaacucaaccacauugauauuaaauguaaauuaucuacgucaacauuguccaauagaaauauaaugugagccacauauuuuaaauugucuaauaguuacuuuuaaaaaaguaaaaugggccgagugcaguggcucaugccuguaaucccagcauuuugggaggccgaggcggguggaucacuuggggucaggaguuugagaccagccuggccaacauggugaaaccccgucucuacaaaaaauacaaaaauuagccaggcaugguggugcaugccuguaaucucagcuaccuggaaggcugaggcaggagaaucgcuugaaccugggagguggagguuacagugacugagaucacgccacugcacuccagccugggcaauggagcgagacuuuaucucaaaaaaaaaaaaaaaaaaaaaaagaggaaauaaaaugaaacaggugaaauuaauuuuaacauauuuaaggcuaggcacaguggcucacgucuauaaucccagcacuuugcgaggccaaggugggugcaucacuugaggucaggaguucaagaccagccuggccaacauggcaaaacucugucuacuaaaaauaaaaaaaauuagcccgucaucgugugugccuguaauugggaggcugaggcaggagauucacuugaauccaggaagcagagguugcagugagcugagaucgcgccacuguacuccagccuggaugacagagcaagacuguuucaauuaaaaaauauauacauauauaaaauauauaaaauaauauauagguaauauauguuauauauaaauaauauauuuuuacauaaaaauauauauaauacaggucgggcgcaguggcucacaccuguaaucccagcacuuugggaggcagaggcagguggaucaccugaggucaggaacuugagaccggccugaccaacaugcugaaacccugucucuacuaaaaauacaaaaauuagccaggugugguggcaggcgccuguaaucccagcuacccaggaggcugaggcacgagaaucgcuugaacuugggagguggagguugcagugagccaagaucacaccacugcacuccaaccugggugacagagugagacuuugucucaaaaaaauauauauauaauguauuuuuuauauauaauaaauaauauauauguaauguguaauauauuaaauaauauauuuauauauguaauauauaauauauuaaauaauauauuuauauauguaauauauaauauauuaaauaauauauuuauauauguaauauauaauauauuaaauaauauauuuauauauguaauauauaauauauuaaauaauauauuuauauauguaauauguaauauauuaaauaauauauuuauauauguaauauguaauauauuaaauaauauauuauauauguaauauguaauauauuaaauaauauauuauauauguaauauguaauauauuaaauaauauauuauauauguaauauguaauauauuaaauaauauauauguaauauguaauauguuaaauauauuuauauauguaauauguaauauauuaaauaauauauauguaauauguaauauguuaaauauauuuauauauguaauauguaauauauuaaauaauauauuuauauauguaauauguaauauauuaaauaauauauuuauauauguaauauguaauauauuaaauaauauauuuauauauguaauauauuaaauaauauauuuauauauguaauauauuaaauaauauauuuauauauguaauauauuaaauaauauauuuauauauguaauauauuaaauaauauauuuauauauguaauauauuaaauaauauauuuauauauguaauauguaauauauuaaauaauauauuuauauauguaauauguaauauauuaaauaauuauauauguaauauguacuauauuaaauaauuauauauguaauauguacuauauuaaauauauauguaauauauuaaauaauauauuauauguaauauauuaaauaauauuuauauaugugauauguaauauauuaaauaauauuuuauauauguaauauauaauacauuaaguaauauauaaaauauauauuauauguaaaauauauacuacauuuuaaauauauauuaaauaauauauacuauauauuaaauaauauauauaaaauaauauauacuauauauuaaauaauauauauaaaauaauauauacuauauuuuaaauauauauuaaauaauauauacuguaugguaaauauauaauauauacuguauauuaaguauacaguauauauuuauacuauauuaaguauauuaaguuauauauuaaaauauauauuaaauaauauauaucauguauuaaauuauauauugauauauuacauauauuauuaauauauguuauauauaguaauguauaauauauaaauauauuaauauuuuuauauauugcauaauauguaauauauuaauauauuauaccuuauacauuaauauauauaaauauauaaaauauauauuaauaugauauauuuuauuuauauauuaaauaauauauauuauauauucaauaacguuauuuaacaaaauaugucauuuuagcauguagucaaaauacuauugagauauuuuaccuucucuuugaaaugugcuguggauuuuacacuuauagcacaucuccgguuggauuagucacauuucaagugcucaauggucacauuuggcuaguggcugccuuacuaaacaguauaggguaaacauccaauuaaaaggcagauauuggcuauccuuggggaggccagcaaauuuccggauaagggaagcuggugggcaggaaaaaggcaugcaauggcccucaugagccagaagaauagcugcugacugaugccugggggaccaagcccauaauuguggagcuggagccgcacugugucccuugcuucagucugaucuuuggggagccugcacaguucugaccucaguuaagagcuaagggaagagauuugggaauguuuggcccuguguaacagcaaaaggauucauuggugagggugucuggcagguauccguaaagauaauaagaugaagggaacaucgccguuuggaaagugucgugauaugauacacaaguugugcugccucuguggcucuaaggcauaccaccuucagaagucaaccuguggcaaauguggcuccccugccaagcgcaagagaaaguguaacuggacugccacggcuaaaagaaaauaccacggcgacugguugaaugaagcaccuaaacauuguauacugcagauuuaggcauggauucuuugcaggaacaacaccuacacccaagagggcagcaguugugucauccaguucaucuuaagaauuucaaugauuagucacacaauaaauauuccgguuuuuaaaaauguauauauuuuaaacauauauauguuuauauguauauguuauaucuguauuacauauaugugaaaagaggcagagauugucagauuggauuaaaaagcugucuguaagaaacuauuuauuauuuauuuuugagacggaguuuuggucuuguugcccaggcuggaguacaauggcaugaucuuggcucacugcaaccucagccucccagguucaagcgauucuccugccccagccccccgaguagcugggauuacaagcaccugccaccacacccagcuaauuugucuauuuuuaguagagaugggguuucaccauguuggccagccuggucuugaacuccugaccucaggugacccaccugccuuggccucccaaagugcugggauuacagaugugagccacugcgccuggccaaggaaccauuuuaaauguaaagacauagguuuacaaaaguuaagggacagaaaaaauauacccugcaaacaugacucaaaaaagugacuuauuaacauuauacaaauuagauuucagaacaaggaauauuaucaguaauagagacauuucuuaaugauaaaggggucaguucaucaagaaggcuuagcaaccuaaauauguacacaccuaauaacagaacuucgaaauacgugaagcauaaucugauagaacugaaaggagaaauagacaaaucuauuacuguuggagguuucacugccucugaguaauggauagaauaaguagaaaaucaguaaggauauagaagacuggaacagguagaucgauccuaugcacccaaauguuuguacaccaggaacacuuccucuacucagcccucuaugcccuauccuacgugaagcaggauaacuggagcauuuccugucucucuauuauuuuccccccaagacccuauucucccucucauuccuugcugucaauuuacguggaugaauuggaaaaauagcaagcugacaugucucuuuuuugggggauggguucuacucuauaaacccauauuaguuauuaccaguuguuuccaauuggaaaagcauuggacuguuggaauacaguauuucuaacuucaccagcuagugaaaggccaaugaggaacaaacucauaggaaauaugggggacaggacgauggugaaagaggaauuuagaaucuacauagcagacuguaauuacacugaaacuacagcuaaccaggcagacuaauuaccuacuugguaagcuucaucucugaaaagaaagagauaucucucagcuauucagcaucacaauagccugguguguagagagcauauucuuacuugauugguggcauaaaauaagaagcaaaacuuuauggggaaguacuaaagucacccgauuuuuauugcagagucagaaucuggaaccagagcacuugcauuuugaugaacauucuuuuuuuuuuuuuuuuuuuuccugagacagggucucacucuguaauccaggcuagagugcaguggugugaucauagcucacugcagccucaaacucccgagcuaaagugauccuccugccucagccucccaaggagcugggaccacaggaaugugccaccaugccuggcuuuuuuguugguuuuuaguuuuuagagagaaagucucacuauauugcccagccuggucucgaauuccuggccucaagugauccuaccaccuuagccuccuaaagugcuaggauuacaggcaggagcccacacccagcuuugucuagcauucuaacuuucagaauauauauuuuugaugggaacggggggaauugguaguggucauaguuugauaauuuuuccaaggaguaguuaaaucugagugaugcucaguaaagagaggaaacaaccugcaaaacauuaaguucaaccagacaaaccuagccuuaggaauagguuuuccuuagagaauaaaagcugauugcauaagaaggaaaaaaacuaggcaaaaugaaauaaauuaguuaagugacuaugaugaauccaccauugcuguacacuuacguguagaauaaaacgaucagaacuaaaguuuucuaacgugacucuuuggcuuccacauuauuaugguuuaucucuuugaaguguuucuaaauagaacuagcccugauuaaccagggauuuaugcaaggucacauggagaauaguaguuauucuccauaaaugacuccauaaacauguugcuugccugucuuucucuaaaaguuuagcuuuaauucugauaauuuguuccuugaauuggcauguaagaaaaauucugugugcauguuugcagugagggaaaccugccuuccugguuucuauaauauuacuagguuagcuccugugagugaaugaccugaaccauacuauucaaaugcugcuguuagucucuuggacuuugugguugauaaggguaaauuuaauuugaaaaucagaauggggaggucaaggugaaaaucuagagagguaaaauuggaaaaauggcuuuuguccccccaaaaguugucuugaucucugcucagaaguauugucaugcccaggccuuuuagaacauuuuuucucaagcuaauuagaagaguucaaacuauaagcaugagaauggcuaaaaaucaagacuuuacugguagugaaauguuuuauuucuaaaaacaugagaaaacaauaguuuggcugguuuacuggggaagaaggaagauacaaauagcauuggucguuuaugucauugugguaauguacaggaaaaagauugaauccuuaguuugaaaacauuguaggcuuuucucugaaagaaaagcuuuuuucagcuucagccuggcagcucuucaaauaaaaucucaaaggaacaaggcacuauaaacaacccacccaucccuaaacaugacugcauagacaaguagaugcuuauggccaaggcugcaaaggcagcaggaaggguagcuccuuaagcaccaagagccacagugagcaaauagaggcaagugugggucccagaaaaggugacagguggacuaauguugacaguuaguccucagauugugguauauuggugagacaaauagcaagcacaggacucaucuacuuuuagcucauuucaaagggaauuuaggaucugcuggugcuaagagagucuuguuugaggaaagggcuguugccaacuuggcgucggggacaguugucuucacaaaagucaagcaaaugcugugaccaucacugcuccucuuucaucuugaacacugugaucccuucucucauuucuuuuuccuucaucuucagcccuccucugugagaugacauguaggacuuuuuuguucucucuuagcucauuuuuuugguuuaauugugucuuggcugaacuauggcaauuuuccucauuuggaugguguaauagcuaaaaaaauugaggagaaagacuugaauccagauucugccuuggaugucagauuuacauucucagcuaauguggggagcauugaggucaccaaacucccuucuacugggaucuaggggaaaugaaaaagaacccagaucauuccuuagagcuaauuaacuaguugacuuuggaggccauuuuccucucaguugagaaacuuugguugggugcagcaauggaagaggaauucucaaagggaacagauaccauggugucugaugacugggguucucuguucuuguucagcuguguuggucuuuagcuuucuagugaacccucugaaggugaaaaaacaagcaaaacucaggcuguguaaguccagcuaagcuuccuugguuucuggaacucuuuccucuugaaaaauagaauagugauguauagcaugacacucauuuaugucauucuuuuuuuuuuuuuucacuucagacuuacgauuccagagguaaucucugauaggcaccuaggggagauguauuuccauggcugucaugugcuucaccguccuuaucucucugccugauuccuuucaccuccugcuucaguccuuauuucuuguuggaauauauaagcugucugccccuauggaagguuucgcuuacaguaacuggcagaucaucugcuuaugucuuggauugaaggguuuacccuauaacauggccaacauuauaagauggguagaaggccagaggaaucagugaauuccuucuugccaauuuuuccucauuagagaacauaguuuacagccuagaaaucuguacuugcugggaagauccuacugcauuuauggcugccuucggaaaccuagaggcagucuuuagcaccauuauccugaggggcagaguuagacugaaaacuuauaguuaagaaauaccugauucuaauugugucuugauuaauuauuaucuguaacaacugaucuccaguuaucuauugggcaucacacuaggcagagaauaagccacaaccugaguccuuugggcugacugggccuguugcucagucaucagcugcagagaaaacagugucuuucuucaguccuagccuuccccuaccucagagcucugccucauggcgagugugguuuucccgcagcugccuaggcauccucaucuauaggcccuuucucuggucuagaccgugcuccgguguguuccuggcaguguuccccugcugccuacccaguaugucguugcuuacuguugggcaguagcucacuguucuggcauccugguguguaaauauuugucaaagaacaggggcauuuucccauuccccaaaaagcauucugaaaaaugugccuguuuucuuagucauauuuccaagccguggaucaguuagcccauucauuccuugcaguugacagacacuggccugaccucagcuggccacauaaaguaaguaugcaguaacuuccggcacgauaacuuucaaguuuuaguaccaaagaguccuggaccuaauggaaccauacacaacauagucacuauuagagaagaugucguuucauuaacaaagaaucacacaucuccccacucagccauuguaauuucuuuccacacuuaauauugaaggcauaaauggaaucaacaaagaugagaaagcuaaccauauagauucugggguagaacguuauucuucauguuugugacuugacuuuaggucucauauaagguagguuuuuauacuuccaugugugccuuuauauaaaggugacauugcugagcuacuaucaguuuacagguguuuuuccaguauaauuaauggcuucuccugucacuuaguucuacuugagaccaaaagaguuugccucugcaggauggguuauuaaguugaaaaggcagucuuuaaccauggagcagaguuuuccaucuuuguguaaaaccauguggcugucauauaaaauuugaguucuugauuuuaacuugacuaacacuaggcgcuaacugagcucaguaucuacuuaaauugcucacacaguuccaguagauaaagguaacugcuaaugugcauuauuaaacugcuugcaugccuuccucuccuuuucuguaagccucaccuuaacaccccugucuuccugcagucuuuugaccuaaccuucagucuucuacaagccuggccagcgucugcccauuuguacucccaaccccauaauauauaugucagcuuuuucucuuuucaccauuuauagcacuucagccuucccccuucuagucagaauuugauuuagagaaaugaaucuguuggauguugaagacuuaauucaguuuauuaggaaacaauuacauaugcuauucaacacagcaacugcaacuauuuugaaaggcuaggccugagugucuauucuaauagguguaauuucuucccacagaucaucaauuucuacaugaauaugcugauggagcgaaguaaagagaagggcuugccaagugugcaugcauuuaauaccuuuuucuucacuaaauuaaaaacggcugguuaucaggcagugaaacguuggacaaagaaaguagauguauuuucuguugacauucuuuuggugcccauucaccugggaguacacuggugucuagcugugaguaccccuuucauuuuugauaaaauguaaaagcuauguacuuauagaacacacagaggguagugaguaguaguucuacauguucccuugauuauugagagaaagaguguuuaguaguagguugacuaaaaucagauagaucuaugaacuuccuaucaagauugggauguagauuuugaagaaagcuguggaauuucccuuucuagaaauauuuaaaagagaguuauagggugucuaagcagccuuaaaggaaggcaugggggaaaaaaagugacuuauuaaugaugcugccacucagauucugugacuguuauuuucagccuaaucauaacuuaccuugcauacuugguaauuuaauauuuuuaugacucugugagcauuagcuuaauguguuaauaaaacuauuucacagucuguuuuggauuacauuucaaaagcauaaagccaaaaggaacuucucaauauaaagaaauaaaacccagaaucugcucaccaucuuucugaaacuuuguggaagugauuuugagauacucaccuuauauucccugaaaaucauguaguuucuucacuguugcccacuuugcagagggagagaaugaacauuagaaaaaggcuucacagcaauaauggggccaccuguugaugagugccaucauaguuuuauguaaauaacccuucauuuuuuuucucuacagauuaagcauaauauaaugcaaaauaucagucaaacuugucaugauuuuguaggaagucuggcaaaagguuccaaagggcagggaagggaaaaacugauaaaccgauuuucuucaucucauaaacacagagacuuuuuuucuuauucucagguuguggacuuuagaaagaagaauauuaccuauuacgacuccaugggugggauaaacaaugaagccugcagaauacucuuguaaguagggaguugaggacagaagaguuugauaucggguauaggugguguuuuuccaguaauugaacucaguuguuugauaccuucaauggagugauugauaaaaucuucauauuaaguaaaaaugcauauuuuguaucuaaguaaguuuaguuuaaaaacaauaccaaaguaugcccuaaugggagcaauuacuauccuaaugcacuaaaauguagacuagauauaaagauauagaugcuacuuagaaaucauuuaauccaaccuccuaauuuuucagaugaagagaccaaggcccacagaggugccuuugauuugcccagguccuauuaguuaguggcucagguggaccagaaugcaaaucucuuuaugcuccaccuguuucauuuuccaaaauaccuauuccucacuguaccacucugauggccaggaggaaguacauuccacaauggugaacaguuugcacuuaaaagagagcucuauugaagguaugcacucaauacauuguugauuuggauuuaauuuuuagauaggagagccaagccuaacaguaguaaauaaauaccucaauaguaccagaaaaacacuuuucuuccauuagauugaguucuaaaggaccauauaaaccaaggaaaagaauaaaaagaauuguuccucagaaggaaugguagguagaaggagcuuaacuguuagaggcagaggucauguuccuuuugaguugacagaguggacauuagaagagacaagcuagaagaggcaugcucagcucuggagaaaacuuaacaauccagggauucccugcccaguauuauauacucuuuuccucagaagagcagaugaaacaaauuuguuccuagguauugucagccccauucuuaguguggcagcugucaucgauguuccccacugcuuaucucauucucuccugauaccuuuaggcaauaccuaaagcaagaaagcauugacaagaaaaggaaagaguuugacaccaauggcuggcagcuuuucagcaagaaaagccagguaccuuucaucuugaugaaauaaaaguccuaaaaguaggguauuuggggaggaaagaauuuuacugcuuaauucccagggaccaccuguguucgugucuagccugacuucagcuugguugguugguuucugggggaggauaaauuaagcuauccguaggaaaagugauaguguguuucuuauguagaacuagguuuucuaaaugcccagauauuuuacuaagcuuuucacuccuaaggggaauguuugcugauuauuuggccucugggggagggagcaguuuuuauacccuuaggugccaugggagucggagauauucuccuguuugauuaauacagaguacacagaccugacuggaauguuguauuuuguuucuuugagccucuguuguccugacuggggggccagagucaucuguuuguaauuuagagaaaccuguacaauuuauaucuuuugguucuuauuuuuaaucuaagaaggaaagaagcuuggaaagaugucauuuuuuuuguuguuggucuuccaggagauuccucagcagaugaauggaagugacugugggauguuugccugcaaauaugcugacuguauuaccaaagacagaccaaucaacuucacacaggugagcugagccuuccauagggagcucuaggauuacuuugucuccaagcugcccuguagauguuuuucucuccaguuguucucuuuaggggccucuacccuaaccuuuagcaugcuucagcccaugauucauaacacugaugguuacuaccugaaucacaucacaaaagaaagaaaauuagugauaagccacguccuggguuaccacaccucaguuauuguaguaaagguuucaagagcagaaccuucucugccugucuccucuaccuacuguaacuucuagagagaacugggaccagagcagguuucuuuaguucccuugcauuucguuaguagucagguuugggaauaggccauaccucaaucuccuaguguaauuuguuaugcugcccccuccccugaccccucacuugaugaaucuggucagucuucucuuagagagugauuggucauuucuguccauguggucucucagaccaaaguggauugagauuagagauuaugguuuauucugauguguucuccacuuuuacuucuguuugaaucagugacuuuaccagauuuuucuaccauagcccuuugucuagaccagccugagcugacucuucaaguucccuuaauucuucuaaaaggugaauuuuuuauuuuuaggccuaggcucauauccucuuaaaaguucaacauagaagacuuauuagacaccauucucaaaauucuuagagacgugggcauagccuggggauuccuggaaauacccaguguaacuucuaaggcuauaauggugaaaaauaacaauagaaaaagcaaugaaaagaaaaaaacuacauguaaccaagaaugaauaauuuaaaagaccagaaauacaacugagacuguuuguugaaaaccuugcaaaagaaagaaguauggggaaaggcguaucaggucuagacaaaagcauugaaaauuaagggugucucugugucccuacagcaacacaugccauacuuccggaagcggauggucugggagauccuccaccgaaaacucuugugaagacugucucacuuagcagaccuugaccaugugggggaccagcucuuuguugucuacagccagagaccuuggaaacagcugcucccagcccucugcuguuguaacacccuugauccuggaccaggcccuggcgagaugcauucacaagcacaucugccuuuccuuuuguaucucagauacuauuuuugcaaagaaacuuuggugcugugaaaggggugagggacaucccuaagcugaagagagagacugcuuuucacuucuucaguucugccaucuuguuuucaaagggcuccagccucacucagucccuaauuaugggacugagaaaagcuuggaaagaaucuugguuucauauaaauucuuguuguuaggccuuacuaagaaguaggaaagggcaugggcaaaagguagggauaaaaaccaccagcauauacauggacauacacacacacccacacacacaaacacacacacacacacaauuuucacgauguauggucaggaaugugacuguaaacuggacuuuggggcccaggcauaagucccuuccuccaggaccuuuccuauuuauaugucccuauacaaaauccaucugcuuuuauacguagcuguuuuaucaucuguagcuucauccuauccggaggcacagcacaugagcccuggacaggucccaaaguuccaagcaguccuuuccgugaaagcagggguuugcaugugcuaccaacacaugauacggggaagacccacccagggagcgguuucaguggcgcaacaaagcaccacuuuuacuguugccuacuucugaccaagaagaaaaaggaccuuaguauuuagcauaaaauuccagcgcuggaugaaugcagaucuaguuuggucuguggcuaguuuaaauauguuucuaaccacagagaauuucauauauauauacauauauauauacacauacauauauauauauauauauguauguauaaaauuucacagggauaugcuuuuuuuuuuaaagacugaauguguucaccauuuagccuguagauuuauuuccauuuuccaaauuccagcacacagagaucccagccccuaugaguaggguguuuguggacuaccuaauggaauauuuuugaggccuggaugaacuuugccauauggguagagguuacagagggaggugauauuuucagcuaaaaaaaaaaacggguggaguuuggacugaucaacuugagauuuaaaaacugcuauuccuuuuguucuuucuagcaucucuccccacccucugagagcuccucaggcuuagauagugaagugaucaaaugccagugucauuuuguacuuaaguuccaaaguaggaacauuuuauacuuuuuucuguauuguaauagguaguuuuguaugaaaucuuuucuccucucccguuguaccgcauucuuuccagcauugugcuuuuucccugggcuuauuugaaaauuuuacuguuuuauacaagcucguuuaguacauuuuucuauguuuuaccacaaguuacaauuugaaaagaaaacuauuuuuuuuaaauauuccauuguuaacugaauguuacuguuuccacuccagcaacuacauguccucccuucaacugccugccuuuuggggaaagaccaccuuuuguguguuuguuuuuucucucucuuucuuucccuuucucuuucuaucucucuuuauuuuucuuucuuuuucuuuguuuuugaguuuucuauaggaaauaaauagcuuucuauauaugaguugcuggggaccuucacauucucuuuuagaaagcuguggcaugcagucucauugcaggacuccuggaauauugucugguucuugguauuuacuguauguaagcaacaacuugaaagguggcaauauggugucgauuuggacuaugaaucaaaagaccuuuuucagguucuuucacuauugucugggggacucagaacaagauuguucucuguauuuauuguuuguccauuuagguaacaucugucuuaccuuccucacagacuuuguacagaccaaagcaacaaauauuuauugccauguauagcagaaaaugaaacaugcaacaaaagcacuuugaaaaauauauaaggaauuguugagccugucugaauuugggcccccuuucugacuaaugcaguuuugcacaagguagaaguuagugacccugagaccaucuuaccacccuggaccugguccaaauacagacuuacacaguggaccauucuuuccugagcuagccaacaagagcaggaguaguaucuggaaacuuuccccuuuguuuagggguaggcuuugaugaccaggaaaaaaaaaaagguauuucugcauuuuauggcccaaaggcauguuauuaauaucuuauguaauuuacuuuaaacuaaauaagacuuuuuucuccuguguuccccuuucuccuguguccacugcucauauucaccugccuucccuaaaaaaggaauauuugagggaugauaagcacuagaugccagcuauagagaccucaacagaaaccauaaucccaagaaucacuccgagacccugaacagagaauaucagacagaccuuucuuacccauuugagaaacacauggucugaggcacagaggcuaguuacaucccauuugucaccugggacccaccauugcucccaggaguccuauuuaggguugaauauaagaguacuuuucccucauccagucuggggaauuugugucaauugacuccucuguaugagaugcuucauacuucuauguggaauuaauuucuguauucuuuagccacuguaaucaugcuagcaucuucuauccacugcccccagcaauguuagcaccaagauccugagguagaaacagagauaaccuggaaaagcacuuccaccaaccccaucucauagccuguccauuacugccugguuuuacauggcccuuaaguggcucuaguggguaaagggggaagaguucacuugagagccccaauguuuuuaauguuucaguuucugguccugugccaucccuccagcuuuuaaauaugucuugcuggaguaagagagaggacugacaccugggguuucuuuuuguuugguccaccuggauggacuagcaugagguggaauaugaugcuuucacccugggaguucacauacccaagagagucagaaaaagagguguuaggcuauuaggcccuauuguuaaacaggccacgugcugaacuacugggaaggguaccuuauuuucccgcccaggagcaaugcaucuacagcuuggaauuccaugggaagggacaaggcucaucccagcauccuuuauuauaagucuagggccuuguuuuaccuguacugacuccuaacaucugucuacuaagaacacacacuaccauucccagcuuugaagguggaaaaggaaacgugggacagaggguuaugcuggucaccuguuaaaauaaaggauaccuuacacauacuuccuuugugggagagaaaagaguggcuaggaggcuuugagcugggaccucgaggaaauguuauugugagcugucucuuuggccugucagggagaugguagggauaauuccaauuaugugaaugguuggaccacguguccaggggucuuaucaaacucuaagauucuggaaugguauuaagugccacaauguugcugggaagaggaagucaaggcagagauucaaaguuaaauuuuuaaggccacuggcuuagcacuggcuugguuuuagaguuaaggcgacaagaccuuagcugcagaauuuucuccauuccaaucuaaggaguagccaucaauuccuuacuucuggagauugccuuauccuuugcagaacacaagugcuaggaaaggaaaaagugugggagaguggcacacaagaaguccagaguccaguccacuggagaccccucauucaauuuacuuuuauucuuuucacaaauaccuacugaguaaucguacgcaaauccuaucucuuugaugccuucccugaucacaugaucuuaauaucucucaucuggacaucugcagcccuuauaaucagaaaauaauauaaguccacaugguauuuguauuguaauucaccuuuugcaucaugaauggacugagacauguagccaccaagggcagguaaaugauuuggugcuuuuuuuucaaaccaggaauaaaagcuguuucuuucuggccugccagugaugagguagagguaauuauucaacauuuauuuagaaagacaacauugugggccaggcauaguggcucacaccuguaaucccagcacauugggaggcugaggugggaggaucccuugagcccaagaguucgagaucagccugggcaacacaaaaauuuaaaaaaaauauauugugaagaaaggaggacugcucauggcagccugcaaccuccuuuguggucccaaaucguucaucucuggccucaaaccuaacgcuccacucuacccuuaacaaaaacaccuuccucagcauuuagcaugcucuuugggguggguggggguucucagucucuaccaggggccuuguggaaguauuuucucuacacagcuuucuguuaaauaguuuccuccauccuuuuuauuuccggugauauugugcaucccucauagacugagacucugaggaagccccucaggcuagguguuuuacaagcacguguuuaagcacuggccuuagucgcccugaaggguggagugaaaagaugguuugacuauggaaauaaaagccaccuuguucucagguuuuuauagccugcugaccuuguccucaggaucuuagagucuguauuagagucuguagaccuuauaguuaacuaauuuaggaagcuaagcaaacaccaagcaauauaccuuaucaagaaggcagacucauaggcauguaguuccauacagaacuagaaguagaggaugaaggggcaaagguggagguaagucagggauaauguugccuuuaucugccuaucuauaugauucuuccuaauuuuuaaaaaguugacuuauuuaaaauaaacuguggaucuugcuuucuugcuuugacuggaaacucccugguaaaaaggacuugaugguguuugucucucugucccccugucucuguggcuguuugcucugucucugucugugccugugucucccgauccaagcuggaccagugauuggauccucgguguggucuggauuucugaguccaccccuuacccaggagucugaauacuguucauucauuuauuucaucccauauaccuggaagugaagccuggaacgcaaauaacaugcaaauuuguggcucuuuggcacuuuaaaaaaccaaaccugucuguggaggcugccaaagaacuuuccugaggccaaacacaccaaucaggacuuccaacccacccugcuaacuguggccuucuguucuugcuccucuccugcaccccuuucuucucacaauauaacuucgaagugaagugcuugccacuuuucuaccuguaaaacucacacucaugacaguaaaacauaagaaagcaccaacuucucaaaaaucuauuauuuugggggaacaguuuucucuauguuggguuagaagauccucuucuuguccccaggauguucucaaauucuaagguuuucuuuuagucaugguuaagacuuugaagccaauugaauauggagugacuagggaaaucuucaagccacguucgcucuccugauuccugaaugugguuaaaaauagcugacgaaugccugggucugcaccagguaucaccagucaggcaauagacugucccugcgaauggggaccuggaccuaaccaugggucagagucagccuuuaucccaaaccacucccuggguaucuggucuagucuugggcucugcagaaaguuacaaagggaaggggguggggugccuguuccuugaaccccaggaaaaauauuuuacuuccuuaccuuccugugccucauuuuuccauugucccaucaccagccaaucaucucugccuguaagagucaacccaucacuuuuccaguagcaucccccaccacucuccccugcccacucugccucagccacaauggccucuuugguguuugucuaagaagccaagcuugcuuuuacuucagggccauucuacucaaugcuuccucugggcucugguggaauguuacccuauaccccaauucucacaccccauagcuuucuuacccucaguuuuuccccacaguacuuaacagcaucuaacuauauuacaaguugacucccccuuaucugaaaugcuugggaccagaagugucucagauuuuggaauauuugcauuauacuuaccaguugagcauuccaaaucugaaacccaaaaugcuccaaugagcguuuccuuugagugucaugucagcauacaaaaaaauucaauuuuggagcauuucagauuugggaugcccaaccuguauuaaaugauuuguuuuauccaucacuaaaauaucuguauuccaggugcuagaauuauguauuccaggugccuagaauaguugaaggagagaauaguugaagggacgaaugaauuccuguuauuuagcaucuuugaccugugcuuccaucaugaagccuccacccuauuccagguucucacaucuuugugucuaguuuauacuuccuaccucagagucucuggcuucaaguucauuguccauuuggcaguuagaguuguugucuucaaauaguguuaaugauaauauaaacauuuaucgagaccuuggccugagacuuacaugucaaauacuuuauauguauuacuucauuuaaucuucacaaaucuaugauguagguacauuauuauccccauuucucagaugagaaaaugaggaggauagggauuaaauaauuugcccagagucucucagauuuucagugacagaaacagggagcauaugacuccaagaccccuaaaagugcuagaaucugcugcuuccacguggccacacgacuucaucucaacaggaaaaacgccugaccuagacuccaaggggacucgaccaaagugaaaccaaauaagagaaccuuugacaaaguucucaaagucaucuucugcuuuucucucgugagcaacauugagguccuuauuugucuuuucaucauaguuuggaagucaaggggaaugaggaggucccucugucauugguucacuuucucuuggcuucuccagacagggauaacaaggaauucuccucaccucucccaugacaacccuuuccugucuguccuuuuucuuuuuggcuccuccuuucauccucugcucuuggcugugcacauuagcaaaccucuuuucccucaaggucucuagucugaauccagaaaggggaaggcuagggauugaagguggugagguagggagacaucaaguggauucagccuguccccaccgacggccucaggaauccagugugccaggcgguggcccucucuggggaugaccuggggaccuauacuuguaggaauuuggaaacauuucuagugcuccauuuuaucuuuuugccucggucugugucucccgcucugucucuucagcauggaguuuccucggccauuccuacugguuugagaaugucaggaaugcagagccuugugcccucccucuccuccaccucccacccccauacacugagccccucugcccuguagaggcggaaguuaguucagcuacagacugagggggaggggugccgcccuguuacuggagaaggaagacagcacacauucuggcucaaccccuccuccugcccucucuccuauuucauccccaaaaucagucugccacuuucaucuuccucuucaacagacagccuuucccacccucaccccucacuggaggccucucuugaugguaauuacuccuaauuguuuucccuuggcucacgaagccuuuccuugccugcccugagccaacagcucuccugugucugcucagaaaaugggcucaacucucauggaaagagaggcuagccucuuugggcuucaaaacccuggcuuucuagaucuaagucagaggggaggcacccacuugggcucucucaaggcaaauugcaacagagaauagugaccaaacccuagcagcaaggucuccugaggagcucugagcauuucucugaagaucucagcaccagagaagguccuuugggucuggcuaggaaagggaacuacaggacucuugaauggagucuccaagccccacagcucuggcccugguaguguggagaugccuaucucucgucagccauuccccuucucaccagaggaccauccuccaccucccacgccccucaguuccauguaccauccuacaccccagccaauaaggugaggaggccuuucgccagagcuugagaccaucucacauccccucacucacuuggacaggcacacacaggcuggcuuuauguuguccccuccugguagccccugcuuccauaucgacaccacaguaacuggugguaggggugaggaaggagggugaagaucaugguuagugugguggugaggagguauacacacugucccuuucucuuucagcagggcuacugauccugauucauucuacccucaaaagaaggucccuaguggucuagggcucuugaaaauccugucuacccccagaaaaggauugugugguaucacugagagagcagaggacauagaaauauuuuauuuauucauucauucauucaacaaauacuuagugaaugccuacuauggugcuggaaacuuucggcaucucuuggcccaggcacguaacacuuugcucuagccccagccuaaaauauccugucccagggcucaguuccauggcaccuggcagccugagccacaucgccucccacccaccuccaccccaacucauugcugcuuugugcagcuguaaagccucuucuagugggcaaaacaggcucugcaagaagaggccugagaaguagacauaagaauggaggaaaagccaguuuuaccaaauccuagaccucuaaggagucucaaagacacaccauaaagggccugagcugagagauuucccuuagacucaaagauugcaugguuggaccuucugaagcuaggucucuuuuuccuucuuuccuauaucggggccagggaaucaaauucuauuuuuaacagaauguuuacaugaaucuaagagucuucauuuauuuauuugcccaucucuccauucauccuucuauucauucaacugcuuacucaguauucuaggagcuacucugugccaggcauggggauagagggaggaauguagcauggucgcuggucuaugggccuguccuuugguccccaaguucucucucucagcuuuggcuacuucagaucuuccuucucuccuuguguaggggaccagacuccaacccaggaagucucucaauggauaacuggaauuccuacaucagaggccacugguagucagggccagccaggggaauagaggccuggcuagugauaggaggaaugaggaaggugccaccaggccacugagcccaucacugugguuuggcuccucuggugaaaaaauagcaagccuggacaacuaucucccuguguccugagcucuggguugcucccagaugggaguugcuccauuaaacaaaccacagccaaaggcaauaggggcccaggcccacagagcacuagaaggcggagugggaacauugggcccaggacagaaugugagccaagcccguccaucacaggcacaguggugugagugaggcccaauggcuggauggagggaugagcccacguagcaggagcugcaggugagucagggaaugaguugccacucccagacucaggcacaggacaaaucugagacagccacaaagcaaauaaagucagcuuucuagagucugauuuaggaauuagcugaagauucuucccccaaaagugcccagcuggguaauagguugagaauaggguugagaagagaagguuaugaccagacaccagugggguggggagcauguaugcauaugugcgugugcuauuuugaguuugggucuguguaauuucuuucuccugugucuucuacuucagucuaaaaccagaaaaacucugagugguuugggcuuccccaggccucuccuccccuuuccacauguggcugagggugaguuaaugggaccugcacacacagaggcucacacagcuuugcagacagaggcccauucauaccaggagugugcagcaccucucuccugggcuggccugcagugcugcuccuguaccaccagcaugugcgaaugagggacgugcacccuugcacaugcagccuugcucuucagcacacacacacgcagccacgcucaacucuuuuaacccucuaccaccaugugcaggguggcucuugguucuuggcuugggcucuggcuuugccuuuuuuaguuucuuuuacccaaugugggacccaccugaguuaacccuuaaacaaccuccucagaaccccaggcaguccaccuugguggcacuugcucggguaggggagugcccggguaggggagugcucgguaggggagugaacacaaucucagccaaagaacagcauggagaugccaccuuccaguggagggaaagagaggacuguuaaaaucuggaugcaagccacagccaugccacuagcaagcugugggaccucaggcaaguuauuugaccccucuggacuucagucucugaacugcgaggugagagaagagcuugaggagggguaaaccugagggccacagauaacccccugaaaugauacacaaaacauguagaauucuacauuuugcuggaaagagguuucaugaguuuagccagcuucuucugggacccuugaacccccucaaaaccugagaaccagugaacucaaacauuccaagacccuguaugagucaguuucuuuguaagugaugcggauauggccauuagaguccacucagucaucuaaggucagugucaacaucaccuugccccuagugccugaaguuaguuccccuacaugaccccaauccuauaccccuagguuguggaaccacaggccccuaucacauccaggaagagcucagcucugggucagacugaugcuuucucauuggauggaccccuuucuugaaugggguccagucuagcaggagccauggggcaagauggaauggaggaugggugaauaucaggaauaauaaccaugauacuggugucuacugagugcuuacuaugugccaggcauuguguaacaaaucaauaaaguacauaauaccauuauuuccauuucacauaugaggaaacugaggcucauggagaucgucaguugcucgggaucacucaaccagcaaauagaagacacuagcacugacagaagaucugucugacuccaaagucucuacucuuagaaaagagaaggaaugagaggacauuuuuggggggaugaccccaucucuggugacauuucagaugcauugggcacugcggugcagcauuuggggcacaaagcugcauaagggaucucucuggggagaagaggccagagccagcagucuaccucagccaguccuuggggguaugagggcagcugggaggcuggcugaagccacuggcucuccagagcuuuugcugaggacuugcucaaaagccucuuuguucacuguuccagcuuccacaagaagcucuccaccccuggguccucagggaccuugggcugccccaccaacauacaggggucuccagccccucccaccaucagccagaaaacagccagcccucaucacucuacaggauuuuuaaaaggauggguggcucagggacaagggacaggacugcuagggagauggggugggcaggagggacuguguuaggaagaaucaguggaaguccuguaagccggcugcuccccaaacaaacauuuuacuucuuuuggaggccaggaaugaaagacuuauuagcuguuuauauuacuuaaaagaguuuugcagaugcuuauuaauuuguaguuauuaauauuaauuauuauugauuauuaaaggacucagaauccacuugcuaacacuguuuucucugucuucuuccuguaaucccuuccauugcccccuuccagccucuaugcuaucagaaagagugaggaagacuggaaaauaugccagugggauacuugacagguucccuugaacugaacuccagccuucuucauccccagacuggcaucuagaaggaaccagagaaugcaggaaggagucccagccugaagguucuggaggguagagucagcuccacugggagcagggaaucagggcaucucuagugccuuuucuacuucucuuacuggacacuccuaagacugguuuucuuccacuuuuuugcuauggcccuucuggaucugaggucugucuccuccugaggguaggaauggcagucacuguugcauuuccuaagcucaggaagaauaugauucacagcucugugggagccuaacuuucucuggcuccuccugcuugccugggccccacucccaaaaccucuccugcucccugcuccugcucaacagucaccuccugcuccgcucugguacagccugucuuucugcucuggggcuugugguguuaggaaguccucaggacuaggugggccaaggacagacuagaaacuacuuaaggcacaggaaggcagggguacuauauaaaaaauuaagauuuaauuucugauauuucauauuuuuaaagcaucaaaguaauccucauggcaaaaguuagaacuucgucagacuucuuuauacuuaaucguuagaauugcuuucauuuugaauaccaaucguuucaaaacuugguauuuguaaagguuuuaauccagcuccaauaguuuugcacugucccuaaacaagagaaaaagcagccuggaaaaaucagcccugcauggccccaaaaugggggcagagggauggcagagugcuaugaagagcacagcauuuggggccaagaggcuuagguucaagccucaaagccaucauuugcuaacugagggcccuuagaauuacccucucugauccuccauuuucuccuaagaugggcauaaucuuaucuauuuacuaccuacauaauauuagccaguuacuucgcauauuguagugaaggccaaaugggguugcaggugucuaagcacauuaaaauagucacugcaucaacauuaaucgucauuagagcaaagaguggaaggaacgucccauagcgaucacuagaagcuuuacaacagcaucuuguccacuucccagccucuagucuaacucaaacauauccagggaguagaccccagcccgccucacucuaauucugggcucaaaacuuaggaaggucuuucuguugcugaaauaaacacuucuuggucucaugaacaacaaucguuuaauucaaggcaaauuucuaaaaggguucccuuugcuuuacaaacaccaccugaccaggccugcaagggaaggggaaccauuuuaaggggcccccaccaugcagggccgcuuggucacugugcuaucgaugaggacaucaucugcaagaucacuguuuucccucuggccgugguuggaugaagcccagugugcuguucucauuguuugggcgcagcaucacaggcuaugaguugaaaauuggcucuccuuggacaguccucaagcacuacauuuuuuucagugacucucaccagacccacagaugaauuuaccuucucugcguaugccuuuugacugguucuguuucagggaaccgcaagcucaauaagcuccacuguucuaccaagcuggacaaacagccacgucucuguucucuuggccagacccugaggccuggaguccugccuucaggaauuccagaauucuagaaaguuagagcuagacaagaccucagccuucaucuagucuugcuccaaccacugugcggauggggaaacaaggcaugggcuggggaugacuuaagggguauaaaauguugggcuuucuuuugucaagcccagcaugugccuccuauaggcaccaguggucucugcaaguccuggccugcuggccucgcagccacagagagcucggacucucucaggcagcucacuucauugcuggaacaauagcaauguucuuccuaaugcugggcaaaaauuggccucccgccuuccuuuaaugcucaccugcuugugcagucuccaaggagagauaggucuggccugcauagaacaauuggaaauuaauucauccuuaaaggaaguggagcagacugucccaggucauucuugggcagccucugccauuagauuggagagaaggcccagcacucugggucuacacagacucugaauauagagaccuggauucauguucuguugccuaagagcuauuaauacacgauggugagcauguuacuaaccuguuuaagccucaguuuccucuacugugaaaacagagguaauaggaguuuccuauguugguucauucuccguauggcucacccaugauccuaagauggcuaccuagagaaauauggcuaaaggaaugggucauucccucuugucuugcuggcaccauacaacuuggagaaccuguucagauaugcuuccauagaucugcucaacagccccgggagguagacagggagguuuacuauuuaugguuuacagauaagagaaccaggcugggaaauucuaagugguuuguacaagaucacccagcuaaaaagcaggagaacugggacuugaauccaggccuccugaauuuggugacagugcagacuugcuccgugccaucaggccuggcuccugggaaggaacacuuugagaagccuuaguggggcuuggucucaugccucacccagggccuggccauagugggugcucgggggaccuuugucuuuucugccacagccugagccagaguggaagcugggcugugcagcagagcaggaacccagcagguggcagggacagccuggcugugccugcuuucucccuuggugguggggaccacaugcuaagcuacgucuguaaacauggccacagccucuuucugaucccuugagcucugugucucugcauacacgucucuugguuuucuuucuccuuugacuucacucuccuccccacucuccccaugccccuccucuguccuggauuugaucuucugucuccuggccuccuugucucucucaacauccaguguuuuuuucucuuguugacuuccucuuucccucucucucccucaguuccuccuuuggaucuuccugggucgagcagacaagugagaggcuucugccgugcucagggcaagaggcugcugagcugcccuuccguccccuccucccuccccacacaucccucucccuugcccuggccccucaucaccuuggcuggcuccuccuugaugcaugggcugaggcgaagguacagggaggcaguuagagcagcuucccuggauacaaaagcuucuuucuaccccuuggagaugagguuuccaggcagguuauuuuuauagcagggcucaggcaggauucuucagagaaaauaaacaaagucauacacaccaguccuucacacccuucagccccuucccuggagaggggcccagccuagcugugccgacacagggacgcccaccaccccagaggggcugugggggcugcugccgggauaucaagaggccaggggucugggaugggggagggggcgccaaggagggagacugacacagguccccugcagccccagucaggccaggaggagauggcuggaaccuuggggucccugccucaccacuggggccagagucuuggguccggcaucuguaggggagagucagauucaaaugcaggcguaacccaaauuuucuaaaugcuuaccaagugccaggcacugugcuugcaauuuacaaacacauuuuacuuauuccucaucacugaauucacugaauucaguagaagucauuucuacaaguugccacuuaguauuggccucuaugugccuggcacucuguuaggugcuagggagacaagauuaaaugacacauggagagagagagagcucagagagcuuuccagcuggugagacauugauugaaucccuuacuaugaagauuucaagguggauauuuuuaug

SEQ ID NO: 17929 - RNA, 2484 nt, Homo sapiens
cagccuuggccgaagccacuguagcguccccucuccuccccccaccccgcuaguccagacuccagagccccacugcagcuuccagccauccucccuuuuucuucgccacuuccugguuaccauggagacacacgucauuuacgugccgugcgucgccuuggaaacagaggagcauccgcgacacccccgggagacccaccccagcugcugcugccacacucgcgggcgcugcccgguaauggccugggggagucccgaguccgacgcgccgcuggccucagccuggacgcggaccccuccgcgagcgcgucugugacccacggaaccggcaggcgcucucugcuuguggcgcccagagggcggcgcugacacgggcgcgauccgggaggcgaggcagggcagggcacuuucgucccggggcgaucccaagagacgccggcucugggacccucgccggguccucgucccgcagccucuucucggccucccgcgauccugccugcgcccucugcccaggacucgucucucacgucggcuccccgccagucucgggagccuccgcuucccucggcucccgcuagccccucccgggaccucucccccuccacccccucccccaccccggaggccgggcuggacgcgacccagagccuccgccacccgcuucugccacucaauggaggacggucugcuggagaucaugaccaaggacggcggcgacaugccggcgccccuggagguguccaccgugccggcagugggggacgugaucuccggggaguacaacggcggcaugaaggaacugauggagcaccugaaagcccagcugcaagcccuguuugaggacgugagggccaugaggggggcccuggacgagcaggccucgcacauccaggugcucucggacgacgugugcgccaaccagcgagccaucgucuccaugugccagauuaugaccacugcgccccgccagggcggcuugggcguggucggcggcaaggggagcuuccagagcgacccccaagagccggagacuccuucgccugggaucggggacagcggcuugcugggucgcgaucccgaggacgaggaggaagaggaagaagagaaggagaugcccagccccgccacacccuccagucacugugagcgccccgaaagccccugugcuggucuccuugggggggacgggccacuuguggagccccucgacaugcccgacauuacccugcugcaacuggagggcgaggccucccugugaggggacuccguggggcacuaccuucccgggcugucuuuggguuuccgagugcaugacgcgagggggacugaacggcgcggugcggcaugcuucacuuggacagcugcucuugugggucaggcagagagagacucccucgaggaaggauuuguagggugaaggacuuugggagcaucgagaauucuuucugcccaacuaagcgaauuauagcgaacugcggaaaggugaggcuccgggagaggaagcgcccaucucuggacucccauccaucccuauccuguccuuucccccuucccagacaacaggagaacccgugaauuguguaaauaaaauucugcuuuuucuauucugaaaaaggacuuaccuaggaccauggcaaauaaucucuaacaauuuaccuggaaauuaaggaauuggggguauuuuguucuggcaacaggaaauuuacccuucugcugaaauccaagauauucagugcucugcagaagccucucccccucacagaucucugcggcugcugauugguaaaggaagcuugaggagggaacugcagcccuaggaaucugggugaaugggguuccaagggccccugggcugggaggagcuggcuaugaaugugcaugaagacauaauagcucaaccucuaggauuuugcaugcagagcggauccugccuugucacugacuucaucugggauugcuuuuccacucccuggggcuuagagaacaaagagcccgguucacaggcagagacucgggggugcucagcagcagcccagauuuaggggacauuugagggacucuuggggccgcagccaaaaacugucucuccuggcuacaccugcuuaacuucaguuccuuuuucugucaauauguccuugcccacugccucucgguguugccuucauaaugucuuguguguguuaugugugucuacuuguguaguagugugugagcccucaggggcagggcuuguggcucugguguuagguucaggggcuucagacccuucuacgagcuccaagcuaucaauggcgcuuuucucucccucuucccccaaccagggcauggagcauguggcuguccugagguucuuuuacugaugugccgcccuuccaccuccucaaguggugacuuugugugcccucccccuccuuuguguauuccuucucaaugcuuuccuugguguuaaccuuaauaaaaaggcgucaucuccccuccuug

SEQ ID NO: 17930 - RNA, 2884 nt, Homo sapiens
cagaaccucuuguuaagccaccaucguucuuuuccaguuuuaaaagaacuugggaggccaaggcagacggaucacaaggucaggaguucgagaccagcuugaccaacauggugaaacgccgucucuacuuaaaauacaaaaaaauuagcugggcgugguggcacacgccuguaaucccagcuacucaggaggcugaggcaggagaauugcuugaaccugggaggcggagcuugcaguggugagccgagaucacacuccagccugggcaacagugagacuccuucucaaaaaaaaauaauaaauaauaaauaaauaaauaauaagcaacagguugugggggccaggcacgguggcucacaccuguaaucccaacacuuugggaggccgaggcaggcagaucaccugaggucaggaguuugagacaagccuggccaacaugaugaaaccccaucucuacuaaaaauauacaaaauuagcccggugugguggcacgcaccuguagucccagcuacucgggaggcugaggcaggaggaucccuugaacccaggagguggagguuguagugagccaaaaucacuccacugcacuccggccugggagacacagugagacuccaacucaaaaaaaaaaaaagaaaagaaaagaaacugaggcuaguacaaagguagcaagcaaucugaauugauuguucagagucagaucaaacuccuuguucuacucuuccccccuucucacuauugcaauuaacuagucuuaaaaaaauuuuuuuaaguaaaaaauaaaaguaagaaacugaguuucugagauaauaaauggcuugcccacaaccagcaaauggcagaauuaggacuugcccucuggucuucaggcucuaaauccugcauucuuuccaagguaccagaugaggccugucuaggaccgugacacuaacugcacuccucacaccacacaugcaagaccuuauuugcagggaagggacagaggccucucugcacagagcaucccugaaugacacuuaccggugcugacuucaggucauucaaggaaaaauccagacuccuucuggcucuguguuaccccagaagcauaugagaguccagaccuccaauccugggaaaccacuccagucaaaagucuuccagucucacuucccaaccugguugcaaccaagugguugccagcucccucuguccuaugacuacccuccugauccaucaugaggggccacaagucuuugccagcccaccucccuccaccccaggaggcuucucuccaaggcccacuuccucaaccuuauucagucccugccucuccccaauacccucuucccaggccccaagacucauacccccuuacagcagugagaagcacaguaagaggcaauggugggcccaaggggcagcagcugugaacagcuagcacaaugcugucuucaauaauucauucccagggagguugcaggcaccaugcccucacccugagcuagagauggcuaccacagcucagauccuuaaacugagaagggugggagucaagggugcggcagaggcuagugggagcaaguagaaagguacccagccugcaggccagacacuggcaccucuuuguuagagaggggcucugaugugggcucagagcagggaucccgugagauaaaggaacacgcaaauugccaugagcuagaggggcagagaggaagaauccaaacacauugccucacucccacucccuccagcuguacaugccagggucagccucuucccucauggcucugaccuucucaaggccacccucagccucuugucagcagccccacccuccuaaaggcccaaguccucucugcuccagcuggcauguuucagcugccccuacuuggggaacucuuuucccaaagaacucccaccacaugugccuguaaucugagucaaacaucgcagaaccuuuuccaaggauccuaacccccaccuccaucucuuuucagcccagcuucccugacuaaccucugauguuuacaaagcuuguaaacguguggggguggaggaaggacuugaacugaccccuugggcugugcugugcugugcugugauucagaguccuaaagcuuuaggaauuuagcgagagcaguuccuugcuucuagugagggagagaaggugguaaauucuaggccagcccccacauuccccuggccacccuagagauccugccaucaauacccauucuccauguggggcagcccuagaguuccacucauguuccaggcucauugcucacugcaauccguucugugagacuggaaucaccuaucaugugcaucagcagacccagaggggaaacugggaucuaagacuaaaagaaacauauuaucaagcaccuacuaugugcuaggcugagccggauucugggcagcaagagcaugaagccaaucaccucagcccucucaccuuccccuccuucccagguaccaggaggaaccuccaaaugcacacaacagucauacuaucugucccagagugagcaagaguuaggucuugaacccacagcugacuccccagucuguccagaggccugauuugggaaggagggugcgaucuugcugggcauugucgcaagaaacccuucagacauauuuauagcaaaugcugcaucaggggauggaaucugaaagugccucgaagcaucaaauaacaccaugaguccagaggcagagcccagaaaaagaaggcacugcagcaggagggauugagguuugauauuggaggaacuucccccagaguaauaucuggaacuggcaauggggauucccuguggaagcuacuuccacaggauuuucucagaagagaagggauagguaccuuuuucuggucuagguagaaaagauaaaa

SEQ ID NO: 17931 - RNA, 2884 nt, Homo sapiens
uuuuaucuuuucuaccuagaccagaaaaagguaccuaucccuucucuucugagaaaauccuguggaaguagcuuccacagggaauccccauugccaguuccagauauuacucugggggaaguuccuccaauaucaaaccucaaucccuccugcugcagugccuucuuuuucugggcucugccucuggacucaugguguuauuugaugcuucgaggcacuuucagauuccauccccugaugcagcauuugcuauaaauaugucugaaggguuucuugcgacaaugcccagcaagaucgcacccuccuucccaaaucaggccucuggacagacuggggagucagcuguggguucaagaccuaacucuugcucacucugggacagauaguaugacuguugugugcauuuggagguuccuccugguaccugggaaggaggggaaggugagagggcugaggugauuggcuucaugcucuugcugcccagaauccggcucagccuagcacauaguaggugcuugauaauauguuucuuuuagucuuagaucccaguuuccccucugggucugcugaugcacaugauaggugauuccagucucacagaacggauugcagugagcaaugagccuggaacaugaguggaacucuagggcugccccacauggagaauggguauugauggcaggaucucuaggguggccaggggaaugugggggcuggccuagaauuuaccaccuucucucccucacuagaagcaaggaacugcucucgcuaaauuccuaaagcuuuaggacucugaaucacagcacagcacagcacagcccaaggggucaguucaaguccuuccuccacccccacacguuuacaagcuuuguaaacaucagagguuagucagggaagcugggcugaaaagagauggagguggggguuaggauccuuggaaaagguucugcgauguuugacucagauuacaggcacauguggugggaguucuuugggaaaagaguuccccaaguaggggcagcugaaacaugccagcuggagcagagaggacuugggccuuuaggaggguggggcugcugacaagaggcugaggguggccuugagaaggucagagccaugagggaagaggcugacccuggcauguacagcuggagggagugggagugaggcaauguguuuggauucuuccucucugccccucuagcucauggcaauuugcguguuccuuuaucucacgggaucccugcucugagcccacaucagagccccucucuaacaaagaggugccagugucuggccugcaggcuggguaccuuucuacuugcucccacuagccucugccgcacccuugacucccacccuucucaguuuaaggaucugagcugugguagccaucucuagcucagggugagggcauggugccugcaaccucccugggaaugaauuauugaagacagcauugugcuagcuguucacagcugcugccccuugggcccaccauugccucuuacugugcuucucacugcuguaaggggguaugagucuuggggccugggaagaggguauuggggagaggcagggacugaauaagguugaggaagugggccuuggagagaagccuccugggguggagggaggugggcuggcaaagacuuguggccccucaugauggaucaggaggguagucauaggacagagggagcuggcaaccacuugguugcaaccagguugggaagugagacuggaagacuuuugacuggagugguuucccaggauuggaggucuggacucucauaugcuucugggguaacacagagccagaaggagucuggauuuuuccuugaaugaccugaagucagcaccgguaagugucauucagggaugcucugugcagagaggccucugucccuucccugcaaauaaggucuugcauguguggugugaggagugcaguuagugucacgguccuagacaggccucaucugguaccuuggaaagaaugcaggauuuagagccugaagaccagagggcaaguccuaauucugccauuugcugguugugggcaagccauuuauuaucucagaaacucaguuucuuacuuuuauuuuuuacuuaaaaaaauuuuuuuaagacuaguuaauugcaauagugagaaggggggaagaguagaacaaggaguuugaucugacucugaacaaucaauucagauugcuugcuaccuuuguacuagccucaguuucuuuucuuuucuuuuuuuuuuuuugaguuggagucucacugugucucccaggccggagugcaguggagugauuuuggcucacuacaaccuccaccuccuggguucaagggauccuccugccucagccucccgaguagcugggacuacaggugcgugccaccacaccgggcuaauuuuguauauuuuuaguagagaugggguuucaucauguuggccaggcuugucucaaacuccugaccucaggugaucugccugccucggccucccaaaguguugggauuacaggugugagccaccgugccuggcccccacaaccuguugcuuauuauuuauuuauuuauuauuuauuauuuuuuuuugagaaggagucucacuguugcccaggcuggagugugaucucggcucaccacugcaagcuccgccucccagguucaagcaauucuccugccucagccuccugaguagcugggauuacaggcgugugccaccacgcccagcuaauuuuuuuguauuuuaaguagagacggcguuucaccauguuggucaagcuggucucgaacuccugaccuugugauccgucugccuuggccucccaaguucuuuuaaaacuggaaaagaacgaugguggcuuaacaagagguucug

SEQ ID NO: 17932 - RNA, 13331 nt, Homo sapiens
ccucaguuggagggaggcagggaaucuggcuugauuggcgugcugagacgcaccuggcgcaacccucccuucugaaucgaaguucaagucccgcggacacugcaaccaugaaggagagacgggccccccagccagucguggccagauguaagcucguucuggucggggacgugcagugugggaagaccgcgauguugcaaguguuagcgaaggauugcuauccagaggugagcugcccgcccgcccgcuggccggcuuuucucccugccugcccgccuugggguagauuuccaccugcucaggagacguggcucccccagccccagcccauccucagccgcuuucugaggcuuuaccauccucagcugcuuuuuggcuggaggacugcccugccuuagcuuccccugagaccuguuccacuucugccgccccgcuggcuccuccucaccucuucacccagaggacccaucagauccccuccaccuuccugcgucccuggagucugcucucaggugagggcacuggaggcauuugaaagucugggguuucuucuugacguaaucccugccuauccgcucaccugcuccucaaaggcucuaugccugugccuucaggcaggcuucugcagccccucuguucaccuggccgggagggguuugagaggagaugagcuaggauuggcuuuggccuguggcucucucaaauugggaaacacaaaucuggggaugggaggaaucugugugugugugugucccugaucgccuaggauauggggggcuuaccccuggugugguggugugggggggugucauucacauuucucacugcugcagagcaaagugccugguccuccacagucccuucccuccugccccaggcaucuccucugguuucuugucuccugugacuuuacugucucucuggugagugcguguguagccagcacuaaccaggggaucugaggguaggggugcauggggugaauguuuccucucuuuucacagaccuaugugcccaccguguucgaaaauuacacagccuguuuggagacagaggaacagaggguggagcuuagucucugggauaccucagguaagaauucugcuccaaauaccccuuucccaccccuacuggucugcuguguagcugcugucuuuuagaaauuguuuuccccuuugguggggagaagugaaaaaagaggaucugaagacucauuaguuguggggagggcugacaguugguggacucaguugcaugguccaagggugcagagugggugaaccccaggagccacucucuucccugggucugguuccacccuuuagagggcugggauggugaggugaagggacccaugaauaguccugggggugggcaguaaaacaggacuucuccauuuccauucccuaccacccaacaugcacgcguacacacaugcacacacacgcgcgcgcgcgcacacacacacacacacacacacacacacacaccuuuuacuuccccagagcaaagccaaauaagaggcaagaggcagugcugcuggaggcagcgugguuggggcggagagacaagucugcuuuggggaaagguugcucagacucaguuuugucuccugcauuccaucuugggccacugcuguccuccugccgcagcucagccccacucgucacaccgcugcagcucggggaugaagcaaugcaucaucgauguuuuggaaguugggggagauggcuuaauauagggcauagucaguugugaauaguggccggcagggcagaggggagguuggcucugacuguuuucccucuacuggggugagguagaauaugcccugucucucuagaauguagaaacaauguuuuuccagccucucagccccaagcccuuagugcuaggcuauccuuugccuugauucugaccccuucccauuaucucuuuaccccagaccuuuuucaauagacuggcucagagucauaauuaaggaguaaaagccgggaauaagagaaagaaaauaaaauccaccccuccccaaaaaugcauauucaggcugaguuuaaaaagggaccguaaaucacuagguguuuccugcuacauauaauaaauaugcuguccugcuccuucaacagcuguuguucccaugcucuaauucugaggucugaaaagauuggggcuagggaaugguuagacagacaaugagccuuuccuccccaaacaaaaauuccccaaucugguaugcuuuucccuguugcaguuucagggcuugggaggcagcguucugguucuccugggcugugcuaugcuggcaagauugggcuagaaugcagcuugauggcaugauguauaauuuuugguuuuucaucugcuguacccucccaccuuccaaucuucccagaaucuuacugcagcucaucucuuuucacuaccaccgcccaaacgcccuccccccaccuccucccuccuuugacagucagaaugcagcccucaaaucccaaaccagaucauggaaaaucagcaaguguagucucuguucccugugucacacccccacccccaauuuccgaaaggauaaaggcugucaguuauucucaaacucccucuuucagauuagguucccauaaggaaggaggaaguggccauggugugugggauaggguuucccaauguugggcucaggguugacccuguucccauuauuuacuugcuagucuuaggggagggggauugcuuggagccaaaauggaggccuccuccccucccccuuccccagugcugcagugcuuccgcuccucagugcugcagugguaagaccccaccucagaaagggauggaggaggcuugcugaaggagcaggcagcuaucccaacuccccuguauuccuuuuuuuaaugaccaacauccccccaccagcuuggauuccccccaguuuccauggcgauuguggugcagggagaggggcugcuugcuauucugagcacggauugucuggguuccaaauccgcuacugcuccuuccccaggguggagggggcaggcucagcuccuagcauucucccauaugggaccaccugggucugcauugccuauuucccuuccaacgaaggacucuugcucuagccucuaaauccccagccaucggugcugcugucuuugagacugccuuccugagauguggggcggucaggagguacagcuuuccuuuugcccuuuucaguguaagccgaucuggguggguggagaaguggggcacugaacccuugauucucucccuccccugcuagccuccuaaaguucugaccccauggaaaagcagcaggcagguuauguaacaaggagguuuuucucuucacuggggagacccuggagcagaagggagugaaguugggcagcaggcaggcucuagaagagagaagcccugaaauaagugcugucucucugcagggcuggaagcaucuucugggacucagaaaacuaguagaucuccaauuaagccugcuguaggagacccaaacagggccaaauuauacuccacccacuuuauuuugucuucuuucccuuuuucuggacuaagggggaugauauucuuucaugaccuucuggcagacagucaggucccaagcuuccagccgcaguacauucccccugggagauggguggauccucagggauugaggaugguauucccagggcuuuagggcuuaggccuauuggggaaggaaaacaccauggcucaccaucagcucuuucuggccuacaccaggaucucccuacuacgauaauguccguccacucugcuacagcgacucggaugcaguauuacuauguuuugacaucagccguccagagacaguggacagcgcacucaagaagguaagacuagaucaacucucuaaucucuaacucagcaugaggaccaagaaggaaucgggaccuugucaugaaugcccucuuguauaacaucaagaaauggaagccagggaaggaagagauuugcccaaggccacaccauuagcuacagcucugggacuggaacuugggucuccuuaccccacugccucccgcccuuuuuguuaucccaugcugccuugccagaggccccgcaagggagggugguauugaagacucaggaagcagaggacggagagucagagaaccuuuaggugauacgguaugagggucaggcaugggaccuuuuggaggcagcuucuauagacccugaucccagucccacugagaaugggcaagccaggcaggucugagcugagcugcugguaugaaaugcuuaggucugggcagauccaccaaugcugaggaguccuaggaaaccuuguguaucuagcauaguauagaagaugcugggaucauguucuucccuugagaagagacugguuggcuucccccuggcauucuggacuugugaggcccuuuggggugagggggcagauccaugccuauaugguuggcagagagugggaggagaauugcccuugugcccucucuggugacugagccauagacugggggaacaggcuccugggucagcacucugggggccccaaaggccucaugggcaggaaaaugauguaauuagugcaacggugaugcugugacucagagggaggacugggcuggugaugagugaggugaugugugugacguugccagccaagcuucuccugguaucugucugccacuaacucuccuuccuuccuccuucuccuacccuucuuccugcuccaccccucaguggaggacagaaauccuagauuauugucccagcacccgcguuuugcucauuggcugcaagacagaccugcgaacagaccugaguacucugauggagcugucccaccagaagcaggcgcccaucuccuaugagcaggugugugcgcaugcaagugcaugucgugggguggagugaggaaggcuagaggcagacagcuugaaauauggcccuggcucaaauucuuccacuauggcaagagagaauugcuguuauaauuagcaaaugagucaccuggagagagguggugggcaccugcuuacccagauguaugcugucaguuagcaggugaguuauuccugugugugcccacauuucuaagauuguauucugaccaccugcguuagaaucauuagagguguuuguuagaauuucacacacacaaaaaaaagaggccaggugcaagguggcucaugccuguaauuccagaacuuugggaggcugaggcaggaggauagcuugagcccaggaguuugagauaagccugggcaacaaagcaagacugucucuaccaaaaaaaaaaaaaaaaaaaaaaaaauagcugggugugguggugagugccuguagucacagcuacucaggaugcugaggugggaggaccgcugcuugagcccaggagguugaggcugcaaggagcugugaucaugccacugcacuccagccugagugacagagugagacccugucucaaaaaaaaagaaaaggaggaggggcacugggugcgguggcucacgccuguaaucccagcacuugagaggccaaggccgauggaucacuugagcucaggaauucaggacuagccuggccaacauggcaaaacgcugucucuacuaaaaauaccaaaaguagcugggugugguggcaugcacccguaaucccagcuacucaggaggcugaggcaggagaaucgcuugaaccugggagauggagguugcaguuagcugagauugugccacugcacucccaccugggcgacagagugagagacucugucucaaggaaaaaaaaaaaaaaaaaaggccaggugugguggcucaugccuguaaucccagcacuuugggagacggaggcagguggaucacuucaggucaggaguucaagaccagccuggccaacguggugaaaccccgucucuacaaaaaauacaaaaaauuagccagguaugguggugcacaccuguaaucccugggcaacagagugagacucuauuucaagaaaaaaaagugugaucugccuagguuggagugcaguggcacaauaguuguuuaugcagccuugaccucccggacucaagugauccucccuccugucucccuaguagcugggacuauagguaugggccccacgccuagcuaaucuuuuaacauuuuuuguagagacaaggucucaguauguuuccgggguuguucuugaacuccugacaucaagugauucuccuaccuuggccucccaaagugcugggauuacaguugugagucaccacaccuggccuggaaucugcauuuuuuauaagaccccuggauaauuucuuaugugcaugagagcauaggguugggggacugaguuucgcucuugucacccaggcuggagugcaguggugcgaucucagcucacugcaaccucugccucccggguucaagagauucuccugccucagccuccugcguagcugggauuacaggugccugccaacacgcccagcuaauuuuuguuauuuuuaguagagaugggguuucaccauguuggccaggcuggucuugaacuccugaccucaggugauccaccugccuuggccuccacugcaccugaccuggggagcucuuaagaauacuaauaccggccaggcgcgguggcucacgccuguaaucccagcacuuugggaggcugaggcgggcagaucacaaggucaggagaucaagaccauccuggcuaacauggugaaacaccaucucuacuaaaaauacaaaaaauuagccaggcguguuggcgggugccuguagucccagcuacucgggaggcugaggcaggagaauggugugaacccgggaggcagagcuugcagugagccgagaucgcgccacugcacuccagccugggcaacagagcgagacuguuucaaaaaaaaaaaaaaaagaaaagaaagaaaaagaagaauacuaaugccuuggcucuauacccagaauuuuuuuuuccuuuuccuuuuuuuuuuuuuuuuuuuuccagagacagggucuuacucugucacccagaaugaagugcaguggugugauccuagcucacuacagugcagaacuccugggcucaagggauccucucuaguauuugagacuauaguugugugcccacuuccagugaauuuuuaaacauuuuuuaaaaguguuuauuauuauuuuauuaucuuuauuuuugagauuuauuuuuguaauuccaaagcgcugggauuauggguguaagccaccgcgcccggccaccuaggcuggucuugaacuccuggccuccucaagugauccucccaucacagccuccugaguagcugggauuagaggcacuagccacugccccagcuauccccagaaauucuaauuuaguuuggcaucaauauaguuuuaagaguauuccagaugauuuauaaugugcagucaggcaucgucuuaagaaaaagaggcaucaucagacaggguguaugccaaaaaaaaaaaaaaaaaagaaaagauaaucgaauaaucugcagagggugguguuuggagacuggcagcuggguccccucuggaguggcccuggggagugacgcacagaggcagcgucccagagccauuuuggcccacugcauuaaugcccucacccccuccugcaggguugugcaauagcaaagcagcugggugcagaaaucuaccuggaaggcucagcuuucaccucagaaaagagcauccacagcaucuuucggacggcauccaugcugugucugaacaagccuagcccacugccccagaagagcccuguccgaagccucuccaaacgacugcuccaccuccccagucgcucugaacucaucucuucuaccuucaagaaggaaaaggccaaaagcuguuccauuaugugaaguggaaauuggaggggggagacaacccccuacuuccucccuuggggugcagaggcacggggagagggaggaugagacaauuuaggacacuggacaugaguuuuucagauggccacggugagggcuuggaaggagacaggaauggggcgaggaaggagccaggcccggcaugaggaccugacgcugagagagaaccaucauaccccaagccaggcacuagauuuuggagggggcgacuaccccagugccccccccgcuccagaggaaggaaagcugugggggacggggggcaugcuggccucaugggcuugggggccuacagcagccucaccuucagcuucaugccucuuccacacagcguuuccaugcaggucaggggaugggaggggucccugagcccuucccuuccccucuaaggaggcagcaacggagaguggggaaguggagcggcagcucccuugggggcuuagcccaggugcuucguaacugcaaucggaagugcaggagcuggucagagccaaugagaaggaaaccucaucuuugcauagcccaugccucauggagaggugacaucauacauucacaugcuucucaccuaaguccccaggguccaagggagaagccccagacccccuucucuugcagagugugggggugguggugcugcaggggcagggcugggugggggucaccagacuuuuucugcccuuaggguaguacagcuggcauuuguuuuauagacucuugucuuuggaauuggggggagggggggaguguuucaaucuguuauauguucuguguuuaaugaagaaaaccuauuuauuaaugaaaaauauaauacauauaaagaauuuggcuccguauuuuuuucuguuuucuuuaguuguuacaauugguauuuuuuuuuuuuggucuuuuuuuuuuuuccuuuuuguggagaacagggucucgcuauauugcucaggcaggucucaaacuccugggcucaagcuauccucacaucucugccucccuaagagcugggauuacaggcaugagccaccgugcuugagcccuuugguugaugauaaugagagaaaagcuguccugggacccuuucuguggguugcagaggggcugccuccaccauuccccagcuccuccaagaaggagcuucucucuucccccaucccccugcccuagccccacccaagaccuacuaaaccaaggaagggcuccuuagcccgagagcaggggugcagggguucucaacccuggaacuauugacauuuuggacuggauaaugcuuuguugugagggacuguccuaugcagcccaagauguuuagcagugucccugaucugguggaugcuagaagacagcaccccacucuccagcuaucacacccaaaaaugucuccagacguugcuaaauggccccuguggaaaaauucugguugagaaccacugcccuggagagucuagaggagagaaaaagguuggaugaaaucaucaguagaggauccaagcugcugagauuccaccccacauagaagguggacagacuaagccaaagcugggggaggcuccugggauucuggucuccucugaguucaaggagaggugacauuugccuucaugaccuuccaauuccgaugccuacugauggcagcucaggggccuuaacucuuaacuuccuuucucagugacuuauagcucuuguuuuccaagugccauaguguagugcuagugccagaaauaaaguuagcauguacuaggccaggcgcgguggcucaagccuguaaucccagaacuuugggaggcugaggcagguggaucacaaggucgggagaucgagaccauccuggcuaacacggugaaaccccaucucuacuaaaauacaaaaauuagccgggcaugguggcacgugccuguaaucccaacuacucgggaggcugaggcaggagaaucgcuuaaacccgggaggcagagguugcagugagccaagauugcgccacugcacuccaaccugggcaaaagagggagacuccaucucuaaauaaauaaauaaauaaauaaaguuagcauguacuuaaugaguguucagcacugugcacuguguugagggcuuuacaugaucacauuuagacucauaaaugauaagagcuaacauuuguuaaauguuuacuaugggucggggcacuuacgagauuuuucuuuuuuuuuuuuugagacagggucucacucugucgcccacgcuggaguacaguggcaugaccacugcucacugcaaccucacccuccugguucaccguccugaucacccuccugacccuccuaccucagccuccuggguagcuaggacuacaggaguaccacaguaguagucuauuuuuuguggagaugggguuucaccauguugcccaggcuggucuugaacuucugggcucaagugauccuccugccucggccuuccaaagugcugggauuacaggcauaaaccauggugcccggccccacuuacgaguucuuucuauguuauuuauuccugugauaacccuaugagccuaugaggugcuauuuuuuuuuuuuuagacggaguuucacucuggcuggagugcaauggcacgaucuuggcucaccgcaaccucugccuccuggguucaagugauucuccugccucagccucccaagggacuacaggcaugugcuaccaugcccggcuaauucuguuuuuguuuguuuguuuguuuguuuuuuuaguagagacgagguuucuccauguuggucaggcugguuucgaacucccgaccucaggugauccacccaccuuggccucccaaagugcugggauuacaggugucagccacggcgccccgccgcuaucuacuucauuuuacagaaaagaagaccgagguucagagagauuagguaacgugcacaaggucacacagcuaggaagugguugaacauggauacaaauccaggcaaucuggcuucacaucaugcacucuaacuugcucugcuguccuguccugugagggaagugguauuauuaucucuguuuuguaaugaggaaagagaaaagccagagaugccauauaauuugcacaagaucacaguacuaguaagcaauugagccaagauucaaaccagaacucacuguucaccaaaaucccauggaccccuuacugguaggcauguuguaccuaaauagguaucuccaguuaugguucuuacuagaacaccaucccucugucucugucuccaaagaugaugguuuagguguggugacuggugccuguaguucuagcacuuugggaggacgagccgggcggauugcuugaggccaggaguuugagaccaaacuggacaacauugcaagacccugucucuacagaaaguaaaacgauuagccaggcaugauggggugcaccuguggucccagcuacuugggaggcugaggcaggaggaucacuugagcccaggucagggcugcagugagcuguuugugccacuccacuucaaccugggcaacaaagugaaacccggucucaaaaauaaauaaguaaauaagccagguguggagucucacgccuguaaucccagcacuuugggaggccgaggcagguggaucacgaggucaggagaucgagaccauccuggccaacaugaugaaaccccguuccuacugaaaauacaaaaauuagcugggugugguggcaugugccuguaaucccagcuacuugggagguugaagcaggagaaucgcuugaaccagggagguggagauugcagugagccgagauugcaccacugcacuccagcuuggcgacagagcgagacuccaucucaaaaauaaauaaauaaauaaaauaaaauaaaaauacaaacaaauaagaaaacaaagauucauguuugugagagaacuaguggggcaagacaaauaacaaguauccuugaagcccaaugucuuacaugugucaugagaugugcgcacaaguacuagaggaacucugccacuaugaacugggacaagcuuuaucacccuccaggagcucaauuuaaagagaguugagauggcagccugaaaauggggaaagguaauggacucugaaguuaaaugaaccugaauuuuggcuccauucuuuucuuuucuuuuuucuuucuuucuuuuuuuuuuuuuuccagucaggguuuugcucugucacccaggcuguagugcaguggcacgagcauggcucacugcgaccucgaccuccugggcucaagcaguccuccugucuuggccucccaaagugcugagauacaagcaugagccaccucaccuggcccauucuuuuaacuauguggccuuugaaggcauaauuacucuuucugggccacaaucuccuuaccaguaaaauggagauagcacucaucucauacugcuaugagaacuaaguaaaacaaauaagguagguuaaguguccagcccagagcugagcacuuagaagauucucaauaaaaaguggcugcaguuuuugaagauucuggccuaccaugguuggucugauucuuaguuuaaucugugaaucugugagucgagcgcccucucgugcuuuuguggugaauuacaccuaacagaucucagagcucucuucuuucccuugcguucucucuggaguagaagcugggaggugaaaggcugcagguucuaagagaagugugugucuccgaggguuacuuugggccauuguacgugaugcucagggcuuuaggauuacuugggucuauccugaggcucugcuugagagcuugggcauauucagagagaaaaggcagaccuacagccauguggaauugaagcaacaaaccugcugcuggcaaaaugggaagggagguccgagauacuucugguuaucuaaaccguuuccgcaacugcaauguuuuguuuuguuuugagggaaagaguuaugaacccauaagaccaaagagaaacacaaagugaacuuacgauuugagguuaaaacaacaacaacaacaucaacaacaacaacaacagcaacaacaaaacucaguggaagacugaaguaggggaaucugggggaagaaagaagcaaaaauaccaagauagcucaacaauuggucacauuccaaagggcaagaaauugaggaaaccaggguuccaucuggaauguugagaaaacaggugcuagagcccaggagauaccauccuuccgggaggacuuuagagcccauugugugggcucauuuggagcuguaacaauaacuggggguuguuauggcauucacccggcugcaggggccaagguugcuaaaacguccuccuaagccugggauaguuccacacacaauggagaacugcaucacccuccuugugaaccuacuccgguaaccugaucuuuaguuuguccaacuguaaaauggggcuagccccauucucacagaauuauuauaaaaaccgcuuuucc

SEQ ID NO: 17933 - RNA, 3588 nt, Homo sapiens
uagcaucgcgacccgccccgucccguccagucuggccugggcgccgcgggaacgcuguccuggcugccgccacccgaacagccuguccuggugccccggcucccugccccgcgcccagucaugacccugcgccccucacuccucccgcuccaucugcugcugcugcugcugcucagugcggcggugugccgggcugaggcugggcucgaaaccgaaagucccguccggacccuccaaguggagacccuggugaggagauagucccgacccucagcccccgugggccgagccuuguugggugguaauacuggggucucagcgaaccugggagccgggaggagaggaagugcgggaacugaguuggggguggugccgggucuaggggcgagaacgggaucuuuggaagagcauccgugaccccuguaguccgaucguagguggagcccccagaaccaugugccgagcccgcugcuuuuggagacacgcuucacauacacuacacggugaggggucuggggggccggggcggggccugggagggggcggcgcccugcugaaacacgucagcuuuggcuuggacacguggcaagcgguucgggagaagaaacucggggcucuggggucgucgagcacguggcgaggggagagacguugcucuuccgugccucuuuucccuccuugcuuuucugccaguuccuaccuggcacggagaagugcaggguggagagaucuccgagaagcgccagccuucuggggcuuccuguuccuuacagcgguaaggggaacgcuaggcugccgcacuaagggggcugccgccgcccagcgguccagguguguguugcgcgccugcugggagggagagggugcuagauguaugcucuugaugcucucuccccccagggaagcuugguagauggacguauuauugacaccucccugaccagagacccucugguuauagaacuuggccaaaagcaggugauuccagguaugugaccugugccucccauuccaccucuucccaaccuaagcccuuucuuagccucuucggcuccaaagcugcccuggaaauccccccugaaaugaguaagacccuagggcucuacgaguuaccuccugagguucaaaccucacuucuaguacuccacuugucccauauccuauuggaagccagagauuuaagaagugagggaaaggucaauugaggauggaggaggaagacuuugaucuucaugucaugggauuuggggaagguggauagcuuccaguucaguugugucuucuucuucaaggucuggagcagagucuucucgacauguguguggggugaguaucucggcaggggugggccuggguacccccuuugcauggguagaggcuuucucggccauccucacuccuuaagcaggagaauguggaauaaaggacccugcuucccacuggacagguccaggucagugggaccucugagggcauucaaagccucugugccucuugcgcuguugcuuuugucgggggaguugaggcacauggggagauggacaccuuugcuggccagccuguuugguguucagguggaaaaauucguguuuugggugugaagauucaggggguuuugcugaaggagcuucagcuggacugaggcugcuggccuaccucuccugccucuggcugugacugacauuccuucccucagagagaagcgaagggcaaucauuccuucucacuuggccuauggaaaacggggauuuccaccaucugucccagguaaucugacuaggacucucucucaggccaucaaaauacccagucccuaagagcuauaaggagcuauauacuuuguuugaugcuugagaagauccagaccaaguuuguuuagacagauaggaguggcuggggccuccaucuacagggccaccuuuuuccuccucauaucaccaacagggacuaaagacaaccugaugaggccaccuggcaugaccuccagcagccaguaacuuguuagggaagagaccugcuugggccacaugggucugcugccugugccaccaccuuucccagaacacuggacuucuuuccugcccuuuucuacaacucuacgcugugucagcuguacagccaccccccaccccuuccuuucagccuccaucagggaagagacaguaaaaauaaucacagucaagugauucaaaacaaaacaaaaagcaacuguuaaagccaagucugccccauaacuuuaaaagccaucauuggucacugccgaugucuauuuuugaaggguugagauggacagauuucccaagaugcauaucuuuugcuuucaguucuaacaaauguucuauuagcuaaaauguguuguacuccacagaguauugggcucguaauucuuuuuuuuuuuuugagauggaguuucacucuuguugcccaggcuggagugcaauagugcaaucuucacucaccacaaccuccgccacccggguucaagcaauucuccugucucagccucccgaguagcugggauuacaggcaugcgccaccacgaccggcuaauuuuauacuuuuaguagagauggggcuucuccauguuggccaggcuggucucaaacucccaaccucaggugauccgccugccuuggcuucccaaagugcggggauuacaggcaugagccaccgcgccuggcugggcucguuaauucuuauccuaguuccagcuuagaggaaggccuggaaggaggguagggggaccaaggagaaacuuuuacccaaagcccuauuaccuccccauucccagugcugcuuauuuguaccucuucugcccacucauuucuguuccaccugccccuuuacuucuuaagcagcauccucauccuucuuccucuucagcucuuauguugaaacuccuguuaucucauaaucacguugaaugugcucauugguugguugauuuuuuaaagucuaguuuaaauccauuuaauuucagcccugcaaagacucuauccgugugguuauuuggaaauacgauaaauuaguaguuaguauagaggguucucccacuuacaaauggagaagagccuguacauuucauauucacagaaaguuuuccugcauucaaagacuugucacuggacccaagccacauguguaguuggggucaacaugauuaucacuggacucugcucguaaauccuccucuacucuugucuaaaggaauucaagcccacauuuaaaucuugucagcuucauaguuguuggcuuugcuguggccuacgcucccuauuuucauucagauucugagcccuggauaaaaugcagagagucuaacccucuccaccccucugccucuccagcggaugcaguggugcaguaugacguggagcugauugcacuaauccgagccaacuacuggcuaaagcuggugaagggcauuuugccucugguagggauggccauggugccagcccuccugggccucauuggguaucaccuauacagaaaggccaauagacccaaagucuccaaaaagaagcucaaggaagagaaacgaaacaagagcaaaaagaaauaauaaauaauaaauuuuaaaaaacu

SEQ ID NO: 17934 - RNA, 463 nt, Homo sapiens
caccccucaccuuguuuuuuugggggcuccagggaccaaucuggggcuggaaauguuaggagguugccuuggugcugccccagaucuguccagcagggggcaguaagugaucuugguaguaucccuggcugcuaagcccuuggcaggggugguccuuucuacauucccauucacuuaacagcucuuuugggauuggguguuucauuccauuucugcccacucccucuccucuccucucugguagguuuaauuuuaugcuuucccugauuccagcuuucugcuuccugaggacucccgcuccccccaccccaaaguuugucugugguguuauagugguaacugcaguuccuccucuggaauguagacuguauauguuuaauaacucaccuucucuauccuugcucaaaaugugggauaacgcgaugacugugacccugguuggaaauuaaacuuguuuuaugca

SEQ ID NO: 17935 - RNA, 4301 nt, Homo sapiens
gucaucgauaaaaauagagauuuuauucugcagaggaagaugcuacacuggugggggcgaggagccgcuaauagcuacaguggaaggaaauacugauuccaggaggcaaacgcaucuuugagaaacugaggagagaagagggaccagaaaaggcugcagggagaaaggagagaagaguggagagggauuggguuggguuggagguggucuuugcaaaccaggcugggacccagcacaauaaauaguuuuauuuacaacauccaaacucguggcucuguauccacguuucagugcaaauuauuuacacacugaugaggaggcaggacaggaagggguaggagguggcccagggaggcauggcucacagcuguucaauggcuccacgacagagacugggagaaugggggcauuucugcugguucccccaaccucauuuccacaucaucacagcugcccuuuugcccuguaaccuccugcuucagcuacagguggggaggagaaaggcccugaugcccagguguggguucagggucugcacccauggcaggagaauaggaagggacuuaggaggacccggagaaaacgcaggacaaaggggaagaagagaggcagagaggucgcuggcgcgauggagcaggcagaaugacaccaucaggagccgaccccauggcggaggggacccauccuucucucaccuccuggccaagcagggggcagugcaacaaggggucucccgcggagagggagggagguagguccggggcagguccaucaggauggcaagaggguucaugccgccccaggcaagugguuugaggaguccccagguaggaggaagugggagagaugggaugcguaugaaccgcggggagugugacuggagguacucgggugggcgaauaaccgggucuugagugcuagcgagucuguuugggggagggcucgaggagagcguuccugggggcgaguccgcgcagcgccucacagacacucgugcaguacgcgcgugugcgugcaguugcggcagcugacguggcagcaccaguggaaggugcaguugcagcgcucggugacgcgcugcgugcgcgugcgguggccccugccgcagcagagcagcucgcagccguccagcgcgggcgacgagcuguuacaggcgcgcccugccgugccugcugugcccaggcguccgcuguacgugcagaaguugggcgauuucucgaaguagacgaggucguggggggagggcgguuugugggccgggucuuccggcuccaggcgcagcagcuccgcccgcgaagcgcgguugcugccgcgguugccguacaggacgcgcgaggcgccgucgaagcggucgcgcagcacaucgcccacggcgcgcagcgugggcagccgcauccagcacgugcgcaccgugcaugagccggacaucccguggcacuugcacuccuggcgcaucucggagaauacggucugcggggauaggggaagaaagagugucccagggcaccgggccagagucacccucccagacacugcccucucccggacgccacgggggccggaccucagcaaaggcccaggccuagcugagcccaggggaagggaggcgcgaaauguuccgcugagauuuggaaacccugcccaacccugcuccgccgcggcgagucagucucggccucucaggcuuauuuuucgaaucuguacagcgaagagacugugcuugauuugcaaccucuucuaccuguccgcgggccagacauaccuuugcccucagccacugucuccucuauucuccgucuucguuccaagccuccggcucucccaggacgcccucuccuggugccccuugccuuaucucaccgaccgucacuuccccagcccgagguuggccccugccgcuccgcuuagggugcggagccucucaaagcucaccguacggccugccucguuguugugaagguucaugaggaagcgcaggucccgccccuucuccccggaguccacgaacucccggccgaagaggcggccgaagucaauguugucgcugcagcccccccagugccagucggggcccccggggccgcgccgccgguagucacacgugcaggauucgauggaaccuucugagcaggagcgcgccaccgaaugggugaccccggcggaggugauagcgaagauaaacgccguuucucgacagccugugggagaagggagcggggaucagcgaggggguacgcggggcgcggccagcacccucaugaagggcuugggaccggaaucccacccccgacuccgcacuuugaguccugagagccagggccggcagugcuggaaagcuggucucuagggcuaguagagaaagcaggugcgugggcacgcagccacguccacgggcguaaucacaccuuacugggagauucuagggcgcauuuuggcucgauagcggaaguggagcagccccagagagacaaaccgaagagaggggagcggaagaaccauacauccccaagacuucuucgcagcccaaaacuuucggcccauuuuggcggugcaagccuugcugggcgagaggccagacacacgccugcagagagcagcuucccaggcgcuuuugagagaggcugggggaaagcggcggucagccggcguccgcgacccgaaacuuucuuuaucuggggcaguagcucagaaaaguuaagcuucguuuccagggugcacggcuggaaaacgccugguagaagucuggccccgagcuggcgcugggcacgaggcacuuggcaagguugauugugugacccuccaggcgccugggacaccuucucugaacucgcccgcccaugcccugggggugaccccgcguuuccccugcucccggaagcgucgccuuccugggcacccaccucgguugacgaucuugccgaagagguggggcccuggagcagugggacaguuccagcggcgauuccggaacugccacuugcacucgcgcacggcacucugcagccccccacucacgcugugcaggauccccggauuuuggcguaucagacgccgcuguuugcggcucaacagcugcagacugggcucgaguaccaguugcagacucuuggagucuguaagcagguucguggaggaggcuacguucacaauaccccuggugggacguaugauagcucaggcucaggaaggggauccgcacccuaaccauaaaaacugugccacccgguccucuuccuggggguauguggcuggagagaauggcgggagauuaauaauacccgcucucccaggcucacuaauuugaaagaacugggcguccagacuugugugugcccaguagucccagggcugcucgccugagcccuagguccggagacuggacagaggagguacccggagaccgagugucuaccuuggaucuccgagccucuuccggucagccugagcgagauaaucauggccugcaguucuugcccacccaaggcgugaaaugcuuaggagucccacccucuucuccccuccuuucuaggcgaacuccuggcccuucacuucccgagguggggaaaccuguggugagccaccgccgugaggcuggaguuggcgcucaaaggggaagggcggugcuagaugagagugggcucccugccugggguaucuuaggccuccgcgggcggaucauucgccccacuuguacagagcuggagucuggggcaguuucaugccagaucgcccuucggugucgcggagggaagucagagcggggagggagccugucggcagacggaucccagagcgugggagcuggguaggguuggccccuggcucugugccgcgggacaaguggcgaccccgcaccagcucacuuaccaccaucggccacugcuguuggcagccagggcugcgggcagagcggccagcgccagcagcagcguagcagaaacccagccaggcaacagcgcccagagccccauggccugccuggcuuugcccgcucugugcugcaguugcggcgacuuugguuguugcccgcgacggugggacgggacgcggcgguggcggcaguggcgagaguucgcagucuggcuuuaacaacccugggggcgggcggcggacagcauggcucgcggucccggcuggugggcugaggcggccacggcgggcggcaccgccucuuauaguugcggcgcuggcugaagugacgggaggaggcugccccuccgggccgcacuguggcaccagggcgcaccgguuaggggcgcagacaaugggcagcgagcggggcugugguucccgcccgucug

SEQ ID NO: 17936 - RNA, 7515 nt, Homo sapiens
ccuuuuucgcucggucuccuuggccucccgcuccugcgacgccgcuuuccuuuucucuugcucccgagcucggaccucggccaggggccccgcccgccaguuggucgccuccugcagcacccuggaggcccagggccggcggggcggcggcuguggggaucccgggcgcggcccacaccugggacaaugagcaggaacccaggugagcaguuugugggggaagggagccgagguccggggagcugggagcacuggagaccacuuggggcagccaugugaaggggugugugugagugugugcgcgugugcacgugcguauauguuaggacugaagucgaagcgggacuccucgccaucucuccaugcacacuuuaacagcgucugccccaucucaccuccugcccuuucucacacccacuucuguucccccaaacaacgggaugagucaggccccagcccucgggagcgggcagagguggaaggcgugggaaagagaagggggaccagcagugcucgcuggugccugcggggagguccggaccccacuccccgccccaccacucucuuccccucaccccugcuucacucacgugcgguucuggaacccgcgagcccaguggcuggccuggaaguccaugggcugucgagaaggggcgcggcgacuauaaugacaggaaauagucuucacuucuaucaccaauagcuuggacuucugcacccagaggcagcugccagacuccucauccuggagcucccgggggcugucaggccccucggagaacagugggccauccagcauccugccccaccccaccccggccccccacccucccacccgccccaggagcccccucccagcccagggagccggcgcccacugcagagccgcgggcccggggacugggaacuauauauacccgggcacacgugugugugccugucucugugugugcgcgcgcaugugacaccgcgcggacugcuccgcgcugcuaccucccccaugugcacggccgcccccuggggcccgggauuggacgccccuucccacugcuguugucccccaagccugaugggaucgcacgagugggcgggggagggacuuaugauucuugccaagcugacagugcccccucccccgccccuauuucuucaaccuuccugccguuuuaacccuuuacucuccugcuugucagguugccugaccaccaggguucugccccuggcuuccugccucagauuucaguuuccccaacauagagugaugagauuggaacucaaggucucugccugccacucugcugguuuccauggggcuggggugcaggaggggcuggcccacggcuggggggcuauuuuuagcggcaguggcuguucgggugcagagaugagaugaguaaccagcucccaugcgguggagagaggaggcgguggcuuuuaccaagcuuuugugcgacucugagggagagcugccuucccuaagcucaaaaagggugaccccuacacccguaucuccuugucagcucagugcugcagccuaggacugcugguacagcaggacacaggcgucugccuuggccacccaagcugcccuaccaguuccauucuacauguuuguccuugggcagccagggagcccucccacagcagcaggcuuucaccuccaauccagaagccaggauuuggggguuauauuguucugugcccacacagccugcccagcuuuauggaggacagaguaagugcuuaugcacucucacccuuccagagggggauggaggagaaaugauguguuugcuuggcaaaacuaauccccuagcaacugaaaugauaaaaguggccuuuauuuuuuucaauguagaacucccccucaccaccaccacaaugccuaguucacucaguccccaccuuaaguggugcuccagaugcucaccuuuugggcugccucuguccuggggggcuguugcuuauauccacaugaucccuccuccuaagcuuauaccagguguccccugauucaccaugguaauguuaguggcagcacagcccacgccaacccuuccaugcagagacuuagcaaccaugccuggcaaccauggcagcagcuucaguggaggggagcagugcagagagaggggagaguguguggggcaugguuccucgggaagaagggauaauuugccucucuggagaggaauagguaagaauagaagcuugugagucucccaaauuucaucccuugucucucccucagcuucauccucacacugagacggauagguuggguuuuagagggaaaugggagaagcaagaguucccaauuaguuuuccacuaauguacauggagcccuuuggguccagacccuuccuuuuaaggggauggggaacaaccagaaagguuguggggcagagacugacagacugagaaacaacucaacaaaaccaggucucugcucccuaacacaaaccuuuagagagaacgcaaacaucccgucccauccacccuaccccccuugauuccacacaccugccagcugcacugaugacuugacucgaagaugcuuccuuccacccuaggucccacuagaguccugaggcuuuuuaaagcccuugccuccucccuaggcaaaucuuccuuaaugagggaaugugacauaaggggccaucuguccuuuccaccaugugcuuacccuccugacacauaaacauacucuaauucuaauaacuuggaagccuuccucccccaagguugagaaugugcugugagagcuguaaaggggugaaggcagaagcaggggcuccuccacagccaugaugcaacacugaaagcugagcucugaugagggccaccuucuuuuuuuaaaauaagcuuccucaggucgaaucugaugagggccuugaugcuuuucccuguguuccaucaggagaacccaguaugcccuggcuggaggguuaucagagggguuaggcacuguggggcaggggcaaggaaugacuccgaaauugcuccuggcuuggaugggaaacuguaucauaccugcaaggcuggggugagcuggcacccaaauuuagcucauacuccagucuagcaguucuucugauguugggugcugacugcuguuugggucuacaugcuuucaauacagggaauggaucugauggagugaccacugcccugcuguucucccaccauccagcucauucucaccuuggaagaggcaagggauuuguagguuuaaagauagugcuggccgggugcgguggcucaugccuguaaucccagcacuuugggaggcugaggcagguagaucacaaggucaggaguucgagaccagccuggccaauaugggugaaacuccgucuuuacuaaaaaauacaaaaauuagcugggcgugguggcgcgcgccuguagucccagcuacucaggaggcugaggcaggagaaucacuugaacccgggagacggagguugcagugagcugagauugcgccauugcacuccaaccugggcaacagagugagauuccaucucaaaaaaaaaaaaaaaaaaaaaaaaaaagauagugccaacucagcaaaagccaaacaguccaaccuuccccaacuaagaaaagcugauaaugguggcaggauucucugcccaaaggagacccucaagucugucuacucguguguguguacgugugugugugcguacacacguuauuauuauuguuaaugaccaguugaagaagccauauaaaguaggaagguaguacccaucaacuguaaaaaucaaacacugcaauaucgugaagagauuccugucauuuaauuagauuugccacaaaaagcaauaaccuuagcuaaccacgcugcucuccuccuccaccuaacccccaucucccuucauaugcacaaacacaggaacccaaagccccuccuccccacaauccuccccacucacauuaugggaagaaaugucacuaaauggacuuggccuccuccauauagcacggaacaggugaauaaaaauaucuuuaugaagaauuuuguugugcuauuaucuuaggguugaaucagggccaagauggaggcagaggcaagugaggucuggggaucucuuagagaucagaauuugucugagaggcacagagccuauaguucacccagaaagggggauauaucuaagaggacaggggcuagaacuggcuaggcugaaaguuuuuucaaguguaugugugaggguaaggguagcuauaaauccauucucuuuccucccccauaccuucccuagcucccagauagaagggcaggggacccugaacagggaacagagucacaauucccucaaguuucaucugauucccacagagcuuccagcaggcagugaguugggcauauccccuggugcugcaugaccccuucccccagcucagggcuucuucucuccaccugugagcaccagggccugcaggaugucagacagugauacaauucccuugaccacaucauuuucauccaccacuacaagucggugaaccuggcacagagcaacaagggagaaagggaauguuuagugcuggccucaggggaagccccucugccccuacucuccuugccaaaccccacucucaaggcugcuccccucagcuccuuuaggguugcuggccucccuaccucugcuuccacuagccuguugaugauggucuccagagucucaugcagguagcacuugagaacacccucaaaguaaugugaucgauguugcaaggcuuuagucacagauacaucuagguuguuguaggucuuuucugcugccagauucuggggagacagaggaaggagcuugcagggaagcaagagagccagccuccaaacccugaacccauccaaccucaacagagggauucagggcaauugucagccacaagccacacccaacucauucaauuccuuuucaaauaggauuugaaagccuggaagcuucuaagacccuuagaucacagaagagacucccuucucccucuccauauuuaacagugccccccccccaccacuucccuaccucccagacccuccacaaucacucacgauaacaucaaacuuggaguagauguccaccacacgcccuagggggacagaggcagcucaguaaggaggaucugggaucuaaagcucccccuacucauagaaucacccuccuggcuaagcugaggggaaagcagaucuucccagagccacccugacuugccuggaucuucccucccucuccuucugcccaaucucucacccuucucauccaccacuggcagggcugagacucgaugcuguacaaaaauccccagagccacauagacgggggugguagugcgaaccauagcaauauuggcauaggugccaaucuguagcucuuccagagacuuggacaugaacucuggcuuggggaacucagugaucugaggaaagaaccaucagcuuaacuuucaaggcacccaaagccacccuuggauacccccuccaacccaguauauuagaaauaagggcugggugcgccggcuuaugccuauaaucccagcacuuugggaggcugagggggacauauugcuugagcccaggaguucgagaccagccugggcaacauggcaaaacccuaucucuauaaaaaauaccaaaaaauuagccagguguggugguacacacguguagucccagcucuucuggggguugaggucgggggucaccugagaccaagagguuggaggcugcagugagccaugauagcgccucugcacgccagccugggcaacagaguaagaacuugucucaaaauaaauuaauaaauaaauaagaaguggggcuggaugcaguggcucacaccuguaauccuagcacuuugggaggcugaggcgggaggaucacuugagcucaggaguuugacacuagccugagcaacacagugagaccucgucucucuuuucaaucaaucaaucaaucaaucaaugaaaaaagagaaaaaagaacugggcugaggagcacuuacaaacaauuugaggaacuucagaaugcgcuugugggugaggauguacaaaguauugccugauucugggucaauaacuggcagccuguggaucuuguuccgaauuaaugaagagacagcaucaaacaagcugugagagggugggagauaauaaguuccacagugcuggggcugggggugauuaaacagguccauacaguguauugcucaacagggaaaacugaugguuagggaaggggggcaguguacaggccagacuuaaagagaaagagagagagagagagagugagaaugagagagagagagagacugugugugugugugugugugugugugugugugugugugugugugugugucuuuucucucuucuuccccuuucccugggugucuagggcauuagcuaggcugaugacaaaaucucuuccgcuuuuuggacagauggguaacuggaacucaccuggcauuaggagaaaugcagacaagcgguuuaaaggaguccuggagauacaccucugaagggaaaagggaugggucacaaaauaccaccauggaaaaguguuucccagaaacccgccaucccuuuauccuuuuauaaccccaauucucuacauaccucuccaaguuucuaucuuguguucuucuagcucauagaucuguaccugaaagcagaagcaacagaauuugagaccugaucucucugcuuccuuaagcccucguggcuugcuuggagaaaaagaaaugagaaugagggauuuagggcagggaaagugauuuuggucauuggguuaagguuccuuaccaaggcugauuuauaguagcggugcaggauauugaugaaaucagugauggucagcaugccuagaggacaagacagagcccucagcacugccugaagcuugucucccugcccagcacaagaugccaauaauauuguguuccagaaacuuuugcuuacccacaaaacuuugcuucuuacuaucccauaaaggggcagcucguacaccguuagucaccaaagcaaaaaaagcuuucuucaccuguagccaagacaguaauaaucauaaaggcaaauccacaggggcaggacuguaaaaaaagaacaguguuugggcauguuggguaaaacaugagacuaacuucacagaaggauaaggauauuacccuuaggaugagauaggaugagagguauuaaaccacaggcuccaaagggggaagggaaaagaggauuucacccaccugcagggacguaucaaauacaaccaauuuggagcuugugggaaucaggucauagcagcgaugagacuucaugaaggaaguauacacgcuauuguuggauucuggggucucugcauagggugggauaguuaguagcuuccuuccacauaaaaacucccaaucaaaagagacagaaaacaaaauaguguucuaguaucucaaauauuuagagcauuauuuuuuaauaagaccccuuauuuuaucugucuuguuccuauuguu

SEQ ID NO: 17937 - RNA, 7515 nt, Homo sapiens
aacaauaggaacaagacagauaaaauaaggggucuuauuaaaaaauaaugcucuaaauauuugagauacuagaacacuauuuuguuuucugucucuuuugauugggaguuuuuauguggaaggaagcuacuaacuaucccacccuaugcagagaccccagaauccaacaauagcguguauacuuccuucaugaagucucaucgcugcuaugaccugauucccacaagcuccaaauugguuguauuugauacgucccugcaggugggugaaauccucuuuucccuucccccuuuggagccugugguuuaauaccucucauccuaucucauccuaaggguaauauccuuauccuucugugaaguuagucucauguuuuacccaacaugcccaaacacuguucuuuuuuuacaguccugccccuguggauuugccuuuaugauuauuacugucuuggcuacaggugaagaaagcuuuuuuugcuuuggugacuaacgguguacgagcugccccuuuaugggauaguaagaagcaaaguuuuguggguaagcaaaaguuucuggaacacaauauuauuggcaucuugugcugggcagggagacaagcuucaggcagugcugagggcucugucuuguccucuaggcaugcugaccaucacugauuucaucaauauccugcaccgcuacuauaaaucagccuugguaaggaaccuuaacccaaugaccaaaaucacuuucccugcccuaaaucccucauucucauuucuuuuucuccaagcaagccacgagggcuuaaggaagcagagagaucaggucucaaauucuguugcuucugcuuucagguacagaucuaugagcuagaagaacacaagauagaaacuuggagagguauguagagaauugggguuauaaaaggauaaagggauggcggguuucugggaaacacuuuuccauggugguauuuugugacccaucccuuuucccuucagagguguaucuccaggacuccuuuaaaccgcuugucugcauuucuccuaaugccaggugaguuccaguuacccaucuguccaaaaagcggaagagauuuugucaucagccuagcuaaugcccuagacacccagggaaaggggaagaagagagaaaagacacacacacacacacacacacacacacacacacacacacacacacacagucucucucucucucucauucucacucucucucucucucucuuucucuuuaagucuggccuguacacugccccccuucccuaaccaucaguuuucccuguugagcaauacacuguauggaccuguuuaaucacccccagccccagcacuguggaacuuauuaucucccacccucucacagcuuguuugaugcugucucuucauuaauucggaacaagauccacaggcugccaguuauugacccagaaucaggcaauacuuuguacauccucacccacaagcgcauucugaaguuccucaaauuguuuguaagugcuccucagcccaguucuuuuuucucuuuuuucauugauugauugauugauugauugaaaagagagacgaggucucacuguguugcucaggcuagugucaaacuccugagcucaagugauccucccgccucagccucccaaagugcuaggauuacaggugugagccacugcauccagccccacuucuuauuuauuuauuaauuuauuuugagacaaguucuuacucuguugcccaggcuggcgugcagaggcgcuaucauggcucacugcagccuccaaccucuuggucucaggugacccccgaccucaacccccagaagagcugggacuacacguguguaccaccacaccuggcuaauuuuuugguauuuuuuauagagauaggguuuugccauguugcccaggcuggucucgaacuccugggcucaagcaauaugucccccucagccucccaaagugcugggauuauaggcauaagccggcgcacccagcccuuauuucuaauauacuggguuggaggggguauccaaggguggcuuugggugccuugaaaguuaagcugaugguucuuuccucagaucacugaguuccccaagccagaguucauguccaagucucuggaagagcuacagauuggcaccuaugccaauauugcuaugguucgcacuaccacccccgucuauguggcucuggggauuuuuguacagcaucgagucucagcccugccagugguggaugagaagggugagagauugggcagaaggagagggagggaagauccaggcaagucaggguggcucugggaagaucugcuuuccccucagcuuagccaggagggugauucuaugaguagggggagcuuuagaucccagauccuccuuacugagcugccucugucccccuagggcgugugguggacaucuacuccaaguuugauguuaucgugagugauuguggagggucugggagguagggaagugguggggggggggcacuguuaaauauggagagggagaagggagucucuucugugaucuaagggucuuagaagcuuccaggcuuucaaauccuauuugaaaaggaauugaaugaguuggguguggcuuguggcugacaauugcccugaaucccucuguugagguuggauggguucaggguuuggaggcuggcucucuugcuucccugcaagcuccuuccucugucuccccagaaucuggcagcagaaaagaccuacaacaaccuagauguaucugugacuaaagccuugcaacaucgaucacauuacuuugaggguguucucaagugcuaccugcaugagacucuggagaccaucaucaacaggcuaguggaagcagagguagggaggccagcaacccuaaaggagcugaggggagcagccuugagagugggguuuggcaaggagaguaggggcagaggggcuuccccugaggccagcacuaaacauucccuuucucccuuguugcucugugccagguucaccgacuuguagugguggaugaaaaugauguggucaagggaauuguaucacugucugacauccugcaggcccuggugcucacagguggagagaagaagcccugagcugggggaaggggucaugcagcaccaggggauaugcccaacucacugccugcuggaagcucugugggaaucagaugaaacuugagggaauugugacucuguucccuguucaggguccccugcccuucuaucugggagcuagggaagguaugggggaggaaagagaauggauuuauagcuacccuuacccucacacauacacuugaaaaaacuuucagccuagccaguucuagccccuguccucuuagauauaucccccuuucugggugaacuauaggcucugugccucucagacaaauucugaucucuaagagauccccagaccucacuugccucugccuccaucuuggcccugauucaacccuaagauaauagcacaacaaaauucuucauaaagauauuuuuauucaccuguuccgugcuauauggaggaggccaaguccauuuagugacauuucuucccauaaugugaguggggaggauuguggggaggaggggcuuuggguuccuguguuugugcauaugaagggagauggggguuagguggaggaggagagcagcgugguuagcuaagguuauugcuuuuuguggcaaaucuaauuaaaugacaggaaucucuucacgauauugcaguguuugauuuuuacaguugauggguacuaccuuccuacuuuauauggcuucuucaacuggucauuaacaauaauaauaacguguguacgcacacacacacguacacacacacgaguagacagacuugagggucuccuuugggcagagaauccugccaccauuaucagcuuuucuuaguuggggaagguuggacuguuuggcuuuugcugaguuggcacuaucuuuuuuuuuuuuuuuuuuuuuuuuuuugagauggaaucucacucuguugcccagguuggagugcaauggcgcaaucucagcucacugcaaccuccgucucccggguucaagugauucuccugccucagccuccugaguagcugggacuacaggcgcgcgccaccacgcccagcuaauuuuuguauuuuuuaguaaagacggaguuucacccauauuggccaggcuggucucgaacuccugaccuugugaucuaccugccucagccucccaaagugcugggauuacaggcaugagccaccgcacccggccagcacuaucuuuaaaccuacaaaucccuugccucuuccaaggugagaaugagcuggauggugggagaacagcagggcaguggucacuccaucagauccauucccuguauugaaagcauguagacccaaacagcagucagcacccaacaucagaagaacugcuagacuggaguaugagcuaaauuugggugccagcucaccccagccuugcagguaugauacaguuucccauccaagccaggagcaauuucggagucauuccuugccccugccccacagugccuaaccccucugauaacccuccagccagggcauacuggguucuccugauggaacacagggaaaagcaucaaggcccucaucagauucgaccugaggaagcuuauuuuaaaaaaagaagguggcccucaucagagcucagcuuucaguguugcaucauggcuguggaggagccccugcuucugccuucaccccuuuacagcucucacagcacauucucaaccuugggggaggaaggcuuccaaguuauuagaauuagaguauguuuaugugucaggaggguaagcacaugguggaaaggacagauggccccuuaugucacauucccucauuaaggaagauuugccuagggaggaggcaagggcuuuaaaaagccucaggacucuagugggaccuaggguggaaggaagcaucuucgagucaagucaucagugcagcuggcagguguguggaaucaagggggguaggguggaugggacgggauguuugcguucucucuaaagguuuguguuagggagcagagaccugguuuuguugaguuguuucucagucugucagucucugccccacaaccuuucugguuguuccccauccccuuaaaaggaagggucuggacccaaagggcuccauguacauuaguggaaaacuaauugggaacucuugcuucucccauuucccucuaaaacccaaccuauccgucucagugugaggaugaagcugagggagagacaagggaugaaauuugggagacucacaagcuucuauucuuaccuauuccucuccagagaggcaaauuaucccuucuucccgaggaaccaugccccacacacucuccccucucucugcacugcuccccuccacugaagcugcugccaugguugccaggcaugguugcuaagucucugcauggaaggguuggcgugggcugugcugccacuaacauuaccauggugaaucaggggacaccugguauaagcuuaggaggagggaucauguggauauaagcaacagccccccaggacagaggcagcccaaaaggugagcaucuggagcaccacuuaagguggggacugagugaacuaggcauuguggugguggugagggggaguucuacauugaaaaaaauaaaggccacuuuuaucauuucaguugcuaggggauuaguuuugccaagcaaacacaucauuucuccuccaucccccucuggaagggugagagugcauaagcacuuacucuguccuccauaaagcugggcaggcugugugggcacagaacaauauaacccccaaauccuggcuucuggauuggaggugaaagccugcugcugugggagggcucccuggcugcccaaggacaaacauguagaauggaacugguagggcagcuuggguggccaaggcagacgccuguguccugcuguaccagcaguccuaggcugcagcacugagcugacaaggagauacggguguaggggucacccuuuuugagcuuagggaaggcagcucucccucagagucgcacaaaagcuugguaaaagccaccgccuccucucuccaccgcaugggagcugguuacucaucucaucucugcacccgaacagccacugccgcuaaaaauagccccccagccgugggccagccccuccugcaccccagccccauggaaaccagcagaguggcaggcagagaccuugaguuccaaucucaucacucuauguuggggaaacugaaaucugaggcaggaagccaggggcagaacccugguggucaggcaaccugacaagcaggagaguaaaggguuaaaacggcaggaagguugaagaaauaggggcgggggagggggcacugucagcuuggcaagaaucauaagucccucccccgcccacucgugcgaucccaucaggcuugggggacaacagcagugggaaggggcguccaaucccgggccccagggggcggccgugcacaugggggagguagcagcgcggagcaguccgcgcggugucacaugcgcgcgcacacacagagacaggcacacacacgugugcccggguauauauaguucccaguccccgggcccgcggcucugcagugggcgccggcucccugggcugggagggggcuccuggggcgggugggaggguggggggccggggugggguggggcaggaugcuggauggcccacuguucuccgaggggccugacagcccccgggagcuccaggaugaggagucuggcagcugccucugggugcagaaguccaagcuauuggugauagaagugaagacuauuuccugucauuauagucgccgcgccccuucucgacagcccauggacuuccaggccagccacugggcucgcggguuccagaaccgcacgugagugaagcaggggugaggggaagagagugguggggcggggagugggguccggaccuccccgcaggcaccagcgagcacugcuggucccccuucucuuucccacgccuuccaccucugcccgcucccgagggcuggggccugacucaucccguuguuugggggaacagaagugggugugagaaagggcaggaggugagauggggcagacgcuguuaaagugugcauggagagauggcgaggagucccgcuucgacuucaguccuaacauauacgcacgugcacacgcgcacacacucacacacaccccuucacauggcugccccaaguggucuccagugcucccagcuccccggaccucggcucccuucccccacaaacugcucaccuggguuccugcucauugucccaggugugggccgcgcccgggauccccacagccgccgccccgccggcccugggccuccagggugcugcaggaggcgaccaacuggcgggcggggccccuggccgagguccgagcucgggagcaagagaaaaggaaagcggcgucgcaggagcgggaggccaaggagaccgagcgaaaaagg

SEQ ID NO: 17938 - RNA, 1738 nt, Homo sapiens
caugcccauaccuagugaggcaggguguggcccggagcucccacuuucccucagucaccaaacugcugcuggucuggugggaagggguggugaugugggggugggggagcuuagugucagcgcggggagggugggggguauuuaucuauuuauacaugggauuguacauagucuuguggggcaugggggagccggcuggaggugagaacccuccccucuccccccaccccccggggagagcaaauguaaaacuacuaauuuuugugcuuuauauauucuauauaaauauaucuauuuucuuuuuacaaaaccaguuuauaaaugguagggggguguggggcggacacauggagcuccccuugugggggggcccccuccauuacccgaccuaccgcccuuuuccucaccccccaccccacuccccacccccuggcugugacugcuguaagauggggguauagaggcugggcaauucccacccccuguuguauaguuggacuauguuauaacgcacaaaagagagcugaccccagggggagccagagggugauggguuccuugccucccuuuccuuccccuuucugcccaagcuugugcugcaguugaaccucuuccugggggugggaguagguaaggggugggugaggccccaaaccccucucugguagggaaccguggggaugaagaugaagcuuauaugcaguucucuucuaggggcugugggcaaagggcauuuuguaauuaauauuuucaagaaucagaugucuggaguguaggggugggcuugguggugguggacgggcgggccugcuggagggggagcuuggucgcuguugugauuuuagguuuguuuuuguuuuguuuugaauuugggggguuguggauuguuggggguagggagauuuuuuuuuuuuaaagcugcuuccucaacuguuucaagcugcaaauguuuaagagaauaacagcccccacucccacaggaaccgcuguaauuaaaucagacaguaggaagacugggcugcugcccucaaagccacagcccuuggauguuccuuuuccgagagcagaaggucuaggcuacagggagggggagauuggcucccgugagucaggcuguguuuggggcuugggcccugggauugggaaaaggggauggggcagacuuuguaagcauaugcuagguauccgauaguccuguagaauuuagugaagaaaccuuauacaguuuuuaauuuuuauauaaacuauaacucagacccaagcuacaagguuggaauuuugguugguuuuuuuuuuaaguacccugccuguauaauugcaucagaaucccccaccccaccccccgcccccguguuuguauuuuggguugguuuacacucgcacauacucaguuuucaguuuuccccuuuacagucuucuccccucaccuccaggacccucccccuuuuuaaaaaauaaaucgcugacaagugugaaucccgugaagacuuuauuuuguguuguguguauccuguacagcaagguugguccuucguaacaacggaugaaaugguucccuuuuuuaaagcgcccucucucccuccacccucagcgccccuguccuuggcauguuuuguaucagcgaucauucugaacuguacauauuuauguugcgagaggcaaagggcaaguuuuggauuuugcuucuuccaaguuuguuuuuaaacgacaaauaaaaaaagaacauuuuaaauacaag

SEQ ID NO: 17939 - RNA, 5645 nt, Homo sapiens
cucucacuagauacauagaagucaacaauaaaauaaggccgggggcaguggcucacgccuguaaucccagcacuuugggaggcugagguggguggaucacuuaaggucaggaguucgagaccauccuggccuaggugaaaccucaucucuacuaaaaauaaaaaaguuagcuaggcaugguggcgggugccugcagaagacugaggcaggagaacugcuugaaccugggaggcggagguugcagcgagccaagauugcagcacugcaccacuccagccugggcaacagagugaaacuccgucucacacacacacacgaaaaagaagucaacaacaaaagauuucucaauuuauuugcauauauacauugucaccccagggagccagcucuauuucagaaguccccggcuccccuuacccagccaacacccaaaacccacccaagaggauggguccuggauaaauaaugcccaggacucauauccugaccccauagguuauaacagaauucaucaaacaaaaacagagggcuagaggccaguguccaugagagguccuugccccuuuguaaacauugacauccaggccacuggagccuggggaaagugugcaaacaugaggaugccacacuguguguccaggggccaggaacacagcuggcaaccauacccgugaaguccugaggaucugccccccacuggaacauggcaagugccgggggcagaagcaaggcaguuaccccacacccaagggcucacaugagauggcagcgacgcucuugcccauaggaauucuccacacgggcaaucuccuggaugacuuuggugaagaugccuugagucagcuauaagaggagaggauucagggcaaaagucaguucagugccaauaccacccagcucuggggugaaagccccauucccgcaacauucccaccaccaagcaguacaauaaggaaaacacagcuaccaucaccacccuucuagucuucaggcccagcaccugauucucucgagcagaugacuccauaaaugucgcaccccaggacucugccagcuucuuuccuucaacugccuguaccucucuggaagcaaauuugggacauaaagauggaggauagaaaugucaguaagugcucugaaaaaucuucagaaucaagacuuccuggccaggcacaguggcucaugccuguaaugcagcacuuugggaggccgaggugguggaucacuugagcucaggaguucaagaccagccuggacaacacagggaaacaccaucucuauuaaaaaaaaaaugggccacacgcgguugcuugugccuguaaucccgauacuuugggaggccuaggcggguggaucacaaggucaggagaucgagaccauccuggcuaacauggugaaaccccgucucuacuaaaaauacaaaaaauuagcugggcgugguggcacgcgccuguagucccagcuacuugggaagcugaggcaggagacucgcuugaacccgggaggcagagguugcagugagccgagaucacaccacugcacuccagccugggcaacagagcaagacuccgucuaaaaaaaaaaaaaauagagaagaaaaagacuuucucugacccaugccauuuccccaaguuuugggaggagggcuguggaaggagaaaauauagguaaacaaaggaacaaugggugaaucuaggacugaggcuugaaauaugaaauuguggcuuuuaagauagaaguauuaucuuccuuaagcuucagguuagagacaaagagaggugaaaugacuuguuugagucaguggaagagccaggaugagagccugacugauucccaguccauuucacuuccuuuugcucugaguagcagagauuuacauaccucucuggagagagaucugccuuguuccccacuagaaccacuggcacccugugaggaaacagcaguuacuucagaauccccucauuccccgcauuccccaacuccuuacaucaaggcuggacgacuccuuaucagaccaggcaggaucuauauccgagccuccucucuaacuugacaauucuccccucugcucucucccacccccucaugcccacacuaugucccuaucccccagggccacuuaccggguuuucccauggccuucauguagcuuuugguacagacucucaaugacuuggaagcuuuaaacacaagaauuggagcuauaacuuuaugagacaguccucagguucucccaagucccgcacucacaaccuuggucacuuaccuaugcagagaggugacagaauacacaagcacauaaccauggaccccaaugaugaaugaauagggcagaaugcuguacucauccuggcaagaaaugggaaacaucaguaccuagauccaaaccacuaagauggcaaagguuggugggacaacauccaggugacccucccuggggcacgcccuacuauagucacuucaacauguauuuauggaacagcuccaaugagcccugcauacuguuagcagguaaaaugcuuuuaauacuacuuuacggaugagccacaaagacuaccagacuucaucuccgagggcugaacugccacauuuggauaccauaccccaacugguaccugcccugcuguguccaccagauguaggugaaacucaucuuugccaagagucacuaucuugcuguaagcugaaaagaaaagaaaacuugacugugaagugccuuauaggaccagcgauguauguccccugacuuuuuuuuuuuuuuuuuuuugagacaagagucucacucuauuguccaggcugggcugcaguggcaugaucucagcucacugcaaccucugccacccggguucaagcuauucuccugccucagccucccgaguagcugggauuacagggaccugccaccaugcccggcuaauuacauuuuuuuuuuuugagaugaggucuugcuauguugcccaggcuguagagcaguggcuauucacaggcgcacucuuagcacccuauagccuggaacuccugggcucaagcaauccugucaccucagccucccaaguagcuggaacuacaggugugcaccucugcaccuggcugucuccuuaccuuuuuuuuuuuuuuuggcagcauuuuuuaaaguagauuauugguugggcgcaguggcucacaccuguaaucccagcacuuugggaggccagggcaggcggaucacuuaagaccaagaguuugagaccagccuggccaacauggugaaacccugucucuacuaaaaauacaaaaaauuaguugggcaugguggugcaugccuguagucccagcuacucaggagggugaagcgugagaauugcuugaacccaggagguggagguugcagugagcugagauugcggcacugcacuccagccugggugacagagcgagacugucuugaaaagaaaagaaaaauaaaguaauuacuuuuguuuuauugaugaauaauagauguaccaaguuucaggguacaugugacaauuuaauacauucauauaauuuguaaagaucaaauaaguguaucuggaauauucaucaccuuaaauauuuggcuuuucuuuaugcuagaaccauuugaauucuucucuucuagcuauuuugaaauguaaaauagcuuauuguaagcuauagucacccuacugaucuacuaagucuuauuucuucuaucaaacuauauauuuguacccauugaucaauuuaucuucaucccucccacucccuucccccuuacauucuuuuuauucuuuuuuuuuuuucuuuuuuuucuugagacauugcuucacucuuguugcccaggcuagagcgcaguggcacgaucucggcucacugcaaccuccgccucccagguucaagcaauucuccugccucagccucccgaguagaugggauuacagauguccaucaccauguccggcuaauuuuuuguauuuuuaguagagacgggguuucaccauguuggccaggcuggucucgaacucuugaccucaggugauccaccugccuuggccucccaaagaacugggauuacaggcauaagccacggugcccagcuuuuuuuuuuuuuuuuuuuuuuuuuugagacagucucacccugacacccaggcuggugugcaguggcacgaccuuggcucacugccacuuuugccuccuggguucaagcgauucuccuaccucagucuccuuuguagcugggauuacaggcgugcgccaccaugcccagcuaauuuugguauuuuuaguagagaugagguuucaccauguuggccagguuggucucgaaauccagaccucaauccauccgcccgccucagcuucccaaagugcugggauuacaggcaugagccacugcgcccagccuccccuuacauucuuaaccuugggggugacacagauagaucagcuccagggaguuauccagguaacuggaaagacacgcuaagguucuuaaugucuacaucuaaacuaucccagacucaauaucuugcaaaauccauacucuagccauccaucgaacaggauugcuaaagaagaaaucagauguaaugucuaaauaaaucagccccuuggcaccagagaaauaaauuauggaguugggugggguauccaagcccuccgggucgcauaccaccagcacacuaggggagaagucuacucacuauucuccacuguaggaucguagccuuccgagaacucgccuuccacaaauugaugugccaaagaugucuucccuguggggagcagugugacaguuguauccaaaucauccauccacauucacauccucuguccuuucggacuguggcccaggaccaaaggagaccccaaauuaacaccacagucugugagugccucaagcaaugcuauccuuugugucuacccucacccucuuuucacccagggucuccgcacuuuggcuaccggaugcauucagaagcgcagcaggaagccuuucccgccgccuuccccaccccaucccacucguaggaagauccaagauucccuaggaucaaguccgccccgccccaggacaccugcgacuaucuguccccacggagaccgcgucccgguuuucaaauugugaccccaccccuauccccaaaguaacgcugggaccacucugagauucccgcagccagguccgcauuaacccuuaagugcucccgcuuccugcagccuccacacaccaccaacucuuccaauccuccacucuuccauuccuccacucuuccaauccucgcucuacaaccccauccuuacgaugucaucauuccucccugggucgcguucccacggcagcgcgccucuucuggcuacaaagcugcugcgcguccgagcucugcagggcggagacucaccuacacagcgguauccgaggaugaccaccuuccuguagcggacuagcggcauggcaggagcccgccccaggggcuugcggaacugcgggcucagagagcccgaaaacgaggucagggugugagcaggcgcggcagcuggugcaggaaagucgcucaccccgaagcugccgugggcaaguuagaaggaaaccaaaacaagcgccgcgcccggagcugcccacgugaucacaacacagcacgucuaacgccagggagccgggc

SEQ ID NO: 17940 - RNA, 5645 nt, Homo sapiens
gcccggcucccuggcguuagacgugcuguguugugaucacgugggcagcuccgggcgcggcgcuuguuuugguuuccuucuaacuugcccacggcagcuucggggugagcgacuuuccugcaccagcugccgcgccugcucacacccugaccucguuuucgggcucucugagcccgcaguuccgcaagccccuggggcgggcuccugccaugccgcuaguccgcuacaggaagguggucauccucggauaccgcuguguaggugagucuccgcccugcagagcucggacgcgcagcagcuuuguagccagaagaggcgcgcugccgugggaacgcgacccagggaggaaugaugacaucguaaggaugggguuguagagcgaggauuggaagaguggaggaauggaagaguggaggauuggaagaguuggugguguguggaggcugcaggaagcgggagcacuuaaggguuaaugcggaccuggcugcgggaaucucagaguggucccagcguuacuuuggggauagggguggggucacaauuugaaaaccgggacgcggucuccguggggacagauagucgcagguguccuggggcggggcggacuugauccuagggaaucuuggaucuuccuacgagugggaugggguggggaaggcggcgggaaaggcuuccugcugcgcuucugaaugcauccgguagccaaagugcggagacccugggugaaaagagggugaggguagacacaaaggauagcauugcuugaggcacucacagacugugguguuaauuuggggucuccuuugguccugggccacaguccgaaaggacagaggaugugaauguggauggaugauuuggauacaacugucacacugcuccccacagggaagacaucuuuggcacaucaauuuguggaaggcgaguucucggaaggcuacgauccuacaguggagaauagugaguagacuucuccccuagugugcuggugguaugcgacccggagggcuuggauaccccacccaacuccauaauuuauuucucuggugccaaggggcugauuuauuuagacauuacaucugauuucuucuuuagcaauccuguucgauggauggcuagaguauggauuuugcaagauauugagucugggauaguuuagauguagacauuaagaaccuuagcgugucuuuccaguuaccuggauaacucccuggagcugaucuaucugugucacccccaagguuaagaauguaaggggaggcugggcgcaguggcucaugccuguaaucccagcacuuugggaagcugaggcgggcggauggauugaggucuggauuucgagaccaaccuggccaacauggugaaaccucaucucuacuaaaaauaccaaaauuagcugggcaugguggcgcacgccuguaaucccagcuacaaaggagacugagguaggagaaucgcuugaacccaggaggcaaaaguggcagugagccaaggucgugccacugcacaccagccugggugucagggugagacugucucaaaaaaaaaaaaaaaaaaaaaaaaaagcugggcaccguggcuuaugccuguaaucccaguucuuugggaggccaaggcagguggaucaccugaggucaagaguucgagaccagccuggccaacauggugaaaccccgucucuacuaaaaauacaaaaaauuagccggacauggugauggacaucuguaaucccaucuacucgggaggcugaggcaggagaauugcuugaaccugggaggcggagguugcagugagccgagaucgugccacugcgcucuagccugggcaacaagagugaagcaaugucucaagaaaaaaaagaaaaaaaaaaaagaauaaaaagaauguaagggggaagggagugggagggaugaagauaaauugaucaauggguacaaauauauaguuugauagaagaaauaagacuuaguagaucaguagggugacuauagcuuacaauaagcuauuuuacauuucaaaauagcuagaagagaagaauucaaaugguucuagcauaaagaaaagccaaauauuuaaggugaugaauauuccagauacacuuauuugaucuuuacaaauuauaugaauguauuaaauugucacauguacccugaaacuugguacaucuauuauucaucaauaaaacaaaaguaauuacuuuauuuuucuuuucuuuucaagacagucucgcucugucacccaggcuggagugcagugccgcaaucucagcucacugcaaccuccaccuccuggguucaagcaauucucacgcuucacccuccugaguagcugggacuacaggcaugcaccaccaugcccaacuaauuuuuuguauuuuuaguagagacaggguuucaccauguuggccaggcuggucucaaacucuuggucuuaagugauccgccugcccuggccucccaaagugcugggauuacaggugugagccacugcgcccaaccaauaaucuacuuuaaaaaaugcugccaaaaaaaaaaaaaaagguaaggagacagccaggugcagaggugcacaccuguaguuccagcuacuugggaggcugaggugacaggauugcuugagcccaggaguuccaggcuauagggugcuaagagugcgccugugaauagccacugcucuacagccugggcaacauagcaagaccucaucucaaaaaaaaaaaauguaauuagccgggcaugguggcaggucccuguaaucccagcuacucgggaggcugaggcaggagaauagcuugaacccggguggcagagguugcagugagcugagaucaugccacugcagcccagccuggacaauagagugagacucuugucucaaaaaaaaaaaaaaaaaaaagucaggggacauacaucgcugguccuauaaggcacuucacagucaaguuuucuuuucuuuucagcuuacagcaagauagugacucuuggcaaagaugaguuucaccuacaucugguggacacagcagggcagguaccaguugggguaugguauccaaauguggcaguucagcccucggagaugaagucugguagucuuuguggcucauccguaaaguaguauuaaaagcauuuuaccugcuaacaguaugcagggcucauuggagcuguuccauaaauacauguugaagugacuauaguagggcgugccccagggagggucaccuggauguugucccaccaaccuuugccaucuuagugguuuggaucuagguacugauguuucccauuucuugccaggaugaguacagcauucugcccuauucauucaucauugggguccaugguuaugugcuuguguauucugucaccucucugcauagguaagugaccaagguugugagugcgggacuugggagaaccugaggacugucucauaaaguuauagcuccaauucuuguguuuaaagcuuccaagucauugagagucuguaccaaaagcuacaugaaggccaugggaaaacccgguaaguggcccugggggauagggacauagugugggcaugagggggugggagagagcagaggggagaauugucaaguuagagaggaggcucggauauagauccugccuggucugauaaggagucguccagccuugauguaaggaguuggggaaugcggggaaugaggggauucugaaguaacugcuguuuccucacagggugccagugguucuaguggggaacaaggcagaucucucuccagagagguauguaaaucucugcuacucagagcaaaaggaagugaaauggacugggaaucagucaggcucucauccuggcucuuccacugacucaaacaagucauuucaccucucuuugucucuaaccugaagcuuaaggaagauaauacuucuaucuuaaaagccacaauuucauauuucaagccucaguccuagauucacccauuguuccuuuguuuaccuauauuuucuccuuccacagcccuccucccaaaacuuggggaaauggcaugggucagagaaagucuuuuucuucucuauuuuuuuuuuuuuuagacggagucuugcucuguugcccaggcuggagugcaguggugugaucucggcucacugcaaccucugccucccggguucaagcgagucuccugccucagcuucccaaguagcugggacuacaggcgcgugccaccacgcccagcuaauuuuuuguauuuuuaguagagacgggguuucaccauguuagccaggauggucucgaucuccugaccuugugauccacccgccuaggccucccaaaguaucgggauuacaggcacaagcaaccgcguguggcccauuuuuuuuuuaauagagaugguguuucccuguguuguccaggcuggucuugaacuccugagcucaagugauccaccaccucggccucccaaagugcugcauuacaggcaugagccacugugccuggccaggaagucuugauucugaagauuuuucagagcacuuacugacauuucuauccuccaucuuuaugucccaaauuugcuuccagagagguacaggcaguugaaggaaagaagcuggcagaguccuggggugcgacauuuauggagucaucugcucgagagaaucaggugcugggccugaagacuagaaggguggugaugguagcuguguuuuccuuauuguacugcuugguggugggaauguugcgggaauggggcuuucaccccagagcugggugguauuggcacugaacugacuuuugcccugaauccucuccucuuauagcugacucaaggcaucuucaccaaagucauccaggagauugcccguguggagaauuccuaugggcaagagcgucgcugccaucucaugugagcccuugggugugggguaacugccuugcuucugcccccggcacuugccauguuccaguggggggcagauccucaggacuucacggguaugguugccagcuguguuccuggccccuggacacacaguguggcauccucauguuugcacacuuuccccaggcuccaguggccuggaugucaauguuuacaaaggggcaaggaccucucauggacacuggccucuagcccucuguuuuuguuugaugaauucuguuauaaccuauggggucaggauaugaguccugggcauuauuuauccaggacccauccucuuggguggguuuuggguguuggcuggguaaggggagccggggacuucugaaauagagcuggcucccuggggugacaauguauauaugcaaauaaauugagaaaucuuuuguuguugacuucuuuuucgugugugugugugagacggaguuucacucuguugcccaggcuggaguggugcagugcugcaaucuuggcucgcugcaaccuccgccucccagguucaagcaguucuccugccucagucuucugcaggcacccgccaccaugccuagcuaacuuuuuuauuuuuaguagagaugagguuucaccuaggccaggauggucucgaacuccugaccuuaagugauccacccaccucagccucccaaagugcugggauuacaggcgugagccacugcccccggccuuauuuuauuguugacuucuauguaucuagugagag

SEQ ID NO: 17941 - RNA, 7759 nt, Homo sapiens
uaaggcggaguccggaguccgggcguucuggcagcaccagaguccugcagcagagacgggcugggcuggcacucacccacgaccccccuucccugcuaugaugguuugucaguagcagguccuagacaccccccgcccgcucccggggcacgugggcagagcuagcagcagccaggugcacggagccacaagagcucuagggcacucugggggcagcugugccugcugcccucucuggugccuguggagaugccuaacugacaggagaguuagugaggacaagaacgcucccuuuuggccgagguccgcuguauccauggcucuccugaccaaucuacugccccugugcugcuuggcacuucuggcgcugccagcccagagcugcgggccgggccgggggccgguuggccggcgccgcuaugcgcgcaagcagcucgugccgcuacucuacaagcaauuugugcccggcgugccagagcggacccugggcgccagugggccagcggaggggaggguggcaaggggcuccgagcgcuuccgggaccucgugcccaacuacaaccccgacaucaucuucaaggaugaggagaacaguggagccgaccgccugaugaccgagguaaggagggccucucccuaccugcgccggggcacugccagcuccuccguuuuccuauggcagcccaggugggugaguccagcuucaccuacagagaguuuagccuuagagauuucccuugucaccagccccaggggggggaaaaauccuugcagucuggacagaguaauuaggacggcucccgacuagaauagucugggauggggaggggaggagggacugacuagugagagugaagcugguagaggcagcgagggcggggaaaggaggauggcggcaggcgagacgggaaauggcugaggcguggaccgggggucagccacccagccaggcaggaagggcuggggugagcugggggccaggagcuggcuagguagcagacagaagccuggcuccugaccugauuguagaaaagcucugugggccgaaaagaagagacugaaaagggcugggacagggguggccaagggucaggucaccagaccaucuaccugaggaggggcugggcagacauugcuuuuggcaugggaaacguguccuagaaccaggacacaucuauucuagggucuauucuagggcuauccuagggucuaaacgauaaucuugggguuaaaaaguaauccucagugagaauaacagauggacccaccugagaaucagagggcuccuaagucuuccaagcucugccuaucucaggggcuuuccuuggaauuacauaauuaggauaaauucaacuaccauuuuugagcauuggaaccaccuagagugagguggaagagaaggaccaccucuggcgagugauuuauuuuuuauuuuuuguagagacggggucuugccauguugccuaggcuagucuugaacuccugagcucaagggauccucccaccucggccucccaaagugcuggauuacaggugugagccacuucauccagccuggccagugaucuugaauguuagaacugaaagaaaacuugagagaugacauuccuccaacccuccccacccccacugccacccucauuuuacaucugagagcuggacuucccccaggaggaaaagcaauuuaaacucucacaauuuaaaguggcauggcugggacuagaauucaggacuccugauucuaagcccuauauacuuuccauuacaccaccuaauuguguauggaguggggagguggggggagagggagggguacggauuuccucugauuaauugccauaguuuuccagguuacuuuguuaggaaaaccuguccagggaagaaauaauuccuuuugcuucugcccugaagccuuccuccuaccuagagaugggaaaaggggcauuccuucuuuccuccuuggccguggaacauuguggcccuuuccucugguugccaccugcagcagagugggcagaacaagggacaggcucaggaggggcuccggcaggccugggagcccccucagucuuacuuaucucccacacccuggcugcaaaaggccuccauugaguuggcucugcacugggcugcugcccccgcaggucagggccucggggccuccuuaggggacgaaacgacaaaguuggaaggagcuaccacuuuuccuguuuuccccccacccaaccccaacucugcgggguggaggagacuagaggagaggggaaaagugucuuucuguuaggagaaaaccaaguccgaggugagaggucggaggggaaagaaaaaaaggaagcugucccucugcgccuccucccgcggugucccugcuauggugcgcgccaaggucucccgcucccaggcuggagcggccaagauaacuguggucucacucccccaggugcaggcuuccagccgcagcuucuuuuccucuucuccgcucucacccugcagggggcuccccagauccgcacaaggagaccguuauucucaggugcuacucccacgcccuucugggcugcaucuagagcagagaugggagagauaggggcucuccggacuggcagagccuuagcuggaacugggaagacuggacgcgcggggggaggggaccuacccggacggagcagggauugggggcgcggcuuucugcccuuuccucucccugagccggggcggcugaaaagcgccuuuguggccggagcugcugaguccgcuucucccagcgcguucccggccugggcucaggauucucgcucgguuaagucaucccggauaauggccauuguacuucgcgcaacccccgccaccccaauccuuuuuccagcagccuugaucccgcacagcuccucuugggcaccucucuggggggcacccagagcacgaagggguuaaugcuaagggcccaaaggaggaggaggaaggaaggaaggaagcgaugcccggugccagggaaggcaaugaaacaaaagaugaaucaggcggagggaggggagccggugccuggggcgggggccaggcucaaacaggggcucuccgggagcaaccaggcccucccugaccacgcuuccauucgcccuccuaacucuguccuucucccagguugagccgcugucccugaaccaauaggggugagggacgggcauuaaaaauggggaaggagcuagguaugggcacccccucucaaccucagaggugagcccacaguucuccaacgacguccugggaacagagugcagauuggugacuaccaucgacucagauucucauuucuccaggacacucaaaagcugggagggguaagaguagggccggaauaacaaagaaucaacccuccuauccaggucccuuuugccccaaggguggugguggggagacugacuccuuuauuccccgccagcguuguaaggagcgggugaacgcuuuggccauugccgugaugaacauguggcccggagugcgccuacgagugacugagggcugggacgaggacggccaccacgcucaggauucacuccacuacgaaggccgugcuuuggacaucacuacgucugaccgcgaccgcaacaaguauggguugcuggcgcgccucgcaguggaagccggcuucgacugggucuacuacgagucccgcaaccacguccacgugucggucaaagcugguacaguaggaggagggugguaaaauccgcccaaagggggcucccuccgggaaacugagucugcaguaguacuguugccacccuaggggagaccaagcgggcuuuaguguugaaaaccacccguccaggccgaggcggugccucacgccucuaaucccagcacuuugggaggccaaggagggcggaucacuugaggucaggaguucgagaucagccuagccaacauggugaaaucccgucucuauuauaaauacgaaaauuaguugggcguggugguguaugccuguaaucccggcuacucgugaggcugaggcacgagaaucacuugaacccgggagguagaaguugcagugagccgagauggugccacugcacuccaucuacugggcgacagagcgagauucuaucucaaaauacauacauacauacauacauacauacauacauacauacauacauagaaaagagaagaaaaaggaaaagaaaagaaagaaaaaccgcccuuccuuuucugcccagguuggggccagucagauuaacggaaaauuguguuguccaugacuggcgauaucugcgcuggccuugagaaucguucuggaaccgcuggucuugauucaauccucccugugguuguucccugcagauaacucacuggcgguccgggcgggcggcugcuuuccgggaaaugcaacugugcgccuguggagcggcgagcggaaagggcugcgggaacugcaccgcggagacuggguuuuggcggccgaugcgucaggccggguggugcccacgccggugcugcucuuccuggaccgggacuugcagcgccgggcuucauuuguggcuguggagaccgaguggccuccacgcaaacuguugcucacgcccuggcaccugguguuugccgcucgagggccggcgcccgcgccaggcgacuuugcaccgguguucgcgcgccggcuacgcgcuggggacucggugcuggcgcccggcggggaugcgcuucggccagcgcgcguggcccguguggcgcgggaggaagccgugggcguguucgcgccgcucaccgcgcacgggacgcugcuggugaacgauguccuggccucuugcuacgcgguucuggagagucaccagugggcgcaccgcgcuuuugcccccuugagacugcugcacgcgcuaggggcgcugcuccccggcggggccguccagccgacuggcaugcauugguacucucggcuccucuaccgcuuagcggaggagcuacugggcugagcgucccaggcauagaaaccucgaagcgcccgaggaaacgagggccugcuggcugagauauggggcugugggcagcagacgaugccgacuggaagggagggagagggagggggagggagaaaauggggcuaugccuggcuuaggggcaaccucguacugagaggaggugauaccggguccuagguagguagggcugauggugcgcacuccuuaaagaggacuauuuagccucucccccagugcuucagccccacccgauaauuuuauuuuauuucuuauuuauaaauuguaauauaaugauucccuugcccagcuugccaaggugaggggcuggggcauggcauuaacacugucugacacagccagccagucugacaucugacguuuuccugcaaggugggcuaauaaagggaaggcuuucaggagcuuacuggaaaacacuuccauucagagggugauucaccuccagagagggggauaaagguggccaaccugaguuaacagcuuacuuccggcucccccuccuuccucagcagggucuuugggacccuuuuccucccuucagaaggggcaucccaacccauaagcaacagagcccacaagagucguacccuuuuccaggcugcuguuuccgucucccauccagagaggaccagcauuucgcuccugcggcugaaggguccaggguugucccaggugggaaagacugugcacaccucuucucuguuuauaggggcuccagcaggggcucaggccccuaugaguacugauacucaaagcaucuaguccccuauuguuagccaguaguccugguccccauccuaccuugguggcagggccuggaugggguggauguuuuuucugauaugccacugggccaacugaugauccaugggaaaccuggguaauaauuugcaaucgucgcauagucauggccugaaaaaggaaggggggcacaguaagaggcuggaauauuuccuuacugaagggcugcucagagagagagaauggauucagccuggguguaugugggggaaguagauucccuaaacaagggcauaucagcauuacaacccgagcuccccuccugaucgcuggcccugauuguuguuucuacuggcuuggucuucagcgccuccuccucccucucccauuaucaccagcucuacuucccuagccuggguguuuuuggaaccuuuagguuccaacgcaguagacaccuggaauccaggcaggcaggugccccugaguuaggaauggaagcucuggaggaagcugggcugcuccagaagggaagugucuuggguggaggugaggcggggaggaggaaauagucggggguuguugguaccacccggagcucgcccuugccaguagccgcugugcgcucccaucgcacagggucccugcuauacaccgcccucugguggccuucaagagaauucuaggccuaugcauaugguucucugaaacggaaggcaagcggucucagacauggaaggguguacuggaccugcgcaaaggagcccgcucccaggagggagagaugaugggugggccuuguuaagcugccagcgcugagucacacauaucaggagcugucaaggaguccaccugcuucuccuugggcaagucguuccaaaccauggcacuuuuacaucacuccugccuaguuuagcucugugguuccuggaagcugcagaugcccuacuaguauaccuguaguagcccagacuuccuuauguaucaaaguugccgccucaugucccucacccucaugacccuugaguucaauugucaaggaggugaaagcauaauaggguuccagguagugcuugauaaaggcaauauuuggaagcaggucaaguuuaccuuugguguccuuccacccacugcugcccucaacccacacugaggcucuguugccaccuuuguuuuuccgggucucagaaacacaucccaagcuguggaccuuuccuacuuucuaaaccugcccuugucucuuuuuaucagaucuggugccuuccugucaugucaccacaggugaugacuaauccgauaaaugaauuaguuguccuauguugaugggcuccuugguuuuacugcccuucccagguaaucagguaaugcauauauauauacauguauuuuuuaaagagacaggaucucgcucuguugcccacgcuggagugcaguggugugaccuugguccccuguagcuucaaccuccugggcucaagcaauccucccaccucagccucucaaguagcugggacuacaggugcaugccgcuaugccuggcuaauguuuguauuuucuguagagacagagucuugcuacguugcccaggcuggucuugaacuccugggcucccgccuuugccccacaaagugcuggaauuacaggugugagccccugugcccagcaguaauacauauaucuuacaguuuuaaccuuuaaccauaaaaucauaauggugaugauuccuagcacuguaauaaguuagcuagggagauauuucaggacaaggagaacucauugguuucccuuaaacuacauccuguaaguaacuuucuaggcuugaggcuuaccucucaacccucacuuccucccuuuauuaucuuuauuccuuugaggccccuccuaacucucaaaaaaaaaaaaaauccaugacuugccuucaagcggcaaugcgcaccaucuuggugcagcaggugggcauauucacuuggccaugcaacaccucccaauugcagcaccuuucaccaucaacaaaauaggcgaugaug

SEQ ID NO: 17942 - RNA, 9851 nt, Homo sapiens
uucguuaaccggaaguagacguaccucacggaagccggcuuuggcccugcggcugcuaccgucgccgcggagaaauuguuggaucuggcagucuaggaauggugagaccucgcgguucgccucugaggguucucagaggaguuggggaugaaauggaguuuugcagagugccgccggggacgaccaccccccaaguuuggggccccgccccaguggcgccccgaaaagcugcgcaugcgugggccggaccggguuagaaucuggcucgaaguguuacgcaugcgcaaaggcauggagaccguggggugagaaugggcuugcgaguuuacccccaccuccccagccaccagccugugggucucaaaccaaggcuacuuggugcucugcuuugaguugcagaggugacuucaucaaugcuccuaccccgaguucuugagacagaccuggaccgauccccuaccuugggugugcacucuugggagaacgaggggcggaggguccgguaaggaaggggcacagacccuaccucaguuugccggcaagcucgggccccuucgcccucuccucagaugucaagauucuuagucguagccuauggagcggagagcgacaggcucaccuggggacagggcuagaacacugagcuaagagccacccugguuagaaguggggacucacgagaggagcgccccgagaaaguccaguaccuggguucucuagggguuguuggggcacagcgugguugauaaucacgcaguucccaaacagugguuuuugguuuccacgagaugguaucucauggaaauaccacuuacuaaaucuucaguaaaaaccccaaauggaaaagaaaaacaaaaaaaaaacgagauggacugguuggaguuuugucucccuuucuuuuuuccugcuuuggccugggaggggaaggcuggugcugcugagcugaguggacagcugaaguaaagaaaaaugugggccaaagaaucccuugucucuugcuaguuuauagucaaggcgcuuaaccuaggagauaccaguagaauuaaagggucuaugaacccucuaaaauaguauguguuugcacccuuuucugcaguccauagcuguuaucauacucugaaaggugccagugaccuucacaagacugaugucuaaggcuauuauuggcagaguggggccuuaugccucuuuccuguccuuaugucuucccuagcuuaugggacccugggggaccugagccaguauaaggaagugaggcuggccaguuggaaaucugagccucagggagccucauuucuccuuugcagaaucuccucucagccuuuaagcucaccuggucagaauccuuggaugagccugugggaccguuccuccuagcccggugguuuggaaccaguggcuuugggacuguaagaggauggacaaagguaguaugaggccgggacagcuccccaaaugcucgggcgccaagcaucugcugauuccacucugugccuggcacgugugucuuucgguccuggcuaggccuugccaccucccccugggccagcaccacccauguaccugucggcagagccacaguugacugacuugcuguugagcugcugcucuuuagcacggcugcauuuugauggcagagggagcaguuaugcccagagcccagcgugucggcaucaccagucugaccugagcaccaugugcugcacgacaugacacguggcaccgggggaacugcccagcguggaaggucugggccaggucugagcccagaugggaucuggauggccaaggaacucuaccuuaaaaccucaagugucaaggaggcaggggaggggccaagagggcuggcaggggaagggggcuggggaggggucccauuugcagaggcucuaggaucuuaggaggcccgaauccaccauuucucucuugcuagauucucaggggcugcuagauucaucccugauggcaucaggcacugccagccgcucagaggaugaggagucacuggcagggcagaagcgagccuccucccaggccuugggcaccaucccuaaacggagaagcuccuccagguaguaaggguucggagggccaggaacugggaaaggguagaaggucuguggcguuaagugccacaugccuccccaucuguugggaauggcugccugagccccucuggggccuuaguauuggcagagccuugugcuuuuccugucccugcuaaauccuucccugugggacugagggcaggggagggagaucuuaggucucugacgugaagucuuuguggugugauacccugucaucucagagggcuggaguguagcaguuccauggccacaaccaggcuguggcguaaagugaaagcaggcuggagcagauagcacccuacugggcaccugcucucuuuugggggcugggggugugugaauggguaccagggugggguaaggaguguucacugggcaggacccuuuacagguucaucaagaggaagaaguucgaugaugagcugguggagagcagccuggcaaaaucuucuacccgggcaaagggggccagugggguggaaccagggcgcuguucggggagugaacccuccuccagugagaagaagaaggugaggaauugggagacuuaggggaugggagguagugccagauuucauguuuccccagaaccuuugccagcugccaagagcccugcagagcaggcuggugagaggaccaagcugccccagcccucaucucagaugccccccuccugggaacacaccucucccuacuccccauuucuugcugcagcccccacccccaacccugccauugcauccuguaucacauuccgugugggaggcauggagcaugcaucuauucugggagcagacagccuguucccagcauugcagaguguaaaaauaacccccagguggcauugcuguggcccuagacacugcaccagcaagagugauuucccgguauccuccccacccaacuuucacucuggggucggggauacugccagcaaagagaagaccccguauggucaaggacuauauagaaguaacuuggugggauggggguggguauuagaaagcugagcuccuuuccugugcuuccuguugugggcuggaguuggugcugaggcuggggcuggggcugccgcugccacagaguaugugaaacucuagucaugaagcgccagcugacuggaugcuggcuuugagcuugguuuguuccuguccucugcccagguauccaaagcccccagcacuccugugccacccagcccagccccagccccuggacucaccaagcgugugaagaagaguaaacagccacuucaggugaccaaggaucugggccgcuggaagccugcagaugaccuccugcucauaaaugcuguguugcagguagugcccccaccauaggcucagugugccccuuucccccaaccuccaguucgcaccccaaaauuagcccaacagggcccuguggguggcaaagaaggguuguucccagcuccaaggcuggagcaaauccuucuggggccuugcagaccaacgaccugaccuccguccaccugggcgugaaauucagcugccgcuucacccuucgggagguccaggagcguugguacgcccugcucuacgauccugucaucuccaagugagugggagcugguuccagcaguggggagguacugggacaccagaauuuggguccuggagcagagggaauuguaccagggccccaggaggggucugggaggcaggacuccuggaggcuccuugggggugauacugaggccugagaggcuucaaagagaaguuucuuccugccuccaggcaagggagucugcaggcagagggaauagcaugggagagaaaacuaaaaugagugcccggagugcacuguguguguuguggcuuugggcggagaaaacuaaaaugagugcccggagugcacuguguguguuguggcuuugggcgggucaccuccagccuuuccacauugaccuccuacaguuucauccuccuaacaagggggagucgaauagaagaacaccaagcccccuucuagcuccaguagccacaggcuuccaaauaaacucauacacaugcaacacacaguuccucuuccucugucacuuaaugucuucagagcuugguuggaugcuuaacacccauccucuccacagacccugguaccacuuaaguuguagcugcaguucugauauaccaggaaaugggcugggcucagcuuggaaaggggaggugguaggcaguggcuaggggguggcagcuuuggccaaguaaggaggaaggacuuggagggagcagcagcugguccaaggcucugccucaggaaggacugggucugaaggggacauaggggccuccguuuucugaguuggcuguucauucacuugacaaaccuguggagccacagauuaucugcuaagccuuaggcccuuccuaaugagggccuggccucuagguucuggaucucaaaagccuguagguuugggggaaauaguaggaaccccagauugcuugacaccuuuccuucaccccuccccucugucucuuuccguguccagguuggccugucaggccaugaggcagcugcacccagaggcuauugcagccauccagagcaaggcccuguuuagcaaggcugaggagcagcugcugagcaaagugggaucgguaaggcugagggcugggaagguggaggaucagggcacagcgagagcuggaccaccuagaaaaccacugauguggagagcuccccacccacugucuggauaugugcacaugcacacgugugcacauuggcaggggcguuugugacaggggccucaggaagagccaagccugacuucuugggugacuagcuugcuucuuccagcuccugggggaugcugaggugggagguagagaugguaaggcagagaggcaugugugaaaaagcccagaugccuagagaauguuucuugcccucuagaccagccagcccaccuuggagaccuuccaggaccugcugcacagacacccugaugccuucuaccuggcccguaccgcgaaggcccugcaggcccacuggcagcucaugaagcaguauuaccugcuggaggaccagacagguaacgccccaggagcuggcagaaugggggugugugcacgugcaugugugugugugucugaaguacucgacacagcugccuucaagugcccuguaacagauuccucagugauccccagugucuuguucaccucacauugcaaaaaaaacuacuuuccagagagagaaaguggcuggaauggucuucagcaucaugguaagaguagccaacauugccuggaaucuuuggcaaaagguccaaauagcggaguuaucuaccauuucuugucuuuuguuuuuuucaugacauauuuuauucucacauaaauaacacaugaauuauuauggauaacauucaaacaugagcaaaauaagaaaguccacuuuccugcccacccuucaguuuguuuuccacccuagagguaauaaccacuuuuucugagcuuuuccgcucuuugccucucuccguucuuccuucugucuuccuucuuccucuucuuuucccacuaggccguuagugcugucaagcugcccucaggccauucauaaauccccacugggacuucacacccaguccaucugucucucccuuuccccaagggccucacugcucccuacuuccucuugccucaacagcacagcacucacucucccagugaugggguaagaaaacagugugauuaaacuggaggaacuccccagugaggucuguaauucggguucugauuuccauaguacaagcacguucucacuuucuaaaaguacugcccauugccgucuacauaguuuuucacacaguucaaacaugaagcuucauugguacccaucaccuuacuaccagggucccgcagcuucugcuuaggaaaaaggauuccugcaggagcauuuuaggaaaucucaucagaaggaggccccaucuuccguuccuaaggaccucugauuuuaguggcccgggggcagcccucuuuauuccugcggcuuccaaaauucugccucuuccucagacucagauaucacagaauucccacagagagaacagauacugacuggauaacuuuucuuuuuacugcuaaagcuaguuccuuugucacuauuuuaaaaguuaugccaggcaugguggcucacgccuguaaucccagcacuuugggaggccgaggcacgaagucaggaguucaagaccagccugaccaacaugguauaaccccgucucuacuaaaaauacaaaaaguagccaggccugguggcacacgccuguaaucccagcuacucaggaagcugaggcaggagaauugcugaacccgggaggcagagguugcagugagccaagaucgcgcuacugcacuccagcugggaugacagagcaagacuccaucucaaaaaaagaaaaaagaaaagaaaguuauuuuguguaaauuuauuuguuaacuaaaagccuuaucaugaaaguuuuauuuauuccuucaagaguuuuuguauuucuucaaaagggauuugauuucuccuuugccguugagagcuaggagacccuaggaauaggcaggacacauugcuuagcugucaagucagcggaagaugagauucguggaacuucaggcagcucugguggggagggacuugauggagugacugcccugcuuccccccauauggucucaccucagugggaggaagaggagcaucuauggccccuccacacucccccucacuuccucaguugacaauugcauggccacuagcugcuauagagcacacccuacagucuugggaacggcuggccuaaaagcagagguuuucagauuuggggggccuuuaucccuuuaaauuuuuguuaagagacagggucuuucccuguugcccagcugaacuugaauucucagcucaagagauccucuugccucaggcuccgaguagcuaggucugugggcacacaccacuguucccgacuuccuuucacauuguggccagaaaaaaaaacagacuuucaugaaacuguauuuauccugagcauaucugaugggcucugaugcucauuuuccuauuccauuucauuuuuugaaaaaaugaaacugauuucaugacccauuagcaggucaugaccccagaucaagagacauuggcuuaaggugggcggcgcccaccagcacguacuuucucaguggaacuuggcuggcaggugccucccagccccucacagcguggcaggaaaugcuggagagcauaugaugugauggaaggagagguugagauuucgaauggagagagcaggaucuaaauccugccuccgucccaaacuagggucacauaguuuaaccccucuccugugucuguuuccucaucuguaaaauagagcuaaugguagugccuccccugcuuaguucaaggcuguguaaucaaagcccuuugcacaccaagaagcccauacaaaaggucaauuuuaauuuccuucccuuucuagaaccaccucuacccucaacuaagccuaaagaugcuuugugccaaauuagagcccagccuaaucugguaugggcacccuugcuggugcugggcucuccacccagcgcagucugcagcugguccacuuggcuuagugguccgcucagcaucggguucagcaagacccuuggugcucacgcuuucucuguccuuuguucagugcagccgcugcccaaaggggaccaagugcugaacuucucugaugcagaggaccugauugaugacaguaagcucaagugaguggcuggagacacaggaagggguggagagagccgagucacuccugucagguagagcgccccaggcugcccagccccagcccuugggcucccguuggugcuuggcccccccuggcugagcccccuccccucccacuggggccuucuuaggcuccgcugcuuuacccuuauccccagcccaaccccagagaaggaggcugggccaaggccugauguaccaccuuccaggccacuuggcuaaaggggcucagggaugcccuaaugagccaaguaacaggcaagcugaagguggaccuaaaucuuccuucucuucuugccccucagggacaugcgagaugagguccuggaacaugguaaguauggccucaugggguggugaggggauggaagcuccugccagaaucaagaggaccaguacaaggugcugguggccucagagcaucccuccuuaccaccccaccucaccccagagcugaugguggcugaccggcgccagaagcgagagauucggcagcuggaacaggaacugcauaaguggcaggugcuaguggacagcaucacaggugaggaggccugggcaccagaaggcucacucuucagcauccuucgccccagccugugccccuguugcugccuggcuggggagacccucguuucccaggccccgacccccuucccuuauaaaccuugcccugguucccugccuugcauucuggcccucagggguaggcucuuccaaacucccucuucucccaggcaugagcucuccggacuucgacaaccagacacuggcagugcugcggggccgcauggugcgguaccugaugcgcucgcgugaggugaggcaggcccauccccgcccuucuuaggcugcuuccucugucagugccuuucucugcguaguccuugguuucccaucuuucucuggccugcauagaccuacucccccaauucuucaggucccagcccucaccugccccauuuccccagaucacccugggcagagcaaccaaggauaaccagauugauguggaccugucucuggaggguccggccuggaagauaucccggaaacaagguaucccccacccccugccccagcaggaagcagugugaggucgucccucccagccucucgcuguccuuucuagcccugggcuugguguccauggggacccucguggaccaccugaggcagggauuccuuggugucugcaggaagcagagcugguccauggaagcuccuggcucucucuggccuuuccccaucccaucaaucccuccccaucccaucaucccuucuuucuuucugcuuccacaggugucaucaagcugaagaacaacggugauuucuucauugccaaugagggucgacggcccaucuacaucgauggacggccggugcucuguggcuccaaauggcgccucagcaacaacucugugguggaggugagcuggggaggaggcaggaaggccaggaugagaccuaggcguggugagccaguacaccaacuugguccuggugccaccucugucuuaagccaccuuugucucccacccagaucgccagccugcgauucgucuuccuuaucaaccaggaccucauugcccucaucagggcugaggcugccaagaucacaccacagugaggagugguggcaggacucgugggcccucuccggccuguuuccccugccacuccagcccccuugagcugggaacucaggcuccuggaaaaaccugggcagugggaggcucagcugcgggccauugauuugagccuuugagggaggauagggcuggccuuugugaagccagcagaggcugagaaccucaggcuucccuagauccagagccccuccccaucuuccucucucuaaaaacaacccuaccccccauugccaccuucacuccugugucuccagcugauuagccucagacucuucuuuuauuguuuuucuuuuguaaauaaaaagcaccagguuccaaaguag

SEQ ID NO: 17943 - RNA, 1504 nt, Homo sapiens
cuauuucauauauagagcugugguuaagcuuggucugaaccaguccuuugccaugauguuccuaggagccagagcgcaggggcuuggguucugcauggagcagauccuuucacugagaaaguuugcucauucagguaugcaaggagcugcaccgcuuugagaagcugauggaguauuuccggaaugaggacagcaauauugacuucauggugaggaacugggccuggguccagcacauacccaccagggcuguguguguguuccuugacaacaggggugaggccaacagcguaucuugauauuccacguagagcccagaaugauucuauucagcaaaugcuucuuguccaccugccuaccccagagagcucuuagaaacuucaggauaucauuuguguauaucagaucuaccuccuuuuccucuuuucuguggccuuuuuguccuugaauuggauccuuuuugagcugcccucccuuuccuaagcucuuccucuagcuucucuuccccucacugcagggucuuuggcuagguaagguugucucgaggaauaccuguugauguacaaaggaaaucagauagcuauaucuucacuuacaucuguuuuucauguaauuuacuugucuuuauacacugaauauuaaaugacauuuuuaaaauuaaaauacucuuauugcccccauaaagacuuaacucuuuaauugacucccuguaauuauccacaugaugaugauauucuaacagccgccuauccuccuggucucuugccuuuccucugcccuuccuguugcugcuucucugggccuccucuucuucagguggccugcaugcaguucaucaacaucguggugcacucgguggaggacaugaacuuccggguccaccugcaguaugaguuuaccaagcuggggcuagaggaguuccugcaggugagcuggcugggguccuuguaaggugaggugcuuugggaucaguuuagccguaucacaaaugauuuuucuuuuauaagugccuaauccuugaugcuccugggacccugccugucuucuguagccugggacucaggaccucugcagcuaacuccccagucaggcagcuccaugggggcgagaaucugacauggccugcagcaggaacucuuugggaagugguggcgaagggggaugaggacuaagacuuucucagaaaguuccccugaugaucugccugcuccuacaacuacuccuacucucugcucuucccccagaagucaaggcacacagagagcgagaagcugcaggugcagauucaggcauaucuggacaacguguuugaugucggggguuuguuggaggaugcugagaccaagaauguagcccuggagaagguggaggaguuggaggagcaugugucccauguagguggucuuccuuugccugccagagccacuguugauggaagcucaaguaaccaggaauccugagcugacccauuugccuccagauugagucccagggaggcuuuaga

SEQ ID NO: 17944 - RNA, 2917 nt, Homo sapiens
ucccccuuauagaaacacuuucuccaggccgggccgggcuugguaaaccucagccgugccuggguagaggacgccgggcugggccgagcggggguggaaugagggcgucuagaacagagaaaacuaaguaggugcgcgcgggcccacaggcaugcgcguuugcuucuguggggcugggcgugcacguguaugugugguugugagcgucgguguuuguaauuugcuuuucugcauacguguuggguguaaauccaugggggaaaggcuugagugccucuuuggccuuaaaugcucccgccucucucuuccuucuccaggauggggucguccccccaguaaucuggaaaacaguuacagcaacaggcuccucucaucagacggcagugcuggucguuuccucacugguuugcggggaaggcugggcagaaaaaggaugcaaccuuguucucaaccacuugcuaucucggugaggaugaggaaaagcaaacagcccauccaggccccugcagagccucagagcuucaauaucauucccauuaguccuuaauuaaacaccuauuugcccuugccuaaauaccguauaacccucacagccugcauuguagugacugccccagaaauguagguucucaccuggguucugcagggaaauacgaaggaaucccuagguacagucuccgccuacuucauuaaaauuucuuuuguugcgaguauacaaaggaugcagcuuagaguaucauauuaguccaauaaaggaacauaaaaaguaaggcaaguuagggugcucagauuggcuaggauuaagaguucuuuucugaaggagguuuauuuaaauacggaauuugaagggcagagagagcuugaguaggguccaggcaggguaaaggccacaaggagauucagauaggaaagagcaaauuaucugcgugggaccgugagcagaucaccgugguacguugggaagugggagaaauuaauggaggagguuucuuauggaggagagcagaauaaggauauggaugugacaagacauaagauaaagaagucauuuuggguucuugagcauagagguaguuugaugaaaagagugcccaaggacagcuauuacuggaaccuaaaagaugucuugauggguacccccaccagcuuucucauuuuuuugcuuaaaaaauauuuuauucuuuucuuuucucugagauggagucucacucugucccagguuggacggagugcaguggcacaaucucugcucacugcaaccuccaccuccugauuucaggugauucuccugccucagccucccaaguagcugguauuauaagagugcaccaccacaccuggcuaauuuuuguauuuuuaguagagacggaggcuucaccauguuggccaggcuggucucgaacuccugaccucaggugauuugcccaccucggccucccaaagugcuaggauuauagaugugagccaccaugcccggcccuuaaauuauucuuaacgugcaauaaaaugcacacaucuuaggugcuuuguuuggugaauuucaaaauauacaccuauguaauuaacacccaaaacaagauacugaaccaccacccuauaaaguucccucaugccccuuuauaguugaucaccccacacccaccaccacccuccccuggcaacuuccugaauuauagcaccauagauuugucugcauuuguauuucacauauauggagcuuuacaguauguacuugugucuguauccuuuagcuuaguaauguuuuugagauccauccauguguaucaguaaucuguucuuuuuuauugcugaguauuauuccauugcaugaauauaucacaauguguuuauccauucuucaauugauggauauuuggguauuuccaguugggguuaugaugaauauggcugcuauuaacauucuggugcaaauauuuucauagacauguuuucauuucuccuuuucaccuuauuucuugaugauaguggcaucuucggaagccuacagcauugugaauucuuauucaaucaucuaacauugaauagggaucagugggcuaguucugggauuacaacaaaaaguagacaugguccuuuccucaaagggcuugaaaguccaauaaaacuccauguaccuguuguauuccuaauauugccuuguauuccuaauucugccuugagguagaaaaccuuaaaagucugccaggcauuucuaacuacuuuuggauguuuccaaauaacugaauuauuggaaguaaacagaacaucaagaugauaauuuacuuuccuuuuuuuuuuuuuuuuuuuugagacagagucuugcucugucacccagacuggaguguagcagcacaaucucggcucacugcaaggucugccuuccaagaggcaauucucuugccucuugcaauucucaagcaauucuccugccucacccucccaaguagcugagauuacaggcgugcgccaccacacccagcuaauuuuuguauuuuuaguagaaaugagguuucaccaaguuguccaggcuggucuugaacuccugaccucaagugaucugcccacuucagccucccaaagugcugggauuacaggugugagccucugugcccagccaauauuuuacuuuucauuuagauguuuacucuuguuuaauaaacagccagaacaucuguauuugucagagcaaguaccuggcucucuccuuccuuaaaggcuauugugcacuugauaauuucagcauucagauuuuggcagauucucuaugcuucacaaaccuucauccucacugacagggguugaaagaaguguagcuacuauugcuucaagaucccuuucagucuuuugauaaggcuuaaggcacuuucauuccuuagugcuauuauuugcauaaauuaaaaauuacacagaaguccca

SEQ ID NO: 17945 - RNA, 4698 nt, Homo sapiens
agaucgugguggaggaugugggaugacaaagaggagaggcaaugggccagagugucucaaggcacucugaggagagacagagguggaacgugaguaucagugauuuauuggguagcccccacucuaaacaccagcagccccacgcaugcauccucaccagaaauaaauaaggcggcauucaaugaaccagucugucuucuuccuaaggagcucuggggagggucugccucugcccaccuaggggcugggaucccuucagcucuugaggaaggguuggggaagguggggggugcaggcugcaggcccgcccuuuucuggccuggcccuugcagccugugagcuuggcacugcauucacaaucucugaggucugucccagagagaccuguccccagcagaccccagccccuggccccuaccccaggagucccaucauggguuccuucuccccucucuaacugugcagccagggugaccagcuccuccuccucagccaagaggaccgguugugcaaaaaggaagcuuguguuagguacuuuuucuucuuuucccccuuggcucaggggcugaggggcuggccccugccugacacuggucagcggguggucagcuccauggucuucuuccgcucuucccgcugcuccucccaguccucgucaggcucauacgugccuuugaugauggccacacgcucacucaggcucagggaguuggggaagagcagguagaaguaaaggauggcagccaggaccgcccccacgaugggcccuacccagaaaaccugguggagacagggcaggagucagggcgcugagccccagaccuugaagaccacaugccccccaccccacagaggacagacccacggacccugagaggagacagacaugcagacuuccagaccuucagggagaaagacuuccucccaccucggggacgaauauacugacacaccacucccagggacagagacauggaccacagacaccuagacccucaaagaaggcaaacagauucccagagggacaggcucccuccaaccacaccggaaagagaagcaaauaaaccuucagaggggacacguggguccucagagagacggaugaacagagcgcguguccccuccacgcagggauagaagcagacccuggagagagugaccaugagcuuccaaagggggggcagacagacuguccacagggacagacccacaggaagacucucccaacccccucaacagggacagauaaauaaaacaucagagaggaccagcacgcagacaccgagggggacggacaccaaauccucaagggaauugacacagagccccucugcaccuccagguucaguagagccucuuccauaagcggauagauacucagacucccuguccccagcgguucaggccauacaaagccaccucugccccucuagcugaaucccauccccuacugugucccuuucucugucagccaccacuccguggcccacccccaagcucuagacccacagaauccaggucuggugagcucugagcugccacugcugggucuccaggcccucaucuccagggagccaggggaagggacagacucacccagugagcggggcugaaccgauucaugaccaccgcagggccaaaagagcgggcuggguucauggagcagccagugaaguagaucuggauagagacagggcgguggagagaaaggcaacauccugguccacucccacagaaucuggacucucucaagguuacacugcaguccaggggcucagccaggucucaaacucaggcuggcaaccucucccuccaaggaucccagcugcuugguuaaccauggacccuuaacuacgcccuccucucuucucugcucugagguuggguuugauuccugucccaucccaccuccuacuuacucccaucuuuccucagcccagagguuuuggggggaucaauucuggggcccaguagggccagaguccaggagcccuaaauccaggccuuaaacucugcuggacucauccaucugaagugggcuccgcuccagggcuccauuauuugccuugagugccugccccacccucaccccagcccaaugucgguacugcucacuccgacaagguggcccagggugacagacaggccaauggacagggcuggggagcccacagggcuggugcggcgggagucaguggaggcgaagaugcagagugccagcuggaaggucagaaucagcuccaccaccauggccuggcccugcguuguguuguuguugagcugcaaggggauagcggguuaggaccccggccaccuucuggcuguauagccaggggcucggggaguagggcuuuuggccuccagggacacuuagagcaccuuggcaccuggaagccaaguccuguggacaucgccccagcgaagccauuuguuaaagacacuguacauuucauaguuugcacaggcuugaagcucaggccuguggccaaagggcagagcgucaggguagcuuuuccuggacacgggccuaucaauggcucugcccaacccccagcccccauaagcuggcauuuacccuccauccugugggcagcugcccgguuugccugccucacaccccaucccggccuccugcccgugccuggccccaugccagugccagccuuaaacccgucucuccagugcggcugacucacagcuugacaauggccaagcaaauccuccucuguguuugauuaaugaacccaguuugcaugggguugggggcugacucuggggcugcaggaggugggagggaggcaggggugcgggguugaggggaggagcacagguuggggaaagagggaaccaauacucaacagaaacugcucugcacuggccccacauuaggggguuccuaucuacgguuucuaaaugugagccccuugacaccugcuguggcagacacaaccauccccauggaggcgcugagaacaaugaagcacagacaggccagggucacccaaagccgugaugacagcccgcuuuucucuggugguucuacucaaccgcuccacugaggugaugggagaggugaggggcccaggaggaagguggagcucaaaggugagacaggaggaggcagaaguuucuggcaggagaggagggguagcaggcauuggagagagaccagggugggccagcaugaggggagggggagaggaggugggcaggaagggagcacauaucagccuggagaguugccuuccuggccuugggaggcucuugccuuccuggugaagggugugggcuggcccacucugcggcaccccuuuuuuccaggugggguaagaggccugguccugagcccaccccagggucgaggcucccaccccccccccagggcacucaccgcguugacggccagauugccccgggcauugagcggugccacaccguagaggaugccagccccggcaauggcgcccaccagcugggccgccacguagaagaaagcccggagcagcgagaucugguugcccaccaagagggccagggugauggcgggguugauguggccgccgcucacgggucccagggccugggccagcgugccuauggccaggccaaacgccagcgcgaucugcaggaugguaggcagcgccgacggccacuugagggccgagcccaggccaaagaagacgaagaugaggguggccaagaacucugcgaacacggccuugaggaaggccacggagcacaccuccuucuucaugguggccgcgggggcccggcggcagcugccgcggcggggggcgcccguugggucgcaggcggcggaggagguggaugcggcgggggcgggggccuggcugcggggcgccgcgcacugucccgcgcccacuccgaggcuggcggccuggcgcgggcccugcuggggcgcgcuauauagggggcgggcggccgggcgcggggccggcgcgggggggcagggggcggcuccuacgcucgggggccagcgcggcgcgcggguugggaggcuccaggccgcugcgggcccgccgcucuccgucguccagcgcaaccccggcgcgacccccgccccccggccggggcagccgccggcccguccgggccacgugacccaggcggcgguguagaccggcccagcgucccgggcccugcgcaugaugcgcccagguuggcucccgcgcucuccucggugccgugcgccccggacucccugggagacggggcucggucccggcgcuucacuccgaccucggggcgucuagcuccgccggccuuuaccgcgcuccgugcgcggccuuccccuuuucuucucuucgggcuuuugguccagcuccuccuuuuccuccugcgaccggagcauccugacccgccucacccccggcugggucggagugaugcucgucccgcaggucggcgccgcucaccucccucaccgccggcggcgggggcgggcggccgggcuggguccugcagggcgguccggccguccgacgugggccgcucccggccugggccgggcgagcuucugggcuuggaaggcuggcguuuugggaaaagugggcaccgugccagccugccccgacgcuucgcaauccucgacgcccgguagcugggcaguaccuggacuaggcaacggauccccggaggcgcccucucccaggccgggguuccccuugucgacgggac

SEQ ID NO: 17946 - RNA, 3995 nt, Homo sapiens
uacaguaacagcaacaauaaucaucauuuauugggguuguuuuucuagcauuuuaacuucugaaaguauuuuccgauuucuugauuucacagcagucccuggaggaggauuguguguccauuuuacagcuggagaagccgagauccagaaaggacccccaaguugugggcagaauaaaucuacagcagcuuuuaacuauuaaaccaacuuagauuuugguagucuuucagaggcacugaaucucaaaucuuaguuuccugggucccuccuggguuccuaccacccuuagggcuuauucaacagcuuucuggggauccuguaaugcugacagagagccuggagacggcuucuuugacccaggucaugagucaauggcuagaugggcacuuccccucugaggauuguuccugccugagagugggcuguggggugggagcuggggcaagcaccugggaggaggcuucccugggaaaggccugucuggcucaaaccucccuuccucuaucccaccucucuacgagccugagaaaauguucuucucugugucaguucuucucaagggugggggccucuccagagcauuuggaggauugaggaauaaagaccuauugggagaggccgggcacgguggcucacgccuguaaucccagcacuuugggaggccgaggugggcagaucgccucaggucaggaguuugagaccacccugaccaauaugaugaaaccccaucucuacuaaaaauacaaaaaauuagcugggcgugguggcaggcgccuguaaucccagcuacuugggaggcugaggcaggagaaucccuugaacccaggagguagagguugcagugagccgagaucaugccacugcacuccagccuggguaacagaucaagauucugucucaaaacaaacaaagaucuauugguagagcagucucuguccucaggaagcccccagucugaaggaggaaauauagcccccaaaaccacacccaaggucagagaaacacccccaggagcucagaggcugucccagggccugauuccuccagaaagccuguccucucuggaccaaggguuuccuggguggguaagaagcuggggcucccugaggucccuauagcucccaugucuaagcagaguggcugucugggcucccauuccuuucucccccaagacuugggcaucuggggucaggacuccuacgggguccagugggugagaggaugggagggcgauccuaaauccccugccuuccucugcucugucccaccgagagguggggaagcccuacagagagggaaugggacaaauucacucccagauucuaccuagaaacguaaugccagggauagggcuuguccccuccagcccaccuggucaggacaaaaggucaagccucccccucccgccacccccagggagaaccuccaggcagguccugcaaggcaggaagcccaagggcgcggccaggcguaggcuguuucacacacucuccaucuccacggcucccgaacccggcugggauuccuucuucaggggcuccgccccugccccugccccuguccccaccucuacggugccugugaggauagccagccgcugcgccagggucuuggugucggggaacaggacgaaguuguagaucagugaggccaggagggcucccaucaggggccccacccagaagaccugaggagaaggaugucgucaccccacccaggagcuaucaggaccacaggguggcucugggaccgcugccugcuuccccagugccgacuugaucucccaggucucccucaacugucuguaaggugcuaaauuugagaaccacgagucguguuucccaagcccacaagguaaggggaccuugccccuugcucucccugcccucccuggggcugagcccaggcucugcagccguggcuggggccuggggccagucuccucacccgcccccgccucuuuccucucacuucccccguuuuagccaggaguccuggcuauugcuguuucugucucugcuggugugugugucuauuucuguuugucuuuuucuuuauccaaguuugaaaauugguccagcuggagaaagugaauaaggaaacagccaggacuuaaaagucugggccaaggcugcagcuccugcccuggcccauuucuugccaguccacuggguauccugggcaacugaagccgaaaagaaaggaagucucagccaagacauucacccuggccuucugagcuuagggaagcugcaagugaaacccaccgucuacaggcaacucaggcucccuucccuccccagggcugccagcagaggggcucacccaguggacugugaacuucccaaugaugauggcagggccgaaggagcgggcuggauucauggagcagccagugaaguggaucuggggagcaagugcagggucagggugggagaagguuuaaggcaggccugagaggggaccauuucucaguccuggcucagagccuuagccccagccacggccucuguagugccauauccugggccuagagugcaggggguaccacuuuggcuccaaggcacgaggggcucagggagggacacugccuggccuucagggcuccacaguuuccccggggacggacccggugugugcaugugcacgguguccccucuguuccuuaccccaaugagguggcccagugccacagagaucccaaucaugguggccggggagccugaugucugacggcugucgguggaagcgaagacacagagcaccagcugcagggucagaagcagcuccacugccaccgccuggccaguugagacacuguuccggaccuggacagagggaguuacucuggaccagacgcgggcucugcccacggacagacagagaaaccccugccacugggccuggucuccucagcuggaggggggugacaccucacugccgcccagcuucaggacuucgggaggccugugcagagggguccauaucugcucuggacccuugcucccugcagaagugaguggugcuccucccaccccaccaguggguugguuggggccagugguucaggaggcuugcuugagaggagacuggcagcagguguggaaggaggagauuugggggaagaagguggaacacagaugguuacgaaauggagaaggggcgagugaggcaggccucgagguggagggaagaacuugggaacagucggagagcagaggacguggguggagccugggagaaaaaugaaguccccgugggguccccuucucuacccacaggccccgcacucccuuggccgcaucuacccuuaaacgccugguccuucuauuccuucuccuuuauguggccucuuccuucuccaccuguucuucgcgccacuaucccauuucuauucugccuagacugaggucaaagucucaguccucuggguccuggggcccagcccgggaggauguggagccugcagcugacuuguuuccuccuuugcucccucgccuccguccuggccuccaccuucaccacuugugcgcauucccgccuccuggcccuccaggugccccucccugcaccuaccacguugaucccaagggucucucggaugucucccggcaugaccccauaaagcagagcagcccccaccguggcccccaccagcugggcagccacauaggccacagcacggggcagagagaugugggagccuacgaggaaggccagcgucacggcgggguuggcgugggccccgcuggccuuccaggugaccugcacagccauggcggugaccagguugaaggugauggcaaucuguagcacggagggaagugcugugggccagcgcaugacugagcccacgccaaagaacacauacagccccguggccaggaacucugcaaacagcgcccugcugauggcuuuccaaagccugcacgccaacaugcuggcccagccacgucccccuggcuccacugcauccauguccuggugccuuggcc

SEQ ID NO: 17947 - RNA, 3440 nt, Homo sapiens
ugacugacacguggagccucuucaaauggcugcaauugcuucagucaccugggauguuacugagggagcagcggggguggagggaaggugaugaggugagguggaggcaggcgaggacugauugaggccaaggagcagccucaggaggagucugggggaagacagaagguaugaaucaggagaaucagcuuccagaccuggcccugccauucauuagcauaggcaggccccuugaccucucuggaccucgguuuccucaucuguaaggcagagauaauauuuauuucacaggauuuuucgaggauuacaugagcuaacgcauggaaagugcuuaguacauuggcauguaccuaguaaaucccaauaaguaaauaacuauuauuaguauuagcauuuggaucuagugguaaaaccaccagugcagccaaaccagggcagaaucuaaggcacugguucuuaacccaggcugcacauucgaaucaccuggggagcuuuuaaaacugcaaugccagcugggcgcgguggcucacuccuguaaucccagcacuuugggaggcagaggaggguggaucgccugaggucaggaguuugagaccaaccuggccaacauggugaaacccaucucuacuaaaaauacaaaaaguagcugggcgugguggcgggcaccuguaaucccagcuacucgagaggcugaggcaggagaaucauuugaaccugggaggcggagguugcagugagccgagauugugcuauugcacucuagccggggagacaagagcgaaacuccauuucaaaaaauaaaaauaauaagauaaaacugcaaugccagccaggcgugguggcucacgccugcaaucccagcacuuugggaggccgaggugaguggaucaccugaggucaggagaccaaccuggccaacauggugaaacccugccuccacagaaaauacaaaaauuagccaggcgugguggcacgcaccuguaaucccagcuacucaggaggcugaggcagaagugcuugaacccgggagacagagguugcagugaucggagaucgugccacugcacucuagccugggcaacagagcgagacucugucucagaaaaaaaaaaaaaaaacugcaaugccauggcuccacuuuagaccaguuaaaucagaaucucuggggcuguggcgcgaucuuggcucacugcaagcucagucuccuggguucacgccauucuccugccucagccucccaaguagcugggacuacaggcacccgccacuacaccuggcaaaguuuuuuguauuuuuaguagagacgggguuucaccguguuagccaggauggucucaaucuccugaccuugugauccacccgucucagccucccaaagugcugggauuauaggcgugagccaccauacccggccuuuuuuuuuuuuuuuuuuuuuaaguuggggucucacccugucgcccaggcuggagugcaauggcacaaucucggcucacugcaaccuccgccuccccgguucaagagguucuucugccucagccucccgaguagcugggauuacaggcgcacaccacgacgcccggcuaauuuuuuguaucuuuuguagagcuggggguuucaccauguaggcuugaacucccgaccucaggugauccacccaccuuggccucccaaagugcugggauuacaggcaugagccacugcgcccggacaaucgcccaacuuuuugaggccuuuaacauauagccaaucuugagcaaccuugcucuucagaacuuaugggucugaauuaugguuucauagugucacaggccccagucuuaggaaguucuuucuuauauacaaccuaaaucccucaugcuguuguuucuucuucguuugagaagugauggguccuugcacacacacauccccucaucccuacccuguacaucgcagcaaaccuucaccgaggguuuuccuggaucaagccccaagauuggcccuguggacauggugaggauuggcagaguccuugccucaaaauaucccaguguggaaagagagacaaacauguugacuugugacucuagugcaagggccaggagugaaauagaaggcugagccagggcugccagcagagagaggcaggggggcagucacucugacagggguuugugggacaaggaugaggaaaagaggaaguugguguuggcagggccuuaguaagauaacacuugagggauccaagggcugugauuagugucucauuacuucuuucugcuucucuggcccacccaccccuuguccaaguccugacagaggauacuggcuccuucagcauccucccagcuucuucuccaugcuucguuuucucuggacccugcaguccuuagaccucaguacccuuuauccccaccacggacugagagggaaacaggccugaagauauuucuccuucugcuggcaggaggcaucuagccagggcccacuuaggacuuuggccuugugcucaccuagguucaaaucucagcucugucacaccagugcuguguggcccugggcaaguaaccuagccugagucucacuuuucuccagaaaccauaaaacccagcuaaugcccaugcuguugaaacaaugugugucuagcaaacaguaggggguguuccaucaauaguggcaagcauuaugaucaucccugaaaggcugaugggggcaaauuccccauggaugcuucccuugcagauggccccaucugcuuuaggugcagaagcgcccuccagccucucagagaugggugaagagggaggguaaagagggggacaagacccccugggauuuccaggcagcucuucuccgcucccccgugcaugaaaucacacgcgccccaaucugucugcauccacuucaucugccggcucagcaaaugcagagacaauuaaggaguuaauuagcacgcacugggaaggggcuggggaccuaaggcugaugggacccagcaacacagccuccccacccuccauacucaacguuguccccccaccaccugccaacccauaacccucaucuuuuccacugcuuucucuuuuuacuaguccaaacacuccucuuaccccacucccacacuuaccugcuauccucacccuuucucccccaccuuaugcuauccugucucuuuucucucauuccucucucuaaucucuucucuccuccuccacucagcuuuucucccuuuucccacucaagucucugucuucuccauccuucuaggacucacccuuuccuccuccccacuuccuccuucuaaucuagcccccucuucacuccccaucucuucucccucuccuauucaucaccuuucccucuccaacuugaauaugggucucaacaaaugugccuguccacugguucaugaacauggggcucuguaucugcuacaggaguccauggguuccagguugccu

SEQ ID NO: 17948 - RNA, 26260 nt, Homo sapiens
acacacagagucauacacacaagccauagggccucgcaggcagggagacggcuccgggacuggagagaggcagcgccgccgaaagcggccgcgaggaggggcgaggcggcgcggggagcccugggucccgcucccggauccggggccccgcgcgcacaccagcccagagacagccucgcagacacucguaggcgcgcacgcgcacccucuccccucccccuccccucccgccgccucccggccggacgauggaucccugcagaucccagggcugagagcaccgcgcaccgcgccgagcccgggcagaccgagccgaggcgagcgagccagcgagccagcgcgcgcgggcgggcggacagaucggagccgagcggggccgggcggggcgcucccugcagggcucugcgcggcgugccgcggcggccgcgggcuccggccccgggccaugagccccuccgcgacucggcgcugagcccgccaccgguccagcgccccaggacccgccgccggcugccggcuugccgaagcccccucagguggguuuccgauaccccugccuuuggccgcgaggcuccucgguaccccgaagccgggacucuccucccucuggauuucccuugcugcuggggcggcucgguggcuggggaggggggcgggggccgagcuggggaucugacugcgacgagaagcuggacuggggggggcugcguccggggcggggacagcucgcugucauagggaaccgcgcccccccuccauacauccaccucgggcagcccgccaccccccacucccaacauacacacagccugcgcuuaugugagaacuggagacacccgcaggugaggacucaggcugggccccucccuagauguagccaccucccuggggguuuucuggccccaguuuagcccuuaggaccacagccccguccagggaauacccgugaccaggacaggagcuccuuaccccggggucagcccaucugggugaguuuucaucuccaggaugggguggauauucuugucccagagugaccccacaucuggagggaacuccugcgccugccuaugggugcaucaggacuucccccucaaccucggaugacuauaucuggggucuccccgggccugggaagcuucucuggggagcauucucuuggccugaccugacccccugugccucuguauuuggaggaacccuggaugugucccuuggucagccaccucugggcuugcaaagcagggaagucuucugcccgaggaguggugaccucuggagaugaggauucuggaugggcacauguggaggggcuccauguguacuuucaucccaggacaaugauagacugucccucccuccucccccaggauccccucaacaaggauggaacugaaggccgaggaggaggagguggguggcguccagccggugagcauccaggccuucgccagcagcuccacacugcacggccuggcccacaucuucuccuacgagcggcugucucugaagcgggcacugugggcccugugcuuccugggcucccuggcugugcugcugugugugugcacggagcgugugcaguacuacuuccacuaccaccaugucaccaagcucgacgagguggcugccucucagcuuaccuucccugcugucacgcugugcaaccucaacgaguuccgcuuuagccaagucuccaagaaugaccuguaucaugcuggggagcugcuggcccugcucaacaacagguggguggcucccacccucccucagcccugcuccuggaguugcuugaguuccagucaggaugucugccucccugacccaccauagagcccagccaacccugcccuuuaacccacccccacccccaaaccugccacucacagcagaggaguuagggugcugcugagcacccaguuaagggcacccagccuccgaucccagcauaguccagaacagcucgacccccacccagccugagguaugagacauugucacccucucuggagugagcuuuaccuucauucuggccacucugucuugaccuucucgucaguugggggauggggacagaacaucuuuaaaggguagaaacuacaguauaaaagccacagccccugccuugucucucugcccaccuuauccaugcuuccucucacccaugugcugggaugggaugcccugccccugggcagccacuacaguuccuccugucauuucagacccaugugguagagccucugcaugcccagcucuccuuccuugccuacaccugggacugauccccagggcuggaggcugcccccaucacccaaguugggugcaggacacugaugacuguacugacccgugugucacucacccccggaccccagguaugagauaccagacacacagauggcagaugaaaagcagcuggagauacugcaggacaaagccaacuuccgcagcuucaaacccaaacccuucaacaugcgugaguucuacgaccgagcugggcacgacauucgagacaugcugcucuccugccacuuccggggggaggucugcagcgcugaagacuucaagguggugaguccccucguguggggugugagucagccuggcccacagaggaggaggaggagacaaggagcaggcugggccucuccgggugcuugcuacucugggagaggaaguuguauguccugggguuugcuucuaguagaaggggaguuuguucagcauaggggcacauuugcacucacugcaugagcaccugagccucagccuugcagccaugauggcaggaaagagagccuacagugcacaacacacacauauaugcacacacgugcguggucuggcauagccacaaacccaccaagcuuaccuucuaggccacaggugucagagcugagcagacagguggguaagcuacagccguguuacuuguagugagguccaggaccaucaacugggagcuugaaaggaaugcaggacuuugccaccccacuucccaaaccuacugaaccagaaucuccaucuaauaagauccucaggugacuggaguauacacuaaaguuugagaagcaccgugaagcacaaguaagggaaaccuucucuuaaauagccagacaguaacucccugugugccauccgcaccccauacauagacacauacacuguuugguuagguuuccugcuugccggcaagagccgcagagccaggaucugaggaaaggaaggccaucgggacacccagucauggcugcccuggaggcuuccuuugcaucuuaaaauggagaugccccacagauguggcugccucaggccagcaccucagggagggcauagggaaacugauuuuggcaucugaugugcugggcaacccugggcaagucacacagauuccugaggguuaagaccuggacccagauggcaaagagaccagaggcuccagagccaugcaggaacaauaacaccaaaugaauggacaaugcuuguaacucuuucaaaugcuuucuaggcuccccucaauccccuugauacauaaucacauuaccucuguuuuacaaaugcacgaaacugagacacaggcagaaugauuuacccaagcucacacaguuagugacaggugacagguucaggauuagaacucaugucuuguuaagcugaaaauguccuuuacucuuuuaauuaauauuguggacccugggguuauuguguccacuucaaauucuugccagucuuuuccaggacccuuugcucuccaugccuacucagcucuuggauucucuuccuucuuccugccuauuuucuccccgcuugcuugcuuccuccugcaguaugggaauaugaacuguauuugugcagaaaggauggcaccauagucaugcuuaguguuucuagcugugcaagaccucccaauauccuuaagccuugcucugcagaccaguuucacuggccuuugucaauccugcuggacaaaguucacaugacugcacucuuugcugagccaagcugauggggagcuuagccaagaugcaagaaccacuuccuucccucucuuacugcuucauaacaggagaguccuggauuccccagagcuugagaccagaggguuugcagucucacaagugaugcucccaagaguaacaggacuguaggugaagguggaagcaaaagccagagccgccucccuccaacacacccaacacacaagcaggagggacccgugagaaagauggagaaaacguauuuguuugagugguuuguaguguuggaugagggagagaagugcuuggcucaaucugaggaggugcuaagauauaaauuugggcacaguuaguccauagaaaguauucaguugaggcuccaucuguccaucauguccagaaagauuccaaguggugaugcuaagauaacauuugguugaugguaauggagacacugagaugugauugguccaugcugucugaggggaccauucuaaguagucagauggagaugugauuggcucacaaaguucuggagcagucugaauuauuccucuuacucagggguaaagacacacaggcuagcacccugcagccccagcugugccccuucuugcuucuggguugucagggaagaccagguuuuugcuguuuugcagcccaugucaaagaccugacccugaauuuugcuggacucaaaccucucacuccucccucugcucucuucaguugguuucauugccagccccucuccaugucaagagcucuacccauagggauguucccacacagaugggcgucuggcuggaguccaugucugacaccuccccgguggagaagggccuggcagucucucuccuccagcuccccaguccuaagggcucccacacuccuugccugauacuccaugcucucccuucucuccucagucuugugauuaacauccuugccauucucugcuaggccaagagguguguugggagugugucucuagcccugggcagauguagcacugacaggaaacaccugucuauagggucgaucuaagggagaccaucuuggcaucuucugcagccuucagagcagagguucuucacugaggaaagaagguagucagggaagagaggcuuugugguuagggcuuugcuugcucuuucaguagcucaggaagaagcugcugggccccauccaacaggauugcugugggauaccaccccccacuguccaagaccuugcucaaugcuuuugcaaaguauagcgugcgggggcacguguggacucuuuuguagauuucuaagggcaacccucuucucaacaauaagaacccuguuucucaaggcugguugggggaggcauaagaagacaauucagggaggcuacucuggucacucaaagaccccagcuccccugaugaggaucugcaguaacaggcauuucuccagaugugcuccuggaucuagcucaaccccagggaauaguugguggucacaaagcauuuggccaggguccaucccccagguguggcugagucagcuugggagggugggggugaauauggggagccugagcugaaucugggagagacugguuuggaaauccuucgggacugaagagggagaagggcagggcagggaguauccccacagcaaccuggcugggaagguuucaauagcugccuccugagcaaccacagugacccaaccacaaggcccccucuucccggccaccuccuuuucuuccugguaggguguguuguugccaagacaaugggguccauggcuccucucuccugccccaccuugaggccagccaggccaaggcagggcagggauuccauggaggggggcuggggugcagcugucugcuggugucugggugggggccagagaagugagcacagucgcagcuggugccauccuccagcugcaccuuaucugucccuggcagugggagcagcugauguggccagaaugcugagcagcagcaaggggagggggcuggcagauggucacccagucugcccuaugccacccccuccuccgcugagaccuagacccuuugccuagcggagagagaagcaggaauucauuucuggggccuggaagagaaggaagaggaggacagaguggaaaugcugggguggacauguggugugacucauaaucucucucaggagggugaaauugggggacaggaaucccugggagggguccacaggaguccuucucaggacccuggauuggagaccagaaucucccagggaagagguggagugaauggggaugagcacagaagccuccccugcaauccacugcuagguucugaaggggcccgggcauccccuggagcaccuagggaaguaagaugcugcaaugagagguggcugugggcgccugauccugggacccaaaguggggagagagaagucaucuuaaagcaggagagccagggauggcagugcccagcaagagccaggacuagcauggaguuuauucaucccuagggcucaccccucauccccacaccccaugcugccccauagaagcucagaccagaagucccuugggagggccugaccuuacuacuggggucugcacccuccagcuaggcagggaguggaggggcugcugaagggaaaggcugcccagacugccaugcagacaggggaaggggaaucuugggcagccccacccagaggccugguggucuucaugggugggaagggggaacaugcacagauugcagagggauagaagaggccgaccuggagacaguaacuuuagaggagggguucaugggguucaugaacuuugggggaaggguuccugcccuagggguucauggcuaccaccuccugccuuauccuucucaucugucccucucuccuaggaagugccuaaacugaacacagguggguggagagaggagaugggagcagagcccauugcaguugcaggaauccaguggguggucccuggguuggggucucagaugucuccuuuugccucucucucagacacagauacacacaaacauccuucagguagcccaauuuccucucucaccucuuccccuucuccccagaccccagccauuucugacuccaucccucucucagacagcuaucagcuaagaacuacucuaagcuaauugaccugggggcuguuggcuaaagcaauagggaauucaguaacuaagugccucugggggccaagccuggaaguggagggcuggggaggagcaccucuaagucuugggacuuugucacugcccagcugguggagaacuccuggauauggccacugcaugcccaguguguccuggaggcagaagggcaggcccacagagaggcuuggaauguucugcuguggauggagguugcuucugaguguguuucaguuuuguggaaaguaauuucaauucucuggggauagcgagggagacagaauauucagaaugagaagcugggauuaggggagcguuaagcuccacuggauucauucccauagcagacagugccacuuccaugugccagguccugcgcuggggcaguuaagugcagcacggaagguucagggcugagagccaugggggugguacuaaagggggcccaguggggugggcuucagaacaagggggaacaugcuggggaugagcagacucucaacauccagggggaguccucccaaucuccccagccaaacucagccucucggaaaaugccagguucauagaauauguuggugucuccccagcuaacuaaaucaaccggccaauucucuccggccauucuuccgccuuggccaaccccugcccacccccacccccaagcuuucccucacuuguauguuugggguggccaaugcagaagccucuaccuucugaccuauaacgucccagucaggacccuuaggugugcauucugggaggcaaagcuggaaggagacagcgagaaugagaaggggugccuagcuggguggaggauaggacugggcauuagggcuccuggucucuauuuugggcaaaguuccaccuggccccacuucuuagcuucuaagcccaaucuccuguaaggagguuguaaaauuauucuuuauugaggggcaguccuuccucugggacucuuuggccaagcccacggugccccauguguaauggaugugcagcgccaaccuaccuggacacaggaauuggacaucuuccucauagaauauuuaaaaaugaucaugaagcugcuguguauucacuugaaagggaaguucccuuaaggaacuguaaggacagacacugccaccccaggcucuccaaggccacucuccagggagagggagggucaauugugaucuuucugagaucccaugaguucuuggauagaaaaugcuuucccacccuucugcaugcccucuguguggcugacaguucugggggcccaggagguugggcugugcagcuuagugccaugugucucuaguuggugucacaccagcaugccaggcugagaacaucccugggggugagacuguggcaguggccuuggccauggacagcagccaucucagacuuccucacaacacccucaucacauaugcgccccgagcaugcaagcacacaugugcaccucugugugugucugcaggggagugugaauguagagugugaaguggaagcauguggagguguaugggggcccaugcagcuugguguguguggcugugagagaaagcuucuguguaggcaaaccucugguugcaugcagagcacauacuagcaaaauuaaucaucucuuucaguugugcuuugcaauuuacaaauucccuuuacuuuagcucacgugaucuucauaauucuuguaggaaggaaauuauuaacaucuucauuggaaagaugggaaaacugaggcucagaggaguugugugacuugccugaggucacacagcugggaaaugacagagugggacccugacuucagaucuucuaaguccggguucuuuguguguggcuguaggaguguguauggaggagggugcucuguugagaagcaguguggagaggcaggaagggcaagaaaggguauagagaagagacccuaggaaucccguucccaaguugaguaggccuaguuuuuugaugcuuuugucuuuucauugcaucaucaggccaagugccaaucuuaggugaacccaccacuggcuuuccccagggucacaccagggcagucaggaccucccugaggaagucacauaccagggcagcuuaguaucacauugcguucaugcucaacauccuuaaaugggcgugcagugcugccuggcaaccccacuguguuuuccuggucagcuugcucucucugaugacuacuucgaacuucuccacucuucucagucacccuuccuagcuccucucucacccucagcggaugaccuuggcuaccacuuacuucacugagaaaauagaagccucagacaagaucuuguccuucuucuggguaccaagcccuagaagggaacauucaucuuaucuaggauaaagucucaaccuagaauuuucaucuuauucccucugccuuuuuaagaucuuucuccugcuaauucugucucucccugcucuacaguuggucgcucuuucucaagugaaaccccauugacaaugaaacaugcugaagaugcucuugucuuaaaauacauagcuguaacgacagcuaacauauauugagaacuugcuauguaucggucuuugugcuaagauaaaaacuaaaacaugugucucucaacuccacagcaccugccagcuccuauaguaucucucugcuucccuuuacaaaguuccuaaaagugauauguuuauuucacuguuucuauuuccucaucucuaacucacuuucugauccacuccaggcugccuucuucccccaucaucaccauuccuccuaaaugguucuagcuaaggccaguggucaccuucauguugccgaauccagcaaauauuuuuuuuauuauucuugaucucucaauagcauuuaaaauaguugcccaccaacucuucugcuguuguuuuuuuuuuuuuuuugagacggaguuuugcucuuguugcucaggcuggagugcaguggcaccaucucagcucacugcaaccuccgccuccuggguucaagcaauucuccugccucagccuccugaguagcuggauuacagaugcgugccaccaugcgcggcuauuuuuuuguuguuguuguauuuuucguagagacggguuuucuccauguuggucaggcuggucuugagcucccgaccucaggugauccgccugucucggccucccggagugcugggauuacaggcgugagccacugcgcccggaccccaccaccucuuuuuugaacuauucgcuuuccugacaaucauacucucuuuguuuuccuccuaugucuacccacuccucugucucuuugccaguucauuuucuucuacuuggccauuuagugucaucacuacucaaggcucagucucaagcuuuaaucuucuuuuaaaucauaagaguacaaugcaccagcuugaaaaauuuuuacacugguaugucuuacaguguaguauuuugcauauugcauugguauaaaacauuuccaguaccccagaaaguuccuucaggcuguuuccuagucaaugcuaccccauaagaguuaaccacuguucuaacaguauagaucaauuucccucauucuugaacuucuuggaguauauguauccuccauacaguguauacucuuuugugucuguuuguuuuguuuuguuuugcuugugauuacgucugugagauuuagccauguuguuguguguggaagugguuaguucuuuuuugaugcuguauaguaucucauuauaugaauaugccacaauugauccauucuacugaugcuagacauuuggguuguuacuaguuuuuggcucuuaucuauaaagcuacuaugaacauuuuuguucauguuuuuugguugauauaugcacucauuucuccugggcacaugacuagcuauggagcuaugguuaagucauaggguaugauucuguuuagcuuuaguggauacugccaaaucagaccuuuuuuucuaucuuuuuuuuaaacuuuauauucuauucuugggcagucucaucuucacucaucacuucaauuaccaucuacacacugacaacugccaaauuuaugucucagcccagcucucuccucuuagcaucagcuccagucgccaauuuucccacuuaacgucucuacuuggaugucccuaagacuccucaaaaccugcaugugcaaaaccaaagucaucaucuuaccucccaaacuaguucuuuaccugugugccugaucuagugagccacccacuguucaccccgucaugcaaaccagaaaucaucccugacacuccaucucccucaccugccuugacaggaucugccaauuuugccucauaaacaucuccacucuacccccuguuccggcccaucccaccacugcaugucucuuugggccacggcaauggcuccucgacaggccuuccagcagcccuucuauauccuucacucugcagccagaguggucuuuucaaaucaaagcucugaucacuugaacgccuuccauggggagucuuucauugucccucagccagaauccucaccguggccuuuaaggcccugagugaccuggguccucccugccuuuacccaccucuccagccacacuugccccuucucaucucucuccuuccaggccuuugcauacacucaguucucucucuggaauauccucccuccuccacagcgguaagcgcuagugcgcacgugcacacacacaaauauauacacacacacaccauuaccuaauuacuccucuuuauuuauuuuuuauuuuauuuauuuauuuauuuauuuauuuauuuauuuauuauuuaauuuauuuuuuugagacagaaucucguucuauugccugggcuggagugcaguggugcaaucuuagcucacugcaacuuccacauccuugguucaagcaagucucaugccucagccucccaaguagcugagauuacagucaugugucaccaugccuggcuaauuuuuguauuuuuaguagauaagggguuucaccaugguggccaggcuggucuugaacuccuggccucaagugauccgcccauuucagccucccaaagugcugggauuacaggcauaagccaccgcgcccagccuccucuuuauucuuuagacuguaauucaaacaucauuuccucagagaaagcuuccuuaauuccccagucuggggcaagucccucugucauucacucugauagagucauuuuuuuuuuucauagcacuuaugguuugcaauuagauauuuguuuuuuucauuuuugaauugaggucugucuucccuguucgacaguaagcuccaugagggcagguccaugauguguucuccacugugucaaugaguaaaugcaagaaugaagaagcaagggauuuggagacagaugaccucauuccagccuccagcccacuucuugcucucccuaagacuugaauaggcugguguggcucaguuuucucacuugucagaugggaaugaaguuacucaaaccugcuuauuucacuggguugugugaggaucccaugagauaacaauugaaaaccaugaagcauuacacagacaugagggguggcuggaaugaagaaagggauauagaaaaagucagaaaccacucagcacacacugcuaaagagaaggucuggguggggggcgcuguaugcuuggacagaggguucaggacugagugcagcucugugugugugucugcuugggcaccucuccaggggcccucuguguaugcccuuugacacuuuccucaucccccaauuacuugaacaagaugaagaugggaaagaauguuagaagaauaagcauuuguuugaacaagcauacaggcgauggaggagagaggacaugcaguuggguguguguguguguuggggugugugcguguugggguguguguguguuggggcguguguguguguguuggggugugugugucgccccacaccagggcugcgugucugugugguaaugugcaagugugcaguguggucuugguugcugugggggaagagguauucaguugcacccaacuuacuguccuuuggcacugucugugcgugcacacccuugucuuugcuggggcucccaagcuggaagcucccgcugccuuagcugcuuccuucuggaaaucaaucuacuuccccuuccaaaacaucugaaggagggggacagugcccucuagugggaacgcaugggcagcugcagcuuccucagcccaagccucagccccacuccacccaagucuggaaguccucucugaagcacuuccuggggaaugcaaaggaggaggccccugcccucugagagcucaagaucuggcaggcaggaaaaagauacacacaggacaggacacacagguucaugcaggagaagccugaggacagcagcugaaggugggggagucucuccucaucucugcaaugacuuaucucugguugcccuggguguuccuggccuuccuugcuuccuguuccugcacauggucucuugguccugcucuuuugcucucggucauuacucauagcuguagggccuugagcagaacuggacccuuuagucuauucccugggugggcacuaacagcacccuguggagucgggaggauucuuggaggagguaacaugugaguaggaucuugaaaaaugaguaggaauucuccagauggaguccagggaaggcacaggacuguggaugagccucgugugucuggggacagguggugguggcuggaugcuggccugagguggaggguacauugcuuucagcuuuuuuuuuuuuuuuuuugagacggagucuugcucugucccccaggcuggagugcaguggcucagucucggcucacugcaagcuccaccuccuggguucacaccauucuccugccucagccucccgaguagcugggaccacaggcgccugccagcacaccuggcuaaauuuuuuugguuuuuuuuuuuuguauuuuuaguagagacaggguuucacuguguuagccaggauggucucgaucuccugaccucuugaucuguccaccucgaccucccaaagugcugggauuacaggcgugagccaccacgccuggcugcuuucagcuuuguggggcuacaagagaggacuaaauuuugccaggaggcaguggggagugagagaaggucuuuacuuuuuugagauggagccuuguucugucgcccaggcuggagugcaguggugcgaucucggcucacugcaaccuccgccucccggguucaagcgauucuucugccucaaccucccaagcagcuggaacuacaggugcgugccaccauaccuggcuagagaaggucuuuaagcagaagaauggucagagucacacaacucgaacuaaagguggggagaaacugcagggaggcagggagaccaguugagaggcuguuguuuaggcaaaagaggagggcaguggcagaaagaggaggacaguggcuguuguuuaggccagucugagggcaguggcagaaggauggagaggggcuagagcucaagacucugcuucugaggccucuuugucccuggcagcaaagcugaggccaaagguuccacaucacucaguucugcuagaaccugacacccugccucacauccccaacacacucuagggucucugcaaauggagaagggaagauggugggagcagggagggagaagagaggaggaggaaggggaacauggccuggggcuaggggaugcuuaaggaauggggaggcccaagcagacccaccuagccccggucuagccccacugcuccuccucuggcccugcagagaaagcauuaaucugcuauaccucccucccccgcuuccccuccuccccucgggucaccuucuuggcccuggagacuuggcugauggcucaaguuccucaaccaguggcccugaguaaucagaacacacagaggggccaggggccugggggcagggaaugguaaauuagcgguaggggagccucagagacugaggccgggagucugcaaggcugaggguuuuggugggaaccccaaguugguucccaauacucucuaccugacccaggucccccugccccacccccagcacugaucucaauuucuuccacccaccagagaauuccucgaacaaacuaaacuguucggggggcggggggcaggccaaaaaggguaguggugaucugccaggaagcuuucccacugcaggagacagggucccucccccuagugccgggaacuggucagaaaugagucuguggucagugagagacugcugcuaauggaaccugggcuggcccacaagccacaggagggguaggggagaggaaaggaaccaaaauacaucucagcauagguggguaggacgagggcugguaaugcuguccugaaauagagcuggggccagggagggaggggaagagaaacagggucggggacuggaauuggaggucugagagaguaccuggugguggggcacggaggggcucagguaucccagaggaauaacuggacgagggagaauaagggagaggacccagaauugggauggggacacugagggauaugcugaggaacagauuggaggaugacagagagcaugaguguguguuguguguguccuggggggguagggacuguggucgcugugaucaucauggcagugggugcaaaggauggugcuaggucccgucucaccugggagggguggguuccaggaaucccagcccuaggcuuuuccaggguuuccacucuguccuaaacccucucugugcugccggagcuggugacaggaaaggggcuccagcccccugcucuccaucagccucccuuucccacugccaucaauuauucaucagcccagacacccgcccucccuggcagggcaggcugguccuccucccaugccccgccccagccacacugccacagaggcccuggugaggaaggacggccagcugggcugagauaccuggcugacgggcuggguggcuggcucugccggacucugccuggagucacaucgccuuccccucuggcaccuucccccuuccuccugcaaaucccuggcaccaggaagccccuggagaaaaugcccauccagaucuucugcuccaugucauucuccucuggagaggaagccccagggcccuugggagauauuugggguccccaccaccaucagcagcagcaggacaucucagaaucggaagaggaggaagaagagaaggaaaaggaggcagugaggaaggaggccagugaggggcauucacccauggacuugguggccuuugccaacagcugcacccuccauggcaccaaccacauuuuuguggagggggguccagggccaaggcaggugcugugggcgguggccuuuguccuggcacugggugccuuccugugccagguaggggaccgcguugcuuauuaccucagcuacccacacgugacccuucuaaacgaaguggccaccacggagcuggccuucccggcagucacccucugcaacacuaaugcugugcggcugucccagcucagcuacccugacuugcuuuauuuggcccccaugcugggacuggaugaaagugaugaccccggggugccccucgcuccaccgggcccugaggccuucucuggggagcccuuuaaccugcaccgcuucuacaaucgcuccugccaccggcuggaggacaugcugcucuauugcuccuaccaagggggacccugcggcccucacaacuucucaguggugaguggagccccaugccugccacaguaccccaagagugucugccauggcugucccugacugucaccuccugggguuggggcuggggcuggggcuggggcugaugacugugcugcccccuaccucaucuggcugacacaggccagagcucacccaggaguccggggccuggagcugggcugguauucccagguccacaccagugcugcuuuuccuguuagaaucuugaaacacgucugucuuaguugguauuuugcugcugccucccaacauguccuccagcuuuaccugcccuucucaagacuuccucaugguccagcagggcccgggaccuugcuccaucugugaggucaaccuuugaucuguugguggacgccagugccuggccaguuguucacuauuuugacuagcacccauggacugaagcuggggugggugcugccuggucucuggugguacaagagaagggagugaaagggugacaguagagggguggggauaucccccaaccccaccccaccauggcccuugucagcaucuccugcagcagggacuucauugcaucuucacuuggucuuccugugcccuccuauggacgccccacccccaccagcucugugugugugugugugugugugugugugugugugugugugugugugucugaggguaaauaacaggucucuaaaucauaucccucuccccagcuuuaaguggccagggacccucuuccuaggggaagcucucacugggaacuguccuucugcuuggccccccacccagggguccagggcuuucccugcuggggggccaccugguaccccacugucucuccuaaguucaucuuccaggucugucuggccugacugcucuccugccccaccagcucccagaugccaggccuucccugccccacacacccaucccucaguccuccacccccucccuagcguaggggcagggggugucaucauacccgugcaucaugggaugacugcaggcauacaggggccuggggguuugggccacugggccucaggccaggagccauaggaaugugucuaccucugggcccgagaguagagcagacaguucucacccaggcccaccagguggcagcagcaauccacuguacagcagcccuguccucugaaccggcgcaagacagggcugcuagccggccucagacaccucuaaucccauacaacuccggauggaguguaggcaugggcauauguccagccuggagccuguggcugggugccgcaagaccuggucauggggcuggggacuaggagcccuuggaguucucucuuugccucaucucuggaccucacccacaaaguggggagagcaguaugucuccucuucuggaggucaauggaggaggcuguucuaggaagggggaagggggcaaagaccguauucccuaguaaccuacugccauugcugcuccagucuggccugaaacucuuuugucucuccccugcucugggcuguauugacucaccuuaugaccuguuuuguggacuuugucaccauccagcaguaguaaaagcacagccaccccaacuuggggacauucaaggaggcuguggggaaaaggccaaggauaacugguuuacuuuucucuuugcagcuuuuuaaucagcacugugaccagggcugcacuggggcauggaguggggagaagacuggggagacagccccuggggcugagauaucuucugaggcccuccuaguuuugcaaaagcauuaacgcacacaccaugcccugggggcucagucccaagugcuggaagaagaggugcuggugcuugguugagugugguccuuggcauggcaacugggucuacuuucagguucugcugauaaugggauaauggaauaaugauggacccaaggggcuaggggcugaaugaaaccaaaaaacugaguuuggcugggcacgguggcucaugccuguaaucccaacacuuugggaggcugaggcagguggaucaccugaggucaggaguuugagaccagccuggccaacagggugaaaccccaucucuacuaaaaauacaaaaauuagccgggugugauguugugcacuuguaaucccagcuacuugggaggcugaggcaggagaaucacuugagcccaggaggcggaaguugcagugagcugagaucgcaccacugcacuccagccugggcaacagagcaagacuccaucccaaaaaaaaaaaacugaguuugggucuuggggaaagcagaauuucagauucccagagugaaaucuaggagaagagaagauaugucuuggagggccucaggagcuugggccugaggaaagugucccaaggaggggccguguuaggauccuggugaugaaaauguauaugucaggguccuggcaggaaaaagacagcuacuugaugauuuaauugaagacuuuaacaaagggacugcugacagagcugggggcaggguuaaggaaaccaauaagggggacugaggcagugagcaguacuaggaaaucguuaucacuucuaggcugaagaagcacaaaagaagacagugcucuguagggagcccuggcaggaucuguaaucauggagggccuaaggcacuacuagagcuacagaggggcgagggcuggggaaggauucauaccccaaucuuuccuccugccuucugagccauuaccaauaccucccaacugucaaccccaacuagaagcccaugcagguggcaaaggagcucaggcgaugcacccuaccaggaacaguuuuccagggcacacagagggcaagaaagggugagaaacaggugggagaggggagcaaauggagaaugggcugcacgggaggaaccauucccaaaggguguugagauuccaacagcugggguggcuaggaacagcccuuggugaguagagggugcuggcaggacucuuaggcucuccacucugcccucgccaggucuucacacgcuauggaaagugcuacacguucaacucgggccgagaugggcggccgcggcugaagaccaugaagggugggacgggcaaugggcuggaaaucaugcuggacauccagcaggacgaguaccugccuguguggggggagacugguacgucacccacuucaggggccccucugcauggcucuaggccccagccucugccaggggauuccugggcuucacugugagaccugggcagggcccgggcuuuccccucucccuccagcaucucaccaucucuaucacugacucuaccugacuuccacacucacaucucucuggcucccacuuccugguucaguuacucuccaagguaaccagccauccucuuccaucaacgccgccgccacucuauaaauaacucccucucuucucgggcugccugccugucuggucucggggggccuuggggcagagagagaugggggaaaagggaaaaagggagugggagaaauggagagcaucugaaacagugacacucugggagaaaguauuugaaacaucaagaugcagagcagaagccagguaagaaaagaaguguguaggauacaggggucaucggagcagcucagagcugguaaacccagaaggaggcuagggggugggcuaggacccuauagacuucccccaccccagccccagugcacccuaugcuuauuuccaggagagguaggaugcccccaggucugagggguguuagggagucaggagcccucccaacccacacacuccucauuccccuagacgagacguccuucgaagcaggcaucaaagugcagauccauagucaggaugaaccuccuuucaucgaccagcugggcuuuggcguggccccaggcuuccagaccuuuguggccugccaggagcagcgggugagagggccaugggaggcugguccuggggugggguauugagggguccagauggaguggugggcaaucaguaaugggaaggacaggugagcaaggaccugggugguaaucuggcuagucagaagcaugagugaucgaaugaacaagaaugcucuguaaacucugagaccuuuggaggcugcagagggagaggggagcagaacuccagagaucugcaucuugucagaggaguccaucaagcugauuuggggagaaguccccgcacucccccagcuccccggcucucccagcagcucaucuaccugcccccacccuggggcaccugcaaagcuguuaccauggacucggauuuggauuucuucgacuccuacagcaucacugccugccgcaucgacugugagacgcgcuaccugguggagaacugcaacugccgcauggugcacaugccaggucaggccuggggcuccgagcauacuccuggggucccugggccuuugcugcccuucacuagcuccccauccauaucaaucucccaaccccaguuccagcccaccccaucccacacccaccuggcucaugucucucugaccucaguucccgccugcacccccagggaugggugggaagggucuagaagguauggaccuggagugggucacuucuggggcagcaugggggccugccaguccucccuucccaucuucucccagcuuacaccuucuaggccuuugguacuaccaccaucaccagaccccuugaauucccauccugcaucauugucuuuucuccucuguaggggaugccccauacuguacuccagagcaguacaaggagugugcagauccugcucugggugagcgccccuggccuggggcagucugggggagggaaaaggugcugccagccacgugcgcaggaguuucaggucacgcucccagaagccucacauaacuccuggacugggcugcacccucucuugugucugacauuaaagcugagaauggucagucaugguggcuuacaccuguaaucccagcacuuugggaggcugaggugggcaaauugcuugagcccaggaguucgagaccagccugguuucauggugaaacccugacucuaugaaaaauuaaaaaaaaauuaugugggcaugguggcaugugccucuagucccagcuacucuggaggcugaggugggagaauuccuugaaccggggaggugagguugcagugagccgagauugcaccacugcacuccagccugggugacagagcaagacccugucugagaauaauaauaauaaucaauaaaguugagaauagcaucuucagaggccccuaugaaaaaugaacagaggucaccugggaauggccuucaucuucuuucaucagccccucagcugguugacccuggaggguccugaggaagugagauauaagaguaagaaauauccauggggaggcuuggugagaauuagcacaugguagacacagcugugagggggcagcugggguucuccucacucuccuaguucucuccaucuacaucguugguucaguggccugcaggguucagcagguaaaguccucaaacaugccucaggcuggauggugagguaggauguuggcagaguuuagcauccaggcagggugaagggcaggucacggaaagagaaaggggcccagaguuucucugggcagagcuaggaugugcaugugggaaggugcuggcagaagggcaccacucaacugagaccucucaccuggcugagugcagacuuccugguggagaaggaccaggaguacugcgugugugaaaugccuugcaaccugacccgcuauggcaaagagcuguccauggucaagauccccagcaaagccucagccaaguaccuggccaagaaguucaacaaaucugagcaauacauaggguaagggcucuggcuggguagagcaaggcccuuggguugggacuguggaauggaugagugggguuugaugggggcgggggcuggcaggcagggggaacuugagauaacacggggaagguccaaaaggcaagcaaagagucuaggguggguaugcagggaagaucaagccagaauaagcagggaagcaccccuuucuccuccuucuucauccucauuguuguaaccggagucacuuuauacuugaugcauacugcauaugguacagaacauuuuuucauauaugccaucucauuuaauccuaaaaggcagguaucuccaucagcaucucauuuuauggauauggaaacugagauucagagaggcugccuugccaaggucaccugguuaguaagagauagagauaugacuugaaccuaggucuccucccccaaucccugugcagggagaacauccuggugcuggacauuuucuuugaaguccucaacuaugagaccauugaacagaagaaggccuaugagauugcagggcuccugggugagcugcugaugacaccuguccccuucucaugccaugggcauggcguggcucccuaucauccaaaagcagggugcucacuucugucccaugaggguccuccaccccagaggcccuuccccaaacccuguugucuugguaaguggugagggaagggaacugagccuucucuuagggcaaaguggaaaagagaaaagacaggccugugggcaugagggagggguaggcauggaaguggagacuauuucauaugccccuaaacuaagaggguugugguauuuuguaaacgauuauuuuucuugaaaaacaccugcuuguuuuagaaagguagaaaaacgcagaaaagcauagagaagaaaacaaaaauuccaccugaaucuggcuuugcgauccuucugugcgaaggcuaccaaucccuuugagaauacaacuugccugccccagucccaguaaacccugcugcccccacgauguccugaccccacugaccccccuggcgccugcccccgcaggugacaucgggggccagauggggcuguucaucggggccagcauccucacggugcuggagcucuuugacuacgccuacgagguaagcgggggcgaggcccggcacggggccacgugggggcgggguccagcccgcccaccugccccguccccguccuaggucauuaagcacaagcugugccgacgaggaaaaugccagaaggaggccaaaaggagcagugcggacaagggcguggcccucagccuggacgacgucaaaagacacgugagggagcgagcgagggcgcccuccagcccgccugugccuccaccgccccaggaaccccguccacccccgcccacccgccucugccaccaccuucucuccuuugccucccgaaugccccagcacuaccugaagcccuuccgagggauaacccgucccuguccuguccccuucccccagaacccgugcgagagccuucggggccacccugccgggaugacauacgcugccaacauccuaccucaccauccggcccgaggcacguucgaggacuuuaccugcugagccccgcaggccgcugaaccaaaggccuagauggggaggacuaggagagcgagggggcccccagcugccuccucacaucugcccuggggacuccccacacuccggggcagaucuuuccucuugucugugguaaggaaggagucuugaccauagaguccucucucugccucuaucccauucuuuuuacauuuaacaaaacuaaucuaaaaaagaacuaaaaagggagaacggggcaagggaccucaggcugccccucucuccuccaugcugccuccccuagcucccagccugaauucugucuaucuagcugucugccaucugaguguccaucuacauucugcugccaccagucaccaaaggcccuucccagugagggguggaagggaucucuggggucuggaauuuggccccaaaccagagaauguaccuuaagggggagggcuagugugggggagggaggcuuccccagccuuaagagacccucucagcccagugacuguccccaaacccaagucuccuggcaggaacuaaaaccucagccccacucucucacaccauguggaaucucgugggggucggggauccccuuaagaagugguaauggggacaagaugcggcccuggugcuguaggcuacauccugauaccuauaaguucacccccaccccacagcugcuggagagaaaucccaagaggcagcccuuccucaccaucccauuaaagaccgggcugguuagcguccagcucagggagaagggcgcuagugccuaaccucacuggucccucucccggaggcccuuguagagggccacguccauaaauuuucuuauggaacucucccacauccucuuccccaacuucauuugcuucucucaacaaccucaucugcauuuucuauuucuauaugauacagacucuauauugcuauaucucuguauauacuuucccagcccugucugucuccaccccauccccucuugucucugagaaccauucucccaccccaaguuccaccuucuauguuucuacucccucccuggucucugaaugccuucgccuguauaaagaguuggacucucuccccuggugucuguacuguguacacacaucccucugagaagcacaaggagacgacacgcgcauuguaaccuuugcacugucucaguggcgacaaaggaagcugugaaucacaagcucugccucuuucuggccucacccucucccccaacccgggcacccucggcccucccugcagccuuaacauucucuuccccugcuccuccuaucccauugcccucugcccagcugacaguggcauccccagggaagggguugcuguagagauagcccccacccaggggauggaggucuacccuggacacuaagccaagugugucagagacagaagggagcuggggauuggcgacuccugaaguuggggcagugggaugcugacaggcagaagcugagguccucagucaguggccuuuccuccuucugggugcccagcccccuuuccucaccugauacccaagcccaccacuuuuauuuucuggugagguggguuugggaggaaagagaggccuagaggaggaguugaaagcucugcuguugucucacccuaucuuaaugagagacaagugagguggagggccugcccccccucccuccaccagacacuccuuccaggccugagccccaaccccucuucaggccuuccuucccuagcugugucuuggucuucaaucccagaacaggaccugugagcagcugcauuggccuggagcuggagaguaaggcuguaggaucuuuggaaucucuugguuccuaagaguuuccucagagaucauaccuccccagagggaagcaggaaugaggccaaaaagugugcauuggauaggggaacagcaggcagggcucugggugacgcaugccucuggucuaauaaacuggguuucaaccaucuccucuucaguguuguucucuuauuug

SEQ ID NO: 17949 - RNA, 8529 nt, Homo sapiens
gcucucgaguugcugguguugucaguaccucacgagaaggcccucauucagcaaagagagcugcccuuggaauauuggugcccaccaacauaggaaucugcucacccuucccuaccguucaucagccuuugggccacccucuggccugcuggcuuccagaugccaggcaugguuagcugguuacccuggccggucuggagcagcugaggaagaggugcagaguuugggaggaagaaagggguggagucagggauguccucuggggagauagcacaggaggggcccagcugacaccucccccagcuagagcuacugagaaggaagccugggugaauacaaaggucacagggagcugagugaucugagccuguuaugaaagguguagcucugucagcagauuaaguuccugcuccccaaagagggugcuggcggggagggugagggaaggcuuggaaaggucgcacagaguggggaggagcuggcaaagaacuaggaaccgggaagucccuggggagaaugucaagccaccgagcuacagaugccagcauggcagcaauuugggugccagggcagccugggggagggggaagggggagaaccagagguuucugaggacacagauguugcuaggagaagcuaaaagggguuuguuugagaucuuuguauuuuguuaacaaacacugagauccaucgaagcuguguggguccuggcagaggucagcaaagggguccuuggggccugcaucagcucagaagcccagaccccucccugacaauccuugccucaucgcuccuguggcuaagauacuucuucagcccuuuaacaggauuacugguguaugugagacagccacuagcagccccugcccuaccggccucucccccaacccuucuccacauacaucacccccgccaccaagcaggcagcacuggggcuugauuccaccccucccagaggauauggagaaagccccacaucuggagagggacagggcaacugcauuucuggcaaaugugguggcaugaggcugccaguggcuugacaguucaggaucuccaggugcguagcugggccccauagccuccuguccuccagugaaaagaugagaagacucugcucccugggaguccuggagauccuggugacuagguaccccaggcuucugcuggucuccacugggguaaaaaagcggccuggccugggcccuggccccacucacauauguucuggaugauucugcaggcaguggaugaauucacccacuggcuggcccucguagcacaccuuguacacagccaugaacaagggaaaccuagauuggagagggaaaggcucagcuuagccucccacuccugguccacucuacccccacccccacucacugccuaacccuccugucccuugcccucccaccuuggagcucaggaaggauggcugugaguuucuaccuucugagaaugugaacucccuagcccuagguuuaaggucagauugcuaauugcccugcucccuaccauguugaacuggccugcaugauucucuggcuuggauuuucugugccaacugggcaacccacuuuuuuuuuuuuuuuuuuuuuuuugagacagacucucgcucugucgccuaggcuggagcgcaguggugcaaucuuggcucacugcaaccuccgccucccagguucaagcgauucuccugcaucagccuccugaguagcugggauuacaggcacacaccaccaugccugacuaauuuuuguauuuuuaguagagaugggguuucaccauguuggucaggcugagcucaaacuccugaccucgugauccacccaccuuggccucccaaagugcugggauuacaggugugagacaccacacccagccuugagcaacccacuuaaccucucugagccucagugucaccaacuguaaaauggggccaauauaacaaaggaaugauuguguaugugaagauguaauuagguaugaugugaaagugcuuaauaaauacucauuuccuucuuacuguccuuuugcccagcugcucccuuuuccaagcuuuacccugaccagucaugaguggauauucugaaccuguuucauacugucuucuucuaggagucuuucucagaccagcacagcucugcucugaucagcccaaucacccccgcugucuuucugaaaacgagcaccuugaagcccauccuucuccuuacaccucagcacccagaacaggauucagggaacagauggguuggccuuggggaagagacucaaacuaggggugauggacagaagugggaugagcuuauuccugcugccccagagcuccaaccccagagcagaggacaaggaaggaggggcacaaagggauccagguaauguagugugaagagcacuagacuggaaggaguucaaagaccaugaacuagcuggcggacaaugggcaugccagacucugcaagcucuggacucugucugaaauguaagguaauacuccccuuucuguccacuucacagauuuguggcagguuuaggaagaugaugaacagggcgagcacuucuggcuguggcucccuuaaucaguggggcuguggccaauacuuacuugucuaccaggcccuugugcuggaggaugcuguauagcucccgggcugucucgggccccugcaguuucugcccauucagcaacucuuucuccagcugcucaauggacugugcagaaaacaggaugaguggauggaaaugggagagaaggguugucaguaggggguggagagacuggagcucagaugggaguggggucuugggaggaaaagagggauggggaugugcacaacagucuuaauguuugugcuccagagaugccucccgccaagcaccucuaccuggaugccuacagagccgccccucuguucucccuucucccggggcccaccuuuccuguacgcgcaaaggccucagccacuuuccgguuccgcccuccauagcagguagugaucaggucagcaacaccacagcucuccaagaagguggcagaggacacagggccacugcagaagagcuuggcgaaggcuaucaucuccaugagucccagccggaucacugccgccuugguguugucgccaaagcccaggccaucacagaagccagcccccacggccacuacauucuugaaggaguggaggucauaggugagaaaagacccccuccuauaggccccauguggagcccccucauacucauuucaucagccgugacacccacugcagaagagagguauaguguguggccuuuuagaagccuacuuccgccucuugguuuccccccuugcugcacccccuuucuuaagcccugccccauacucccuccucgaggacauuuucugaaaaccacucuucucucuaguugaucuucccaucuaugaccauuccauuguacagcccucaagucaacagcuguccaggauccauaguucuggccauuagucugucugggugucaaggauguuuugucucccauuagccugggcaucuccuugucccccuggaccaccuccuggagccagaggguggggagucccacacggggcuaaaaugggacaggagcaaggggguccacggucugaugaugaauaaucagccggccugaauggcccuggccuugcuucugcagcuccuccuauaugcaugggacaugguaggaaaggggaaccacugcucaauagugagagccuggaguaccugcagccuugcagagcucagccagaccuccuuuggggccuucuccucaccccauagcugccucugugccccucucaccuuuaaggcuccacagaucucuacuguguccaccucuugcaccacugugauacggaaguuuggugucugcaucagcucuuucaggaguugucccugggccggguccuugcagccuaaagugaggagggggcaaggcuuugagggaaggacucuuuuuaaaaaauauuuauuuuauagagaugggagucucucucuguugcccaggcuggacucaaacuccugggcuuaagcgauccucccaccucagccucuuaaguagcugggaccacaggugugccacugcaccaacucugagggagggcucaucacuguguuucccuaagcaggcccugaagccccuucccugggggugucccagccuccuucaccucugaugcuuguauuuuccuuucucugccuuaugggaaagagauggcuaagugggguuggggcaguuuggggaggggaugcaacuagaugcacuguguaugcaggugccagggggcucucaccaaugguugucucacagaacuucucaucagccaccucgcuggcaauguuggcccccaucagcacacucauggggaugccgaggcgcuccccaaucacuuccgagaugagcuucagcccauuggggcccucgucuacccccugagcacaggauggagcucaggccaggugcccuuugggcccaccugcgggcuuccgcccagaaauucugucccuuccaaauccauugcucaucugugucccucccgacagguccugccccauuccaacccagcucaaguuugcugugaggaggccagacagcaugugaccaacuguccugccacauacccucaaccagucuacuucuccaaggcaacggguccccuccacaucccuaggcaaccccgccugacugccccaacaaacugccauucagugaccagucacugcuccaaaccagcuacucuucacacuucucaaaccagcccgcuucucauaucucccaggcauuccuuuauaccuccgaaacuccccgagaggaccuccaaaccaaucucgucuccucccuucagccucccuuccagugacccccagcaccucacugcuuuccuaagccucuccagagccaacugccucucuuuucuccagcaaacucuuggccugcgucugccauuuucuguucuccuugcuucacccacccugaaccccacaacagugagccgcacccucccccauccacaugaaggugucccuggcaccuuaauaagagauaugccaguggcguuugccuucagauggcccuugagcuggucacagaucuugccgaugaacugauggggcaccacaaagaucaggaugucagcauccucugcagccuggaccacaucugggacagccaccugugggggugaccaagugcucgcgggccuggcagaccuccccuagccccuguggaacccuauucaggagaucugggagccaaagagugaggcugguaggggagcaggaaggcuuguuugggacugaaucuagaaggacugaacuuggaggaauaagacacucuacucccuccccccagcuaccacucugucucccuccagcuguccugggcucuugaggacuccuggaaaccucaucccagcacucuccuaucccuuggcugugggacagugcgggaggccaaaagcagccugggcuuggcaaaagaaagagcucaaauaagauuucaucacccagcuccucaggaaccccagcugggaagggggagccccagccuuucugcucucuucccugcuuccccuuuccagguggggagagccacguggauuugaccaaagaccguaaguccaaggagcagccuccaagucggcuacucacucagugaaugaguaacaggauuagugccggaggcaggcacuacuggaccccaagucugggagcccagucuuuggcugccauggagaccaacuuguucucccaucccuuccccacccacccgccugggagccugugaggggaaagcauagguucuccucaguccucaggaaagggcccagagcagcccuccugagaccuucccaaguccugcugcaccugaagcggcccucucagcaggaggcaccuguugaguaaggucggcuccaacuccuggcccucccuuccucucccuguucuucgcaggguguuggggcucaccacauuugggggcaacuugugcccuggcagguauuugacauucucaugcugcguguugaugaucucagucagcuuuuugccuccaaugucuuccucaaauacccacauggucacccgugggucaaacugugccagcugggcugcauugccacccacgaucuuggcgauggcugagccccuggugggagggggagcacaggaaaguacaggaggagggaacaguggcaggaguuggggcagcgccccaccucaggaucucacagcagccccccaggcuguucacuccuaccuaccuuccuuaucaccuccacucccaugacaaauaguccccagugaccuggcaguagaaaggagacucagucuccucacccuuugcuacuagagaagggagccccacuucucaucuucccacccccaaacucaagcggcucuucacauagagagcucuggagacgccuucccauggugaacaggugcagcugcccaggagggcgggggucaggagagggccgggcaccgucuguccugugcugcuaugauagaagauagcagcaggggcugaacaggaaccugagggccuuucccacccauucugccuccuacccaccucugucuuggggggccuacccuucccccauaucacuugacagagcugcuuaccaguucccggagccuacaaugcagacuuucuugcuagccauggugccgcgucucugccugagccggcucagugccacacucccuagcuccucugccggcuaggagcauuuaacuccaccacacgugggugcagccaagccccgcccuccagggguggguggggaggcuggcgcccagggagauagagagucuggcagagccagggaaaggagagacagggguacagacagguguggaacaggaauggggcagagacuaggcccagcuuuuucuccugggcucaucggcugacagugcuggcaagcuucuucccuuggccccagcccagcuucccaccauggucucauuuugaggucugcuaagaaaauagcccagauaaggagcaggugacugcucucccuugcuccuuucugucccccagcaugaaauaaauuguauuuagcuucaguagcagcuaggggaaugcuuuucagagguaggcuccuccaugacccccuauccccccgccaacccugccacauauccucacaggacccuguuccacaguucuguccuccagcaggcccacgcuagcuccacugcagggcuggggugggggaugugggcccacuucccaccucuaaagaugaggccacauaagagguaagggccugcuuugaggacagcccagcucaaaaaaggaugagagacuccaggugccucaaaagacaagauugucuuggucacccacagaggucaucuuggggacucauccaugggccucucagaugauccccacccaaaaauguguucuagggaaggugggaaagguuaaaguuagagagcucugagaauugcgguacacaauuuuguuguagacucugggcuuaagaggacaggagagaauaggaggcaggcagagugcacacuguccuugaaaggcuuugagccuccuucaacuccuccucucagggguuuccaagguacugccccaggggcuucaucaggugaauggcuaguuugcagaggccagaaaaggggaaggcaggcaguacccggggcagcuguguccguggggcuuuguggucucagaugcugugauuggggguaaguuugguguauguuuuuuggggaagggcgagaauggaaggagcacccucagcaguucagggcucugcaucgcccacggccaucuguuugucuaagacgagggaagcucugguuuccaggcugaucuggagaguggagcaagaggcuccuaacacugugcaccuuggccuagagggcagacaccacugugugcucaugugcugaccuccuggcuuggcagacggcuagguggguguugccaucccccugggcuguugcuggccagcaacugguaacaagcacugggcuacaggggagucugugugcaacccauggguaggaguaagcaggcaggaggucaagacuggggagaaauggcuuucuaaguuccggggacugcccaggaaaaaccaaccauauucuccuuccauggccaguaauuucccauagggaaacggacaugaaaucaguaguuggcuguuuuucuuagcacaauguuauaccuaauacagaaacagccucccacagaccacuccuuuauugcacuggcacugagaugaaggcuccagugccaggcugccagcugggagcacugauuacgggugauggaagagaaaggaugcuucugucccuggcacaaaugaugggagccccaaagaauggauguuuaugcauaaaauaacccccuuguuuuugccuaaaugcuucccucucucauuuugccccuacaaucauuuuagauaguguggagacuaagaaugugcucauuuacaugggaauaaagagggugcagagauucagaaucggcucaucacag

SEQ ID NO: 17950 - RNA, 7827 nt, Homo sapiens
ugaaaagcauuccccuagcugcuacugaagcuaaauacaauuuauuucaugcugggggacagaaaggagcaagggagagcagucaccugcuccuuaucugggcuauuuucuuagcagaccucaaaaugagaccauggugggaagcugggcuggggccaagggaagaagcuugccagcacugucagccgaugagcccaggagaaaaagcugggccuagucucugccccauuccuguuccacaccugucuguaccccugucucuccuuucccuggcucugccagacucucuaucucccugggcgccagccuccccacccaccccuggagggcggggcuuggcugcacccacgugugguggaguuaaaugcuccuagccggcagaggagcuagggaguguggcacugagccggcucaggcagagacgcggcaccauggcuagcaagaaagucugcauuguaggcuccgggaacugguaagcagcucugucaagugauaugggggaaggguaggccccccaagacagagguggguaggaggcagaaugggugggaaaggcccucagguuccuguucagccccugcugcuaucuucuaucauagcagcacaggacagacggugcccggcccucuccugacccccgcccuccugggcagcugcaccuguucaccaugggaaggcgucuccagagcucucuaugugaagagccgcuugaguuugggggugggaagaugagaaguggggcucccuucucuaguagcaaagggugaggagacugagucuccuuucuacugccaggucacuggggacuauuugucaugggaguggaggugauaaggaagguagguaggagugaacagccuggggggcugcugugagauccugagguggggcgcugccccaacuccugccacuguucccuccuccuguacuuuccugugcucccccucccaccaggggcucagccaucgccaagaucguggguggcaaugcagcccagcuggcacaguuugacccacgggugaccauguggguauuugaggaagacauuggaggcaaaaagcugacugagaucaucaacacgcagcaugagaaugucaaauaccugccagggcacaaguugcccccaaauguggugagccccaacacccugcgaagaacagggagaggaagggagggccaggaguuggagccgaccuuacucaacaggugccuccugcugagagggccgcuucaggugcagcaggacuugggaaggucucaggagggcugcucugggcccuuuccugaggacugaggagaaccuaugcuuuccccucacaggcucccaggcggguggguggggaagggaugggagaacaaguuggucuccauggcagccaaagacugggcucccagacuugggguccaguagugccugccuccggcacuaauccuguuacucauucacugagugaguagccgacuuggaggcugcuccuuggacuuacggucuuuggucaaauccacguggcucuccccaccuggaaaggggaagcagggaagagagcagaaaggcuggggcucccccuucccagcugggguuccugaggagcugggugaugaaaucuuauuugagcucuuucuuuugccaagcccaggcugcuuuuggccucccgcacugucccacagccaagggauaggagagugcugggaugagguuuccaggaguccucaagagcccaggacagcuggagggagacagagugguagcuggggggagggaguagagugucuuauuccuccaaguucaguccuucuagauucagucccaaacaagccuuccugcuccccuaccagccucacucuuuggcucccagaucuccugaauaggguuccacaggggcuaggggaggucugccaggcccgcgagcacuuggucacccccacagguggcugucccagaugugguccaggcugcagaggaugcugacauccugaucuuuguggugccccaucaguucaucggcaagaucugugaccagcucaagggccaucugaaggcaaacgccacuggcauaucucuuauuaaggugccagggacaccuucauguggaugggggagggugcggcucacuguugugggguucagggugggugaagcaaggagaacagaaaauggcagacgcaggccaagaguuugcuggagaaaagagaggcaguuggcucuggagaggcuuaggaaagcagugaggugcugggggucacuggaagggaggcugaagggaggagacgagauugguuuggagguccucucggggaguuucggagguauaaaggaaugccugggagauaugagaagcgggcugguuugagaagugugaagaguagcugguuuggagcagugacuggucacugaauggcaguuuguuggggcagucaggcgggguugccuagggauguggaggggacccguugccuuggagaaguagacugguugaggguauguggcaggacaguuggucacaugcugucuggccuccucacagcaaacuugagcuggguuggaauggggcaggaccugucgggagggacacagaugagcaauggauuuggaagggacagaauuucugggcggaagcccgcaggugggcccaaagggcaccuggccugagcuccauccugugcucaggggguagacgagggccccaaugggcugaagcucaucucggaagugauuggggagcgccucggcauccccaugagugugcugaugggggccaacauugccagcgagguggcugaugagaaguucugugagacaaccauuggugagagcccccuggcaccugcauacacagugcaucuaguugcauccccuccccaaacugccccaaccccacuuagccaucucuuucccauaaggcagagaaaggaaaauacaagcaucagaggugaaggaggcugggacacccccagggaaggggcuucagggccugcuuagggaaacacagugaugagcccucccucagaguuggugcaguggcacaccuguggucccagcuacuuaagaggcugaggugggaggaucgcuuaagcccaggaguuugaguccagccugggcaacagagagagacucccaucucuauaaaauaaauauuuuuuaaaaagaguccuucccucaaagccuugcccccuccucacuuuaggcugcaaggacccggcccagggacaacuccugaaagagcugaugcagacaccaaacuuccguaucacaguggugcaagagguggacacaguagagaucuguggagccuuaaaggugagaggggcacagaggcagcuauggggugaggagaaggccccaaaggaggucuggcugagcucugcaaggcugcagguacuccaggcucucacuauugagcagugguuccccuuuccuaccaugucccaugcauauaggaggagcugcagaagcaaggccagggccauucaggccggcugauuauucaucaucagaccguggacccccuugcuccugucccauuuuagccccgugugggacuccccacccucuggcuccaggaggugguccagggggacaaggagaugcccaggcuaaugggagacaaaacauccuugacacccagacagacuaauggccagaacuauggauccuggacagcuguugacuugagggcuguacaauggaauggucauagaugggaagaucaacuagagagaagagugguuuucagaaaauguccucgaggagggaguauggggcagggcuuaagaaagggggugcagcaaggggggaaaccaagaggcggaaguaggcuucuaaaaggccacacacuauaccucucuucugcagugggugucacggcugaugaaaugaguaugagggggcuccacauggggccuauaggagggggucuuuucucaccuaugaccuccacuccuucaagaauguaguggccgugggggcuggcuucugugauggccugggcuuuggcgacaacaccaaggcggcagugauccggcugggacucauggagaugauagccuucgccaagcucuucugcaguggcccuguguccucugccaccuucuuggagagcugugguguugcugaccugaucacuaccugcuauggagggcggaaccggaaaguggcugaggccuuugcgcguacaggaaaggugggccccgggagaagggagaacagaggggcggcucuguaggcauccagguagaggugcuuggcgggaggcaucucuggagcacaaacauuaagacuguugugcacauccccaucccucuuuuccucccaagaccccacucccaucugagcuccagucucuccacccccuacugacaacccuucucucccauuuccauccacucauccuguuuucugcacaguccauugagcagcuggagaaagaguugcugaaugggcagaaacugcaggggcccgagacagcccgggagcuauacagcauccuccagcacaagggccugguagacaaguaaguauuggccacagccccacugauuaagggagccacagccagaagugcucgcccuguucaucaucuuccuaaaccugccacaaaucugugaaguggacagaaaggggaguauuaccuuacauuucagacagaguccagagcuugcagagucuggcaugcccauuguccgccagcuaguucauggucuuugaacuccuuccagucuagugcucuucacacuacauuaccuggaucccuuugugccccuccuuccuuguccucugcucugggguuggagcucuggggcagcaggaauaagcucaucccacuucuguccaucaccccuaguuugagucucuuccccaaggccaacccaucuguucccugaauccuguucugggugcugagguguaaggagaaggaugggcuucaaggugcucguuuucagaaagacagcgggggugauugggcugaucagagcagagcugugcuggucugagaaagacuccuagaagaagacaguaugaaacagguucagaauauccacucaugacuggucaggguaaagcuuggaaaagggagcagcugggcaaaaggacaguaagaaggaaaugaguauuuauuaagcacuuucacaucauaccuaauuacaucuucacauacacaaucauuccuuuguuauauuggccccauuuuacaguuggugacacugaggcucagagagguuaaguggguugcucaaggcuggguguggugucucacaccuguaaucccagcacuuugggaggccaagguggguggaucacgaggucaggaguuugagcucagccugaccaacauggugaaaccccaucucuacuaaaaauacaaaaauuagucaggcaugguggugugugccuguaaucccagcuacucaggaggcugaugcaggagaaucgcuugaaccugggaggcggagguugcagugagccaagauugcaccacugcgcuccagccuaggcgacagagcgagagucugucucaaaaaaaaaaaaaaaaaaaaaaaaguggguugcccaguuggcacagaaaauccaagccagagaaucaugcaggccaguucaacaugguagggagcagggcaauuagcaaucugaccuuaaaccuagggcuagggaguucacauucucagaagguagaaacucacagccauccuuccugagcuccaaggugggagggcaagggacaggaggguuaggcagugaguggggguggggguagaguggaccaggagugggaggcuaagcugagccuuucccucuccaaucuagguuucccuuguucauggcuguguacaaggugugcuacgagggccagccagugggugaauucauccacugccugcagaaucauccagaacauaugugaguggggccagggcccaggccaggccgcuuuuuuaccccaguggagaccagcagaagccugggguaccuagucaccaggaucuccaggacucccagggagcagagucuucucaucuuuucacuggaggacaggaggcuauggggcccagcuacgcaccuggagauccugaacugucaagccacuggcagccucaugccaccacauuugccagaaaugcaguugcccugucccucuccagauguggggcuuucuccauauccucugggagggguggaaucaagccccagugcugccugcuugguggcgggggugauguauguggagaaggguugggggagaggccgguagggcaggggcugcuaguggcugucucacauacaccaguaauccuguuaaagggcugaagaaguaucuuagccacaggagcgaugaggcaaggauugucagggaggggucugggcuucugagcugaugcaggccccaaggaccccuuugcugaccucugccaggacccacacagcuucgauggaucucaguguuuguuaacaaaauacaaagaucucaaacaaaccccuuuuagcuucuccuagcaacaucuguguccucagaaaccucugguucucccccuucccccucccccaggcugcccuggcacccaaauugcugccaugcuggcaucuguagcucgguggcuugacauucuccccagggacuucccgguuccuaguucuuugccagcuccuccccacucugugcgaccuuuccaagccuucccucacccuccccgccagcacccucuuuggggagcaggaacuuaaucugcugacagagcuacaccuuucauaacaggcucagaucacucagcucccugugaccuuuguauucacccaggcuuccuucucaguagcucuagcugggggaggugucagcugggccccuccugugcuaucuccccagaggacaucccugacuccaccccuuucuuccucccaaacucugcaccucuuccucagcugcuccagaccggccaggguaaccagcuaaccaugccuggcaucuggaagccagcaggccagaggguggcccaaaggcugaugaacgguagggaagggugagcagauuccuauguuggugggcaccaauauuccaagggcagcucucuuugcugaaugagggccuucucgugagguacugacaacaccagcaacucgagagcugggaaacucaaggaggaggaagaaaaucaaaaccacccuacucccuggggugaggaaagaacaggaggggaggaggaggagugugcucugcacuugccuugcuccaggaugggguggcagcagaggaaugucacaggucagcagccuaggccuccagcuauaaauaguccggagggcccgagaggcucccgcccguccagcagggcugucagcuuccuguguggcagcaccuggcacacuggcucuggccagcauuaugcuaaaacccuguuacucuccaaugaaccagggaggcgggcuccucucugcgccuaucccuugagaauucugucuuaccagugaaggguggggcugcccagaucaggcagcaggagugaggggcacagucaccccaggccuugcugagcccaggucuggguacugaguguccagagcugccuccccaggagguuaaggugggggcaaaggggaagcuucaagcacuuugccuacuuuuguucacuccccagugcacugugacucaggccuucccaucaggccuauuugucuacccaauaaagcguguuuuuuccagaaacaagaagaguugggagagggagcuucagugcauguggcagugcgugugcuggcgcguaucauugcacguauguuuucccucuuaccguaggaaaaaugaaaaaagaaaucccuccuccauaaucgcagcuacu

SEQ ID NO: 17951 - RNA, 7827 nt, Homo sapiens
aguagcugcgauuauggaggagggauuucuuuuuucauuuuuccuacgguaagagggaaaacauacgugcaaugauacgcgccagcacacgcacugccacaugcacugaagcucccucucccaacucuucuuguuucuggaaaaaacacgcuuuauuggguagacaaauaggccugaugggaaggccugagucacagugcacuggggagugaacaaaaguaggcaaagugcuugaagcuuccccuuugcccccaccuuaaccuccuggggaggcagcucuggacacucaguacccagaccugggcucagcaaggccuggggugacugugccccucacuccugcugccugaucugggcagccccacccuucacugguaagacagaauucucaagggauaggcgcagagaggagcccgccucccugguucauuggagaguaacaggguuuuagcauaaugcuggccagagccagugugccaggugcugccacacaggaagcugacagcccugcuggacgggcgggagccucucgggcccuccggacuauuuauagcuggaggccuaggcugcugaccugugacauuccucugcugccaccccauccuggagcaaggcaagugcagagcacacuccuccuccuccccuccuguucuuuccucaccccagggaguagggugguuuugauuuucuuccuccuccuugaguuucccagcucucgaguugcugguguugucaguaccucacgagaaggcccucauucagcaaagagagcugcccuuggaauauuggugcccaccaacauaggaaucugcucacccuucccuaccguucaucagccuuugggccacccucuggccugcuggcuuccagaugccaggcaugguuagcugguuacccuggccggucuggagcagcugaggaagaggugcagaguuugggaggaagaaagggguggagucagggauguccucuggggagauagcacaggaggggcccagcugacaccucccccagcuagagcuacugagaaggaagccugggugaauacaaaggucacagggagcugagugaucugagccuguuaugaaagguguagcucugucagcagauuaaguuccugcuccccaaagagggugcuggcggggagggugagggaaggcuuggaaaggucgcacagaguggggaggagcuggcaaagaacuaggaaccgggaagucccuggggagaaugucaagccaccgagcuacagaugccagcauggcagcaauuugggugccagggcagccugggggagggggaagggggagaaccagagguuucugaggacacagauguugcuaggagaagcuaaaagggguuuguuugagaucuuuguauuuuguuaacaaacacugagauccaucgaagcuguguggguccuggcagaggucagcaaagggguccuuggggccugcaucagcucagaagcccagaccccucccugacaauccuugccucaucgcuccuguggcuaagauacuucuucagcccuuuaacaggauuacugguguaugugagacagccacuagcagccccugcccuaccggccucucccccaacccuucuccacauacaucacccccgccaccaagcaggcagcacuggggcuugauuccaccccucccagaggauauggagaaagccccacaucuggagagggacagggcaacugcauuucuggcaaaugugguggcaugaggcugccaguggcuugacaguucaggaucuccaggugcguagcugggccccauagccuccuguccuccagugaaaagaugagaagacucugcucccugggaguccuggagauccuggugacuagguaccccaggcuucugcuggucuccacugggguaaaaaagcggccuggccugggcccuggccccacucacauauguucuggaugauucugcaggcaguggaugaauucacccacuggcuggcccucguagcacaccuuguacacagccaugaacaagggaaaccuagauuggagagggaaaggcucagcuuagccucccacuccugguccacucuacccccacccccacucacugccuaacccuccugucccuugcccucccaccuuggagcucaggaaggauggcugugaguuucuaccuucugagaaugugaacucccuagcccuagguuuaaggucagauugcuaauugcccugcucccuaccauguugaacuggccugcaugauucucuggcuuggauuuucugugccaacugggcaacccacuuuuuuuuuuuuuuuuuuuuuuuugagacagacucucgcucugucgccuaggcuggagcgcaguggugcaaucuuggcucacugcaaccuccgccucccagguucaagcgauucuccugcaucagccuccugaguagcugggauuacaggcacacaccaccaugccugacuaauuuuuguauuuuuaguagagaugggguuucaccauguuggucaggcugagcucaaacuccugaccucgugauccacccaccuuggccucccaaagugcugggauuacaggugugagacaccacacccagccuugagcaacccacuuaaccucucugagccucagugucaccaacuguaaaauggggccaauauaacaaaggaaugauuguguaugugaagauguaauuagguaugaugugaaagugcuuaauaaauacucauuuccuucuuacuguccuuuugcccagcugcucccuuuuccaagcuuuacccugaccagucaugaguggauauucugaaccuguuucauacugucuucuucuaggagucuuucucagaccagcacagcucugcucugaucagcccaaucacccccgcugucuuucugaaaacgagcaccuugaagcccauccuucuccuuacaccucagcacccagaacaggauucagggaacagauggguuggccuuggggaagagacucaaacuaggggugauggacagaagugggaugagcuuauuccugcugccccagagcuccaaccccagagcagaggacaaggaaggaggggcacaaagggauccagguaauguagugugaagagcacuagacuggaaggaguucaaagaccaugaacuagcuggcggacaaugggcaugccagacucugcaagcucuggacucugucugaaauguaagguaauacuccccuuucuguccacuucacagauuuguggcagguuuaggaagaugaugaacagggcgagcacuucuggcuguggcucccuuaaucaguggggcuguggccaauacuuacuugucuaccaggcccuugugcuggaggaugcuguauagcucccgggcugucucgggccccugcaguuucugcccauucagcaacucuuucuccagcugcucaauggacugugcagaaaacaggaugaguggauggaaaugggagagaaggguugucaguaggggguggagagacuggagcucagaugggaguggggucuugggaggaaaagagggauggggaugugcacaacagucuuaauguuugugcuccagagaugccucccgccaagcaccucuaccuggaugccuacagagccgccccucuguucucccuucucccggggcccaccuuuccuguacgcgcaaaggccucagccacuuuccgguuccgcccuccauagcagguagugaucaggucagcaacaccacagcucuccaagaagguggcagaggacacagggccacugcagaagagcuuggcgaaggcuaucaucuccaugagucccagccggaucacugccgccuugguguugucgccaaagcccaggccaucacagaagccagcccccacggccacuacauucuugaaggaguggaggucauaggugagaaaagacccccuccuauaggccccauguggagcccccucauacucauuucaucagccgugacacccacugcagaagagagguauaguguguggccuuuuagaagccuacuuccgccucuugguuuccccccuugcugcacccccuuucuuaagcccugccccauacucccuccucgaggacauuuucugaaaaccacucuucucucuaguugaucuucccaucuaugaccauuccauuguacagcccucaagucaacagcuguccaggauccauaguucuggccauuagucugucugggugucaaggauguuuugucucccauuagccugggcaucuccuugucccccuggaccaccuccuggagccagaggguggggagucccacacggggcuaaaaugggacaggagcaaggggguccacggucugaugaugaauaaucagccggccugaauggcccuggccuugcuucugcagcuccuccuauaugcaugggacaugguaggaaaggggaaccacugcucaauagugagagccuggaguaccugcagccuugcagagcucagccagaccuccuuuggggccuucuccucaccccauagcugccucugugccccucucaccuuuaaggcuccacagaucucuacuguguccaccucuugcaccacugugauacggaaguuuggugucugcaucagcucuuucaggaguugucccugggccggguccuugcagccuaaagugaggagggggcaaggcuuugagggaaggacucuuuuuaaaaaauauuuauuuuauagagaugggagucucucucuguugcccaggcuggacucaaacuccugggcuuaagcgauccucccaccucagccucuuaaguagcugggaccacaggugugccacugcaccaacucugagggagggcucaucacuguguuucccuaagcaggcccugaagccccuucccugggggugucccagccuccuucaccucugaugcuuguauuuuccuuucucugccuuaugggaaagagauggcuaagugggguuggggcaguuuggggaggggaugcaacuagaugcacuguguaugcaggugccagggggcucucaccaaugguugucucacagaacuucucaucagccaccucgcuggcaauguuggcccccaucagcacacucauggggaugccgaggcgcuccccaaucacuuccgagaugagcuucagcccauuggggcccucgucuacccccugagcacaggauggagcucaggccaggugcccuuugggcccaccugcgggcuuccgcccagaaauucugucccuuccaaauccauugcucaucugugucccucccgacagguccugccccauuccaacccagcucaaguuugcugugaggaggccagacagcaugugaccaacuguccugccacauacccucaaccagucuacuucuccaaggcaacggguccccuccacaucccuaggcaaccccgccugacugccccaacaaacugccauucagugaccagucacugcuccaaaccagcuacucuucacacuucucaaaccagcccgcuucucauaucucccaggcauuccuuuauaccuccgaaacuccccgagaggaccuccaaaccaaucucgucuccucccuucagccucccuuccagugacccccagcaccucacugcuuuccuaagccucuccagagccaacugccucucuuuucuccagcaaacucuuggccugcgucugccauuuucuguucuccuugcuucacccacccugaaccccacaacagugagccgcacccucccccauccacaugaaggugucccuggcaccuuaauaagagauaugccaguggcguuugccuucagauggcccuugagcuggucacagaucuugccgaugaacugauggggcaccacaaagaucaggaugucagcauccucugcagccuggaccacaucugggacagccaccugugggggugaccaagugcucgcgggccuggcagaccuccccuagccccuguggaacccuauucaggagaucugggagccaaagagugaggcugguaggggagcaggaaggcuuguuugggacugaaucuagaaggacugaacuuggaggaauaagacacucuacucccuccccccagcuaccacucugucucccuccagcuguccugggcucuugaggacuccuggaaaccucaucccagcacucuccuaucccuuggcugugggacagugcgggaggccaaaagcagccugggcuuggcaaaagaaagagcucaaauaagauuucaucacccagcuccucaggaaccccagcugggaagggggagccccagccuuucugcucucuucccugcuuccccuuuccagguggggagagccacguggauuugaccaaagaccguaaguccaaggagcagccuccaagucggcuacucacucagugaaugaguaacaggauuagugccggaggcaggcacuacuggaccccaagucugggagcccagucuuuggcugccauggagaccaacuuguucucccaucccuuccccacccacccgccugggagccugugaggggaaagcauagguucuccucaguccucaggaaagggcccagagcagcccuccugagaccuucccaaguccugcugcaccugaagcggcccucucagcaggaggcaccuguugaguaaggucggcuccaacuccuggcccucccuuccucucccuguucuucgcaggguguuggggcucaccacauuugggggcaacuugugcccuggcagguauuugacauucucaugcugcguguugaugaucucagucagcuuuuugccuccaaugucuuccucaaauacccacauggucacccgugggucaaacugugccagcugggcugcauugccacccacgaucuuggcgauggcugagccccuggugggagggggagcacaggaaaguacaggaggagggaacaguggcaggaguuggggcagcgccccaccucaggaucucacagcagccccccaggcuguucacuccuaccuaccuuccuuaucaccuccacucccaugacaaauaguccccagugaccuggcaguagaaaggagacucagucuccucacccuuugcuacuagagaagggagccccacuucucaucuucccacccccaaacucaagcggcucuucacauagagagcucuggagacgccuucccauggugaacaggugcagcugcccaggagggcgggggucaggagagggccgggcaccgucuguccugugcugcuaugauagaagauagcagcaggggcugaacaggaaccugagggccuuucccacccauucugccuccuacccaccucugucuuggggggccuacccuucccccauaucacuugacagagcugcuuaccaguucccggagccuacaaugcagacuuucuugcuagccauggugccgcgucucugccugagccggcucagugccacacucccuagcuccucugccggcuaggagcauuuaacuccaccacacgugggugcagccaagccccgcccuccagggguggguggggaggcuggcgcccagggagauagagagucuggcagagccagggaaaggagagacagggguacagacagguguggaacaggaauggggcagagacuaggcccagcuuuuucuccugggcucaucggcugacagugcuggcaagcuucuucccuuggccccagcccagcuucccaccauggucucauuuugaggucugcuaagaaaauagcccagauaaggagcaggugacugcucucccuugcuccuuucugucccccagcaugaaauaaauuguauuuagcuucaguagcagcuaggggaaugcuuuuca

SEQ ID NO: 17952 - RNA, 1169 nt, Homo sapiens
ugccuccuuuaggagguccauaugggacacuuuccccuuccucugaaccucaccgccacaccagaacagcccuccguuuuucuccuucaauucuucuccacuacgggccucaccucccauagcuuccuagaguguugugagcgcgcagagggaagcugcaggccugcucggcccaggugcugugucagccuaucugccgguuccgcggcguguacggcccggaaagucacauggcggugggaccggccggcgccucuacacuccugcucuccuaagagcaggacgagacuagcauaaugcacucaccuccacgaaaagcaacaugucguccucugcucagcccaaucguucccgccgccgcaacuccaacuggcucacaggcccgcgccccaauugcuaggauaaggacacacacucgccuugccccuccacccggcaguggacccggcuccuccccugccgucagccgcugcggccugacccgcccagucccaccucccuugaaacaacaacugcuuccgggucuagggaaaaauuguuuccgggagaaaagagagcccucggcgcgcucaacuuuugcacuaucuuuuccagcagcagugugggauguacuaucaucugucggggggaacgauuagaaggagacgccauucuguggcacggggauguguaaaaaucguaaugacacauuuuaucacuugucagauagcuacacagcacugauaauuccgcaguuuucauaguucacaaucuagauuugauuuuuaaagccgaccuuggcgaaguguacugaacaaaccaacccugccgaaaagugguggcucacagaagaaaaguagacaagaaaaaaaaaacaaaaaacuaugauacuagcaaauauguuaauagcagcuaauguauauuaaaugcuuacauuguguuuggcacuauacuaagcauuuuauguuaauugaucuuaaaacaauucuaugcaauaaacacuauuauuaucauccccauuuuacaguugaagaagcccucuaggaggucggguuucccuuuaaagaacuuugccccaggcucauuugaauuaauuacccaugucaccgcuuaauauaccaguaauaacacuuaaucuggacagugucuucuuugacguucugucauuaauucaaacgaaauacaauaaa

SEQ ID NO: 17953 - RNA, 506 nt, Homo sapiens
cagcaugccugguccgacccccaguggcacuaaugugggauccucaggacacucucccagcaaagccguggccgcccgggcagcaagauccacuguccggcagaggaaaaaugccagcugugggacaaggagcgcaggccgcacgaccucggcaggcacauggcggauguggcgauucuacacagaagauucaccugggcucaaaguugguccuguuccaguauugguuaugagccuucuguucaucucuucuguauuuauguugcacauuuggggcaaguacacucguuuguagauucaguuacauccaucugucaucugaagaaggaggaaaaaacccaucauuucuuggaccaaaaguauagugacuauccguucaugagagaaauuuucuguaagcuugcuguuuuacaggggauuuaucaauaauugauuuagaggagucaguuuuuuucuauggcuaauaaacuuuuuaauucacuuacaacaacaaaaaagaacaaucu

SEQ ID NO: 17954 - RNA, 8845 nt, Homo sapiens
accggugccggaagagcgguguucagcacagcagcugcuauggagcaaggcagagacagaggugcucaaaugccuagccacugcucacagcggcuccaaucccaagggaucuggcacaagaaggagaggggguuggggcagugggcucaguggggcaggcagccacgauucccuugauccuugaagggcuggcgcacgccagcaucucuuauccccccucccuggggccaggagauguguagguucaagaaccagacguugaaucuucuuguaguccuucccaggaggccggucauggggugaguucuggcguggggggagaggggcagucucagacagcuggccgaaguacggcaggccugcggggccagcguggcgucacggccuacagucccgagguggugcagcagcucugcggccggaugcccaagacaccggauccagacuccagggcgguugcccugggugggccguggguucugaguccgacauggcaagcacacgugcggggguguaguagaggguggggggccuggugcaguccugggaagaguugccguuaccuuggagaccggcuaaagguggcuugaacacuccccccguaggagaagcagcggucaguccugggagggcagccacaguugcuguaggaauuguccacacggccagccccugcugaccagccacuugaccugcaauacugauggggauaagaagagguugaguaacugccccugcuggaaccauaacuccugucagaacuguggcuaaguuuuccugagucaagaccugcaaaagcaaacaagauuucaaaaagaaaagaaaaaauaaaaaaucaacauugacagcgcaaacacugggucucugagacccagcugagcacaaacaaagcauucugagggcgaugggccgaaggccacaugaggauggggaagagccaaacccuagcuggaggcccaaaccugagggggugccuggaccgacuauccugccuucagagaagucgccuaaauccagggcaaggcggcccugcucacaggaugggaagggggcacaggccucccccaccacagccugcugccugccaggccuuccgcgagcccuugcugacaggccccgugcuuaguggccagggaacagggagcagaggcugauggaaccaaguggucaaggccccgcagaggcuaauggaaccaaguggucaaggccccgcagaggcuaauggaaccaaguggucaaggccccacagaggccuccgagaaguuucugaaggaccauacccuuggcuggaugccuuggagucagggaauguagcgaaagggacagggagcucugccugccugcaggauccugaaggcagccucucauggugcuggggccacucccuggcucuaaaugaggacucugaacaauccauuaacucuuacaggcauccacuggagggccggcaaggguauucauucauuuagucauuugauaaacagaaacucuggcugcgugaaagaguuaauguuauuucugcaauccuggcaggcccaaggagaugauucugcaaauguagauccccuuuuccaaaugggccugaucuaggcaggggugaggcuggaugugccuagugggagagucccucccucaagccauagccccuucccuguccugcccccaugaaguucccagauuccauggcuuccccaugcuggcugucccaugccucgcuccugcccccggccuucuguccagcucccgagggcagcccuuaccuggggggcagcuuguacagccaguggcgucagggucugcgaugccugaggcuggcuuggggcuuggcugaagguggcaauggcaguggcagggcucggagggauccccgggggugacuucacuucacaaggcauugagagaaagaaggacaaggagugagccugacgugaguggaggggucaccacagcaguacaugacaucccaucugcagccugaagcggggacccucagccccaugcugcauugcuacauagcccaagaccaauuguuggucuucccuggcccaugaggcagcuuccugaaugcuacgguggugaggacaggaggcuggggagcccugugccagcucugggagguaggccaccccuucucacaucuagcugaagaagauacccaggugaguguuagcccucauuuccuggcccuguaaggacugucacaucaucaacagaggagucugaagcacacgugugucagggagggccggagcuagaaaugaugggagcggcuguccuugguucauccugccacugaaucgcuguucauccaccuccaggguacuuuuggaugcagcugcugaaagggcaggaguuccugaagggcaaaguccuggaagcaacagucccugaaaauuggacaggucugugcugcacuacaggaucacaggggcucuccaggacagccagcuuuucucugcuauucccggaggucuaaagucaugugagcagcuucagugagcuucuaaaugaauuucccgugaccugcagcuuuuugccuucucuugguaccuuagccuacacacguacugggguaccccaccaggaaacuucuucacagccauacaacgaggagaaggguuauuauuuaauauaugguuaguuaaaaggagccuaggaguugagugauggauauaggaccagaucacuggcuucuuuuuauuuuaauuuaauuuuuuuugagauggagucuugcucugucacccaugcuggagugcaguggugugacuucugcucacugcaaucucugccuccggggcucaagggguucuucugcuucagccucccaagcaguugagauuacaggcgcauaccaccacgccuggcuaauuuuuuucuuguauuuuuaggagagauggguuuucaccauguuggucaggcuagucucgaacuccugaccucaagugaugugcccgccucagccucccgaagugcugggauuacaggcaugagucaccgcgccuggccagaucaauggcuucuuaaaacugcugggcauauauuucuaggcuuuaauccaggccuacugaaucagaauguccaguaguggaggcuaguuaccucaccucucuuuuuuccuucaaagcucccccugcgauauggccaagagugggaaccacugaaucagauaaccgcaaagguucuguccaacccugcaguacuaguccauguuucaacuugggaaggcgucaaccucaacucaggacuauacuguucacagcaugcaauaauaaaacccagguaguuuaaggaauucaagagacaagcacacaccaacaaaggccuuaugaaauaguaaaagaaaacaaaaugacagguuuaucuccucuguggagggaagauacauuucuaacuccagaaaaaaaaucaggcugggugcaguagcccacgccuguaaucccagcacuuugggaggcugaggugguagcaucacuugaagccaggaguuaccagaccagccugggcaacaaaacaagaugcuaucucuacagaaaaaauaaaaaugaguuaaaaaaaaaacaaaaaaauuagcaaacauaaggagagucugaacaugugaaaauuuuaaaaacauuuuguuggacaaaaugugacaaagcauaacaaguaagugagaaaaugggaaagugacaaacauaaaugaugaaagcuuacccucuaaagaagcaaaauauucauuuuauuagggcauauuuaguaggaccauggaguccaagguuuuacauacauuagggcugcuauugcuuccugcaagacuguacagaaagacuaaaugaacucacagaaacaucaacaauguaccuguuucuccacagcaccacucaauauaguuguuuuuuuuuuuuuuuuucugagacaaggucucacucuaucacccaggcuggagugcaguggcgcaaucucgccucacuguaaccuccacuucccaagcucaagugauccucccacaucagccuccagaguagcuggaacuacaggcaugugccaccacaccuggcuaauuuuuguauuuuuuuguagagacagaguuuugccauguugcccaggcuggucucgaacuccugagcucgagcaauccacaugccucagcuucccaaagugcugggauuacagucgugagccaccaugccuggccaccaauauagguuuuaucauugcuuauuuauuuucuggcuuaacaggcaacucauaccuuaaagucaauuacuuuucuucucauugauagcaagauuuuauauuuuuccaugaaaugacuuccuccuauguuaauaauuaauuucccuccaaagggaauuuuauuuuauuuuauuuuaauuugagacggagucucacucuguugcccaggcuggaguguaauggcgcgaucucugcucacugcaaccucugccucccggguucaagcgauucuccugccucagacuccugaguagccgggauuacaggcgugugccaccacgcccggcuaauuuauuuauuuauuuuuuuaguaaagacgggguuuugccauguuggccaggcugauuucgaacuccugaucucaggugaucugcccaucuaggccucccaaagugcugggauuauaggcaugagccaccgcgccuggccucaaagggaauuuaguagacuaucacacacagaauuuuuuaaaggaccaauacaaaaacauucaaagcagcacuguuuaugaaaaaugaaaacccagacaauuugacaauggccaaaaccagaagcaggugcgugacucuaugucaauaaaagacauagguacaugaaauuacgugguggugucauacuacuuagucuacccucagcggccacaacaaugaaaauaugcaugugugacaaagacuggauaguaauuuagagugacacaaaccaauagauucuguuuucauccuggaaaaguuuccuguuacucaguuuuguuuuaaaaacaggaaacccuucuuaauacugcacaccuaggaaguuuccaccgcucuaagcuggcagcuuagguggugccaucaaaauaccucccuuaccugcuugauggugacuaaaauuccuuuauagaggaggaggcguuugugaaaggcuuagacacacaaaccccuggaagaagaugcacacuacacaaacacucacgaaaaccauugauuuaagauccauuucugagagcgaauuuggauaaggagcagaauuaaggcaccagaggaaaugagauaugaagauggauaaaugggugaaaagcgaagugagggcaugaugaauaaaccugagaaaccuccccuguuuucugaaaaggggcuccacugcacaauggcuaugcugaauggaaggaguggcagagaugcaggguccuugucuucccugccugguccccagggcacugccccuugggaacaggugaugacccauccuggccucaacauagaagcagagcauuuccaggcuagggaaaaauggucaugucucuugucauuccuuuauccaaaaagaaaagaaaaugacuaagguuacuaggguuccaaagaauuugcauacugaugugaagguagagcaaguaauguguggccaugcaguuucuuguuaaggagcuguugcuuuucggaaguuugcguguucucaugugcucucuucuugccuccucuucuuggcccacccccaccaguccagaucuccagucaagggaagggggaauauacagcagaagucaaggggaaaugaauugggguguucuggggaaacugaaaaaggaggcccaaggcuuccugcagaaggagaugacuacucugcaagguguuaaugaggaagacugaugagagggugccccaaggccagggagcagugccugaucucccacagcucagcggguucaacucccaggugcaacccccuaagcggagcgcuaccagucucuucccaccucacccugauccauccuaguuuaggccuggaagugacacagacuagaacuaaagcuccagaaacaaagaguguagaguagcccucgcagcugaccagaggcacaggcuguccagugggcaggcagacaagacccuaaaaccaccugagccccagggauucaugcuggcuccccagggaccacaggagggacuuggcacucagguggagcaguaccaggugggggugauggccucguaccaguugccucugcagaggagcccagguugucuggcccagcuucaccagcagcuugacuggcuucagcagggucuccgcucugggagcccucggcggccacacccuccaguccuuugcucucuuccucagcagggaguugggcauccacuccgacuuccagcacucggauggucucaugaccugacaucacgaugaccugcaagcagaggacaggggcacuguugggauaggggccaguauagccgcaggguccaaagcucuggguaugguuuggggagagaggggagggcaccucuggaugcagaccuccuguccagagggcugugugcucugugagaauuccagagccuggcgcagguugcagcucccugauuccagggaaggagcugcuggaagaaagcaggcccuggugacagggagaagggccugacgcaagcuagaaaaaugucccccagagccaaaccauuugggagcuaauuucucuuuguuccaucucuuggacucagugcagggagcggcggauggccuauccuacaacuugcaaggauguccucuuggcagcuaggaucuucgaacguggguaugagggcuccuaacaugguauccacagcuuaagucgggccaggaaccaaaucccucuucacuucccuugaaaccaucugaaaguuccccaaagauaaagggauggaaaaugaaugcuccacaaugcugaguaacuucuaucgcccaugauuccuuuauuucgaaaacucuggaguaaaggcucaggauuucccugcaagcuaaauuccugaaacaagggucaagaauccugaagaugcauccucucccucucugccuggcaccgcuccuggacugcagcuuuuuuuuuuuuuuuuuuuuuugagacagagucucgcucugucacccaggcuggaaugcaguggcgcaaucucggcucacugccagcuccacccccccggguucacgccauucuccugccucagccucccgaguagcugggacuacaggugcccaccaccacgcccggcuaauuuuuuuguauuuuuaguagagaugggguuucacuguguuggccaggauggucucgaucuccugaucucgugauccgcccaccucggccucccaaagugcugggauuacaggugugagccaccacgcccggccugacugcagcuuuuuauccuguggcccuguggcuccaguccugccaccugcugugggcaugcucagacuucaagggcaaucuccaugcaugagcgaugcaggcggacccugagccuccucagaacacuuaagucucccuccccugcccagacgacacacacuagcucuucaucaccagcacggaaacccugccaauugggccauucaagaaucagaaacaaagucuguaaauuaaacagcuuugugucaggccucugugcauuuggccugugccugaaaucacucucacaacacacucuuugagccugaaaguggauccagucggaggcugugcuggaaaaagugacgaugugacccaucagcagaauaugagaugagugaaauacauccccaaagcagcucuugugcugccccagcuugcccuaugaggggcuucacuccaauuacauuuucagagaaauucaucuuuucuuuucuuucuuuuuuuuuuuuuuuuuguagacagagucucgcccugucacccaggcuggaguucaguggcgcgaucucggcucacugcaagcuccaccuccugggcucacgcaauucuccugccucagccacccaaguagcugggauuacaggugcccaccaccacgcccggcuaauuuuuguauuuuuuguagagacaggguuucaccauguuggccaggcuggucucgaacuccugaccucaggugauccacccaccucggccucccaaagugcugggauuauaggugugagccaccgugccuggccuuuuuuucuccuuuuaaaaaaugggccgggcgcgguggcucacgccuguaauuccagcacuuugggaggccgaggugggcagaucacgaggucaggagaucgagaccauccuggcuaacacggugaaaccccaucucuacuaaaaauacaaaaaauuagccgggugugguggugggugccuguagucccagcuacucgggaggcugaggcagaagaauggugugaacccgggaggcggagcuugcagugagccgagauugcgccacugcacuccagccugggugacagagugagacuccaucucaaaacaaacaaacaaacaaacaaacaaaaaagauauaaguaauaguaauuugcaaaaaaaaaaaaaaauuagaaaauauguguaagcaagaagaaaaacuaaggaguaaauuaccugauguucaaaccuuuccccauguaaacuuaaacauauuauguacacuuugauuuuacaucuuaaagucacagcuuaacuccccaaacccaggcccugagaaauccuaaauggcaaguaccucuggacaggugaagugauggugaacccugguaagaaacagagagugaagggcccuguggaguccuccucuguugcccacaccccucacuccaucacccuuacccccccacuucccaccccagaagauaccugcucauugacagucagagaugucucugacccggcuccagg

SEQ ID NO: 17955 - RNA, 5119 nt, Homo sapiens
gaggacagaaacgagcaggggguggggccaaggcgagugggcgggaccgcgcggacccucccgcggccgacuggaggcccggagcaggggcggaguuuccggcggcagcgccacucgggcgucgggugacgcuaggcggacggaccaucaugugacacggaaguagcuccgaacaggaagaggacgaaaaaaauaaccguccgcgacgccgagacaaaccggacccgcaaccaccaugaacagcaaaggcaaggaccgaggguggcagaggccgucggggggaguacugcuggcccagagcgagcggauucggagcccagggucaccaaacgccagguuuggggugggcugcgccaugcuccuuggccggcugcaguccagggcgcugcgccugacgccuucgucauacccaaauuacggcagcuugcugccuccaggcccuuuccuccguaaacucuguggcgcaguuuggagcugcgggcucggguggugggggggcuugacaugaugggcauccgcaggagcaaauagagcgcuagcgcaggcauucgcguaggccaauggagagccggcggaggcggggcgccgcgcuccggaacccccagcggggccgaacuuaacuacugaauugcuggaguugguucgugggccggggccugugaggucucuuuuccuucccuucgcacccccucgcccuucgcugacgggaucagaacuucuccccuuuucugugguuguaccagugugucugucggaacaugauucccauaacgcaggaauagguugaggggguaaaaaaggaauagaaaaaaaaaaaaaaaaaaggccgagcgagguugcucacgccuguaaucccagcaguuugggaggucgaggcgggcggaucaccugaggucaagaguucgagaccagccuggccaacguggugaaaccccgucucuauuaaaaaauacaaaaaucagcugggcgugguggcgggcgccuguaaucccagcuacucgggaggcugggguaggagaauugcuugaacccaggagacggagguugcagugagccgagaucgcgccacugcacuccagccugggcaaaagagcgagacuccgucucagaacaaacaaaaaaccaaaccugaucccccgcuuuuccagugaggauauuccuccucaccccucagcccugcacccuuuucccagucucacgguucacuuccaucauucacacccuuuguuuggaagucgaccuugaauaguaaucuguaaggaaaaucagaacugcuguuacccacgaagucugggcugguuguagacaggcuguggagacuaccuagagcagaggcacccuugauaagccagaacagcagcaggccagaaccccagaccuguccugcauuccggagggaacuugggcccagguagacuuaaccccuuacuucgguauguuaguaggagcagugagcagugccuuucuugucucguuagaauccagcaccuuccauuuuaagggugcaaagacaaugcauauuuucuuaguuccaggaaucaggcccucuggggcagacuauuugcaaauccccuucugcuugcucccacuaaguuagcuacccgauaugaccugccucauuuugguagcucuguguaguaggcaaccuucauuuuuuucuugucuuucaggucaauauccaacacagccaaccuacccugugcagccuccugggaauccaguauacccucagaccuugcaucuuccucaggcuccacccuauaccgaugcuccaccugccuacucagaggugcuuccaguuugccagauuugaacuagcugggaauacucuuagggugguccuuuaguccuuagcuaaaucugacuucacauauuuacucuucacaaaugcuaacaugaauaaucuaaaacacuauauaauuuggcaauuuuugucggaguugaaagugcauuauuugaugauuuuguguuauuuggcacaggcuaaggugcagaagaugaauuugcguucugugagcccaacauuagcuauagcagaaagugauccaggagaauauugaaggccaguggaaaggcaacuuguauaaucuuacaaaaaguauaaccugcauaaggagaauuaagaauuagcucauuaaagagaucucaaauaggaaugucauaaaguaacauuuugccuucucuucugccucuucuagcucuaucguccgagcuuugugcacccaggggcugccacaguccccaccaugucagccgcauuuccuggagccucucuguaucuucccauggcccagucuguggcuguugggccuuuagguuccacaauccccauggcuuauuauccagucggucccaucuauccaccuggcuccacagugcugguggaaggaggguaugaugcaggugccagauuuggagcuggggcuacugcuggcaacauuccugugaguaugaccucaucagaagaaacucagcccuuguguauuuuaacuuucugaaaugacuucauauucauucucuuaccauuucuggaugauaguugccaguguugguacaacuacugacauccaauacucaggcagaaaguguuugagggggcagaacuguggcaagugaguagcaucucacugggggcugaguuaaccagauucuuuuguuuucaugucugucgaguccugcuugcugcuuuuccaguucauugugguacacugaacuggucuaguaaugcuccuuauucauuccauaagcauuuaccauuuacuuaauauuugccaucagcaugguguugcacuaggaacccugauaauuaaaaaaguagaauguauaaucccuaguaaguagcuuuuagaaagauauuaacaauuuuaguuaucauuuuuuccuacuuaauuccccagugcgugggauuuagagcucaaaugacugcucaguaacuacaugcuagagaugaagugaaugugucauuagcgagccuucaguuuuccaguaguucauucaaaaacuguguaagggcgaagcacgguggcucaccugaggucaggaguuugagaccaggcuggccaacauggugaaaccccgacucuacuauaaauacaaaaauuagccgggcaugguggcaggcgucuguaaucccagcuacuugggaggcuaagacaggagaaucacuugaaccugggagguggagguugcagugagcugagaucccaccacugcacuccagccugggcgacaagagcaagacucuaucucaaaaaaauuaaaaaaaaaaaaaauuaaaaauuaaaaacuauguagggaccaugugggauucauacauggacuggcacccugucccuguuuugggaaugugaguaggacagugguucucuacccucaaaaugacuguuggucuggucuguucauguucagaagguagccauaggcuucaucuuagagcuggaacccuuugaaugagugguaggcucccuuuccuguuuguaucuuuggguucacauaaaguauagaccuacuuuagaacucaaauugguggcggaacuagcuccuuaaaacgcagcugguuagcacauugccucauccuaacaggccucugcuuccccuauguccccuucgcuuauauuagcugcccugugcccauucuaucaugucauuuccuuucagccuccaccuccuggaugcccucccaaugcugcucagcuugcagucaugcagggagccaacguccucguaacucagcggaaggggaacuucuucaugggugguucagaugguggcuacaccaucuggugaggaaccaaggccaccucugugccgggaaagacaucacauaccuucagcacuucucacaauguaacugcuuuagucauauuaaccugaaguugcaguuuagacacauguuguuggggugucuuucuggugcccaaacuuucaggcacuuuucaaauuuaauaaggaaccauguaaugguagcaguaccucccuaaagcauuuugagguaggggagguauccauucauaaaaugaaugugggugaagccgcccuaaggauuuuccuuuaauuucucuggaguaauacuguaccauacuggucuuugcuuuuaguaauaaaacaucaaauuagguuuggagggaacuuugaucuuccuaagaauuaaaguugccaaauuauucugauuggucuuuaaucuccuuuaagucuuugauauauauuacuuguuauaaauggaacgcauuaguugucugccuuuuccuuuccaucccuugccccacccaucccaucuccaacccuagucuuccauuuccucccgccagucuccauugaaucaauggugcaggacagaaagccagucagacuaauuuccuucuuuccucgcacuucuccccacucgucaucuuuuaacuaguguuucacaaggauccucugaaacccucucugugccccaaguacagaugccauuacuucugcuuucguaucuccucaggcaaaaguggagggugccuuaugggcccuccucauagguugucucugcauacacgaaccuaacccaaauuugcuuuggugccagaaaaacugagcuauguuugaacaaagaugucgugcaaacuguacugugaacaacaguugguuuaaaauaugaggggcaaggaggaggaugcauuucaaaagcuugauugauguguucagagcuaaauuaagaggaguuuucagaucaaaaacugguuaccauuuuuugucagagugucugaugcggccacucauucggcuccccagaauuccuagacuggguuaauagggucauauugugaaugucucacuacaaaaugacuugaguccagugaaaucucauuaggguuuaagaauauuucagggauccuuaauguuuugauuuuuguuuucugaaauuggauuuuauuuuauuuuaucuuauaauuucaguucaucuaaauuguguguucuguacaugugauguuugacuguaccauugacuguuauggaaguucagcguuguaugucucucucuacacuguggugcacuuaacuuguggaauuuuuauacuaaaaauguagaauaaagacuauuuugaagauuugaauaaagugaugaaguugcauuacaccucac

SEQ ID NO: 17956 - RNA, 5119 nt, Homo sapiens
gugagguguaaugcaacuucaucacuuuauucaaaucuucaaaauagucuuuauucuacauuuuuaguauaaaaauuccacaaguuaagugcaccacaguguagagagagacauacaacgcugaacuuccauaacagucaaugguacagucaaacaucacauguacagaacacacaauuuagaugaacugaaauuauaagauaaaauaaaauaaaauccaauuucagaaaacaaaaaucaaaacauuaaggaucccugaaauauucuuaaacccuaaugagauuucacuggacucaagucauuuuguagugagacauucacaauaugacccuauuaacccagucuaggaauucuggggagccgaaugaguggccgcaucagacacucugacaaaaaaugguaaccaguuuuugaucugaaaacuccucuuaauuuagcucugaacacaucaaucaagcuuuugaaaugcauccuccuccuugccccucauauuuuaaaccaacuguuguucacaguacaguuugcacgacaucuuuguucaaacauagcucaguuuuucuggcaccaaagcaaauuuggguuagguucguguaugcagagacaaccuaugaggagggcccauaaggcacccuccacuuuugccugaggagauacgaaagcagaaguaauggcaucuguacuuggggcacagagaggguuucagaggauccuugugaaacacuaguuaaaagaugacgaguggggagaagugcgaggaaagaaggaaauuagucugacuggcuuucuguccugcaccauugauucaauggagacuggcgggaggaaauggaagacuaggguuggagaugggauggguggggcaagggauggaaaggaaaaggcagacaacuaaugcguuccauuuauaacaaguaauauauaucaaagacuuaaaggagauuaaagaccaaucagaauaauuuggcaacuuuaauucuuaggaagaucaaaguucccuccaaaccuaauuugauguuuuauuacuaaaagcaaagaccaguaugguacaguauuacuccagagaaauuaaaggaaaauccuuagggcggcuucacccacauucauuuuaugaauggauaccuccccuaccucaaaaugcuuuagggagguacugcuaccauuacaugguuccuuauuaaauuugaaaagugccugaaaguuugggcaccagaaagacaccccaacaacaugugucuaaacugcaacuucagguuaauaugacuaaagcaguuacauugugagaagugcugaagguaugugaugucuuucccggcacagagguggccuugguuccucaccagaugguguagccaccaucugaaccacccaugaagaaguuccccuuccgcugaguuacgaggacguuggcucccugcaugacugcaagcugagcagcauugggagggcauccaggagguggaggcugaaaggaaaugacaugauagaaugggcacagggcagcuaauauaagcgaaggggacauaggggaagcagaggccuguuaggaugaggcaaugugcuaaccagcugcguuuuaaggagcuaguuccgccaccaauuugaguucuaaaguaggucuauacuuuaugugaacccaaagauacaaacaggaaagggagccuaccacucauucaaaggguuccagcucuaagaugaagccuauggcuaccuucugaacaugaacagaccagaccaacagucauuuugaggguagagaaccacuguccuacucacauucccaaaacagggacagggugccaguccauguaugaaucccacauggucccuacauaguuuuuaauuuuuaauuuuuuuuuuuuuuaauuuuuuugagauagagucuugcucuugucgcccaggcuggagugcaguggugggaucucagcucacugcaaccuccaccucccagguucaagugauucuccugucuuagccucccaaguagcugggauuacagacgccugccaccaugcccggcuaauuuuuguauuuauaguagagucgggguuucaccauguuggccagccuggucucaaacuccugaccucaggugagccaccgugcuucgcccuuacacaguuuuugaaugaacuacuggaaaacugaaggcucgcuaaugacacauucacuucaucucuagcauguaguuacugagcagucauuugagcucuaaaucccacgcacuggggaauuaaguaggaaaaaaugauaacuaaaauuguuaauaucuuucuaaaagcuacuuacuagggauuauacauucuacuuuuuuaauuaucaggguuccuagugcaacaccaugcugauggcaaauauuaaguaaaugguaaaugcuuauggaaugaauaaggagcauuacuagaccaguucaguguaccacaaugaacuggaaaagcagcaagcaggacucgacagacaugaaaacaaaagaaucugguuaacucagcccccagugagaugcuacucacuugccacaguucugcccccucaaacacuuucugccugaguauuggaugucaguaguuguaccaacacuggcaacuaucauccagaaaugguaagagaaugaauaugaagucauuucagaaaguuaaaauacacaagggcugaguuucuucugaugaggucauacucacaggaauguugccagcaguagccccagcuccaaaucuggcaccugcaucauacccuccuuccaccagcacuguggagccagguggauagaugggaccgacuggauaauaagccauggggauuguggaaccuaaaggcccaacagccacagacugggccaugggaagauacagagaggcuccaggaaaugcggcugacaugguggggacuguggcagccccugggugcacaaagcucggacgauagagcuagaagaggcagaagagaaggcaaaauguuacuuuaugacauuccuauuugagaucucuuuaaugagcuaauucuuaauucuccuuaugcagguuauacuuuuuguaagauuauacaaguugccuuuccacuggccuucaauauucuccuggaucacuuucugcuauagcuaauguugggcucacagaacgcaaauucaucuucugcaccuuagccugugccaaauaacacaaaaucaucaaauaaugcacuuucaacuccgacaaaaauugccaaauuauauaguguuuuagauuauucauguuagcauuugugaagaguaaauaugugaagucagauuuagcuaaggacuaaaggaccacccuaagaguauucccagcuaguucaaaucuggcaaacuggaagcaccucugaguaggcagguggagcaucgguauaggguggagccugaggaagaugcaaggucugaggguauacuggauucccaggaggcugcacaggguagguuggcuguguuggauauugaccugaaagacaagaaaaaaaugaagguugccuacuacacagagcuaccaaaaugaggcaggucauaucggguagcuaacuuagugggagcaagcagaaggggauuugcaaauagucugccccagagggccugauuccuggaacuaagaaaauaugcauugucuuugcacccuuaaaauggaaggugcuggauucuaacgagacaagaaaggcacugcucacugcuccuacuaacauaccgaaguaagggguuaagucuaccugggcccaaguucccuccggaaugcaggacaggucugggguucuggccugcugcuguucuggcuuaucaagggugccucugcucuagguagucuccacagccugucuacaaccagcccagacuucguggguaacagcaguucugauuuuccuuacagauuacuauucaaggucgacuuccaaacaaagggugugaaugauggaagugaaccgugagacugggaaaagggugcagggcugaggggugaggaggaauauccucacuggaaaagcgggggaucagguuugguuuuuuguuuguucugagacggagucucgcucuuuugcccaggcuggagugcaguggcgcgaucucggcucacugcaaccuccgucuccuggguucaagcaauucuccuaccccagccucccgaguagcugggauuacaggcgcccgccaccacgcccagcugauuuuuguauuuuuuaauagagacgggguuucaccacguuggccaggcuggucucgaacucuugaccucaggugauccgcccgccucgaccucccaaacugcugggauuacaggcgugagcaaccucgcucggccuuuuuuuuuuuuuuuuuucuauuccuuuuuuacccccucaaccuauuccugcguuaugggaaucauguuccgacagacacacugguacaaccacagaaaaggggagaaguucugaucccgucagcgaagggcgagggggugcgaagggaaggaaaagagaccucacaggccccggcccacgaaccaacuccagcaauucaguaguuaaguucggccccgcuggggguuccggagcgcggcgccccgccuccgccggcucuccauuggccuacgcgaaugccugcgcuagcgcucuauuugcuccugcggaugcccaucaugucaagcccccccaccacccgagcccgcagcuccaaacugcgccacagaguuuacggaggaaagggccuggaggcagcaagcugccguaauuuggguaugacgaaggcgucaggcgcagcgcccuggacugcagccggccaaggagcauggcgcagcccaccccaaaccuggcguuuggugacccugggcuccgaauccgcucgcucugggccagcaguacuccccccgacggccucugccacccucgguccuugccuuugcuguucauggugguugcggguccgguuugucucggcgucgcggacgguuauuuuuuucguccucuuccuguucggagcuacuuccgugucacaugaugguccguccgccuagcgucacccgacgcccgaguggcgcugccgccggaaacuccgccccugcuccgggccuccagucggccgcgggaggguccgcgcggucccgcccacucgccuuggccccacccccugcucguuucuguccuc

SEQ ID NO: 17957 - RNA, 1900 nt, Homo sapiens
caaaguucccuccaaaccuaauuugauguuuuauuacuaaaagcaaagaccaguaugguacaguauuacuccagagaaauuaaaggaaaauccuuagggcggcuucacccacauucauuuuaugaauggauaccuccccuaccucaaaaugcuuuagggagguacugcuaccauuacaugguuccuuauuaaauuugaaaagugccugaaaguuugggcaccagaaagacaccccaacaacaugugucuaaacugcaacuucagguuaauaugacuaaagcaguuacauugugagaagugcugaagguaugugaugucuuucccggcacagagguggccuugguuccucaccagaugguguagccaccaucugaaccacccaugaagaaguuccccuuccgcugaguuacgaggacguuggcucccugcaugacugcaagcugagcagcauugggagggcauccaggagguggaggcugaaaggaaaugacaugauagaaugggcacagggcagcuaauauaagcgaaggggacauaggggaagcagaggccuguuaggaugaggcaaugugcuaaccagcugcguuuuaaggagcuaguuccgccaccaauuugaguucuaaaguaggucuauacuuuaugugaacccaaagauacaaacaggaaagggagccuaccacucauucaaaggguuccagcucuaagaugaagccuauggcuaccuucugaacaugaacagaccagaccaacagucauuuugaggguagagaaccacuguccuacucacauucccaaaacagggacagggugccaguccauguaugaaucccacauggucccuacauaguuuuuaauuuuuaauuuuuuuuuuuuuuaauuuuuuugagauagagucuugcucuugucgcccaggcuggagugcaguggugggaucucagcucacugcaaccuccaccucccagguucaagugauucuccugucuuagccucccaaguagcugggauuacagacgccugccaccaugcccggcuaauuuuuguauuuauaguagagucgggguuucaccauguuggccagccuggucucaaacuccugaccucaggugagccaccgugcuucgcccuuacacaguuuuugaaugaacuacuggaaaacugaaggcucgcuaaugacacauucacuucaucucuagcauguaguuacugagcagucauuugagcucuaaaucccacgcacuggggaauuaaguaggaaaaaaugauaacuaaaauuguuaauaucuuucuaaaagcuacuuacuagggauuauacauucuacuuuuuuaauuaucaggguuccuagugcaacaccaugcugauggcaaauauuaaguaaaugguaaaugcuuauggaaugaauaaggagcauuacuagaccaguucaguguaccacaaugaacuggaaaagcagcaagcaggacucgacagacaugaaaacaaaagaaucugguuaacucagcccccagugagaugcuacucacuugccacaguucugcccccucaaacacuuucugccugaguauuggaugucaguaguuguaccaacacuggcaacuaucauccagaaaugguaagagaaugaauaugaagucauuucagaaaguuaaaauacacaagggcugaguuucuucugaugaggucauacucacaggaauguugccagcaguagccccagcuccaaaucuggcaccugcaucauacccuccuuccaccagcacuguggagccagguggauagaugggaccgacuggauaauaagccauggggauuguggaaccuaaaggcccaacagccacagacugggccaugggaagauacagagaggcuccaggaaaugcggcugacaugguggggacugug

SEQ ID NO: 17958 - RNA, 2557 nt, Homo sapiens
aguccaaauaagaacagaaggcagggaaaggcauuaaagcucagggaccaaaaggccagggacgcuggagagccagggauggagacagaagcacagagggugagggauggagagcuggggagggaggggcaggagagaaacagggccagcauggggugggcaggggugucagcgacaaagcaaaagggagagaaaaccaagagaaugcagagaaugggauggagagagugagggagaaggagggugccauucagauagcgaggagacaaaagcguuguggcaagagagcaggaguucuuaaggccccgggugccagcccaugccggaucugcccggucugccgggcggagauggcgagcuuccaguccacaauaaauaggaaaaaccugaguacacggcgcauauggcaucugccuggcagaagcauuuuccuucccacgaaaaaaaaaauauccaccggcagaccccuccuguccccgaucccacauucaccacuccagccccugccagccggguuuagucagugacaucccucccacgcggaggcggcggggacggagggacugcggcucccgcggccucccccgcgcgccgucaguguccggagccguacauuuugucccacuccacgaacgaguccaguuccuuggcagaggcccuagggcccaccuuggccagcgccgccuccagguccuuguaggagagggggcgcugcagccccgggaggcccgccccggccgccgccugcuggcacagcugccccagcucgcccccagagaagcccugcgugcccugcaccagcgccgccaguucccgcucacugagcgcgcagcccugcugggccagcgcccgcugcaggaucugcccgcgggccgggcugucgggcagcgccacguagaagcggagagagaagcgccggcgggucgccucguccagagccgcgggccgcgagguggugcccacaaccagcacgccgucagcccccgcgccgcagcccccguccaggcaggccaggagcggcaccugcagcgcgcccccugccgccgcgccgucgucccgggcggggagcagcgccucuagcucgcugaugaggaguacggagggugggcggcagcgcgcggccgcgaaggcggccuggaggaggcgcgcgcccucggcggcgccgggcgcagccagggucgcgccgcgcaggcgcaacagcguggcgcccagcugcguggcgaggcagcggcccagcagcgcuuugcccgcgccccgcggcccaaagagcaggacgguccgcggcgggcgcaggcugcccggguaggcgggcggccugagcaggggccacaccagcuccuccuccagcgccgccuugagcgcgcccuggcccgccacauccgcccacugcaccgggggcccgcaguccaccaucuugcucgucaccagcuccagggccccaggguccacgccuuugggagucucccccgacggcacggcgaaccccccacgaggagccggggcccgcuccgggaacuuuucaaagggcuccaguugcgggccguagacgggggagcccaggaccuugagggggacgccgccaccguacuugcccgacgccuccuccgcggcuccuggcggcuuggcccggaacccguugccccgacauucgccguuguccgcggcgggguaggaggcuccgucagccacgggggccuuggcgggcucguacgcguacuugcgguagcggcccucgggccccucgucggcggccuugcgcuucagcgacagcccggauucggcacccggcgcggccguggggaagccauaggcggugggcggugccggcgcgggcaggggcgugggcgcgggcaggcccggggucagguagggggccgggggugggccugggggcggcgggagcgcgccauagccgggcugcgcugcguagcccccugcgggauaguuguacagcggcgcugagggcccguaccccggaggcggugggggcugcaggagcgcggccgggggcggcgggggcagcgcggcgcccgucugcgcgcaguaacccggcgccagguaccccccgccguagccggccgcguacucgggcgccgccgaugggcccccgcacgcauugccggcguagagggguucagggagguucccggcuaaaacuggggagccccccagggccccggaaccgccgccaccgcccgauuugguuccugggaggccuucguggagugaggccaagggguaggguggcuccggcccuggccagggcucgggauccccuuuggcgccguugaggaaggaggcgucgcuguacccgcccagggccggacgcucguagggagaauccaagaccccagaguacuucucugcauagcgcuuuaggagguuggaggcagugagggcugagaugucgucgugugcccaagcguaguggcagcguuggcgacccccagggggcaacuccaacuugugggccggcgacggggugguggaggagacguccaggugcugcucuggccacugguugaggggcugggcguguucugguguccagugcauc

SEQ ID NO: 17959 - RNA, 2557 nt, Homo sapiens
gaugcacuggacaccagaacacgcccagccccucaaccaguggccagagcagcaccuggacgucuccuccaccaccccgucgccggcccacaaguuggaguugcccccugggggucgccaacgcugccacuacgcuugggcacacgacgacaucucagcccucacugccuccaaccuccuaaagcgcuaugcagagaaguacucuggggucuuggauucucccuacgagcguccggcccugggcggguacagcgacgccuccuuccucaacggcgccaaaggggaucccgagcccuggccagggccggagccacccuaccccuuggccucacuccacgaaggccucccaggaaccaaaucgggcgguggcggcgguuccggggcccuggggggcuccccaguuuuagccgggaaccucccugaaccccucuacgccggcaaugcgugcgggggcccaucggcggcgcccgaguacgcggccggcuacggcgggggguaccuggcgccggguuacugcgcgcagacgggcgccgcgcugcccccgccgcccccggccgcgcuccugcagcccccaccgccuccgggguacgggcccucagcgccgcuguacaacuaucccgcagggggcuacgcagcgcagcccggcuauggcgcgcucccgccgcccccaggcccacccccggcccccuaccugaccccgggccugcccgcgcccacgccccugcccgcgccggcaccgcccaccgccuauggcuuccccacggccgcgccgggugccgaauccgggcugucgcugaagcgcaaggccgccgacgaggggcccgagggccgcuaccgcaaguacgcguacgagcccgccaaggcccccguggcugacggagccuccuaccccgccgcggacaacggcgaaugucggggcaacggguuccgggccaagccgccaggagccgcggaggaggcgucgggcaaguacgguggcggcgucccccucaagguccugggcucccccgucuacggcccgcaacuggagcccuuugaaaaguucccggagcgggccccggcuccucgugggggguucgccgugccgucgggggagacucccaaaggcguggacccuggggcccuggagcuggugacgagcaagaugguggacugcgggcccccggugcagugggcggauguggcgggccagggcgcgcucaaggcggcgcuggaggaggagcugguguggccccugcucaggccgcccgccuacccgggcagccugcgcccgccgcggaccguccugcucuuugggccgcggggcgcgggcaaagcgcugcugggccgcugccucgccacgcagcugggcgccacgcuguugcgccugcgcggcgcgacccuggcugcgcccggcgccgccgagggcgcgcgccuccuccaggccgccuucgcggccgcgcgcugccgcccacccuccguacuccucaucagcgagcuagaggcgcugcuccccgcccgggacgacggcgcggcggcagggggcgcgcugcaggugccgcuccuggccugccuggacgggggcugcggcgcgggggcugacggcgugcugguugugggcaccaccucgcggcccgcggcucuggacgaggcgacccgccggcgcuucucucuccgcuucuacguggcgcugcccgacagcccggcccgcgggcagauccugcagcgggcgcuggcccagcagggcugcgcgcucagugagcgggaacuggcggcgcuggugcagggcacgcagggcuucucugggggcgagcuggggcagcugugccagcaggcggcggccggggcgggccucccggggcugcagcgcccccucuccuacaaggaccuggaggcggcgcuggccaaggugggcccuagggccucugccaaggaacuggacucguucguggagugggacaaaauguacggcuccggacacugacggcgcgcgggggaggccgcgggagccgcagucccuccguccccgccgccuccgcgugggagggaugucacugacuaaacccggcuggcaggggcuggaguggugaaugugggaucggggacaggaggggucugccgguggauauuuuuuuuuucgugggaaggaaaaugcuucugccaggcagaugccauaugcgccguguacucagguuuuuccuauuuauuguggacuggaagcucgccaucuccgcccggcagaccgggcagauccggcaugggcuggcacccggggccuuaagaacuccugcucucuugccacaacgcuuuugucuccucgcuaucugaauggcacccuccuucucccucacucucuccaucccauucucugcauucucuugguuuucucucccuuuugcuuugucgcugacaccccugcccaccccaugcuggcccuguuucucuccugccccucccuccccagcucuccaucccucacccucugugcuucugucuccaucccuggcucuccagcgucccuggccuuuuggucccugagcuuuaaugccuuucccugccuucuguucuuauuuggacu

SEQ ID NO: 17960 - RNA, 45434 nt, Homo sapiens
agccgggccgcgggaggaggggaggcgccgggggcgcgcgcgcgcgcgcugggcgcugcugggcugcggcggcggcggcggcggcggugguuacuauggcggagucggccggagccuccuccuucuucccccuuguuguccuccugcucgccggcagcggcggguccgggccccgggggguccagggugaguccugggacggggggcgggggccgggauggagagggcccggcaagggcgaggccucgagccgcggccgcuggacuacagcgcgcccccuccccacgagcacaauauggccggguggggggcgcagaggagucggggugacccccagucagcuuccccgaucuccgaggcgcagccgcccggcggcgacggagcucacgccgggccccuggggacccgagcccuguuccaggcggaacuggauucgggcaguucucaggggucgcgcucccagcgcccucguguuccagagaggggagucugagccuccagcuccaagauuuggagguccgugguuucugcccuucaccguguccaggggcggggggcuuucuucccucccuccaggugcuccuggggggcgucuuucucccgccaagacugugggguucgggcgguggggucuuagccucuccgagggaaccugauguugagaguccgcgcaccucagacuguaggggaaggggucucuaaccuuuccuucagguccugcacuuggcguguuucuuccccucccuccacugccucccuaauguucugggaaagggagucacauuuccccuucacucaaucccuugaguucaguggggcaauccccccuccgcccuccggcacucaugccccguggaggcuauuuggaggaagugggacgaacaggccccuaaaccuuuuuggagccuggcuuuggaaucccuaacccuauggaaccgaguuccccaaggguugaugugaaucuagguguauuugcuuuccuccucgccucccccacccuaccccggggggcccauucaguuaaucacuuuguggaugccuuucaggugaaauccuggaaccugucuccaaacccccaagauuauuuaaagaucccaccacuggacuguauucccggcccuuggucaguacuuauuuaccuuccuacacgaugccucuucccagcccgcccacccucacacaccccuuaccucccaauccccacagucugcggcucgccuuauaccacccccccacucuccucucuguagaagcggguaccuuuuugcgggacacuucgcuggcuguguuguuuuugaggcuuugggggcugagaagagcagaugaaacccuaaaauauuucauuuaagagagucuuggcgaauguguuuuggccuugggguagcagaugaagguuauauuuggcaguuauauugaagcgauuauugacccacagauggaucugggagagaugaucaggauuguauucgcuccugacguacaaagccugaugcuuugacuucucagcagccccuaaccuuccagcaaugggagauaaaguguguucuguggcucucuucucuuacacuaaaaauaaugauucucagguggguucagucgucuuuaauaaaccagacagucaagaaaagacaccaugccacuuuggaaucucaaaaacaaguucauuaucuccggcuuugauauuuguucccagugguggagccugugcagcggggucuuuguucacgggcuaaugcuucuccuaagcaccucguguguguucuucggccucacugcucuguggcuuagguaucugugcugugggguuugagaaacauggugaagguguaugaacagagcuugacauuuguggugagauaaugauuugcaugaauaaggauguucgucgggccuuauuaagggccauguuuuuggaauguguaacauaauguucucuacuggguaguaaaaaaaaaaaaaaagggagauugaaccucuagguuugucauuuuauguguguauguauaaaucuuuaaauccucauauaggaauuuuuauccugccccuaauauauccaggauuuuuaacagucauuucccugcugauuugauguaguguuugugggguuuuucugguugugagccuaguuaagaauguuugauaauccaagugguucugaauggggcagaguucauuuuuuuguaaccuuccuaaaauggauguuuguggggguuaaggugggugaguaaaauagggaguucguuucuuuuuuugguaaauuggaaauuagguuguguguccagcaaacauucuccagggccuuuaaacuucuuggccagacacuacaguuuuuuccaggacacgucuaguugccaauaguguaugcuauggagaccacugcugcaaagggcuuaaaguaaaacgucaguucugggaaaauagaggcugugggauaacaagaaguugauuuuuuuccccuccccugcauuuccuauauagugcuccccuacgugggcuggaggagugacagagccagacagcucugaugccugauacuuggacuugaugugaggggcaguaagggauagguguuucuauuaauuaaugaauuaacuaggacuuaguaaaaggccagugauaaggagaaugaguuucaguuagaaauagcauccguuugauagguguacauguuuuaaggccuggcuuuggaauuuucacauuuaaaaauguaaaauugaguuaguagcaggagaacaugacauucauuucucaagacaaaagcaacaagagagauauuugacauucucauaggaacauuuugaaauuuugugagcggacuaaaaaucuaauuucaagccaagccuuguaauuuuguugaguggacauggauuuuaaguacaguggaagugcagucuuguagagaccucugauuaguuuuguuuaaacagcuccuggaacagaugugauaaaacauauuaaaauggcuacucugguuaaagguuaaagccagauggagggaggaggcugguuuucagcccuagaacuuagcugccuuacaaguuguccuugaacaaguaacuuaaccuuucugugacugccucaguuuucccucuguaaaaauaaggaaauauuuugugucacucuuauugggacauuugugagacugacuuacugauagccaguuggcggggagguauuuuuagacacaguuucugacuucagugaauaagcaaugcuggguuacuuuuuuaucuuaaggagcagaaaaacauacucugugauugauagacguacagcaugucacagugugguuuucuuuuugugcuuuuuuguagaccccuuucagauuuccucaaguuaauuucugucucuggcaggcucuuacaucgucgacuaggcagcauaccugugcuaaucaaagacagucuggagggagugaccugcuuuaggcuuuauugguuuggcaacguuuuaauucuuacgcaacucuggguauguuuauggcacuauguaaauguuacauaagaacauggaggcugagaaguggccagaauggugacugugaacacaggaagguuagacugaggacuuuauccaaaaggaccuugggaaucugcaaucaguacaggaagaaccugcacuuauuuuccucuaagaaccuuuuuagaugauuaugucuuucagguggacugcuguguuauaaauagguuuauucuccaccggugagcuaauuguaaccuugcuaccaaaauaugaaucaguaaacgaugagacgugcugcuucuuccagcauguccuguugaagcugcuuguugcauuuuggaacaugaguugaauuggguugcagucuguucucauaauagcugaggagcacaggguguugagguggaauggaauuaucaguucguggugcuuuaggucaucuuaauuuuugaagguuaaauuagaauacugaaguggcucuuuauaauuuugaaaucucuauuguuuacuguucaauuuuugcucagaguagcagugaacauuaauucugggaucucgccuguuugucuucaguucuuguguuagcuguuguuguaggaguugguguaagagggucuuaaucucauuuuccucucuguauucauaaaaagggaauccuagaguccuuucucaccagugcuucugaugcuggacauaacugcaggcagccacagcccaucaguuccacuuggacugggaaugcgggaaccuuuuaaguccaacuuacauuucucucacucugcaggcacugccucauggccagguucagauaccugcucugaguuucuguucucaguuuuucacucucaugcagguuuaacuugagcuuuggcuucagaggcaccauuucuguccaugucugcucucucuccucuguuauggagaaauggugugcuaagcaaaaauaugauuucagagaguaucuuucuuuccuuuacucuguagaguugccauacuuugguuuagcugugaaguuuccaucccaggcaaucuuuaucugcucucuaggguucagagacagugccacuuuaggcaacucugggcuuuuugguuuucuuuaguguccacccagucuuaagccugcauuugucucccuaaauauuuugaauuuagcauaaugaaaguaacugccuuucccuuuaaaccauaacaucacaccuaauauuuacacaguuaacauauaggagauuucuuuauucauuggauuggguaugugccuggaacaguuuuuggcauggggaaauaacagagaacaagaugaacaaaagucccuaaaucucuauuauggaacuuauaauugcaauggcuuagacugaaaauaaauaaguaaacacaauuaucaguccaugagugcugugaagaaaauaaaacaggaugcugugccauagugugccuggagcugccacuucaccucucuaucagcuucauuguuuuaucuguaaaauggggcuaauacagucuuguuauuugugguaguuccauaaaguugaauuguagaacugaauuaccaaaucuucaaccauugcuccuaggggaaauacagggcuagguuccugcgagccucuggucacuuuuucaaccugucaauacauaaccuuauuuuauguguuucuuuuuuuuucuuuuuuugagacagggucuugcucuguugcccagguuagaguccagugacaugaucucacucacugcaguuucugccucccaggcucaagcaauccucccaccucagccuccugaguagcugagaccucagguguacaccaccacaccuggcuaauuuuuguauuuauuuacuuuuugguagagacaggguuucgacauguugcccaggcuggucuugaacuccugggcucaagcaauccacucaccugggcuucaccugcugagauuacggguaugagccacugaaccuggccuguuucauguguuucuguuuauuuuuauuuuuaauuuuuauuuuuuugagacaguguccugcucugucacccaggcuguauaguacgagaguguaucauaggccaggcacaguggcucacgccuguaaugccagcacuuugggaggccgaggcagguggaucaugaggucaggaguucgagaccagccugacaaacaugcugaaaccccgucucuauuaaaaauacaaaaauuagccaggugugguggugugccuguaaucccagcuacucaggaggcugaggcaggagaaucacuugaaccugggaggcagagguugcagugagcggagacugcgccacugcacuccagccuaggcaacggagugagacuccgucaaaaaaaaaaaaaaaaaaagccaaaaacaucauagcucacugcagccugaaacuccugggcucaaggaauccuccuuugucagccucccaaguggcuaggaucacacgcacaugccaccauacccggcuaauguuuaaauuuuuuguagagauggggucucacuuguugcccaggcuggucucaaauuccugggcucaaauuauccuccugccuuggccucccaaagggcugggauuacaggccugagcuaccaugccuggcuuuguuucuguuuaaagacaccuuauuuaauauauauuguugguucauuaacauugaacuuuacugacagcagcacuauuaacucaugccugaacuaagcuucucuaacauguauuuucucugugaggcauaucacuaucuucuugcacuuaggaacucuagacagcacuucagcacuacuugugggggaccauuuuauacagcaaaaucaucaaugaaaagcaugacacuaaauauacugcagaaaggauaacuuguuuacaguaugccagcugaaacaagaaggcaggguguugccuuguuugaccucaguugggaaugcaugugguggguguuucagauguuucacuauucugugcauggcugucagugagcaggaagguaccaugaauguugauauugggguuacaaauaaauuugcauuaaccauauuuuguuagaacuguauacaaaagugguagaaauaaaauuguagaauuucacuaaaccagaauuuuaauacauguaguuagaagucccauuuccagacugcaaacuaaacauaugcauguugaguaccuaccauggugaucuagggcagugguccccaaucuuuuugacaucagggacugguuucguggaagauaauuuucccacaggggaaguaggggagauaugauuuugggaugaaacuguuccaccucagaucaucaagcacaucaggccgagguggguggaucaccugagguugggaguucaagaccagccuggccaacauggugaaaccccaucucuacugaaaauaaaaaauuagccgggcaugguaguggcagcgcaugccuguaaucucagcuacucaggaggcugaggcaggagaauagcuugaauccgggaggcggagguugcagucagccgagaucacgccacugcacuccagccuggggaacagagugagacuccucaaaaaaaaaaaaaaagaaaagaaagaucaucaggcacaucaagcauguuagauucucauaaggugcaugcaagcuagaugccucgcaugcgcgguucaccguagguuucccacuccuaugagaaucuaaugccgccgcugaugugacaggaggcagagcucagguacccgccugccacuuaccuccugcuguguggccugguuccuaacaggccguggaccaguaccggucuguggccccagggguuggggaccccugauccaaagggucccuugacacauauuuauugagcaccugucauauacuaggcauuguugcagguguuagggauacaguaguaaacgaaaggagacaaaauugccuucucucagaaagcuuaccuucugccaggugagguggacaauaaacaaaaguauaaaauguaaagcaguugugccuacuacaguccaccuucugcuccucacuuccccaagauuccccauguuugguguacacacaccugcuucagguauucagucaaaugcuagucuuuguagauagaauuaaggucucaaucaguugaccuuuagccaucuaaaggagguuaucauggugggucugucuugauugaacuagcccuuucaaagcagagagauuucucagcugauugcacaagaggaaaucagauguuccagcuggcuuggaagcaagcagacguccauguugugaacugccgaucccaacagccacauggcaaggaacugcaggcaaacucuaggagcugagagugguucccagcugacagcuaggaggaacauggggaccucaguccuucaucugcaaggcaguggaucuugucaacaaccaguaagcuuggaggaggacccaauccuagaugagaaggcagcccuaacuggcacugucggugcugugccuggacuucugaccuguaggaacugugaaauaguaacuagguggugguuuaaaaaauguaugcauugggugggggugagucaaauggugauggugaaaauagguaaagcaagagaggggaauaaugagaaauaccccaagauaggcaugaggguacuugagaccuggugcccagccaucccaucacucacauauaaaaauaaauccuuugaccacauguggcuuucaucugacuauaacuuuuuucuagauauuugugaguggaggggagaggggauuguggaugcuuuggaaauaaguuuuuuaggugcuugggauguuugaguugaggaaucugggaauugaaguauuuucuggguuuuuuuuuuuuuugugguagaggacucaccuugccccacauccuuguauauugcuuugguauauguuugcauauuaccuuuuauaccuguagaagauaagauugaauuguaaucagucaguguucauuucugauauccaggaugugccuagcaccaagcugaaugcugagagggauccugaggaaagagucuguccuugcccuuuggaaguuuacacacagagaccggccacaguggcucaugccuguaaucccaacacuuuggagaaugagguacaggggaucgcuucaguccaggaguuugagacuagccugggcaauauagugagaccucgucucuacaaaacauuuuuaaaaauuacaagggcuugguggcgugugccuguggucccagcuacuugggaggcugaggugggaggauagcuugagaccaggagauugaggcuacagcaaaccaugauugcaccacugcacuccacccugggugacagagugagauccugucucaaaaaaaaaaguuuacacacaaauggacuuuuuuucugcuuguuggaacuaccacaaacuaugaggaguucaggugacaauuguaauaaaagcaucugauuugcugaauguuuacuauauacuaaaguauuaugcuaagcaccuguguuguaucauuuacucuauguaguuauucuuugaggggcuaggggcucuuauucccauuuuacagaugagaaaacuagggcauagagaaguuaagcaguggguccaaagucuauccaaguccaaaacaugugcucuaaauauuguacugugcuauaaacugugaguacuguaaaagugaccuucuaaccaggcucucugccuucaaucucccauuuguuuuccauccuacggcuagaucuaacuuuggaaaugcacccuguuugucugaccuagagguuguguggcuucuaggaucaacucuagaccccuuagcuuagcauugcaaucaguuucaucuggucuuagucucccugacucuucuugccuuuggcuggaaccuuggcauuguucgaacugucaauuuacucugaacccaguguagcuaauauuuuuucacagcccuuugcuuucccuuuuccuuuucucuggaaugcuucuccccacuucucuuccuagccaaacccagcguccuccaguguggaccuucguccucuuguguucucccggucagugauuccauccucucugcuuuuccccucagccuguauugguaguuggaguugcacuguuuauaguugucuucucccacucuccaugcccaaagaauuggugcggggagcuggcuuauuuguuauauggcuucggccugcacagagccuugcauguuucaaguacuuaauaaguuuguuuaauugaauuaauucauuucuuuuccauccucucaguaaaauccuagguaaauaauuccaauucuguuuugcucuaauguuauuauaaucuuguauauauaguauuuuaaaccuacucaaaaaaugccgcaaacauuugugaguuacuuggaacaucauaaucucucuuucuaccucaccucuuucaucucuguuuauccuaccaccuacccauuuuauuccagccaaaugaacuugaucucucaaccucauuaguuuuauucucaguuuggcugauuucuuuuuuccuuuuccauugucccaguugccugaaacaaucauuccuaucccucuucucacucaaaacugugacauacacggucuccucuccauucguccauacuauaauaaauaggucaggaagaaaauaccagggauaaauauccuucccugcucuauugagccagaaguauguuuauucagacucaacaaagaaaacagugguuuuacauguucaucauaaacugauaucaaaggagaaaugcaauuuccugauugucuaaauaugacagcugagucugcacacauaggucccaggaacauuggacacacucccucauaaugaggcccacucauuucagucuuaccuugacauucucuugggcagcaggugggcccuugcuagauguucagguauuuacagucagccauaaauuaaguugcaaugacaggucuccuuagcauaaacaucaaacgucucuucugagugagaacaaagcuuucauucucuaacugagacuuaagguugaacuuguuuaaacagcucucuagggcuggguuugucuccaaguagaaugucagaaaggcaguuuguagaauggauauaguguggagcuggcuuuccaaacaccuuucucuuaugcaaaccccauuccaagaccuuuucccagauuggaauuaaauaccaagcuuaucaagugucuuauuguuaaaucuguguuucuccccaccccccaccauacaaauagcuuccuuuauuaagucaguuauauuuuuuuucauaaguacuuuuuaccaguacauuuguuguuguuguuguuguuuuucuguauaccaccauuggcaccuguaaaauuugacuuuauuauggcuuguggguacuugaaagcuuuuuguuuuaauguauuuuuaaaaucuaauuuugaugauuguaaaaggugaaaauguaacuugggucuuuuuuucuuuuaaccaaauagcaugugauugcuuuacugcugcaagauuuuucuauuuaggcuaguuagaacuuugcuaguacaguaucaguuccuaguuauugccuuccugccccccaagaaagccacacauugccucuauuuugugaacaguuuagugccagacauuuuuuaaccugauucagauuuucauaaacauuuuggcaguugucuagaucaguagcuauuaacaauugucuuucuuuuuaagacaguggaacucuuaaaaaugaaaauguagaaauguauauaaagugaguaaaagcugagcaacucuggcagaggccccucugccccugaaauuauuaggcugagaucuguugagugagguuuauugagcacagugcuauuugccaggugcuguacuagauaccagugagaaacuguugaaaaggacacugguuuccucuuugugaguucagagauucccggacacgguggagagucuagagauucaggaagaagauaguuugaaaaacacuguaguuuuuuuuuguuuuuguuauugagaucauauuguauauguuguuuggcaaauagggauuuaugguaguaauuuuaaauuguagcaaaauacguauaacauaaaauguacuauuuuaauuguacaauuuaguaguguuuaaguaccuucauaaugugcaaaccaucaccacuauuuuuuaauuuuaauuuuauuuauuuauuuuuuauguauuuauuuuuuuuuugagacaaagucuugcuccgucacccaggcuggagugccauagcaugaucucggcucauugcaaccucugccucccagguucaagcgauucuccugucucaaccuucugaguagcugggauuacaggcaugcgccaccgcgcccaguuaauguuuuguauuuuuaguagagacgggguuucaccguguuggccaggcugguuucgacuguaagugauccacccaccucggccucccaaagugcugggauuauaggcaugagccaccacgccuggccgacauuucauauacauagaaucuuaauguguggcuucuuucauguaauauaauguuuuugaguuucaucuauauuauagcacguaucaauaguuucuuuucagggcugaauaauauuccaucauaaauauaccacauuuuguucauucaucauuugauggacauuugggugguuuccaccuuuuggcuauugugaauaguacuguugagaauauucauguacaagucuguguuuaaacauuuguuucaguuauuuuguguauaugccuuggaguagaacugcuggguuauaggguaauucuagauuuaacuuauuaaggaaccaucaagcuuuuuuccacagcaguuguacccuuuuaugucccagcaaugcaccaaggguuccaguuucucuaaaucuucaccaacacuuauuaaauuucuuuuucauauuguuauggccuuccuaguggauauaaaguaguaucucauuaugguuuugauuugcauuugaauuugcaauacauuagagaugauguugaacaucuuuucauguguuugcaggccauuuguauaucuucggagaaaugucuguucaggucuuuuuccaguuuuguugguuuuuuaaaaauuauguuuuuuagagaaggguucuugcucugucacccaggcuggagugcagugguguauucuuagcucaucgcagccuugaacuccugggcuuaagagaucuucuugccucagacuccugaauaguugggaccgcaggcaugcaccaccuugcguggcuccuguucaguuuuuaauuggguuguuguugaguuugaaaaguuuuuuauauauucuggauucuagaccauuuucagauguaugauuugcguauauuuucuccuguucauugucuuuucauucuuuugauauugcccuuugauacacaaagguuuuuaauuuugaugaaguccaguuuauccauuuuacuuuuguugcuugugcuuuggugucauaucugacagaccauugccaaauccaaguucaugaaguuuuaccccucuucugagaguuuuagaaguuuaaguuuuaguugauauauuuaggucuuugaucuauuuugaguuaauuuuugcacaugguguuagguaagggucugacuucauucuuucgcaugugguuauccauuuguucaucaccauauuuugaagagacuuuuccuccccccuguauguucuaagcacucuuguugaaaaucaguuaaucauagauguauggguuuauuucuggauucucaauucgguucuguugguuuguaugucuauacuuagcaccauucuguuugauaacuguagcuuuguuguaagcuuaaaucaagaaguaugaguccuccaacuuuauuuuuuuuuucucccaagauuguuuggacuauucagggucacuugcaauuccauaugaauuuugggaucggcuuuuucauuucuggaaaaaaacaaaaaaaaggccacugagauucugauagggauuguauugacucucaucugauguauauaauuuacauauaugaucauauguuuacucuauguguaauuuauguugguggacaaguucgguucucaguuuuucaguaucaauuugcaaaaagaauuccuuuugaaaaauaguaugccuaagaaacccuggaggaauauacaucaaacauguaguaguaauuaucucuggggcaggaauuagaggggcucucaaccucuacauuauauauuucuguggugauugaaguucuuuuuaaacgaggaaacauggauuaauuugguaagcaggggaaaaaaagcuaguaaagauaaaguauauuuaaaaaaacccugauauaugauacucauaauagcacaacuaacauuuauaguuuuggacccccccaccaaguagaauuccucaaaaugaaauauuagaauugaaaugcuuaguagcaaguaagaacuuugauguauuugauucaaugucagcagcugggugggaggacaaccaguagguuggagauauuagaguacagaccuguggggaggaugcggcugcaucaaagcacaaugggagguagaagcuuuacuagauaaagacaguaccaugugagaucguucagcgagguccuuuccuuauauggaugguauaguugggcuaggauagguaugaugcagaccaucugacugggauaaugagcuuggagaagccacagaauuaggccggacgucagugauuagagacugauuauccaaacacgaacaagagaggaauguagcaguuuugguuaagaacccauccuuaggauacgcagucuuagaacuacuuaaggaaauacacugaauuugaucuugcauguuggaugaaaucgauuacagacuaaauuucaaguagucuggaagagggaauacuuagucuuuucuagacuaaagaugugugugugccagaaucuguguagcuaaugguguuggguugaggaggggaguguggagauagagggaauaccuacacaggaccuggaaaaguagaagaggaaaauacuacuaaaaaaaaaagaaagaaagaaaaaagaauuaacaucacaaaaagagacaacuggaaguucugugccuugugagggaugguagggaugguauucaucacuuguuaguauucuagccagaaauuugagccugaaucacaucaaaccucuaacucuagcuaauagcuuauagaaaauacagaggagagaggaacauguuaaaugacaccuuggagagucaacccaaaaaauccagaaugugggaagcugcaggacaaauggccuagauucuucaacagauaacuugcaaggaaaaauaacagugcaagcgggaaccuauagauugaaaaagguuuuaggagaucucuuagcugagugcaauggaagaaccucauuuagaucuggauuuucauuuuauuuuauuuuugaggcagagucuagcucugucacccaggcuggagugcagugauggagucacagcucacuucagcuucagucuccugggcucaagcaauccuuccaccucagccuccugaagagcugggacgacaggcaugugccaccacaccuagcugauauguuuacuuuuuguagagacagggucucacuguguugcccaggcugaucucaaacuccugagcucaagagauccucccaccucagccucccaaagugcugggauuacaggugugagccaccgugcccuucuuggaucuggguuugagccaguuguuaauuuuuucaagguaauaaaggauuuuugaacacugacuggauauuugauuauauuaaggcuauuauugucaguuauuuuagguaugauaaugauauugugggaaacugcaauuuaaaauauaacuugcggaagauugcaauaucaaugacaaaaaauuaaaggcacuuaaaaacauuaaagguaggccgggcgcaguggcucaugccuguaaucccagcacuuugggaggccgagacggguggaucacaaggucaggagaucgagaccauccuggcuaacauggugaaaccccgucucuacuacaaauacaaaaaauuagccggacgugguggcaggcgccuguagucccagcuacucggaaggcugaggcaggagaauggcaugaacccaggaggcagaguuugcagugagcagagauugugccacugcacuccagccugggcgacagcgcgagacuccgucucaaaaaaaaaccaaacaaacaaacaaauaaaaacauuaaagguggugcgguggcucacaccuguaaucccagcacuuugggaggccgaggcuggugggucaccugaggucaggaguucgagaccagccuggccaacguggugaaaccccgucucuacuaaaaauacaaaaauuaguugggugugguggcgggcgccuguaaucccagcugcucaggaggcugaggcaggagaaucgcuugaacccaggaggcaaugguugcagugagccgaaaucgugccauuguacuccagccugggugacaagagcaagacuccgucuuaaaaacaaaaacaaacaaacaaaaauauuaaagguugggggaaaccugcuagagaaucgguggcugguacuagugggaaugucuggcauuuaauuguacacuuagcuguauaggcacuuggcuaagagcuuuauauacugauuaucuuauucuucagagccacccuaugaaguugauucucuuaguuuucugcauuuucuaauugggcagcccgaguccugugagcccaagaaacuugccuaguguugcuaagcuaacaagugauggaaccaggauuuaagcuuaggcugucugaccucagagcccaggcuguuaaucacuauguaauuauaucucccuaaaggugcucucagugauagaggagguagcagagaaacuaaaagaauuauuucuggcugggcgcgguggcucaugccuguaagcccagcacuuugggaggcugaggcggguggaucaccugaggucaggaguucgagaccagccuggccaacauggcgaaacccggucucuacugaaaauacaaaaaacuagccagacgugguagcaggugccuguaaucccagcaacuugggaggcugaggcagaauugcuugaaccuaggaggcaaagguugcagugagcugagauugcaccauggcauuccagccugggcaacaagagcaaaacugcaucucaaaaaaaaagaauuauuucuucacucguauugagaagcgugcuauggaaacauacaaguccaaauuauuucgaagugaacaaguuguagauguuagauaccucuugagguaaagguuuaaaaccaaucuuauauuaauaguuggcuuguaauaaauguuauuuuauucuaaauuuaaguagugauaaauauaugggacguuuuagaccuaaagaagugggucuuuguggcaaauuguauuuccuaaaugacugcaacuauauuucccaucccacauguuuuucuuacaaugugacuuugacacucuuuccaauaggcagggucuacccaugucccuuccuugaauuuggguggaggcuugacagcuuugaucuaugguauaugguggaugugaugcuuucugguaucuaaggcuaggcugcuagaaggauacaguuucugccagguucguuuccuuuuggguucuugcucuggagaagggcagcugucaugcuaugaggagccuaagcuaaccuaagcuaacccacacaaagggacuacagguugaacaucccuaauccaaaaugcugcaaaauccaaaauuuuuuuagcaccaacgugcucaaaggaaaugcucauuggagcaucuugauuucagauuuucagauuaggguugcccagucagauauauaugaaaauauucuaaaaucccccaaaaucagaaaucugcaaugcuuucugguccgaacauuuuggauaaagaaugcuuauccuguaguuggagaggaccgcaucaagaagaacgaagguccccagccaacagccagcaucaugcgccaaauguaagcgugaguaagccuucagaugauuccagccccagccuuggagucuuccaccugaagccccagauguuguggaguagagauaagcugucccugcugcccugcccaaguuccuggcucauagaauccaugcauagauuaaaugguuguucuaugccacaaguuuuuggaguaauuuguuauauggccauaguaacugggacaauguuauuuuucuucccaucucaaaggacuuuaauguugucgucguaaauggccauuuuugagcagauguuuaguguggaccuacuagaauucagcccuggagaugcaaaggugaauggaacacagucuauuucuuuaaauggcaccacagccagaagacuguuaaauugaccuguuacuccuauauguguaaagagauuuccagaaagacccugguugcuaugcugaugagaccuauaauaaaagugggcuacugaaucuaagaaaacauuauacuacccacucgagagaagguggcaguaugguuucucuaaagcccaggcaggcuaauuggaauuuuuuauagagguaaguaugcaugugaauaaagagaaagacuugaucuggacuuugaaagacccuaauaaagucuguacagguaguuauuuuaaagucacaaagggauuaaaggaauuuacacuguguauaaagaacuaucuuagccagcguggugggguauacuuguaguccuaacuacugaggaggcugaggcagaagggaucguguguggccaugaauuugaggcugcagugagcuaugacugcaccuguaaauagccacugcacuccagccugggcaacauagcaagacccugucucuaagaaaauuuuuuaaaaagucuuaaaaaauaaaguagggauaaagcaccacuuccauaauauugguagagucaccaauaugaaguaaggaauucauggugaaaccuugagguuuccaguggcauuguuaucccaggcuguaacacacuaaaucccuggagaugaacugcaggaagacaugguguggcucuuuggucagaaaaccaauagcgcauuugauacggggaggguaagaauguguugagagugaugugaaugauauuugcagggugcugaaucugaucacaugaagguguuccuaguguggccguggcccugcuggcucugugugccaaguguugucagaaagagcgugguagaaugcugugugguguuguggggaaaagaucgaacuuagacccuggagaccugaguuggagaugugcuccaucguuuuacugguuuaccgcuugugagccccuuaacuucuccgaggcuuuacuauccauaaagugagacagcuauaccugccucagcucgugaguuccuguggggaucacaggagaggaugaaagugaaaacucuugauacaauaacacagcguagcucugcacgguguuuucuuaugggaaacaaacugaaaacauccuaccugaauauaaaacugaugucucugauccugcaaucacaguuguguagaguuauggucuuuguucuauccguacuggagaggguugggauaagggccagggaagaauaauuaaaauaaucaugguuguauuaggcuauucuuaucacuuggggcuguuuggugaauuucucaucuggaaagagugcugagaagcaguuuaugaucaagucauaaaaucacgaagaguaagggcagaacuagaagguugcccggugaaauuugaaaaucucuagcguaccuaaacaggacagugcuccacaaucaguacuaaauuuaugaaauuuauuauucccaaguaguaauuaaguuaaaauucauaauuacuauagcuucaaaaaaguuuuaggugcgcuccuggaccuucaucuguuaggacaaacuuagacguugugugcugugccucuucccuuucacagggggcgccaucaugcugcacacucccacaccccuccuggugagggucugaggcgggauguuaggcuaaauggccaugaaucugacuguguguggcgguuuuugagaauucuuagcugggccauggugucacugaguggccugucuuuucugaguuccagcuguguuaggcgccucuauaacacggagcuagacagucugcccagguuggaacuugucagccuuacucaaaacacagccugucucaugaaucaaauuugcauuuacauccuaccacaaaccaccuuccaaucauacuuuggaaccguguucaaacccugccaaggugguuuugucuuuaguuuaaauuugacuaacuuguuaaugacaaaagucuaugcaaguagggcuuuuguucugaccacuuccuaacuuguuuauguguagagugauuuuguuacuccugugauuugguuuuccgaguuguguuauuucuacuacguaauucuuccgccuuggaauaaggagaguuuuagguauguuuauauacacgguguguaaaauuuuuaaccugaugagucacuaugaaacagauucuaaggggcuguuaucauuaguccagauuuauuuuuucagagagaauugaauuuagugugcgugauuuaaugaacuaagauuuacaguaaauuuagauguuuuuauaauuuaucacuuuuguuucaguggaaaaugaauguuaacagaaggcuagccaaaaugucugucuuuaaaagauguuuaggaaaaggcauauaaaacagagcagaauuguccaguguugggucagugaucaaacagugugaacuuaaaaacaaaacuagauucaaacauagcuggaaaggauuuuagaggucauauaguucaaucccuucuuucugguuaaucaugagaaaaaugagguucaaagagguuaaaugacuugcccaaagccaugcaacuaguuccugauagagcugaaacuugaacagcaguuucuuacugaaacuugccacuuccuaauuagugguuaaggagacacauuuuuacuugggugguggcuuuuuguuuuguuuuuagguuuuacauugagggggggauuaauauuuauugaauaucuacuaguuguuaaguacuuuaaaaaauauauuagcugggcgugguggcacaugcuuguaguuccagcuacucaggaagcugaggcuggaggaucccuugagcccaggaauucgaguccagcuugggcaacauaacaaaacccugucucuaaaaaauagauauauauuucuucauguaauucuuacauagcccugugaaauacagucacgugccguauaacagcauuuuggucagugagggaccacacuguuacaugaugguagucccauaagauuauaaugcuguauuuuuacuucaccuuuucuauguuagauacagaugauucuuguguuacaguugccuacaguauucaguacaguuacauacuguacagguuucuagccuaggagcaagaggcuacaccacuuagacuaugccaucuaaguuuguguaaguacacgcugugagguucacacagcaacaaaauugccuaacgcugcacauuaacagccccacuuuacagauuaggaaacgggugcgagaagguuaauaccuugcucaaggucaugugguuaauauuaaagcuggcauuugagccuuucugaccuguccugcuaugauccccacuguggcuacuagugaugguaauucugaccuuuucagggguaugggcagcggugguaguuaucuuuaaaauauaucuuuuucagacuucucacucuguaaaauauguaauuagacauagauauguguagaguggccuuucucagaggacccgcagcucuuagcaguugcuuggcuaaucuucauaccaucucuguaagauaaacgguguuuucugguuggguaguugaggcccagauaggcucagggacucacccagcgccuuaucacaaacccacacggcccagcccccaguuccguucuucguccugucuagcauagauuucaccacuuuuguucuuuccugucuuacaccaagauuguuuaaguacuucccaaaaauaaugagccacguguggguguguucguucuccagaaugaaucacugugaaagagguugugaacuaacgaaauaagcauaaguaucuggaagcagaggcuccugacuauucagucccucuaauuggugggcucuggagugagcgcuuuucugaaaggcaacuguggguuugggcuugugucucacugugcucagaauaguccucucuugaaguuguuacuuuucccuucuugcuucccaaaauagaaccaauguuguucucuuugcuggacaucacaacacaaauauugagagguaugcuuuccauagagaaccccuuuuaaagugccugaauguccccacugccacaaaggggaaugggaguuagcuuucuuaagauuccagugugaguaaaagagcuuuggaucaaguauucugugaguuucagaaguaaauguaaaagcagaaagaauaagagagggagcaaacaaagguauuuggaagggaaaaugaagcgauuccuuagucuuuuuugugucuaaauggguuagaauaaaaauucaggagaaauuuacuuuuaaaaaucccuuuuaugauuuggauccuagucuaauaggcaccuacuuuaaauguucugccuuuaagaaauaacacuacccaaacucugaagcaagaggcugcauguuuuggaauuucucccagaagaaagggaucugaugaaacgugaaaaaauacaacaggccauaagugaagaucugcacugucuacacugucuauccaccugccagggcugccuccuugguuuccucgggugggacuagcaaggaaucggcucauuuauagaaagccuaaggaaggagggguugggcacugagauauuuagaaucugucuuuggauuugaaaagccaagagaugccuuucagaauauuggaggaagagacgaagauagacuguguacagccuaaauuggugaguuaugacaggguggcuuuucaugggacugcccauaagugucucaucuccaggguccauagugugaaugcauucccacuuguuauccagauaguauuuacuuagugugugaucugggacucaguugggcccccaccaccuccacccgccaaugugugagugcuuccuucagcacuuccgagccccagccucaguguucuagugggcaaagcaacacuccugcccaugccaagaggucagagcuagguuagucucaugggagacaguguuggggagaaccaacugcugcugucugugcuauucuuguuaguugaauaaauaaaggauuucagauuccagggcugcugaagaggcuuucagaggcgccaaauucauuugcaguaauuuccugucaaaugggacacacuuauguaugauaguuacccagcaaaacucauuaaucccagaggugauuguguacacugccuguuugaaaaaaauucgugugugugugugugcgcgcgcacacucaugcgugaaugcaugugcaugcuauccaggggccuuucaggauggguuaaauguauugugcacuuuuaaugcauuaucucacuuaauucucacaauaacuucaugagggaggcucucaaguucucuuuggaggauaucauuuuugccccucgugaaugagaggggcaccugacuuggacuucuaaaggcaggaggacaauaauggaguggucagggaaagcuuuucaaaagaagugacauuugaguugaauuuugaaggauauguaagaaguaggcaggaaaaaagcauugcagcaaaagaaugugugagagcaugcaugcugcaggaagccgugggugugcuugguuccugcugggggagauagggcuggugauagcuccaggaacccuagguggcucugcaugaaguggggggcagccccacauucuccaaaaggaagaugcuuuccucuugucaggcaucucaauuugaagaaaagguaguuccucugucucucacaggcauaaaguagagcacuuagaggauaauaguggagcuucaaaagccuuguuugugagcuaaauaaacaggugaaguugugcucaguuaaggauaucuuuuuggccccaucucuauaaaaacuguuuuggaacaucaaguaugcuaagggauuauauucuaaguuuggaaaaggaccugcaaaagaucucaccauugaugucaaugucugcuccccaauuuccugcagcucugcugugugcgugcaccagcugccuccaggccaacuacacgugugagacagauggggccugcaugguuuccauuuucaaucuggaugggauggagcaccaugugcgcaccugcauccccaaaguggagcuggucccugccgggaagcccuucuacugccugagcucggaggaccugcgcaacacccacugcugcuacacugacuacugcaacaggaucgacuugagggugcccaguggugagugcaugcccuuguugggcuaguggcucagcuuggagauaggguaccccgucauuucauuuuuuucuacucuugcccacucacuugguuugacgauaaagaugccuuuuggauguucccgaaggugacaaaggcugggguuucucagcaguugcuuuuguagauuagagggugaggaagcagauuuucaaguuagucccagaggugcccgcaguguuuagaguaguggcuuagcagccauaggcagcggugaggaguggaagaaccaggcagggauucccacgggaggaugugggacugauccagaaagagauggccccagagccgagcaaaggugacuccucaagggaggaugaugguuagaugugaggagggaccagaauaggaaaaggccagugaccaaagccgagaaacaccacauaccauccuuuugcaagccuaccauucaggaggcauuacuguggagcccacaggaaaaggagagaaacuaaagcagagcuuagaggagcugugggaaguuaaagggcagaaacaggcaucuguguaggggccugaggcggggauaguaccacgaaaugcgugaggugacaaaguggguuguggguuugacuguggaaagaggugccuuaacuaaagaaguugggcauuugagagcaucuaggcagcaagacuagcccagaagauuagagagaucaagggagccugaacacaucgacagggaaaggggucuuuuucacucuucacuuugagggggguguuuuuacucuuucccuuguuuuuacuucucauucuuucccucuccucucucacuugacucaggucaccucaaggagccugagcacccguccauguggggcccgguggagcugguaggcaucaucgccggcccgguguuccuccuguuccucaucaucaucauuguuuuccuugucauuaacuaucaucagcgugucuaucacaaccgccagagacuggacauggaagaucccucaugugagaugugucucuccaaagacaagacgcuccaggaucuugucuacgaucucuccaccucagggucuggcucagguaccaaguucuucagggcaucaugucugugguuggcuuucaucaguuucccagcaggauagagugcuuguagagaaggcuggaggcccugcauuuguuucuaccagcauugagucauuugguuuccuaguuccccuucuuuuggagucugacguguaauaagauaagauaauggguucacagaaaaucucucauuccgugggauucccaaggucuaguacacaauuauccacuacagaaguccugccucucuaagcuuugcaacuguacguacaucuauuaaaauucagcuggucccaccugagcaguggagugcucaauuucagggccccuuuugagaaacaggagugugccagauuccugugagguggugacagcuaaucauugaucucugagcaaccacaaggggaguuuaaggacauccaguaaagcuuagaguugggauuuggugaaucauugacuuguaccaguugcccaaggguuuuuggugggggugaaaauaaaggcagugugggccuccagcauagcaucagcacuauuuccuguacugccuuuuguugaccaagucuuucucagaugagggaaaugaaccaaacacuggaccuuggcauaagacgagaauuuaagauaaaggagcucgggguuguuuaggucucaggguauagcucagcuagcuauuaaaugugaacaugaaugcaaaagaauuuuuuuacuuacuuauuuauguauuuauuuauuuagaaacagagucuugcucuguuucccaggcaggagugcaguggcgcaauuuccgcucucugaaaccuccaccugccugguucaagugauucuccugccucagccuccugaguagcugggauuacaggaaugcgccaccacagcgacuaauuuuuguauuuuuaguagagacaagguuucgccacaucagucaggcuggucuuguguucuugaccucaagugauccgccugccucguaaagaauuuuuuuaaugaagauaaaccauuauuuuugugacaaugguauugcauuccuuuuuuuuuuuuuuuuuuuuuguuuuaagauauggucucgcucuguuguugcccaggcugcagugccauugugcaaucacagcugacugcagccuuaaccuccugggcucaagagauccuccaccuuagucuccugaguagcugagaugucaggcaugugccaccaagccuggcaauuuuuuuuuuuuuuuuuuuuuuuguggaagguuucacuuuguugcccaggcuggucucaaauucuuggcuucaaguccauucuuaaaaaagaaaaaaaacauccacaaagaucacuguugccauucuagcuaaaacgcagaggaucuuauuugugagaacuuugcguguuuuuauguauguuuccuugacgugggacaagacuguuguucuguggggaaauuaugccaucagucaugcccagacauucugcuugacacgggaguacuuugagcugugacaucuccugaauuucaguggcuuugcuuuuauuaagcucugcaguagagagcaccaaaaugauggauauauuuaaaagcugcauauuuuuagaaacagcaaaaaucuagggcuuguuccuuguugaaagagguagggcagugguuagaaccuccuggcugacugugggaauugauuugcugcuagaggaggguagauuggguuuuccaaagucuuuuuaagacccagaccagcugaaacaagggaagggccaugguaguuguuuagucgucugugguaaaaugguuaauaacuauuucccucugagugguuuaguauauucuucauucagaauaugcagagcuuccaagguguuagguuucuaauaaugugguuuuuaaaguaguaaguccaugcugcucauaugacuuucaauucauuuaaauaaguauauacugaauaccuucugggugauaugguuuuaaacagauuagaaagagccugacccggccaggcgcgguggcucacgccuguaaucccagcacuuugggaggcugagguggguggaucaugaggucagaggagauccagaccauccuggcuaacauggugaaacccugucucuacuaaaaauacaaaaaauuagccgggcgugguggcggcgccuguagucccagguacucaagaggcugaggcaggagaauggugugaaccugggaggcggagcuugcagugagccgagaucacgccacugcacuccagccugggcaacagagcgagacuccgucucaaaaaaaaaaaaaaaaaaaaggcugacccaggauuggaucagagagacaggaauuguugggaagagucucacagaggagggcacauuuaaaggagucuugaggccgggcagaucacaugaggucaaaaguuugagaccagccugacuaacauggugaaaccucgucucuacuaaauacaaaaaauuagccggguguaguggcacacgccuauaauuccagcuacuugggaagcugaggcaggagaauugcuugaacccgggaggcagagguugcagugagcccagaucaugccauugcacuccagccugggcagcaagagcaaagcuccgucucaaaaaaaaaaaaaaaaaaaaggccaggcacgguggcucacaccuguaaucccagcacuuugggaggccgaggcggguagaucaccucaggucaggaguucgagaccagccugaccaacaugaugaaacccccaucucuacuaaaaauacaaaaauuaucugggugugguggcgggcaccuguaaucccagcuacucagaaggcugaggcaggagaaucacaugaaccuaggagguggagguugcagugagccgaaaucauaccauugcauuccagccugggugacagagcgagacaccaucucaaaaaaaaaaaaaaaaaggagucuugaagaaugaguuggaauuuuuaagagaggcgagagggcaaagaacauuccaggccaaugaaaauaccuugaguaaaaagacaaaggcaugaagguccacuguauguuuaaagaacuuuuaugaugaggagaccagcaugaugugcuugugcuggggaagcagggggacgucaggcugccccagguguacaggaucuugagggcugaccuuuaucuucuagguaaggggcuucuacugaaaguuuccaugugggaaaugaauguucauuuuuuccuuuggaaggaauucuggcagugguguggaggaugaauucauucacuaccagccuucuguugggaaggguggggugaggcggggugugugugggugcacagggcaagagcaggcugagaugggaggcaaaagaccuguuggaagucuuuuagagaagguccaaaaguaggacaggcggacggagauggagaggcgggggcuaauuugagaaacauuuuggugguucuauacuguugucauuaaaagcauagauuauagagucagacaguccuagauuuuaagcccugcuuugccacuuacugcuuguaugaauuugaauauuacauaaccuccucuuugagccuuaguuuucuuguuuauaaaauggggaugauaacagcgccuuaccuuccaggugguuuggggaagugagauaauuuauguaaagcccuuagcauggagccuaauacauaguaagcaugcaguaaaugguaguucccaucuaccagaccuagggauuaauaauguauuaauuauuugauugggggugggaguaagacaguuaagagucacuugugaugguaagggugauuggauauauagagauacauugaaugagucaaaugaagcaauguugaguuuuauaaagacaguaaaguuaaucuuagacuaaacauagaugguccuccauucuacaucuggaguucgcuugugagcagagcauugcucucuuuggagaugggaacccaugggccgcacagcacugcccucuaguggcuaauaagcagaacagccagaagguggcccccagcacaugagcccacacuuucauguucucugcccucuuuccuuccuccaccaaaauaaagcagauguggguggaucggcccacagguggcuggcugaagaguugguaaaucuggucaaacauuuacauucaaaucuaucauccgugcuuacugagaggagaaauugccuagauaaggaguagcuaaucauacacguuuccuguuuguguucacucuuuccccaucucuccgccuggcucagcccucugguagauuaccuagaaauguguaugggcagcagcagcucuccaugguuaauggacagcguaggaugaagacaccauguuaaggguguuuccguugugccaauuagugugggaguuggaaaauuugucaaauuugcaaugucagguuucuuccuauucuuugguucacaggguuaccccucuuuguccagcgcacaguggcccgaaccaucguuuuacaagagauuauuggcaagggucgguuuggggaaguauggcggggccgcuggagggguggugauguggcugugaaaauauucucuucucgugaagaacggucuugguucagggaagcagagauauaccagacggucaugcugcgccaugaaaacauccuuggauuuauugcugcugacaauaaagguaagggcugggcuuggauacagcauucccagauagaggaugcuagagaaagugcauagcuauggggugcacagcucuguuugccuucaucauuguaacccguagaaagaaaacuugaguaaggucaagguuuccaugcuuuccuuaaaguguggagccuuuuauuccaugaaaagguuauacaaaaauccagguuaucaagcaaauaaacaagcaguucuuacucagauaaacaagauacacccccucacccuaccugcucaauuucucuuucuccacucccccaaacccaccuccauuguaguuccugcagggggucccguaagcuuauuuugaaaaucacuaggaugggcugggcgcgguggcucacgcauguaaugccagcacuuugggaggccgaggcaggcagaucacuugaggucaggaguuugugaccagccuggccaacauggcaaaaccccaucucuacuaaaaauacaaaaaugagcuggccacggugacaccuaccuguaaucccagcuauucaggaggcugaggcaggagaauugcuugaacccaggaggcggagguugcagugagcuggagguugcagugagcugaggucgcgccacugcacuccagccugggcgacagagcgagacuccgucucaaaaaaaaaaaaagaaaaaaaaaaucccuaggaugaggaauugcggccucaacccuggcaaggaggauaacgacagaaaagccuguaguccacgaagugucgccuucggacucugcucuuggucaguccugucccugaggauucuuuccuucuuccucucccuuuuauugcuuuaguuuuugaaucucuuaugugccaggcaccucccuauguuugaggaccucauugacuagcaaaggaugacgaguaagggugauuagaggagguaaacacgaguuguucuguugagcacaaauuggggcugacucgcaccugagcccaguugagacaaagguggcaagaacuggucaggaagaaaaaucuuccuugcagggaagagcacugcagacaugugcaaaggugagguuuggggcccagcaaguaacuuggauggcuguggguggagagggaggcagaggccagauuaugaggggccuuuuugagaggauuguauuccauucugaagauaguggguaguaauuaaaauuucauucauuaauucuauaacauuuauugacugcugugggccagaccucugcuggcugcuuggaccaucacacauaagagcaagacacagucccuccccucacagagcucccaggaagaaggggacagacacguggacagguaguggcacccggagcacagagaggaugcugugaguggcugguucacauuguggaagggucucucuagcaguugugacaugacuugcuccuguggcauggugcaauuuagaaguuagugucuacaaagccuacagaagaugcuauuuguuuuucauuccugaaacaacagcagacugcucauuccucacauugccaugggaaguuguaauggucucugcugcccccaagcugaggagccuuagacuccaauacaagggaggaaggggaagagcaagauuuuuauucccacugaguaagcuauuccuuuuuaaaacuaucaccuuuugauaaaauuuaaaucuuauauguuuuaaaaggaucaaaucaugucuucucuuugaacuuguuagcaggguccucaggacuuuggggcugguuagagugcgagaagcaguguguugggugggccccuuguuugugauaagagaagccaagauguguguguuuccaggauccaucccuuuauugauucuggcagcuugugugaguagggaucuggcuuucaaaacccaccuuaaggccagggaagggaaacaaucagacucccucguucuugccuuuuuaacaugggguauauauaguauggugcccuggaaucagcgccagccuggaauuuuggagauuucaacucaauuuccagucuuccaauugacaacggcauggcuuaauucgauuccuggcuuugguguuucuuuuucucccuccuccugcucuccuccuuccugcugucccuaguguaaaagagaaaauaaaguguaugcacucuaccuuccauugcuccucugaaggaugagaugccuuucugggaauacuuggaaguggucuauucaugcacugaaaagcauuuuuuggccuggaauccaauaauccauaaaggagaucuuuccuacucacagagauaucauagccugguaagaacaacagacugaaaagaaacauuacagaugagacaggugcuguguuugggcuguguucagagggucgcugggacacaggaggcccuccaaggcuuuccuguuugguggugguagauccagcucauugugguucucccgugcagaugagcaagucuuggucaggaucaaagcagugcugcacacaaagcuggugauagcuguuaccuuccccaggcauaugccuccucuuuccugaguaccucacauuucaaauuugacauaauguucagaauccuacaguucaccuaaaggaaaucaggagcaguccuaagaaagaaaugguguuccccuguccuuacugaggucccaaacugguagaccacuauaaaugaaaggaugcuagauggggcuucagggggcauggaggugggaaaugugaauucaggagucuaaccugauuuuguguuguauacacucauccuuaccaaccuucacuguuuugcugauaguuacacuuuuucugggacucaucugugguucucugcagauaauggcaccuggacacagcuguggcuuguuucugacuaucaugagcacgggucccuguuugauuaucugaaccgguacacagugacaauugaggggaugauuaagcuggccuugucugcugcuagugggcuggcacaccugcacauggagaucgugggcacccaaggugaguggacuagcgcaggagcggcgaagugguguaggcaugaaagguccgcaguguccugauuuaguuccuagaauuccuuuuuacugaggaaguuggggcuggaccucaggaacucuaguuuaauuuaaaggaaaggagguuugagcuucacuuaagugagguaucuacaggguguucccuucaccucugucuugauagaacucccucaggaacccuauaauaucaauauucagcuacuugucaaucaguggcuugacauagucauuuguuacgaaggaguaaucaucuuagaaucccacaauagacaugagaaaaaauggaacuaaaaagauaaaccaguguacugggaacaucaguuuagugauuuccauguucauugauggggacagcuggcuuaaaggccacuugguggauuagauucugggccuuacuaaucugggaagguuuuccuggaggaagaagaccugaagcucugcuacuuguugauuaucaugucggcucuuugggagauccuggaucuugucacaauggcaggugugaucccugaugccugguugaccagggccacaauggaaaaucacccgugaaaguuggauccuauuccuauagccugugcggugccaguucucaucaucgggccuguuuccuucugagaacuaggcauugcagcaacuucccuucagucccucagcacuucuguaccugagcauauuugcucagggaaggcgaguaguaguaguaaauauuaauacaaauauuagcuaaauacacauguccuucuauggucguaacuuagcuacaugaaugcauuuaauccucacaacagucccaugaaauaaguagucauucugauuuuauggaugagaagacugagguacagagggcuaaagucacuuuuccagggucacuggauuagcaggaggcaaagccaggacucaaaccuauacagucuggcugcauagucuaugcuuuuaacauuuauaucaucucuuuguaaagaucccuguuuuuuucucugccagggaagccuggaauugcucaucgagacuuaaagucaaagaacauucuggugaagaaaaauggcaugugugccauagcagaccugggccuggcuguccgucaugaugcagucacugacaccauugacauugccccgaaucagaggguggggaccaaacgguaggagggccugggacucugcccuugcuaagcagcuucuacugaguaucccaucugugccguuucccauaugcgcaggagaaggagguguugaaaaaggaggcgaggaccuugcucucagcccacugaaaguugaauugaacaugcacuccccacaauggaaaguugcaucacugcaucuaacagauacaagugcugagagcacagcuccauaaacuguaugcacauugguguuggugguauuaaggucggaggguagagaaggacaaucuagagcaggauuuagaaggauagcaggcaacagguguggcucgggaaagagggaaaacacugucaucuccugugcagagagcugugaaggaggcagggagcaugugcuuagggacuggagaccagauuugccaaacuauagcaaagguaacccaggauagagauuuggggcacccuucaagauuaugggccugcuucccacuucaugcagaagugagguaagaaguaaggagcugugauugcaaauugacuucaugaguuggaaaugggacugccuuuuaauagaguggaagagguggaaaucugcugaaucuaaaugaauuuaauuaagauuauccccugauuuauugugggggcugggguggcuggaaucauaguaauuacucauaauuacuacucagagucauuaagggugccgcugaccaccucuagaauuaauuuugacauaucuauagucagguaagauaacaaaagcaguucggaaugaaacuuaagcucaacccaucacugugacuacauucaauaaagugaaggacccuggugucaaccaaauauuagguacuguuacugccccugugacccacauuacaaguacuucugccaagaagucaaaacaugcuucaaauaaacaaaucuuuacucucucuuuguuuuuuugauauggaguuucgcucuuguugcccaagcuggagugcaauggcacagucauggcucacugcagccuccgccucccggguucaagugauucuccugccucagccucccgaguagcugggauuacaggcgccugccaccaugccuggcuaauuuuuuguauuuguaauagagaugggguuucgcgauguuggccaggcuggucuccaacuccugcccucaggugauccgcccaccuuggccucccaaagugcugggauuacaggcgugagccaccgcaccuggccaaauaaacaaaucuugaugguuaaaaauagagauacacaucagaguagccugguauugccaaaucugugcugaaguauuuagaaucaaauuuaaaacaugggaguuugcaaugaagagauguguacacuucuucugccccaagggacuuuaucagggugauacucuuccacauucagagggcuccugaaucaauacuuugauuuaaagagagcagucaucauuuucugugcgugaccauguuuguuuugcuauugcagauacauggccccugaaguacuugaugaaaccauuaauaugaaacacuuugacuccuuuaaaugugcugauauuuaugcccucgggcuuguauauugggagauugcucgaagaugcaauucuggagguaccuuucuuuuuugccuuugcuccuaccucccauuccaggaugcuggaucacccaaagcuguuuuacugcccccuuucuuuuuacaaccuguuggaugccuguugccagagccugaaucaucguuuaagguugccaucaaagguguggagguagcugugcuuagggugcguuuauucuucagggaucaguuuguugaauagcguuguguguuaugguaaccauucugaaggcucguuuggcuuuauaaacaaacaaacauuguuuuauuaguccguggcggggagugccccggugcgcauagcacgggauucaugcaguggucuccuucacaucagaagcaguauauucuaacgcgguggcucccaagccacauucaugggaaacccugcuguuucauuguuaaaauaauagugcuaauuucuaaauuuauaaaagugcauagauuuuucuuaaaagugaguuuuuucucccauaguuaaaaaucguuggcauuugcagcugcuuauucaugacagaauccaguaagaaauaguaucagauuuagcagaaacacuuuuuauugucaacuuaguauaucaguauuuuaugauaauuuccauauauucugccacaugaucaaguuccaggaccucuagagcccuacucucagccauuuaucugugauauaagagauuccagggcagugaaagugauugaaaaaaagaacugguggugcucacuucgccagcacauauacuaaaauuggaacaauacagagaagguuagcauggccccugcacaaggaugacaugcaaauuccugaagcguuccauauuuuuuaaagaccuaguauuugauagcaccacagggugacuauagucaauaauauaauuguacauuuuaaaauaacugaaagaauauaauuagauuguuuguaacacaguguaaaugcuugaagggauggauaucccauuuucccugaugugauuauuaugcauugcaugccuguaucaaaacaucucauguaccccauaaguauauacaucuacuguguucccacaaaaauuaaaaauuaaaaaaaucuaaucuacaaaaaauaugacaagucuuccagcagaacuguuuuguauauuaauacccuuuuccagcuuccauuuaugacauguuugguaaaauccaaauuauggaaauagugcccagguaguauucauggaauuguaccucuuaaauuuugaucaguauaugcaguaaaacagacuaagaggccaggcgcaguggcucacgcuuguaauccccagcacuuugggaggccaaggcaggcggaucacgaggucaagagaucgagaccauccuggccaacauggugaaacccugucucuacuaaaaauacaaaaauuagcagggcaugguggugcacgccuguagucccagcuacuugggaggcugaggcaggagaacgcuugaacccuggaggcggaguuugcagugagccaagaucgagccacugcauugcagccuugcgacagagcgagacuccaucucaaagaaaaaacaaacaaacuaagaaaaaucuggucacacaggucuuaaacugugaauaaguuuauuucuucuuaugacauccagaaauugaggcuaaauauauaauaaugcuaacauuuauucaccacuugcuauguauaagcucauuuaaucuuuacuacuacaaguaaauaauaaguaggugcuauuaucaucgccauuuuacaaaugaagaaaaugagucacagagaaguuaggaaauuugucuaaggucacauaacuauuuuaguaaacaaggguucagacucggacaggcugaggccagggcuuaagccuguaacuaccccuuagauaauuaccaaguccaauucucuauuuaaaaauauuucccaggcugggcacugugucacaccuguaaucccagcacuuugagaggccagggugggcugauuaccugaggccaggaguuugagaccagcuugggcuacauggugaaacucuaucuuuacaaaaauaaaaaaauuagccagacauaaaggccaggcaugguggcucacgccuguaaucccagcacuuugggaggccaaggugggcggaucaccugggaguucgagaccagccuggccaaugugaagcccuaucucuauuaaaaauacaaaaauuagccggguguaguggcgggcgccuguaaucucagcuacucaggagguugagguaggagagacuccaucucuacuuaaaagaaaaaaaauugucucauuagcucaagacagcaggguuuuuuuguuuuguuuuguuuuucuuuuucuggaaaagggcuugagaaaaauuaauuggcuuuuuauuuuuauuuuuuugagagaggguuucucuuugucacccaggcuguauugccauggcacaaucuuagcucacugcaaccuccgccuccuggguucaagccagucuccugccucagccucccgaguagcugggauuacaggugcccaccaccacugcgggcugauuuuucuguuuuuaguagugauggggcuucauuguguuggccaggcuggucucgaacuccugaccucaggugguccaccugccuuagccucccaaagugcuaggauuauaagcgugagccacugugccuggccuaaauuggcuuuuuaaaacuaucuuuuuauuauggaaaaucuuucuaaguuuguaguucuuaaagaugaggacuuaaaaaaaugcagugcuauuaccacacuuuaaaaaaugaacauuaggccgggcgcgguggcucaugccuguaaucucagcacuuuuggaggccgaggugggcugaucacaaggucaggaguuugcaaccagucuggccaacauagugaaaccccgucuguacuaaaaauacaaaaaaauugccagguaugguagcguacgccuguagucccagcuacuugggaggcugaggaaggagaaucacgugaaccaaggaaguggaaguugcagcaagccgagaucgugccacugcacuccagccugggcaacaguggagacuccgucucaaaaaaggaaaaaaaaaugaacauuaggggucaggugcgguggcucgcaccuguaaucccagcacuuugggaggcugaggcgggcagaucacccgaggucaggaguucaagaccagcuuggccaacauggugaaaccccgaaucuacuaaaaauacaaaaauuagccgggcaugguggcaggcaccuguaaucccagcuacucggaggcugaggcagaagaaucgcuuguacccggcagguggaaguugcauuaagcugagauugcgccauugcacuccagccuggguggcaagagugaaacucacacacacacacacaaauuuagugcuuuuuuuuuuuuuuuuuuuuuugagacagagucucacugucacccaggcuggagugcaguggcgugaucacagcucacuguagccuccaccucuccaggcucaggggaaccuuucacuccagccuccugaguagcuugggacuacaggugcaccaccaugcccuacuaauuuuuguauuuuuuguggagacaaggguuuugccauguugcccaggcuggucuugaacuccuguguucaagcaauccuuccaccucggccucccaaagugcuagaauuagaggugugagccauugugccuggcaaacauuaaugucacuuaacaucuagucaguguugagauuuccccagucuccuaaauuuuuaaagcaguuuguucaaaucgggguuccaauaaguuuuauccccugcaguugaugaauacaccuccuacauuucuugucuacauguucccccucauuuuuucuucccacucuguuuuuucggagaauccaggucauuuguccuguagaauuucccaggcuagauuuugcagauugcuuagguagaguucacauauucuacucuuccugguauuuccuaugaauugguaguuagaucuggcagcuagaaucauuucuggggguucggggacacguauccuucacagggguuccucuguccuucugugacaaguugcguagcauugguucucuauuuuugugucguuaacgugccguggugauauuguccaaaacuaagcgaaugauuacuuccccuacauauguauuugguucccaugauauauaguuggaauaggagaggcagaaaaaauacuugauucuuuccacuuauuuaccauuuuucaaaauaaugaggugguucuguagccucccacagagguaggugacugaaauuuccuuuuuuagacuuuaaaaauauuuguuuccauugaaguuauuugucuuauuguuacuuaaaaguucccaucuuugcucaguugggagcuuaucaaguuggugccuuuugaugugacccccaguagucuuugauagauuccuugcuuuggcuaugaaaaaaaauguuccuggcuacucuuuuguauuucuuuuuguuuaguuguuuuguuugagacagagucuugcacucuuguccaggcuggagugcaguggcaugaucucugcucacugcaaccucugccuccaggguucaagcuauucuccugccucagccucccuaguagcugggacuacagguguuugccaccaugccugguuaauuuuuguauuuuuaguagagaugggguuuuaccguguuggcggggcugguuucaaacuacugaucucaggugauccgcuugccuuggccucccaaagugcugggauuacaggcaugagccaccaugcccggccccuuuuguguauuucuuguuccauacuuagaauuaacuaacuuucuaaggaaccuuaggggguagugguauuuacagagcacaguguagguuuugucaccggcuucugaguaaucuuuuccugcuguugauaacucagguagauacuuucuuuucucccaggaguccaugaagaauaucagcugccauauuacgacuuagugcccucugacccuuccauugaggaaaugcgaaagguuguaugugaucagaagcugcgucccaacauccccaacugguggcagaguuaugagguaagaagcuggccuccugcggcuuucccaucagccugauuucuccaccuuagaaaaggguuucuugacaauggggucaggccccagaggagcccccugagagugucaguuauuauuuacuauuacgugcuauuuuacauaucccaagcccuuuagggcuacagucucuuguccuggacccuguagggugccauuuggaguucacagccuagaagaagaaaaggcuuugggccuggugugguggcauaggccuguaaucguagcgcuuugagaggcugaggcaggaagauagcuugagcucagaaguucgagacaaaccugggcaauguggggagaccccaucucuacaagaaauaaaaaauuaggcuugguggcacaccaccuguagucccagguacuugggaggcugaggugggaggauugcuugagccuaggaggucaaggcugcagugagccaugauugggccacugcguuucagccugggcaacagagcaagacccugucucauaaaagaaaaaggacaaggcuuugucuccaagacacagaugagggagguggucaacaagugacaacugaacccagagcuguuagacaccaaacuaggaaagcagcucuggagcccgagcugagcugagcuccauggaagagugaggaggagguguccauaagagaagcccugagaccagacagaggaggaggacaugccugugaggaaaguggucuuuccagaaacucagaagggaggaggugauguguaugacagggcugggauugggauggagaaugugaauuugggagagacggcagaugaaaucaggggugugggggaaacaacauuugguggaaagaguugacaugaggacauguuugugacauacguacuaauaaacauggaauucuagggucuuaagaguguucaggggaacaggcuucgccuagcuaagugcucaugggccuccuuuucacuugcgguucugcauuuccuuuuacuuauuuuuuucccaacucuaucgaggugugauugacaaaugaaauuguaacaaagguguacaaagugcugaauugauacauguauguauugugacaugauuaccacacaaguuagugaacacaucugucaccucaccuuguugcuuguguguguagugagagcaguugagaccuacuguuagcacauuucagguguacaguauuguugacucuagucaccuugccguccauuagagccccagaacuuaccuagucaaguagagagguuggcucugccuuuaacgagucuaaccacuagagggcauuucugcauuucagaacagaauugcauauuagcugaugcuuucguguugcaucauagagcagcacuucucaccgcacuccuuggaacccucagggcaggguuugcuucagagggcaggugagaccaaaagagcuggccguuagcugcagcguuugccuuucacuuguguaagcugucccuuaaaaaggaagagccgccuggcgcgguggcucaugccuguaaucccagcacuuugggaggccgaggugggcagaucacaaggucgagagagcgagaccauccuggccaaccaauaugguaaaaccccaucucuacuaaaaauacaaaaaucagcugggcguaguggugugugccuguagucccagcuacuggggaggcugagacaggagaaucacuugaacccgggaggcggagguugcggugagccaagauugcgccacugcacuccagccugggugacagagugagacuccuucuaaaaaaaaaaaaaaaaaaaaaaaaaaaaaaaaaaaaaaaggaagagccagggaacaaagggagccuugcagagcauuucccuaaggucggccgccggguggauguggaucugccagacugcacugagcgggagguggcagggaaaugagugagagccuagggaccagaaaggcuucuccagggcaugaccgagcugauggcuccugggucucugcacaggcacugcgggugauggggaagaugaugcgagaguguugguaugccaacggcgcagcccgccugacggcccugcgcaucaagaagacccucucccagcucagcgugcaggaagacgugaagaucuaacugcucccucucuccacacggagcuccuggcagcgagaacuacgcacagcugccgcguugagcguacgauggaggccuaccucucguuucugcccagcccucuguggccaggagcccuggcccgcaagagggacagagcccgggagagacucgcucacucccauguuggguuugagacagacaccuuuucuauuuaccuccuaauggcauggagacucugagagcgaauuguguggagaacucagugccacaccucgaacugguuguagugggaagucccgcgaaacccggugcaucuggcacguggccaggagccaugacaggggcgcuugggaggggccggaggaaccgagguguugccagugcuaagcugcccugaggguuuccuucggggaccagcccacagcacaccaagguggcccggaagaaccagaagugcagccccucucacaggcagcucugagccgcgcuuuccccuccucccugggauggacgcugccgggagacugccaguggagacggaaucugccgcuuugucuguccagccgugugugcaugugccgaggugcgucccccguugugccugguucgugccaugcccuuacacgugcgugugagugugugugugugucuguaggugcgcacuuaccugcuugagcuuucugugcaugugcaggucggggguguggucgucaugcuguccgugcuugcuggugccucuuuucaguagugagcagcaucuaguuucccuggugcccuucccuggaggucucucccucccccagagccccucaugccacagugguacucugugucuggcaggcuacucugcccaccccagcaucagcacagcucuccuccuccaucucagacuguggaaccaaagcuggcccaguuguccaugacaaaagaggcuuuugggccaaaaugugaggguggugggugggaugggcagggaaggaauccugguggaagucuuggguguuagugucagccaugggaaaugagccagcccaagggcaucauccucagcagcaucgaggaagggccgaggaaugugaagccagaucucgggacucagauuggaauguuacaucugucuuucaucucccagauccuggaaacagcaguguauauuuuugguggugguggguuugggguggggaagggaagggcgggcaaggaguggggagggagucuggggugggagggaggcaucugcaugggucuucuuuuacuggacugucugaucaggguggagggaaggugagagguuugcauccacuucaggagcccuacugaagggaacagccugagccgaacauguuauuuaaccugaguauaguauuuaacgaagccuagaagcacggcuguggguggugauuuggucagcauaucuuagguauauaauaacuuugaagccauaacuuuuaacuggagugguuugauuucuuuuuuuaauuuuauugggaggguuuggauuuuaacuuuuuuuaauguuguuaaauauuaaguuuuuguaaaaggaaaaccaucucugugauuaccucucaaucuauuuguuuuuaaagaaaucccuaaaaaaaaaaauuauccaauugaacgcacauagcucaaucacacuggaaauguuuguccuugcaccugagccuguucccacucagcagugagaguuccucuuugcccugaggcucagucucucucguauuuuguccccacccccaauuccuugagugguuuuugcucuagggcccuuucuugcacuguccagcugguuguacccucuccaggcauuuauucaacaaaugugggugaagugccugcugggugccaggugcugggaauacaucuguggacaagacaugcuuggguccuacuccuggagcacuguaaaaagagcugauucaaguaaguagaugccuguuuugagaccagaagguuucauaauugguucuacgacccuuuugagccuagaauuauuguucuuauauaagaucacugaagaaagaggaacccccacaacccccuccacaaagagaccaggggcgggugaugagaccugggguuuagaaccccaggugagaccucaaaucacugcauucauucugagcccccuuccuguccccaggggagguguauuguguauguagccuuagagcaucucugccuccaacccagcaguucucugccaaagcuuguggaggagggagagcccugucccugcccucaggcuccccagugcuccuggcccuucuauuuauuugacugauuauugcuucuuuccuugcauuaaaggagaucuuccccuaaccuuugggccaauuuacuggccacuaauuucguuuaaauaccauugugucauuggggggaccgucuuuaccccugcugaccucccaccuauccgcccugcagcagaaccuuggcgguuuauagguaaugauggaacuuagacuccucuucccagagucacaaguagccucugggaucugccaacacacguccacucccaagccacuagcccacuccccaguuggcccuucugcccuuaccccacacacaguccaacucuuccaccucuggggaagauggagcaggucuuugggaagcucccacacccaccucugccacucuuaacacuaagugagaguuggggagaaacugaagccguguuuuuggccccccgaggcuaacccugauccauagugcuaccugcaccucuggauucuggauucacagaccaaguccaagcccguucuuacgucgccauaaaggcccccgaacggcauucucgguacuucuguuuguuuuuguacauuuuauuagaaaggacuguaaaauagccacuuagacacuuuaccucuucaguaugcaaauguaaauaaauuguaauauaggaaaucuuuuguuuuaauauaagaaugagccuguccaauuucugcuguacauuauuaaaaguuuuauucacagagcug

SEQ ID NO: 17961 - RNA, 1579 nt, Homo sapiens
cggagaggcaaugauguauauuccauucauuccauugcuuauccccaaagggacccagcaaaagggcaucuugcacaaccuccucugugaaggagccaccccagcuaucacagaggguuaccuaauggacaugucuccuugccugaaaccuggagaaguggaugccacagguguggcacagccccugugucuaacagccuguggagccagucauccuucagcugacguggaggcagacuuccccaguuuauguagggcaguccaccuccaggccuccaagugagugaacaccaccagaggacugaaauucgcaccuuguuuccuccucuugcuaggcagaaagcccuagagaaccccagaguaagggugggcccaggaaaugcaauuuuuaucaaguucuuugugugauuccuuaaauccugggauuucagagccagaaauggccuuauggucuggaaaggauaccguaugguccaagcccucauuuaacagaagcaacugaagccagagagagaaagacagaaucauaacagggacuagaacccacuagaacccaagucucuugacuccagagacuguuuaauucagcugcugguagcucccugagagcucagagaucccugccugcuuccuccucccaauuuccccaguuucuccaaggaggggccccuggagcccaggaugccauacuguggagugguuaugcccucugguggccaugagucucgggggaaaaucuucaagccaggcggaaaggcuggaagacuccaccuggaaucccagcccuguuucaggaucccccacggcuccucuuccucccaagagggcacaacugggaugccaagcuccacuuuggucacugaauucuggaaucucacagcugucaguuaggaaguuuuuugcaucaaagcugcuucugcugcaggugaaauucagcagggagaaggcaggcagcuggcgggcuuuguuggugcacuaaccuucgcaugccaggcaguauauaugaggccucuaaagcuuugccuucaacucuccacagcuuucuccuaagcuugagucucuuggcuagcaucuguucucauccuauccucugcagcccuuuaaagcuugggcggugggggaagcauucugcacaccaccugcagcuucauaccaggauacgucccccuccuccucccuccaggaagccuccccacaaaaccuccaccgcucuggcuccucagacaucuguacucaaucuguaccuucuucccaagccagccucucucagaaugagcucucagguuucccucccucugcucugccugcccuggcuccugacacucguggcuggccuggggugggggauuagacagugggggcccagcuaaaggacaaggccuagguaacaccccuucucuucagggcaaccccucgccuggcuauguaacagucagcagccccccauggaggaaauugggagagcugagucuuccacugagcagcuuaagcucuaggguaccaugaugaagucagagcacuaggggcuagugcuggccccucuggagucugaccuaagucucagagcucuaacaugggc

SEQ ID NO: 17962 - RNA, 8985 nt, Homo sapiens
cggagccuauaaagggaggcgacccgcggcccgcccggcuggcaucccccagccgccgccagccccgccgaggggagccagcgccgucucugaggggcguccggcgccggagccaugacccuccgccgacucaggaagcugcagcagaaggaggaggcggcggccaccccggaccccgccgcccggacucccgacucggaagucgcgcccgccgcuccggucccgaccccgggacccccugccgcagccgccaccccugggcccccagcggacgagcuguacgcggcgcuggaggacuaucacccugccgagcuguaccgcgcgcucgccguguccgggggcacccugccccgccgaaaggugcgucccccgcccgccuucaggaucugcucagccccucuccgacucccuacagggccugcugacuccgcagugcccucuccucggcguccgcggagucccccaccuucuuccccggcccgcugggugccucgacuccccgcguuccccgcugcugcgaaggccguggcccucgccugcacaccgcgcccaggcucgguggcucuuaacuccgcgccccaugcacgcccccucucucccuccuugacuccucccagcaccccccuucuccuacccgcuccaucuggcuuucugccccccaugccccgccuccccguggccagguguccuggguccccaggagccccucgcccgagggacagagacagccccaggcaaguugaagguccgagagcccccggugggagaagcgggccgguggcugcgccgcgugcguucucacucugaggaagugcguggggagccgcugacuccggauagcacacccuuccgaggggacuccccgauuccugggcugggggccugccgccuggccccacgucugacguacggggcgcgagggccacugcucccuggacuucugucggaaccggacgcagugggaggggucgcagggcgcccgcggggcaggaaggaugcgggccgcgcccaccucugaguccccucugccagccucuuccucuggccccaggagaccugaggcucagaaccuacacaacaccagguuaagaagaggggccugguggccuuuccucacccagccgcccuccuucgccccggcccccagcuagcccccacacaaugaacagcuuguugagaauuugcauuuuaugaaaaucauguugaaagacaaaggggucucucugugcugcccaguccuuccucccuggccguuugggaacuguccccaccccugaggccaaucugguucugaaccuucucuuccuugccuugggcagcuuugggggaggguuagcaaaggcacagaacagaaaggcccugggcugugcaggcuccaaagaaaagggcugcucugggacuggaccuccucccaggaccaaaaaguuagggagggugagagacuacuuuaguuuaucaaggacccugaagagacaggaaccuucaucucucauccuuccuccacaccccccaccaccaccccuaaagaacucccagucucgguccuuuagugagacuugcugacaaguuugacaucuaagauguuuugucccagaaagcacaaaauauauggcaauggagagagagacccagguauagcugggcacagcuggucaccugcagcugggauccacaacugguccuugaaacggccuguaccuuaggagaccuggcaccucugaccccacauucuggcugggauugccagcccuucgggacagggucccugaccccagcccucccaagccacugucuguagcugagaaauuagauggagagacccaacuggcagaagguccucggagcaccuugauaggugagcccaggggacaccuauccucugaaucccacuggggaagagccccugccucagcuuugggagucuggauggccugagccucuacagacaugggcccuagggguggagaccauuuuagaauaaugaucuccccaccugcugccaguguggaaaccagcaagggcuuagagguucauggaucuggaacccaggaggaugguugugucccugcagucccagguaugaagguaaggccuguagagaaaguugaggaguggugccaguaguggcacuuggcaaauaguuccaccagcaccaaaacagguguggauguggagcugggaaggggcagacaggaagugggucgcuguguccaggguaaccucucagugucugcucaaggacagucccgccuuaccugcuccuucugaccaucuuacugcccagggcucaggauuccgcuggaagaaucucagccagaguccugaacagcagcggugagucaccaacacccagccccugccaugguccaaaggggugaggugcuggguuggggggugccaggacagcaucucagccuagcgaggguagucauucuccuagccuuuaaacauggcucccccgcugggagugagggcaggugggggugagggcugugugaaggggguggcagagaaaggagguagggacuuuugagucauuaggugcucuucaacacacccccagucccugccaguuaccccucccuggggagaucuggaugaacggaugugggaguugggaggggguguaggcaaagucuauggggaacguccuaacccaggccuccugggcuccccugagcccuccuagccuuggcaaaccccacgggcccagaccuuagccaggcuguguccagcugcuuggggcuggcugccccugccuccagaaugucaguccucuucuggucccagccuguggcagcccucuuaggagggaucugagcgugggcagaaguaggugcugacuccaggcccugggaccccacaguuucccuucucuacucaugucccaucccugauuugggcuugacuuucucuaaaauggaucagcaaacugaccugcuagccagauuggccuguuuggcccuugagcuaauaauuuuuaaagaguuguaaaaauaaaaacaaauaacaauauaugacagagaucauaaggggccugcaaagaaagccuaaaguauuuaccauuuggcccuuugcagaaaaaguuugcugacccuuccaaaaaacccuagaacauugggguagacgcggaacucccagccacccugcucccugccccaauaguacagagaggggaaaggccugcuguucagagugagaggggcucgagcuggaguggggaggugcugcucagcauuugggggaaucucugggucaggcuggaagcggagaagccuggucuccagggccuuuccgaggcugagcuacuugaaggggccuuuggaggcugcuuuaacugugccucuggcugggcgggaaggaagggggugggagugggcagaggaaacucugggcucccccagcaggcgaggaucuggagcagcuccagaccauuguguccagcgggcaggccuucagugcgggaaggggcggccucgaggcuccccucccccagcccccacaucuggugggcuggccccagcauagcugggaggagcagcuguggucuugcugagccucgugacuggccucuggggguggggccaguccucucuccaaagcuguggaacagaggaggcuccaggcuguggcugaauuucgggccuuagcuagucaguaagugguacuguagggcucacuggaaagcugggauggggcuaaaaaacucagccggcucauccuucaggggaccggcccuucucugugcuucccucccaccacuagaggcuggauugguucucuguggcuccaugaggcugauuucaauuggguaugggaaagacauuccaauaaucugugaugagacugagcugucacuggagacagaguccugcuggaauguucuagaccaguugccaauauccagggaggcccaagcuaugggacuucuacaccuuuuaauccuaauugucuugaccccugugucucuugcaggaaagugcugacguuggagaaggaggauaaccagaccuucggcuuugagauccaggugggagaagcugcacacaggggucagggggguuggaugaccagccugagggaugaacggacuugucccaacccugggcugaggguccccuuguccauuacagacuuauggccuucaccaccgggaggagcagcguguggaaauggugaccuuugucugccgaguucaugagucuagcccugcccagcuggcugggcucacaccagguggggccugagcccaggacacccaggucugggaaggggauaugaccuuacucccaagcaaagggggugagcaaucucuccugaaaucaauuccucuuccuuuuccuucuuugagaaggccagaaagaagaauggauagaaucugggcuuuggaucuaggcaaauuugccauguacugugugaucuugcacagccccaucuacaaaaugaggguaauaaugcauccaaacaucacagugcggcaaggggauucccugggcacacugccagggccuaauuaaugguggaugaugcugcugcugcucugauuccucccagcaacccuggcagucagcaugggcaggagccagggaagaagcaacauuccauuaagucuguuugauauuggggaucaggccaauccugccccaaaaugggcccagugcugaggaaccgauguuacucccuuuuaaaaaauuagaaacuuuuuuuuuuuuuaagagacagggccucagucugucacccaggcuagagugcaguggcguaaucauaacucacuauaaccuugaacuccugggcucaagcgauccuccucuugccucugccucccaaagcaauauguuacuuccucuaacaaggaaauuaugcuucagcaggagaucccuggauugagcagaucuagaguccccagguuccaggaagggcagccugaaacuguaugaaucaauccccccuccaccaucuuugccccuaagccccuaccuccuucccacuuaccagcagcccgugcuagcuaucuuaguccauuuucuguuaccauaacagaauaccugauacuggguaauuauaaagaaaagagguuuauuuagcucaugguucuggaggcugggaaguucaagacuggguggccgcaucaggugagggccucaugcugcguucugacaugauggauggcaucucauggcaggaacgccugcaagaguggugaguaggcacacgcaaaagagacaaaacaugggugaucuugcuuuauagcaacccacucgccagguaacuaaaccaguccuaccagagcaagaacucacuccccaaaaacagcauggaucccuucacugggcagauccuucauggcccaaaugccacuuuuuuugagauggaguuucgcucuuguugcccaggcuggagugcaauggcaugaucucagcucacugcagccucugccucccagauucaagcaauucuccugccucagccucccgaguagcugggauuacaggcacuggccaccaagcccagcucauuuuuguauuuuuaguagagaugggguuuugccuuguuggccaggcuggucucgaacuccugaccucaggugauccacccgccucggccucccaaagugcugggauuacaggugugagccacggcgcucggccccaaaugccucuuaaagguccuaccaucucucagcacuguuacguuggggaugaagccucaacaugaguuuuggggacaaacaauauuuaaaugguagcaguagccaagugguauacuacaacuucucaaaguaguuucaaauccacucucccuccccaucaucccugaagcauccacagcagggauccauaccccuuuuuacagauaggaauggggcccugacauggggcacacugugcuugaggucaggaagcucuccaguggugcaggguagcagaacuaucccucugggggccagucauucccugugcuucucucccaccaccagaggcuggacugauuaucuguggauccaugaggccaugccaugccuggggccagggucgguucccagcugggugcugcucaccugcucuucccugaauugacugggucuuauggccagcguggacuggacagaaauaaccaaaucugaggguagcccaggguccugggugggcuuagcuuugggacagaacuucuuuuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgccugcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccggacagaacuucuugagggcagagugaggguguugggugugugagguccccacccuuuggcuggggugcugggcguggacaaccugguagucacuacaggcccacaagaauggcugugguucuguguguuuggaucgaguaugagagaugucagaggagaucuacagagaaccaugaggaguuggaggagggaguucaggaguauucccuggaguuacuacccacccuucuccccuuucuggcuaagguaggaggcugguauucuagcaugccccauggagcaaaucuaacccccuugucugccuggcaggggacaccaucgccagcgucaauggccugaauguggaaggcauccggcaucgagagauuguggacaucauuaaggcgucaggcaauguucucagguaugucugggagccgaggugccugaauuccugagcucagccucuugguauuuccucagccuguggcucacucaggcuuugauucuccaaccucagacuggaaacucuauaugggacaucaauucggaaggcagaacuggaggcucgucugcaguaccugaagguaggggaaccuagauaacguccagccuccacccuccucuucccaagccucugcccuguggggggucacuuacagcugaaucuccuguaacugaagauuucuuuugucuacucccugaucccucgucuguacccacguccugcuaguuuccugcuagcuugugacagugggguggggacugucucuugcagcaaacccuguaugagaaguggggagaguacaggucccuaauggugcaggagcagcggcuggugcauggugaguagaucccggggugugaggggccacuuguucugcuacagacaccccaucugcgcuucccccucagaacuggcggguucuaguaaagaacgguuuacuaguaaaccuccacaguaaagcaagguuuguugagcuacuacuacuuuggguacugccgcagccacauuucugguuauucucacacuagcccucugcagguaaguaacagauagugucaucuucacuuuacagaggggaacaccagggcucaaagaguuugugucaauuauuuccgaggcccguuugugcuaagcggcccccauaaggaucugagugauaauuccugauuugcgggugagggaaguagggucucagguuugugccuggccagggccacagagauggucagcaggacggagcggggacgccccgcccaugcccuccgacccuuugcagaggccaccacgguccaggccugacccgcccccuaccucucccgucucugcgcaggccugguggugaaggaccccagcaucuacgacacgcuggagucggugcgcuccugccucuacggcgcgggccugcucccgggcucgcugcccuucgggccucugcucgccgugcccgggcguccccgcggaggcgcccgacgggccaggggcgacgccgacgacgccgucuaccacacgugcuucuucggggacuccgagccgccggcgcugccgcccccgccgcccccggcccgcgccuucggcccgggccccgccgagaccccugccguggggccgggcccugggccgcgggccgcgcugagccgcagcgccagugugcggugcgcgggcccuggcgggggcggaggcgggggcgcgccgggcgcgcucuggacugaggcucgcgagcaggcccuaugcggccccggccugcgcaaaaccaaguaccgcagcuuccgccggcggcugcucaaguucauccccggacucaaccgcucccuggaggaggaggagagccagcuguaggggcgggggcgggcagggagguauuuauuuauuuauucgcaacagccagcgcuaaaagagggggaggccgagccaagaggaccccaggagcccagagcagcgggagaggguccuuccuagccucggcccgccgggucgguuccuggcuggugucugcugagggaguggggggcccagccccuucucuucucccccgccaaaccacagugggagcuggggcagggggagagccaggcaaucgggggccaaagaugggggugcucgccuacagucugcaucuguagugccuugugggguauccaggaacacccucccagcaggggaugggaacccugucccaugaagcccucuccucagcuuuacuugcucccccgcccuuagccuuggggagaaauggcccguggugggcugaccccccacccuccacacacacaguuccaugacccagcgggcccccaggggcaucaggugcugguccuccucccuccuggccucgaccccuaagggcuucgccccucccaggggccuguaacuaagucggguccugccaggcagggggccuguguucugugccccuugggagacaggaacuggcgaguucaggugggguggggacagcacagacuguuccaccguugugcauauuguugcuucugaaccacaaacuguauaaauggaugguuuuuugcau

SEQ ID NO: 17963 - RNA, 22164 nt, Homo sapiens
caggcaugggcgccccugcggugcagagcagcucagggccggcuggugcgcgaccccggaaagcggggguggagaggcgagcggagcccgcggggccaggugaggggcugccgggguggcgggaggugggccccggagaggccgggcaaucucgggucuucgguggaugccuuugggcgggcucggggccacgccggagucccgcuuggaaacuggggagucgggggggggacuggauucccagcggaaccgcuggcuccgagucagcccccaagggcgacggccaaggcuuucucuccccaguccgccaagggugggguuuggcccacgaggggcgcuggagguggccaggccagagaaauuccuuccauuucuccgccggcugcgggaaccgguuccaggagcgcgggagcucgucugccaggagacccagccgggagggaccgaugcugcgugaugcaaccccuucgagggacugagucaagaaaccaaggcugggggucucguggagucaggcggagcuggggauuaggacucggggcuugugucucccaggcguguuuuuuuguuguuguuuuguuuuuuugccgcaacaucuuccuuauacuggguggggugggggcggggguggucuguauuuccagaccuccuccaugguggucuggcuguguggagggcagggcacaguuccuugacuuggcucauucccccccaacgcccccccuuucuuuuuuuuuugagauggagucucgcucuguugcccaggcuggagugcaguagcgugaucucggcucacugcaaucuccgucucccggguucaagcgaaucuccugccucagccuccagaguagcugggacuacaggcacccaccaccacgcccggcuaauuuuuguauuuuuaguagagacaggguuucaccauauuggccaggcuggucuggaacuccugaccuugugauccgccugccucggccuccuaaagugcugggauuacaggcgugagccaccgcgccuggcaggcucauucccuuuuuaugccuucguuuuugauagaugaccuggggaugggagaaaugcugcagaggugguuuauuuacagugaauuguuaauuugguuguggggcuaguauuaggggcacauugggaaaacacaggcugggcagagguugguagguucacaacaguuaugcccacugggugcugauggauuugggggcugucgucggccuggcuuggggcccuagugguggggcuacaaggcuugcuccuagaucuacuccaagugaacauuuaagaucagugacuuggauggagacuuaaaaaggaagucagcugacuccguguagucauccagagcugugaggaaugacaagugcacaguauaaaaucaagauucuaauugaagguaacugggcagaaggaugggccgagauuaacggugugaaugugacugacgauuccugugcugaggccucugcuggacuuaagaaagucagcugaggaguucaggcccugugccuggcucaaaggcccagggacccaggcccuuagcuucugcccugcucucuggauggaggcugugggacugcucugugcagugugaagccuccauccgcuacacagguccaaguggguggcagggggagcgagaaugccugauucuggacuccuugguuaggcucccuggguucuaaucccaguuuugccaauuccuagcugugugaccuugggcaaguugcuuaacauuucuuucugggccuuaguuuccucauugguaaaaugugcauaauaauaaucccuuccucauaacauugugaggcugaaaugagaaaaugcauguaaagugcuuaauguaucuggcacauguuguuuaacaaauauuagcugcuguuguuauugcuaauaauaguaauaugcccacuucuggguagggauauuggccaaugcagagcuuguacucaggaggccaccaggaccugucacgcagagggccugucagcgguguccuguugcaaggggcaguuuauuaagaaaagacuaaaauacuugcuaggaaggacuagaaugaggcuuccugugggccagugcaggggacagagcugggauccagggcuggggacuuuuagagucagggaugugauucaacauaaggaagaaccucugcucuggcucuuggaucugccgccaaauggaagggacagcuccugagcuggaaugcucuccccaccuagcugaccuuccucccagcacagcuccaaugcaggcaugugcauccaccacccuuccacgcacacuuacugagcaccugccagugcugagcaggguuuagagacugcagacucugcagugauugagauggacagcguccuuagauucugguuggguagacaggugauaaaccagugaacagaugugaacauuagaccuaugaugaauaaaaucaggcuaguguggugggguggggaugcaagcuguucagggaagugacaugggaauggaaaccugguugaugagaaagagccaguucugggcagagggaauggcagaugcagaggcccugaguggggagagaaggcccacgugaugggaccauagugaguggcugggaaaugagguugguggggagcaggagcuggggacugaagucuggccugaugguccaccccauuuugggggccacuuucuccuccuccaagcccacucagccuuugguuugcucucugcacagugcagacuguacuugaccuugguucaucccuuaucagcuccuggggcucugggaucuuggugugcucauucuugccucuccuguuguucggggcacacugccuggcucccggggguccucaguaaaugcuugugaugugacuauugaggggggcauuuugaucuggaacaaguggggaaacagauaccuguuugaagaugcuaugaaucauuugugggcaccaccuggugccaaacucuggcccccguucugagaaccagauggggaagaccugggcacucagguugggccugacuaugguaggugguauuuggcccucccuacccuuccuccucagcaguggggugguagggagaaaagacaaagcugggggaaacuacagaccaguuucggggggaugggaggaugacacugucauccuggaaagcagguguaguccaugggccggggcagguuggaaaccuugucuugcuuucuguuugggguuaaaggugcuccagauguuccagucugcccucccuucccuccuugucuccuguggccuuuuccugcuucccaucauacccacaggaucgggagggaggggugcugacaauguuguaaggggagagccuggguacugugggccagaggaucuucccuuggccuguagaccuugggcaaaggucaggugggugaggaagcccauugcccacccucugggguccuccuccucuuugccccuccuagcucccaucaucuccuucucuuuucccagaccucaucucagucugaagggcaguccaauagccagugaaggccugguccugcccucacucuggugcguagucgagaggagagagcacuggaggggauggaagaagagaaggggagaugugggucaaggugccguggcugaaugggguugggggagagcugaagaggcugggguguggggugaggcacacaguuggcuuccacccuggaaggagaggccaggugcccaggguaccuuggacuaggaaccagggguuggggcuagcuuuuauguguguguccucauugaacuucuccuaauauugauauguaguagauauguguauccagcacuguccuuaagucuuuuacacauuaacuuuuuuuuaagccugcugauaagccugugauuguuaauuuuacagaugucaucauuuuuacagaugaggagcaugagguacaaagagauuauguaauuugcccaaggugauaagcaguggagcuaggauucgaacccagacggucugggaucccacauccacucuacucuaaguugaguggagccccugucucuugggggccuccgaggcuuuaggggccaaacuggagccccuuaaggagagugggguauuccgcucuguccucacaauagcucccuuucugugcccgcagcaugcccuuuugugcaugucaaaggccgagagccaggaaggguaugagguggaguugcuagaugcugaugugucuauauggcucugaaaugccccagaugcuaucagcagcuccuggccacacccuacaccccuggaagcagauugccuggggccucggcccccaggcuccaaugccuaacccggggagguccuugggcgcuggcuugucccccucuuguggccuagguccugccacugcucccauuccugcguguccugggcaugcugucuccagggaaugugccugcuggcugguuucucuucacucacaucgacucucccucuguaggccuccaccauggacagaggccaggcccugccccucccaggcagccuggcuccuucugcugggcccugaaggcagacgggauaaugugguuggccaaggccuguugguccauccagagugguaagugcucugcuauuguccuuuguacaccccuccagcaggugggguuggggggcagagguggggguggagcugcccaaagcggaugugguuagggggauggaggggaagcccuggggagguggcagccgaggugcuguucagugugcgggaucugauuucuuuagagguugggguagugugaguguggggacuggggaagccuuauuuucuuggcaggauaggcuggagggcucucugggccuaggugacacgggcuggugggaguaggggaugacagcugcucccaaggcagcaugugccugauuccaggaagcagauaggguagaauagggugucugggggcugggcugggagcaucauggggcagacguggcagcggggaacuggccugucucccagguguagacacuucuccaggugagugcaugaagggaaggcugggaccuccccuuccucguggaaagcauggugccugccccuccucacuguggcaggccagagggccuauggagucuguggugucggggguggccucugugaaugggaaggcagggacagcccuuccacuacugguguucuagcacaucuccuucacuuacagaagaggagacuuagguacagaggggagaaaugacuuuuccagggguccugcagugaggauguguagagccaagcccagaaccaugccuccuggguggcuggcaagcacaggcaccuggucugacuguggaagacauaccuuccuugacugagggugcuuccggagaaggcccacacugaucuggggcugagagguggaggacgggaaugggauuuucagcaggccuuuccuggggacaugagauggggccaagggcacuguaguccugguucugugccuaaaggagcuggagcucugccuugcaccccagacaggggucaugagauucccuuccuccuucccuggaagagggccaucuuugggcagcagcccucccaggccuugagaaaucccggaugaagcacgcacuggcucaguaucucccucagcuucccaaacacuguugccucauggggggucagcguucagggugcagagagccccagagagguggcugggguggggaggauggggugucuggucccagccuggagggaagggggaagcccugggaagcagggccuccuguucugggggcagggcugggugugugccuggccuccugauggcagcaggugcuguaccaccaaccucgggcugaagacagggagaggaauuacuguaagggggagaggcagguguucucuggucagcuggagaucuggacuugggaagcacgugagugaggaugacagcaguggccaggugucccucccucaacucggccccuacauccgcccccaguccagacccagcuuccugagcacucagcccucccucuggguacacagcagcccuggugggcagaauuccuuguguuuaccucguugucugggugaugguggugauuggguggaacucccaugccagauauacugccaaggccacccugaggggcugccaaccggggccccaugagugcuagagcugcuggucuugugacgugggcaccugucugccaggccugggcacgggcccagggucacgcucaugcuggggcucccgucagcugacuauuuugggcucuugcugaccugggccaaagucagguccagucaagagggcccaaaguggcuccccccauccccagaggccggcucugguuucugcuauauaaacagaggaggacacgccggcuuggaggcagcaccacauccagagcucgcucagcugcugcccagccucggcugugaggauaggcuggcugggcagcacgucucuccccacagggcucccugagaccaccaggaagagcccccaaccaaucuugggauucucccuucgugcgguugucugggaccuuuuuccagggucaaagcagaucgugaggaggaagcuggugagucuugggacagggacauugaggaaugggagcugggcuguuuggauuuuuucccauugugacugucaugccaaacccuuuggccuugggcugcggggaggaagcaaggguggccgacaacuggaggcaugagugugcagcuugaccacagcuggaugacgguaguuggacuugugaacgcugugacugagaacuaggagagguguacagagacagcuaaugcagucuagcuccuuucucagagcuuccccacaggguguccguccuccucuccucuccaccccgccuggaugaggcacuggucacugcggcgaguuugguguccauugggguaucucaggauuggcuucugaguggggccccugagcccccacuaguugggacugaguggcugggccaggggcuuggcguucugcugagcccucagucccuggccugccccgcuugccgggcccuugcccggccucccagcugcuuugggugccugagaagcagagcuggagagaggucuggcaaguccgccaaccagcuugccacaaacacgcuccgggaccugggccagggacucuggcccggcauggaacaggcagcagcuccuuacgugggaggcuccugugcucuccuucccaguucucaaaaaaaaauuuuccccuuucugaacgugagucucuaaacgaauccagagccugugacuaaaaauacuuuaacaauaggaaagugcaucagucuuuccggcugggacucguuaucagagaguuuuuauuuuggaauuugaaauuuugcccacguaggcuggguggagaccuugggcagaggcaagggaauuuggugggugcugauguucugcaagguggugggagacccuccaaggcgagaggagaagagagcuggccaggagcugaagagacugagagggaaacugagggagguucaaggcguggggcaaccuuucccaaaggaacuccgugaucuugucuguguuuuccagccccgucuggugguucuuccugaagucugaucuuauucuuuuaugcuguauguuaauuucuucuggccugagagggagggagggagggguagagaaaucacuggacugaagauagccucuguggccauagccugaccuccuuaauuaacuagcucucuccagaguauuaauugaccacucgcugcauacacagucuagaauucucccagugcuggguagagccacaucucugggcacacucucuuuuccucucacucagcccaggagugggagaaguagagaugggguuacuguuugucuguaguuccuggagcaggagggcugccggcucccccguccagcugaggacccugcuaucuccugccccugccacccucccugccagccccaggauucugcugcaggcugcugugguugucccguugcagacaugaguuccacagggccgagugugggacuugaguaugcauggauuuugguauaugucgggguccuggaacccaucccccuguagcacuucccugugcccuggagguacugccugccucccgacuuccacccucacuugccauuacagguuucccaugacagugggggagcccaggccccaggcagugcuacauuuggauguggagccucuccuuuccauugugaacugaauucuaccagcacugggccuggugaugucugcauuaggcagaugaggaagcagucuuggagaggacaagggacuggccucaggucacacaucaggcuugcuagcuccuggacaaagaugccucugauagcucuuccauauuucgccccugcugagagcugaggggaggagugcggccacuagcugaccugccugggucccugggaggcugguuuuggggagguagugauacaugugcucaugguagggcuugggcaagggccaggagagcagagccugggccugaccuuucaccccugguucccagagcugcccacgggaagcccccagggcaguaggcagugcuucccugcccacagugcaaaucccccugccuacugccaaagcaggaagaggaaguggccgggucagggcuggcaauaggcccuggggccgaggaggggaagcucccagggccacuucugagcuggagaaggcaaagcucacuccuucugcccaccccaggggaaggguguggaggcccauggguggggacagucucagugaaaguagggcaaguuccugaccucuacucaguagggguggggcccagcccaagguggaggggcagcgugggaaaagggcuguguaauuccacuuccuucauccccuguuuacccaucuccaccccuacccucugggcuggggaauggugguggacauuggcugcucacuuggggccugcccugggcuacuuacuacugaggaugcacaaaggaucuucccaccacggacuaggagacagugcccuuguccucauguuguucacauacuggucggugagggaugggucugaguacaugauaaaucccugggccccauaagauuugacuaggagggguaagggccuggugaacugcucagaaaauaaacuguguugucagcaggaggaccccuuucuacuaugagauauugcauucccugcuaaucauacuugugcucuaucuguugauagaacaaauacauaaugagaaacagccacugugcuuucagaagaacacacuugaaagaauuuguucucaauaaauuacaucugcaucuggauccauaugaagaaauacguuccucucauucaggcguggcuauuuuaaaauaaaauuugggccgggcacggugacucacgccuguaaucccagcacuuugggaguccgaggcaggcggaucacgaggucaggagaucgagaccauccuggcuaacacagugaaaccccaucucuacuaaaaauacaaaaaauuagccgggcgugguggcgggcgcuuguagucccagcuacucaggaggcuacuaggaggaagggaaacaguaugcacagugggugaaacaguaugugcaaaguggguggugggaagguuuagcucaagguccuuauauggggucgguggggaacugcggugaugagggcagauggauaggcugggccguggugugggggccugacuagguggggcugucucgucuccaucgugacaucucuccccgcccuuccauguugucauggccuugccuuaccuccaggucccugucucuaguuuuggauaccucucucauuauuaccuguucccuccuaccccaucuccccgacaauuagcuguucacucugaccuuguucuugaagguuagacuuggaggggugugugcugggagucuguggccagucugggaccagcauuuguuuuaggccucccaaaguccacgucaauugugccuuucuccaaaguuccacuagcuggaccccacucucucagaggcccaggccauucucccuugagggcccacaaggccugggauccccaagccccuuucaccucucucgccuuuaucuuaggcuaggugcuccacacgggaaccugcauugguggccccagcuguguuuccacagagggacuuugccuuuuucuccuuauuuacuuauuuucagaaugugguguguugagcacccccaccaucucccaccccugcaagcaugaccagguggcagcuguaguuccuuauccuccuccaggcuuuggggcagcaggacugcagccuccauaaccugcagcagcuuggggagguggggccugggcugcaggcccagaucuggaggcuagaugcugagauucagaccagggaccuggacagcuccucaccacacucaguuuuccuugggcuuaugggugggccuaccccacaggauggucugugccacuuuuuacaaaugccaaguugugaggaggagaggagggugccugagcuugaggcugguucaacucucaaagagcuagcaaggcugggccgagggcgguggcucacgccuguaaucccagcacuuugggaggccaaggcggguggaucacgaggucaggagaucgagacuauccugguuaacacggugaaaccccgucucuacuaaaaauacaaaaaauuagcugggugugguggcaggcaccugucgucccagcuacucaggaggcugaggcaggagaauggcaugaaccugggaggcggagcuugcagugagccgagaucgcaccacuucacucuagccugggcgacagcaccaucucaaaaacaaaacaaaacaaaaacaaaaaacaaaaaaagagcuagcaaggcugagauugagcacagacuggucaagccacagauaacgcacuuguucuugcugguuggcaggaagaacaauggcuuggcugaucaucuuuugcuaccuauuaaaauugguuuuauuuuggccggguacaguggcucaugccuguaaucccagcacuuugggaggccaaggcgggcagaucacaaggucaggagaucaagaccauccuggcuaacacagugaaaccccgucucugcuaaaaauacaaaaaaauuagcuggcgugguggcaggcaccuguagucccagugacucgggaggcugaggcaggagaauggcgugaacccgggaggcggagcuugcagugagccgagauagugccacugcacuccagccugggugacagagcgagacuccgucuuaaaaaaaaaaguuaguuuuauuuucuagggaaggcccugcugggguggagggagacauccuggggcaaagugggugcuaggugaggaagucagccugugacacagcugggaucaguuccacccagcaagacuugcugugugcuccugagcaaaguguagcuccucuuggaacccuugacuccuaaucugcaaaaugggaggacuugaauucuauaugugguuuuaaaccuuuuuuuuuuuuaagcuguggagucauuuuccacaaaaggauuccacaaaaucuaagcaaaaucuuacggaaaagccuaagagaaagaaaagcaaaacuuugccugaaaugagguagggauccuggauggguccaauuggcaucauccugcccacacuucacauucaaccaguggccuugaaggaagaugguuuggagcaacccagagcucucugcagaugcauucacguugagacuguaugcugggauggaggguucuggcagguucugaccagaugacugaaugccaucagcauuacagucaccccuugguuuaugaaggggguuggcuccaggaccccaacuuguacugcgaauacucaagucccacuguuggcccuguggaaccuguagauacuaaaagucggcccucuguauauguggguuuuuggauccauguuggauugaaaaaaaauccccaaauccccauaugaguggaccuacacaguucaaacguguuguucaagggucaacuguguaugaagacugcuccaucugugguggacagugaggcuuuagaaagaggagacaggcaggcuaauggauggucuucaugggugugggaaaggaggaguggucacugggcgcaggcaguuggucugugggaccagugaggcaugggcuguggcuggcaguaggaaagcgggagaggcugagugcaguggcucaugccuauaaucccagcacuuugggaagccaaggcaagaggcuugagccugggagguccaggcugcaguaagccauaaucaugccacugcauucuaggcugggcaacagaacaagaccuugucucaaagacaacaaaacaaaacaaaaacggggagaggaaaggacccaagagauguuccaaaaaagaauuucaggaaacagugaaaaguugcaaauggggcaucaggagccaggagcagagauuagguggcaggcagggggugcagaaaugacaaguucugucuggaacagaugaaauuugaggugcuugugggaccuuugagugggcagaagcgggggcuggagacaagggugugggaaaacugugauggggguugaggguggaaaucgggccggcagagccuccggggcagagaaaguccuauggggugaccagaugaguugagaacugggugggugggugcaggcucaauggaagcagaaacucauggauauugacuuacaugggagaaggggaauggaugggggucgcagugggguggcagggcucucuuuuccuuguuuuuguuuuuuugcccuucccucuucucuuacuuuuccgugagggcuccccaggcucaggagagaucaggguggaagggugacggccaaaccagggaaggcuccagguggcugaagccuggucugugcccagcagggcccuggcgggcuguuccucacuccaccgggcaggugauaacuggucagagcugccuccccacaggugcuggagguaggcugggagggccggugcucccugauguggacagggggagggguauugauaagaggcguggagagaucccuagagaugcagucuguggcccuggguuccaacccagugugccaccaccuggcugugugaccuucagcaagugccauuauuucucugagccuguuuguuuauaaaaugaggaagaguuggcacaaguuugaaaagauuucucaggcuccacccgguucugaaauucgguaauuucccaacuagggugcacucccccuguaaggggcuggggaggggacggugcgaaaccaaguucagcuuguggagcggagccagagcuguuggccgagcuugggccuggccaacgccugcccucgggaagguccuguguagggagacugccuggagggacuaagcgagggcucuaacugacgucucaggggcagccucucagccugagacccugcuggggaagccgcguccugugcacuagcugcgccuagggcugaggugagggcgcaggcuccccaggguguguccgaauugcccgccucagcccgcggccuguccugaccgcccagcagcggcagcagcgacacccuagggcuccaggaagggcuugggaagguguaaaggcggggcuaggcucggagggagccggagggaccgggcgcgguuggcucccgggagcaacuggagagugaggagauccucauccggggaagccccgcggccgcgucucuacagcgccccuucucgggcucuggcccucccgcugguuauucuggaccugggggcccccagcugggacccgaguccggugcggggagccuagugggccugggagcugcuauuuuuagcgggcgcggcgggcgcgaggagccuauuuauagaucaaacaauccgcgcucccugcgucaauggaaccccgcgugcgucacgcgcgcagacauuccaggcccccccuccucgccccgcccccucgggcuccccgggccgcaccucccccuggccgccucccgccggaaccgcaccgccccccgcgcccuuguauggccaaagcucgacgggcggccugcgucaguggcgcccccgccccuccccgugcgucacggagcgcuuaagaggagggucgggcucggccggggagucccaguggcggaggcuacgaaacuugggggagugcacagaagaacuucgggagcgcacgcgggaccagggaccaggcugagacucggggcgccaguccgggcaggggcagcgggagccggccggguagguucccuucggggaacgugcaucuguuuuuaggagcggugcaugaaggagauggguguacgcgcgggcagagaggauguuguagggccggcaugcaagaggguagguguagugugcagcuguagcacaacgggaugagaacccaggucagacuggaaacuacugggugcgggguaggagguaggggagguugacuaccugcaaaguggaagcuguaggggguugggguuggcgccgggaguagggacuuguccagcaggcggcuggccuuaguucagucuccuagggugcccaacugggcgcacggugcucugaacuuggguggguguggaugggggucacagcaccgugggggaacagguacacagagcuuuggcgcugcugggauccguacgauucuaacugggauuggauuuccaaaaggcccuccuuccucccagccugucagcucccucccagugucccgguuguuuucuuaacacuuuagaggcuguggcugaguuggcagggguuccccacccugaacuuucugucugaggugcguuaggaagccuccggaucauugaaggaagugacuggcuugguggcugaccuguggagggcugcuugcuguguauugaauaaaggaggcuucuuggggucggggcagggucucuguaagcacagggagaauugauuucgcuggggcuuggaucacgugugugugugugugugugugugugugugugugugugagagagagagagagagagagagaaagagagacagagguggaaacccuuguccuuggggauccuggauagaaguugccaguguuggagucuuggggcggugcugccuagaggauaccucccaaccauuccagcuccagaugcugaucaucccuaugcccccucccccaguagucucuguuggaucuuacagguagggugcagccugaggcuuguucagcagaacaggugcaagccacauuguugccaagaccugccugaagccggauucuccccacugccuccuucaaccccgccucuuccuccuccugugggacugcuccccccuccugugaggcuagauguagguccauaucuuguguuguuaagaaccugcaugaagggggagggacugauggggguugauccggaugugggacguccagguggagaaacaggauuugaauaaggcaggaacaagcgcccaguucugcccaacugcugucuuuccuccuucacccccagcccaucccuggccaggcuguccuagugcaggcagauguggccacccucaccucucgcagggugcugcaugccuguggacuggugccacuggguguguggggccugagcuacaagggucucuguugucuugguugucaggcuagggguggaggugcccuguucagggccuguggaguuagaaggaaggcuaggaccagagaggacuuccugggcucuuggccaggagguggugacagccuuugcccccaucacugcaccccuugauuaugguacucuguuccugcuugauuucuucuccagcuucccucauugacuggugaggccagaguuacgcagaccccagguguguagguugggagggagacuguccuggagccuccucugcauuauuuuuugaccauucugugaauguaaggaucugccugaaugaugcuaucucuguucaggcucucuucaggcuccucgggacuggggcuguguaacccccuuugccugagccucuggauucuucagggcacagacccugcuuuaguggagggacccaggcaggggcagaaugucuuccacccacccaccagcaggcuucuccuuaagucuucugcuggacucucagaguucucuuauuaagauaacugggggcagcagaacauucuuuuuagguacuguuguccauucuccugagaguccagggggcuguggucuccuuccuccccccuugcccuguccccagcaaauggccuuuaaaggucuggagccagguuaccgaugaggaggccuagguucccuuccucuuugcuucugggagcaucucgagcagugcagaguggcuucccagccccagauggcaggauugggguggguuugggaucugcugccuuugcucagugugcaggguugggguggaaaugggggacaggcuagggccucugcauuaggcugccuucuuaggcaggugggcuuucacuuccagcuccucuuccauuuucacgauguccuucuuccuaggcacugcgaggggaggagaaaaggggcuuugcagaggccugggaguauucccaggaagugccugguuggcgaaacaaccagggagcugcuccugggagcugggcugaggcuuugcugggcugccucucccacucacccuucucccggcccccaccaugccuuccccaugggggaggggcagggggcuggaggaacacagcuucccccuguucuagcagagaaaugcuggcuguaugccuccccuaggguucccaggcugacuaggguguggcuggccuucugauggagcccacucaugcugggccgcugcccaggggcuuuguggcaccuaggucgagaugguacucaggccaggggucaggauuccugggugcucuggucccggugccucugucucaucuuuaggcugggauuccugccaccuugcugcucuggggcccaaauacuuugagacaaggcuauaggcuugucccacugacucuccuuucccucccuggggucuccucucucuccagagaugcccuguauccaagcccaauaugggacaccagcaccgaguccgggaccccgugaccaccuggcaagcgacccccugaccccugaguucaucaagcccaccauggaccuggccagccccgaggcagcccccgcugcccccacugcccugcccagcuucagcaccuucauggacggcuacacaggagaguuugacaccuuccucuaccagcugccaggaacaguccagccaugcuccucagccuccuccucggccuccuccacauccucguccucagccaccuccccugccucugccuccuucaaguucgaggacuuccagguguacggcugcuaccccggcccccugagcggcccaguggaugaggcccuguccuccaguggcucugacuacuauggcagccccugcucggccccgucgcccuccacgcccagcuuccagccgccccagcucucucccugggauggcuccuucggccacuucucgcccagccagacuuacgaaggccugcgggcauggacagagcagcugcccaaagccucugggcccccacagccuccagccuucuuuuccuucaguccucccaccggccccagccccagccuggcccagagcccccugaaguuguuccccucacaggccacccaccagcugggggagggagagagcuauuccaugccuacggccuucccagguuuggcacccacuucuccacaccuugagggcucggggauacuggauacacccgugaccucaaccaaggcccggagcggggccccagguggaagugaaggccgcugugcuguguguggggacaacgcuucaugccagcauuaugguguccgcacaugugagggcugcaagggcuucuucaagguaccgcgcagccccagguggggccuuuuguuggaaauggagagaggcuggccucaucccauugggaccuguggucucccccuggguucuccuccuagcuaaguccuguccugcagggugggaucagcccugccaggugggccgccuuccuggagacccguagaugccagggcuggaagcuuucauuugccgggacacucgggcccaugggauugcacagagcuggagggaggggugagauaggggcagauaggagcugcaggggugccuggcgagccucugguuuuccucugcuccucugccuguccucucccaacucaagguucuagugggaaggggugcccccaggcucucauguuccuggcgugagaugaaaggaucccugcggaggguuugguucuugagggcuggggguggacuugggaacaggcuguguguuugucccagcgauggugccugcuuagcuucccguccccaccccccagccccuuggcccucuccugucugcccuagggagaaggcagguggacaagggcccaugaaaaaauacaggugucuagacugccagggagacccuggcccccaguaguguguccuggggacuuccucagagcgagaaaccucccccaaugucuucaagacuuuucucuccccccgcccaaccccgucucucccucccuugccacccaaauguuagaaaaauagcugugaacagagagcgcuuuugucugcaauggcagcaggaucuggacgguccccuccccuaaguuccccccuccccaccccacacucugacagcuuguuccguguugcccccccacccagcgcacagugcagaaaaacgccaaguacaucugccuggcuaacaaggacugcccuguggacaagaggcggcgaaaccgcugccaguucugccgcuuccagaagugccuggcggugggcauggugaaggaagguguguggcuggggugcggcccagcggggcaaggguaggcuugaguggagugggaccagcagggcccccaggcuucugcccuggaggacccagaggagggcacgucuuauuuccaccccaccucugaaccccaggccuuggagggaggcagccuacaccugccuggauugugagggugguggcagggggagguuccuauaggguaccuuggaucucagggacucuggguccuagggacucgguggggcgcgucucagcaguggugugcacggcuugggcugagaggcccuuccucagaucccuuccuuccucaccccuacccauuccuuugcaguuguccgaacagacagccugaaggggcggcggggccggcuaccuucaaaacccaagcagcccccagaugccuccccugccaaucuccucacuucccugguccgugcacaccuggacucagggcccagcacugccaaacuggacuacuccaaggugaggucccaccccgugucugccuuggggaggucuaugagcacaugcagugccuuugugcguguuaggagagcuacccccucuggaaggacugaaugagaaaggagguuuaaaaaagaaagaaagaaaagcgacucccuccaguucgacagaucaaagagaggaucccccucucggcugaccagaugggaaaaugcacccccucaggcagguggccaauuagaaaaauauguccuuuuggcagcugcagcccuggguuaauaugugagacuuggcaagugagagccugggcaggaucucagauccacucccacucccgggaucuggcauccaagugucugacacagccauacguggcaguggguguaggagccugccuggggugcugaccccacuggaccgucuuccuaguuccaggagcuggugcugccccacuuugggaaggaagaugcuggggauguacagcaguucuacgaccugcucuccgguucucuggaggucauccgcaagugggcggagaagaucccuggcuuugcugagcugucaccggcugaccaggaccuguugcuggagucggccuuccuggagcucuucauccuccgccuggcguacaggugagagccacugacugucugcccagccccuuucccugauacaccugccugugaaccacccugaucgcucuucgugcccaucugccugccaggucuaagccaggcgagggcaagcucaucuucugcucaggccuggugcuacaccggcugcagugugcccguggcuucggggacuggauugacaguauccuggccuucucaaggucccugcacagcuugcuugucgaugucccugccuucgccugccucucugcccuuguccucaucaccggugagugaccagcaccacaccagguccaagggaaugggcgucaggggguugacugguucucaggagggcacugucccagggaguuuggugggccgggaucuagcacuuucugggccccugcacugccccgggcucaugccagcaguaaaguagggaccauaggaauugcagaugggcucagcugcauccagcucuaaagcgcaagacagccuuuggucccagacugucaggauccagacugcaggugucauguauguggccuaggguauuggcuuguuuuuaaaaccuuccugucaauuaugcugcauauagaaaaguacacaaaugguaaauuuucauaaaccgcacuuacccaaccagcgccuuggucaagaaagagcacauaacugccccccagaacccauuauugugcccccuuccagucauuugcccuccccaaggguaaccacuacuuuuuauuuaaauauuuuaaaaauaagaugggaaucucacuauguugcccgagcuggucucgaacuccugggcucaaaugauccuccugucucagccuccuaaagugcugggauuacaggugugagccaccacgccuagcccuucacugugacuucugacagugcagaucagauugguugugccuguuuuggacuuuauguaaauguaguucugcaggauggaaucugguguugaaugcagagguuuucagauuucucuguuuuuuaaaggaaagaauccacccucguucauuuuuucacuuaaauugcacaggggacccaacgauauagaacacaaucagagguacucugggcugagggagugcugaguucugaggcuggguuucucagaacagucuagauuuuaaaaacccaaugaucuagccagaaaacguagguuaggauuuuauuucccguuugugacccugggcaagucauuagccuccugggccucggguucucacuuggaguaugaggauaaugaggguuacugcuucucagacuugugacgaugcuuacuaauggccaacaugugaaugcgcuuuugugaagugccagcagagcaugagggguggucaggggcagcaguuuuaggggccugggggaggcuggggcuuugggggccugguucucagauguacagcuaauccuguacccuucccgcagaccggcaugggcugcaggagccgcggcggguggaggagcugcagaaccgcaucgccagcugccugaaggagcacguggcagcuguggcgggcgagccccagccagccagcugccugucacgucuguugggcaaacugcccgagcugcggacccugugcacccagggccugcagcgcaucuucuaccucaagcuggaggacuuggugcccccuccacccaucauugacaagaucuucauggacacgcugcccuucugaccccugccugggaacacgugugcacaugcgcacucucauaugccaccccaugugccuuuaguccacggacccccagagcacccccaagccugggcuugagcugcagaaugacuccaccuucucaccugcuccaggagguuugcagggagcucaagcccuuggggagggggaugccuucaugggggugaccccacgauuugucuuaucccccccagccuggccccggccuuuauguuuuuuguaagauaaaccguuuuuaacacauagcgccgugcuguaaauaagcccagugcugcuguaaauacaggaagaaagagcuugaggugggagcggggcugggaggaagggaugggccccgccuuccugggcagccuuuccagccuccugcuggcucucucuuccuacccuccuuccacauguacauaaacugucacucuaggaagaagacaaaugacagauucugacauuuauauuuguguauuuuccuggauuuauaguaugugacuuuucugauuaauauauuuaauauauugaauaaaaaauagacauguaguuggaacugag

SEQ ID NO: 17964 - RNA, 29356 nt, Homo sapiens
cuccaccucggccgucagccuuuggaucaugcgguucagcucauugaucuccuccuuggugcggcgcagggucuccccgugccugaucaccguggccuucaucuccucacacugggggaaguagagaugcucaugagguucagggugggaccucccauccauucaggacaccacagaugauuuugcagguuguacagugcucagccugugcagccacacauggcaguccugcccugccaccccaaccucagauuggcagcccucucuucucaucccuagggaccagcauccccagaaaaggaagccuauuuaauagauaucucacaucccucccacugacacgucuagcaggcagguguccugugccacucaccuugcugcgguaccaggacucggccucggcccggcugcgggugacaaugucgucauacugugccuuaaucucggcaaugaugcaguccauguucaggucccggcuguuguccagcuugacaaccacggaggugucugagaugugcgacuggagaaugaggaucuccugcaggaggugagggcagugacuuuaguugagaauacagccccacccaccauguccugacuccaccuccucaggcuuucucugguccccaacccugcccccucacacagccucagggacugcaaccucuacccacauccuguccaacacucccacccccaacucuccucucugcuggcugccagguuucugucuggccccugagcccgcaccuccucauacagccgccucaggaagucgaucuccuggaucagggccuccacguuggccuccaggucugacuugcggagguaggcgcaguccacauccuggaaagguggggaguguuggagcucaaggacccuggugauccagcccccagacuccucucucugcccauccauuccauguagccaggggaaagcagucccuggugucccauucccaugccuuuccuccccuucugcccuuccugggaugagcuggcauccucugucccucugaugacaaacccuguuugccuugaccaugccucaccagccuuucaccccuccuugcccuccugucucucccuucucucaucuccugcuccaggaagccugcccagacugaccccccagcucucacacccugacccuuuccugucccccacaagugcuccaagagcccaguggcugcuccugguucuucuccauccccccuuagacccugggauugugucucugccucaaggucagacuccccaaaaugcuagacagacugcacugucucucagcagagacauuguaucugcuauggcuccaggggccucagcaauagaccacaaccucuggaacagagcaggacacacagaggacagugcagccauccccuugcccaagguaggugcugguagauauucccaagucauugcccuuugucaaggcccuggaugcucaauacaaaggccugcaucugggcaguccuagccugcuguggaaaggucauugugccccacgcugagguugagacccccuguguguccccaggaagaaucugucauucugagaucccacagaucugugcuucucaauccugugucacuugccuucuucagagccacaaacucguucucagcuguugcucucagagaaaccuccuccucauaccugagacagagcagagggaagagaggggaggucagggcagggcaggucucugcagagccaccaucacaucacacuucaucacagccauggggacaguacuagaaacaccuccacacagccccggccuggcagccuagcuuagugcuuucuaguuggaugugggaugugucugggauucucuauccacuuugaacuggggauggagagugcucaucugggaccucccaguccuguucccaaaggggcucugaggucccccaggaggcaaauaggacucagcccccagccccauccugggaguggacagcguggacucucagggccuguagcccuagccuccccucacugguaucaaucccagcucagguauggggccuccuggacccgcagacccucaggacuuagaaccuaaggcagugggacacccagagcccaagaccugucacucaugagagacccugggcucacaucugacaggugcuacaaguauaggggcugagggucaggagagaaggccuggacccugcagaggcuuccuccccacccagcgcaggggagagcugcugggugaugugguucagggagagaaggcugaagugggacagagacaggucaugggagucacagcccuccucuuacacaggugucugggcaaagauuccacaaaggaaaagaccccgccacccucggucaaucuaguggucauggccacucacccuaccugggaguucuuauugucuaauccaguguauuuaaccuaaaccccauuccugugcccagcaucccucuugcccgcacucacuucuucuuguagcccuccagcaccuccugcacgugguuaagcucugaggccagccucccgcugucggccuccacgcacucggccucccgccgcagagucucgauguagcccucaaacaggggcuccagguugcucuggcaacacucgcgguucugguagaacugcagcuuugucuccagcaguuuguucugcugcuccaggaagcgcaccugccauucggugugggaagguggggcagauggugucuggugccccaaagccagcucugggggcucgcaggggaggugcuuuaaugggaacccccaaaucuggagcuuaucugagauugaguagaggugggcagugggagacagacaauuucuggauuuccuggucaugaucugugucuagauuucccacucaggaguggagcaagggcuggguggugucagugccugcucccuggggaguugagugaccccccccccccaacccaagcagaugaacagaaguggaggcucagucccucacuaugaaacuaggugaucagcaacccacacaggcagaguacucagguucagaucacagaugagguuucuggggauggugccaggaagagggugucacaggccaucuggaagggagcucagcugucccagcccuuccccugugucaucuggaagucagugcacccuacucucucacccuggggcugcccaaaccccucugaguucagcagcaguggucacaugccccccucccccaacucccugaugucuagcuugugccccagagcagccuggccacacuuuuccuucacaagcucccucuaucugaacugucagcugagucugcaucuugagugccugugugugugugucugugcaugugucugucugucugugugucugugugccucgcccaucagacugggaucucaggcaggcagaggucuuugugccucugacuccauccuuagugcccggcccuggcuguguaggugguggggguucaggaagggugugauccaggacacccaccuugucgaugaaggccgcgaaccugcuguugagggacuugaucugcuccuucuccuccugcuucacgcacugcgcguuggggucgaucuccagguugaggggcgugaggaggcucucguugaccgacacgguggugaugcaugggggacugggcccgcacacgcccccggagcgguagccgaagcugcguccgcaggagccggcccgaaagccuccgcacacgcuguggcugccgaagcccccggugaggccgcgguagcaggagaugccacgguagggggcggcggugaugcagcagcggccgggccgcggcccgcaggccgagaugcagcugaaggcgcgcccaccaaauccugauccgcaggucaugauccuccuggacguuuggguugcagaggacaggauaggggaccuggaguccugauggaaacuccaaugugcuccucagggcaccgcagcccuauuuaugcgcagauucugaaggggcuuggcugugaagaugauguuggggcaauuugcgcuuuaugggcuugggugguuagccgggucuaacgccucuccagaaugugcuuuaaugggggaguggccugcacccucuucuuuguaaaagaugucagucuugggcucugggggagucagcauguuucaucuucaaagugucuugccagcagggcauuccuucaucugcaggcauuggggagggaaggggaaggcagaggagaggacgagaaggaggaguagagccuggcgaggggaagagaagggaggccaggugcugggagaaacugggaggaggagaccuguguguuaagugugauguggggagagggguuucaggaaaggcugaggcauuaauaaauaccaucucucauuuccaucacagcuguggcuaaagugcuccugaaacacaaaucuggauuuccccaucuccagauuuuucaguuggcagcugaaaaccaucucacuuuuccuaccaugggaacagucagcagauuauuaaauauuugucuuuuaucuuuuuuaugaugaaagcuuucaaauauugaggaaaauuggaauaauacaacacacaugcauugaugcuccaccuguuuaccccgauucaacaguuaacauuauaccauauuugcuuucacaguugcccaauuauuugaguggcagaaagcauggcaugucacccuuaaauacaucagcaggaauuucuuaagaauaaggagaguacuauuuucuuauucaggaaaauuaacaauaauuccaaagcaccacuuacuauucaucucagauucaauuuuccuaacuguccuaaggauuuuaaaacuacauuuuacauaauuuaauuuguggcucuagcccuuguauuuucuauaaauuagaaaguaaaucuugagcugggauguccaauuugguagacaauaggcagauguggcuacuuaaauuuaaguuaguaaaaacuaaauaaguuaaaaaucuaguuauucaguugcacuauccacauuuugaguccucagcagcuaccuguaaguagugccuaccuuauuagacagugcauauaaagaacacuucuuuauuauuuauuuuuauuuuauuuauuguuuauuuucacauaaaauucuguuggacagcacugggcuagaggcuggauuagguuuaaauuaaacauuguugggacagaauacuucauaaaauaugcuguguaacucuuauuauaucaccccaggaagcauaaaaugucagauuggugaugcuaaauugaaucacagcugggcgcaguggcucauaccuguaaucccagcacuuugggagucugagggggguggaucaccugaggucaggaguucaagaccagccucaguggaggaguuuaagaccagagauggugaaaccccgucucuacuacaaauacaaaaauuagcccguuaugguggcacgugccuguauucccagcuacaugggaggcuaaggcaggagaauugcuugaacccaggagauggagguuggaucacuucaguacauuucccccuguauuaggaaaaacuguauagagaauuagaauuagaaagaacuguguagagaaacauggaucuuaguuugauaagaauauguuucuuuuuaauuggucaccuacuaugugaucaucauuauauaucguaaaugaucucuaauucucacaucaaucauaugaaguaugugccauuauccccauuuuacugaugaggaaaccaagggucagggagguuaaauaacuugcccgaagucucccagcugguaagugauggagccaggaguugcauugccuucucacuuauaagcugugacaaccccuugacuuccuaaucuuuggauaaguucaagaggguagugaaaguuguuuacaggggaguaucugugaauuuagggugugagagaguccaucuaaggaagacgggcagagucagaguggauugggaugguuagaaccaugaggggucauuuagggacacacggcgaugugaggcuacuugggggcugggaaggaguaugaguuagaugugcagcaccccguggcuaagaauugaaggacgggguggaaaacaucaguuuuaguuauuugcauaccucugguauauggcaauacuuugauagacuguacuauguucuacuuacccagugaaccaccccccacuccaauagagcagguccuagaaaaauuagcucguaaaguacagagguuugcauuaaauugaggagaagaaaagagaagugaaauggccuggcuuauagcccccuggagcugcuaugcuucaagggcaaaggcaggcagaguagacuuagggaaugagaacagaagcaggauugaugggaaaagagaggagaggaaaaaaauagaagagaauagggcucucaggguaucugugcaaaacauucagaguguggccuugugcaggacaaaugugggaggucacagacuguguugagcuaucuggucaccccagagaagaguauggcaccugcugucccuuugugaguucagggcugcugggccagcacuucugaagcucuuuguacccucaucuggaauuuggggcacugcucacaauugagcagugauguccccaguaaaccagcgguuggguguccugaggagcacugugagucaaaguacaucucauccacacuucaccuuuucuaccaguauaacuccuuauaaaaacaacauguauaaacacaagcuaauuacuaauggcugguccuuacuaagcaauuuuaaagauguaagaauaugaaaaauucaaaugugacaccauuucauuaaacuucaggaauuaauugcugcuaauuuuugaagaccuaaaaggacauucaacuuguuuucuucagagugaaaaaaccuugucauggggaagggaggaggggagggaagguggcagggaggaggggagggaagauggcagaaucuccacucuauggucuuggcucuggcaagguaaagaggauagauuuuaacuuuguggagauaacaauuauuuuuauugugaaauauuucaacacaaaaaaugcauaggugguuagaucuguagcaauaccuaccacuuauaggaaaaaauagaacauguguguauuucaggagcuuccuauguaccuuguucugauuguacccuacuccuuccuggccuagggugacuccucucuugcauuuuguguuuaauuauuccuuugcuuuucuuacaguuuuagaaccaaugcacccaucuugcaaugacauauuguuucuuuuuccagcuuuugaacuucacauaaauggacucauguugcauggauccuugugcaucugguuucuuucauuaaauguugcuuccuguagcuguccuguguucauuuucacuguggauugcacucauugcauggcuauaccacaguuuauuugccuuucuaccucgauagccacaagguuguuuccagaguucuguagauugaacagagcugcuaugaacauccuuucucaugucuucuggugcauuuaugcaagaguuuuucugggguauguggcuauuuuuuuuaaaguuaugucaguaguagauguuucauguagaaagcuauuuuaugacuauucuuccaaacuuaauaauaaaaucuuuugauguucaucuuauaccacacuagauacuauuuuaagaguccaacaugcauuaacucauuuaauuuuuacaguugcccucugagguugguguuauuauucucguuuuauagaugaggacacugaggucuagggagguuaaggcucagguugcauguuaguagcagaacuggaacccagagccugugugucugaucccaaaggaagggaugcguuugucccauugcacucccuucuguacaccaucggccaucaguaauaaguaucacacaguagcugguguuuguacauaacauaaaaacacaaacacucaucuugccccaugcccucugcagggcccugcagguugcucucaggguucagggccagagaguauaggagagcucacccuuguucuuggcaagcuuccaguauuaagagaaaagcagagacacauacccagauaaugaacaaaaauggaaacccugcagcacaucaguguguacaaauguuuucuucguggauauauuccaagggcuugucacauaguaggugcucaauaaauauuuuuugaaugaaugaaaagaauaccagcugcauauuaagugcugaguaauggagccaucaaagcuuggugguuuauugugcaaagcuuugugguaggauaggguggggacacaugaagcagaugauguggcuauuccuggggguggggguggagaggggugaccuuccuugcuggggccugaaggaugaaugaagugagugagauguguccuucaaccaagcaaaguccuuggcuugggcuauaagggggugguggggaaagucagccaaugagaacaaggaucuugaaggccuuggggcagaguagagaccaggugucggauuggagaaggaaagagagaagcaaaucagaggagauuucuaggaaaagagggagaaagaaauacuuggucuuagacuauuauucucagggugacuuagaagaagagaaggagagugcugcauggguggagaagaaaaugagggagagaucuuaggagauagucaggaagaggaggaaacuggaggacaguggaggaaaaaugggagaagaucugggaaguaugguggaagggucacuccagggaugaaagagcagaggaggaggagguggaugggggaagcagcacagcaccaagggaaaguguguguaggcccacuggaagaggugggcacuguaguuccagauuuauaguaaugaacccucacagggcagggacauggggcgagggaggugcaggcacccagcugguuagugggaugaauguuaccaggguggagcuuuugagucaggcuccagccccacccaggcaucuuacaggggccuucuggcccuuuguccagugggacuccucucuggugaguucugauggauaauuggccagcguccugggcucucuuggcugagaaggcagggcucugacuugggcucuccccaaucacccacccaacuggccugaggucaauuccauuaucaacaucucaacaucccagguguuguguaagcagccacuccacuaccucucaacuuccuucacuggacccuggccugcaccugcuuucuaugaguagaaagcaugagccagcugcaagguuaguaagggcauggcccucuggagaccuguaagcccagcaugcagaugcuccagauguagagccuacaggcugccuuccagcccacagcuguguagcagagucucagggacgacacugucccugcuuaugagggcugugccucaaccggcauucucccucucucuccgcugucacaguaucucaugauccucuccacuccugcaagggcccacaggaucaccuguuguccacccacuagcccugucucauugucugucacugugugaaaugcuuccaugcacaucuucucaucaacacuguccugcccgccuuuugccuaaagcuuguccucacccuuuccagggagccuuucuugccuuucccaucagacuagcugcaauugcacauugucccagaaaggacacugucagcagucauugcaugccucaguaucugacaguauguaugaaaaguagcccucuuuagacuucuggccuuucucaugaauuuggauaugcucuaccagacugggagcuccagaacccauguuuccuuccuccucuuaaugccuccuucccuccaaaauuaagacaggauugagcauagagcuaggaaauaucagucacaaaauccccgagucccccaucuggaaaauguugucuagucuaagcgaucaacuaucuugaggagucugccuuauaauacccuccagggagcagaaugaaccgaagggagcacugaacaagaacuuucuaauguuaaaaccaccuaauuugcccauucuuuacaagugccccuugaaauaaagguccacuugggcuaaaagaagagauucugaucuccagaucugaaggucuuuugguucaccuugucuccacaaaaaugguggccacugcagaauaagaagugucuuucuuuuacuuaaagccucccuaaauggaagagauaaugcaagcuccuuuagaaaguaaugacuacuugucuucuggcaaguucuuccucaacuccaacuuccauuuguccaucugcaaugaaagcuugccuucucuugcucucauuggagcaccauuauacuuggaugaauuaucaaguccauaucccccauccucaaccucaugaaauccucuggcuacugaccaaucaggagguuuuaggaucaggcaaaaauaaagaugagugagugugccaucauuuaauuuaugacugaggauuucugauggucuguuaaguccaaauaauaaauacacacuuaugaauuauucacagauuacagaauuuuuagauuauccaagccucucuucucauccaguaguaugguuacccaaggauuggugguguguuccuuugccaaagagaagagauucucuuuggaccuucucugaggcaaucaggcuggagcagagauugaaggaggggcauguguuuugggguucuuuucgaggacaaauggaguaaccauggccaaacuucucagauccucugccccuuggacuggcucccacuguagaauauaguagauaacauuuauugagcauuuucuaugugccagcugcuguuaaacauuguccaugcauuauuucauuuaauccuucuacaaguucuuuaagauaaggcgguuaaugaaaacuggacacagauggcuuaggcauguggaugaguauaucccaucaaugcuguugauacgucugcagcagcagcaucagcagcaacaacaacaacaacuaauaugauuacacacuuagagugugccaggcuuaguucucagugauuuacauggauuaacucuuuuaaucuuuacaacuuuaugagguggguacuauuauuaucuucauuuuagaaaucaugaaaugagguacauagaggcuaaguaauugccugaguuuacacagcuagagaguggcagagcuagaauucgaaacgaggcaguuuggaaucugagucugugugcuuaacuaauaugccauguauucaaacuuuuuauuuauuuauuuauuuauuuuaauguuuucuuuuuauggguacauaauaguuauacauguuuaugggcuacauaagauauuuugagauaagcauaaacuguguacugaucaaaucagaguacuuggaauauccaucaccucaaacauuuauuauuucuuuguguugggaucauuccaagccuacuccuuuaguuauuuugaaauacacaauaaaugauuaacuauagucauucuauugugcuacugaacacuagaucucauuucuguuaucuaacuguauuuuuguacucauuaacacgucuuuaucuuccccuccccauuacccuucccagccucugguaaccaucauucuacucucuaucugaugagaucaauuuuuuuagcucucgcauauguguaagaacaucugaaauuugucuuucuguaccucaauuauuuucccuaacauaauguccuccaguuccauccauguuguugcaaaugacaggauuucauuccuuuuuauggcugaauaauauuccauuguguaucuguaacauacuuucuuuauucauccauugauggacacuuaguuugauuccaaaucuuggcuauugugaauagcgcugcaauaaacgugggagugcagacaucucuuugauauaagaauuuucuuucuuuuggauguauaccuaguagugggauugcuggaucaccuggugguucuauuuuuagcuuuuggaggacacuccauacuguuuuccauaguggcuguaguaacuuacaucccacuagcaguguacaaguguuccccuuucuccacauccuugccagcauccauaauuuuuuugucuuuuugauaaaagucauuuuaauuggguugagaugauaaucuuauugugguauugauuuguauuucuuugaugauauguugagcauuuucaauauaccuguuggucauguauaugucuucuuuugagaaaugucuauucagaucuuuugcccauuuuaaaaucagauuauuugguuuacuugcuauugaguuguuugaguuccuuauauauugcagcuacgaauuccuugucaguugaauaguuugcaaauauuucuuccauucuguaggucauuucuucaacuuguugauuguuuccuuuggugugcagaaguucuuuuagcucgaugugaucccauuugcccauuuuuugcuuugguugccuuugguuuugaggucucaaucaagaaaucuuuguccaggucaaugcccuaagcauuuccucaauguuuucuucuaguaguuucauagucugaggucuuauauuuaagucuuuaauccauuuuaauuugguuuuuguauacagugagaaauagauauuucaacuuuucugcugcaacuauaauaagaaauaauuuuacauggugacugaguaugcacauacauauacauaggccauacaacugaaacaaaaagggcauguaacaaguuauucccaugacauaaggugcaaucugcuauuuucuggucuauucuacucuauuugauuuucucauaaucaauuucauuaaaauaaaauucugguugguucaauuagugggucagaacaugaauucugaauaaacacugccccugagcccaccgcuuccuaaugauuguaaugaagcccaucugcucugugcucuggaguccacugagcauguacacauuucuguaacucuaaggcaguaguaggagggaaagccuuaaccuauuucccaggagagucaagugccuuccccuagaucacacagggguacucagggcagagccuugguuccuacccagccuuugugaguuuaagacccacacuauucacacuggauggauggcacauacaaauauagaucuguucucuggcaccugccaaggguacugacaaacuucugugcaggaguuucaaggaguauagugcagaaagcagcagggacucaggggaugauggcaggggcuggaugcucuccucauguggcucuauuugaucucauauucugagccagauacuguauagaugcauaacaguggugcucaucccagaccuucuaggcccuggagguuacacagaggccugagaggacauccagacauucaauccuugucuagggccuugugggagguaauugugcuuuccuggggccagugggcuagugugugcuccugaggccgcaugggacacucugagggagggaaugccuccucucagccgaggcuggccaauaugaccuaauaagguggccugaggacuagucuacaugcuaguugaaugugcaggugaggaccugugagugugugugugugugugagaugguggguagaaaggccagcaugugaaagcauugugugugugaguguguaugugaaagagagaggggggguugugaguaggaaggccagcaugugagugcauugugugugaguuuguguguguaugugugugugcaccagagagugggagagagagagagaaaaaaacauguugauagguauagauaagggauuugggaguagguguggaggaacugggucccugagaaggugacuaaguuagagauucuguaaacgugggucuuuuggggugcagaaacaggucaucuaguucggagaaaccaccaagcgccccccaaguuccacaucaagggauucccccucccaacauuccuggcuaguccuaugagcaccgcggacagcggcauugaccaugucaaaccccgcaggacagaaagagcagcagccccgccccuucccuuccauuccaaccugagucacugcccacuccuucguccaacgucaguuuccucaacuguguauugggagguugaggugggugugcgggacgugaguugguccuuugaagaagaaaacugcaguuuagggcaagagaucauaacaucuggcugcuucugggcaccaauuaaguacauuaaguggggagcgacagcagcuaaacaacccaagcccauaaagccuucuaauugcuccgacccacguggucacagucuccccacuuauauaaaaggccuacagaggugcaaguagugaacgccugacgccccgaccacugugcucuccauucggacgucuccauccucagaaccuccucucuuccccaaaaagcaccaugacuuguggaucuuacugugguggccgcgccuucagcugcaucucggccugcgggccccggcccggccgcugcugcaucaccgccgcccccuaccguggcaucuccugcuaccgcggccucaccgggggcuucggcagccacagcgugugcggaggcuuucgggccggcuccugcggacgcagcuucggcuaccgcuccgggggcgugugcgggcccagucccccaugcaucaccaccgugucggucaacgagagccuccucacgccccucaaccuggagaucgaccccaacgcgcagugcgugaagcaggaggagaaggagcagaucaagucccucaacagcagguucgcggccuucaucgacaagguggguguccuggaucacacccuuccugaacccccaccaccuacacagccagggccgggcacuaaggauggagucagaggcacaaagaccucugccugccugagaucccagucugaugggcgaggcacacagacacacagacagacagacacaugcacagacacacacacacaggcacucaagaugcagacucagcugacaguucagauagagggagcuugugaaggaaaaguguggccaggcugcucuggggcacaagcuagacaucagggaguugggggaggggggcaugugaccacugcugcugaacucagagggguuugggcagccccagggugagagaguagggugcacugacuuccagaugacacaggggaagggcugggacagcugagcucccuuccagauggccugugacacccucuuccuggcaccauccccagaaaccucaucugugaucugaaccugaguacucugccuguguggguugcugaucaccuaguuucauagugagggacugagccucuacuucuguucaucugcuugggugggggguggggggggggucacucaacuccccagggagcaggcacugacaccacccagcccuugcuccacuccugagugggaaaucuagacacagaucaugaccaggaaauccagaaauugucugucucccacugcccaccucuacucaaucucagauaagcuccagauuuggggguucccauuaaagcaccuccccugcgagcccccagagcuggcuuuggggcaccagacaccaucugccccaccuucccacaccgaauggcaggugcgcuuccuggagcagcagaacaaacugcuggagacaaagcugcaguucuaccagaaccgcgaguguugccagagcaaccuggagccccuguuugagggcuacaucgagacucugcggcgggaggccgagugcguggaggccgacagcgggaggcuggccucagagcuuaaccacgugcaggaggugcuggagggcuacaagaagaagugagugcgggcaagagggaugcugggcacaggaaugggguuuagguuaaauacacuggauuagacaauaagaacucccagguagggugaguggccaugaccacuagauugaccgaggguggcggggucuuuuccuuuguggaaucuuugcccagacaccuguguaagaggagggcugugacucccaugaccugucucugucccacuucagccuucucucccugaaccacaucacccagcagcucuccccugcgcuggguggggaggaagccucugcaggguccaggccuucucuccugacccucagccccuauacuuguagcaccugucagaugugagcccagggucucucaugagugacaggucuugggcucugggugucgcacugccuuagguucuaaguccugagggucugcggguccaggaggccccauaccugagcugggauugauaccagugaggggaggcuagggcuacaggcccugagaguccacgcuguccacucccaggauggggcugggggcugaguccuauuugccuccugggggaccucagagccccuuugggaacaggacugggaggucccagaugagcacucuccauccccaguucaaaguggauagagaaucccagacacaucccacauccaacuagaaagcacuaagcuaggcugccaggccggggcuguguggagguguuucuaguacuguccccauggcugugaugaagugugaugugaugguggcucugcagagaccugcccugcccugaccuccccucucuucccucugcucugucucagguaugaggaggagguuucucugagagcaacagcugagaacgaguuuguggcucugaagaaggcaagugacacaggauugagaagcacagaucugugggaucucagaaugacagauucuuccuggggacacacagggggucucaaccucagcguggggcacaaugaccuuuccacagcaggcuaggacugcccagaugcaggccuuuguauugagcauccagggccuugacaaagggcaaugacuugggaauaucuaccagcaccuaccuugggcaaggggauggcugcacuguccucuguguguccugcucuguuccagagguuguggucuauugcugaggccccuggagccauagcagauacaaugucucugcugagagacagugcagucugucuagcauuuuggggagucugaccuugaggcagagacacaaucccagguucuaaggggggauggagaagaaccaggaguagcccuugggcuuuuggagcacugcugggggacaggaaagggucagggugugagagcuggggggucagucugggcaggcuuccuggagcaggagaggggagaaaggagagauaagaggguaaggagcagugaaaggcuggugagccgugcccaagacaaacaggguuuguccucagaauggcagaggaugccaggucaccccgggaagggccagaagggaaggagagggcaugggaaugagacacuggggacuccuuuccccaggcuucauggaaugggugggaagagagaggaaucuagaggcuggaucaccaggguccuugagcuccaacacuccccaccuuuccaggauguggacugcgccuaccuccgcaaaucagaccuggaggccaauguggaggcccugauccaggagaucgacuuccugaggcggcuguaugaggaggugcgggcucaggggccaggcagagaccuggcagccagcagagaggagagaugggggugggaguguuggacaggauguggguagagguugcagucccugaggcugugugagggggcaggguuggggaccagagaaagccugaggagguggagucaggacaugguggguggggcuguguucucaacuaaagucacugcccucaccuccugcaggagauccgcguucuccagucccacaucucagacaccuccgugguugucaagcuggacaacagccgggaccugaacauggacugcaucauugccgagaucaaggcacaguacgaugacauugucacccguagccgggcugaggccgaguccugguaccgcagcaaggugaguggcacaggacaccugccugcuagacauggcagugggagggauuugagauuaucuauuaaauaggcuuccuuuucuggggaugcacuagggaugagaagagauggcugccacucugauguuggggugguagggcaggacugccaugugugguugcacaggcugagcacugcacaaccugcaaaaucaucugucaugcccugaaugggugggaggucccacccugaaccucaugagcaucucuacuucccccagugugaggagaugaaggccacggugaucaggcacggggagacccugcgccgcaccaaggaggagaucaacgagcugaaccgcaugauccagaggcugacggcugagguggagaaugccaagugccagguauggggcaucugugcccaaggucagagagaccgagggucuaaccauggucacacagccuaugugugcccuaucuggaucucagcauucauucuccagccccucuguccauguagagucccugguuguggucucugugagucccaggugaugaaggcaagaggcucuguucuggggugcucccagcuugguggggagcauggucucaucgagguaagcaucagagagacccagggacucuaaucuaccuuguucucucuguucucuucagaauuccaagcuggaggcugcgguggcucagucugagcagcagggugaggcggcccucagcgaugcccgcugcaaguuggccgagcuggagggugcccugcagaaggccaagcaggacauggccugccugaucagggaguaccaggaggugaugaacuccaagcugggccuggacaucgagaucgccaccuacaggcgccugcuggagggcgaggagcagaggugggucccauagaccuuucccuuucccagcccugccaggguucucagugugcucuguccucacacuccuggcagcauuuaaguuuuguuucuuaaccuccccacccugcaaccagacagguaauuuguguaaguccuuuaaguaugaucuagccccguuugagucucucauguucacccaggcacugaucugagauugcagucuuguucaucucaguugagauccaguaaucuggcagcagguauuccuguuacugagaagccuaauuaaggcuuggggucagcuugccuggguagugcuucuucccuuccagcuguagcugcaugugcuucucaggauuccuucucuuuuuccuagucuggcccuggccccaucuagaccugggaguucagauguaucccauaaggacagcuucagauagaugacacuaucaacucaugcuuuucuauuauagugccaaugagcaucccaaagugguauuccauuguggcaggugggaaugaguuaggcagagagcaaggacuuaucccuuggggcaguuaugccuugcuuucaggauuuuugcuuguuugcuugcuucagagguggggggaguggagaagacccauuggucacucagccuuccuauggcuggaggccagcgauacagcuggagggcagcuauacagcuccugcucccagaaggacaacacucccagaaugugagcucauucuuugcccuugguuucuuuccccuaguuggucaguuggucucacucgaagcuccuuuuuuuuuguggacagucaggcccuuggcccuggggagaggagggugaagguuggggaugcagagggagcaucuuguuuauuugggaaauggggaacacagguuugggaccuagaaacuaaagugaccauaugacgagauuuccaccaaacucgaguuguuccauuggaaagcucagaggcaggggucugucuggcugggccuggggaauuucauaagugaagaauucugggaggaggaguuuuccaagucugaauuuggaaguuggagaaacacauggagauggcauuggaaucugaguggcccacuccuccaucacacggggcucuuggagugaacucaggagcuuugguauguguuaccuagggaaccugggcauggaaugauuugaugguggccauggcuucucuuaucugaagcugauuuaaccaauccuuggccagugugcuuucaggggaacuccauuuucuucccuuaggggaagcuauugggagggaaaugugggguggguagaaaugagugucuggggugacagcccugccuugucauuggauauguccuccuucugggccucagccuuuccaucugccggaugagaggacuguggugggcagucucugagccuguucuaaaaucccauuuguuuaucuaacaguuuuguauugagccaggcauuguuuuuagguggugcaggaaggaauagacaaaaaugucuacccuccugaugccuauaaucuaaugacaccaaucagacuggauuucagaaguuaaaucugcuccccucaaaugcaccugcaauucagucagaaccaacuucgagguaguggcagcuaauagcucuuaagggcuaugagccaggcacuaagcacuggacgcuucuuauuugauucaguccucgcaagagaucuacgaaguagguuuuccugaugaggaagccuaggcugagguuggcccaagcugggguugcacagcucagaagcaguggagagcgaggcacucacaggccuucugucuccagacccucacggugacccgagucuacacuggcuccuggccgagagcauuucuugccccuucccuugggcaagugcccagauggagggccacagaugucccccuccacuucagucacgggggcccggcgccuuuuccgcggcacugaccucucgccuucucucccugcaggcugugcgagggcgucggcucggugaaugucuguaaguagugggguccguccccuccucccgcugggcgggucugggagccucugggcaaagggcgcgugggcucgcagcaaagccacucacccaggucgcggcugcgccugacgcgcgccuccgucucuuuccccugcaggcgucagcagcucccgcgguggcguugucuguggcgaucucugcgccuccacuacugccccuguugucuccaccagagucaguagcguccccagcaacagcaacgugguggugggcacuacuaacgccugcgcccccuccgcccggguuggcgucugcggcggcagcuguaagaggugcuaggaggcugccgccuccgccagcgccugucgccgucacucuccacccagccaguaccucgcgccaccagaacgcgccgcccgcgccggccucccaauagccgccgcccgcugccugcacucuaagcgcccuccccaccgcuccgcuccgggagccauccccggucgcaggaguccggggagggccgggaggcgccauggucucucucuguagccuuuccugguagucaauuuguugucccgaggauucaucuuuuucuuccgccugccuucuguuuuuuuugcuguauacauuggucuugccugagcucuuccccaaagcuuggaggaacgggggaggcccgggaaugucccugucugcacgaccugggacucugcccaugugcuuuugccuguggaauggagacgcggacccuggauagugguucuaugacucugcgagggacaggcccacgcguguggggagaacaucucccuuccggggcugcccucaagagcuucugaaaaacuaaugacucugcugccuucuccuuugucuuuguuucacucuguguuuccaauaaacucauuguagcgaaucaagccuagugucucagagucuugaaaaugccagggccuuccugugauaggggcuccugccagagcgccucaggaccuguuuauccacuauuuuucaguagcuaaaaaugaccacaguaggugcugcccaucuguacuugagcagcccaggccuuggggaaaacgagagaagacucacggagccagggaaucuuauggggucauggguuucucuagaccaggauuuaucaacuucagcacuauugacagugugagcugggucauucuuuguuuuagggcugucgcgugcauuugguaggauguuuaguagcaucccuggccucaauccacuagaugccaaggguccuccaccacccucuugugacaacuaaaaaugucucuagauguggccauauguuuucuagggguucucaaccaaggugaucacccgccgcccccaccccagggccuuccuggaggggaaagugcauggggaaaaagacgggguaagaauggaaggaagguaugugagagaagcacugugcagggaggaagagccuuggguugagaggagaacugggcuucucauuccgagccuugauggccauuugccacaugugugacuuugggcaaauugcuuccauccccugaucuucagcugccuuggcuguggaauggggagauuggacaguauuccuaagauccuucuagcucccuaugugagauuguguuugaaagggcuauguuaaugcccuuugaguuugagugccgguucagccauuuacuagucuguaacugugggcaaaucacuaagccucacugagcuuuaguuccuucacauuuagaacgggaugaugauaucuacugggccauagggagguguuucagauaucuauuacacacagcaagucacccacauggagaggcuuaaaacagcaauacuuuaucaugccucagauucuguggguuuacugaggaguucuauuuuacaugauguuguuuggagggcuagaaugucugaaaggcccaauauggccaaaaucucacauggcuggacuuggugcuggccaccagcugggaguucaagugacgugcuuggccaggguguaucagucaggguccaaucagaagacaauaauuugaacagagaaaguuuaacauaaagcauuauuaaccauaacagagauuggccaguaaaaagcaagaacucuaaagcccacagcagcugcagccauaagaagcagccccuacccccaggccuuuucuccagcauccagugauaauuucuuugcuggcucuccagcuuucacuaauugucuccuugagcaaauuuaggcucugccugaugccugggcccaaagucaaagacauagguuuugaguuuuguuucaguagcaucucucugccagguaccaacuugcccuccacuuaucuauugcuauguaacaagacauccccaaauuuaguggcuuaaaacaacaauauuuuucauaguugugugaauugccuaggugauucuucugcuucauaucauugacuggggcucugguacugcugaaagguccaggauggcuucacuuguacgguuggcauuuggagcuagcucuggucaagagcucaggagcugauggccagggccucuguucuucccuacgugcuccagucccuuugaggccaucugggcacggaagcugcagaaggugcuuuccaucagauucuauuggucaaagcagucauggagccagcccaagaucaaggggaggaaaaacaggcuccacuuuugauaugagcagugccaugcacagagagggaggagcugcugggggcucaucucugaagauagcuaccacaggacgauuaaaugagacaacacaaauaaguuugagguauaguguggcauacaacagauacuaaacaauuaguguuuaugacugcucuuguuguuauuacuauuaccaugacaucauaacaguguagcauucucagccucugaauagcaggggcagagugggcugguaggaaauacugggagcuggagguuugacauccuagcuuuugucagcaggaguguguggccaagcuccuucagcuuuuggagccucggguaguuuacccacuuaaaggcaggugauagcagcagcccacugagugaaugagagcuucagcuggugugcagagaaggguggaugucacagcacuguuagucuggguacuggcacuaccacacuggcacuaucucaggcuugucagcacagagggauccaccauccagcuagcucacauuccucagcagccagcaggaagcuuccggagaagaggcagcuggcucucugugaagcauggaaggccucaugaauuggcccauagcaucuaccucugcaagaggauuggaaaagugccuggaaggaaggaggaaugagaaaugcucuugggugaagaaagcuuucauggaauggaguuggagcugggguaggaggggcuacggaggaggagguaggaacgaagugcucauuuucagcuuuuagaggcauuggagagcagcccccacucuccuugguggccuuccugacgcaucagagcuccuggauggccccaugcuccuuuuccagcuccaucuuuaucucucacauacuguucccaugucuggagcacaucucucauccuggcuaacuccuuacuucaguucacuucuugcuuucaaauguaagcuuugcagggacaagcaucuuuaacuauuuuuuuuuuucacuuauaggaacccaagcuuguguaacaguaccugcuacacagcaggugcucaauaaugauuuguuguuggaauaaaugagcuccugguuuuccuuuaggucucagcuucaauguuaccucccuuaggaaguaaucagcuuugccugcuuaacaauccuccagcugugcuucucuuuuucucccagcaccaaggcuuagggcucuucauagccacccccuccuugguguagaggugguaguggugguggagaagauggggcucagggacucaggaccagaggcuccaacaaucuugucuagccccuugagcugguuggguggaaggaagaugcaucacugccagaggcauggagucucuggguucccccagguggcacguccaugaccucccgaggcuggcaguccuuacaguauccuccuuaaccccugagaagggaguguuaaaccccagaggagaaaucggagccccuucccaagacgggcagaacugaaaaggccccugcagagccucugguccaaccccucacuugacagguguucaggacaucuugagccagaguaggggagaaagguggggggcaauggggaauagggagcagugagaggcacugagcuaucagucagagcuagacauacaggggauguacauuguguacauuguguuuaagucuggacuuugucccggggacaguggugacccacugaaagcucagccuuguguaugaugaaggucucuggcugcugugagguggggcauggaagggagaagagcaggacuccaggcaaaauggugauggcugggugugcuggcagcaguaaggagagaggaaagagggggauggagagcuauuuaggaggcagaaaaagaaguccuuggguuuagugaauauugagggcgcaggcauggauaaaucauagguucugguuugggcaacuguguugaugaucuuggcaggagagacuggaggagacuccgguugagagggugggaagcaaugaguuaagcuggaagguaugcugaguucgaagcaucucuaaaacugacaaguggaggugucuuguaggaacuggagcuguugggucuaagccgaggagugaggguaggaggagaaucaucagggcucugaagcccaggugggggauuuuaaccagggaggacauuaacuuugggugguagcugaaggcgagaggcugauaugacugccuggggagagugcagagaggugggaaaaggcccugggguaguuggaugcuugaggcaaggugcagggugagguaugagccagugagcagaacugccugggaagagcugagagccuggccugggagacaaggaggugaaaggcccgagacucaggaauugggaggugggagggagagaaggcacuggggagccccuggacuuggguggaggcuaaaggguccuggggagccuggagauuccaggggaagcaaaggaagggggugaguccuccaaggacauccuggugagaugggugggaaaggccaggggcugggugaaggggaggaaugaagagggccagcaaggaaggcagugcgcuacccuggaggugggcugcagccuugcaaggacuguuccaggccugauuccucgagggugggguuagggacuucucaaagucuuccagagcucuccagagcuuuccaagaggaggacaggagagauugggccaagcagcgggcagaggagccucuuagccuugggguugaagcugugagguaucucggaugagggcagugaguggggcaguugagggagugaguagaagguguccucaugucagcuguggagaaggcugccagguacucaggagguguaugcaugggggaagggugggccaggggcaggugccaaggcucucaucuuucccuguuuggugggcagcaugaggaggauguggcaauggggugggguccagacugacacagggcagcccccaaggguggcugcuggcacuuuuggugguuguugcugugguaccuacguggaaggauggcuggggggcagagugaagauaugcuaggaagagaaaguggggaccguguaugcaagaagggggcaaaacucaaacacacacacaagcacgcauacacgugcacacauauaaacaugcgcaugcacaugcacugccuuccggcugacuucuggccuccucgguccccuucagagccauccagacugacaggugugacagguagaaggugcugugagcacagucagcacugccuggccaggagaugacagaaccaucuggggacaaggcccuacggguguccaggcggagaacaggccagaacgacucuagucuucaggccauaucaucaggcuggggugcucaccacuugguggguguggggaaccccaagaaagcaagacauugcagcacacaaagcagguccccaaguuuauuggaaaaggggagacaagaggccagagaggcagggggaacagucucacagugcuucuuccagggaagcaaggcccuucuccccgggaggggcugaaggcugagacaggggaaggaaugggucuauuccccagccacaggccccuuuccagugggaugaaagguggggaggagccgcuggugggaaugagccgaugguguauucucagaacacaaggggaaaagccagcgaugugcugcuguuuucagcuggugguggggcaguggcacgucuggcaggcagaaggggcuccccuggcucucuuuugggccacuuaaugccuccccuggccgcaggagcccccuccacaggugguguucagcuggccacagggcuugcacaaaccagugcucaccaccagguucccguugcagggggcacugcagacgcugcccgucaccggccgggagcccgacacgcagagauccccgcacacaaccccaccccgggagcugcugacaccugugggaacaagggcagggucaagagaccccugcugauggccaucccauccagccaccuuccuuuggucugucugaugugucgaccauccagggaaggaugcaaagagccuccaguucuauucugaaggagggaacccuagccugggagccagcagaccgggguucugguccugguucugcuuugugacuuugggaguccuuuccucugucugggccucagcuuucucaccuauauaaggugaagguuaugaaugacaucugaggucccuucuugcaaugacaucuuauuauuuuuuccccuccccaacacauucaggcugugagguucuuccugcgagcuaaccucagucugucuugcugcaugaccaaccuauccucuuuacugggggaauuauuggaaacacuccucccaaagucucugcauauauucauagucaagaaguccuuuguccccagucuacauuuuccuuuucagggcucaagauacuuacagacauucacagcuucaacaccuucacacagccugaguggggaaaaaguaaggaaggggaagauaaaagaagucagaaugaggucaucgaauuuccgcuaggugcugaaaugggucaucucagggcuauuucugaccuacauuuauucccuugugcagcuuagaaaaaguugccuuucuggcaguugaagcaacgucaggucacacuauuuagcaaguagaguaugguuggauuucaauucuuauuugucucucagcuguuauuugccuuugugcagugaacaaccugaacaaccauaucugucaggucuagauaggcucaacuuucagaaggagaaggcccucuugggaagacgaggucagggguggaguuuggccagcaacccugcccuagaauaggugauguccaagaaaccaggcaggguauggaucuuggaagaguugagaaugagacaacuugaagauauggaucugggauccauagaggcaagaaugucaccuggggacugagacugagauagggaaaaaucaaaggugggcaggucuaugcaaguggagugcuuagggcuggguuggacccaccucugcuccucgcccuccagcaggcgccuguagguggcgaucucgauauccaggccuagcuuggaguucaucaccuccugguacucccugaucaggcaggccaugucuugcuuggccuucugcagggcgcccuccagcucggccagcuugcagcgggcaucacugagggccgccucacccugcugcucagacugggccaccgcagcuuccagcuuggaguucugggagguagggggaauauggagaggauaaagugaaguuuaguuucuugaaaucccagccagucuccaauaggaucauucaacuucuaucuuaaaauauuaucucuccaaucagcuuccuaaccuuccuucccuccucacuuacacuacacacacacacacacacacacaccacacagauacacacacacaccuuggccaagacaaucagaaauauuucaguagauuucucaucuuacucugucacccaugagacugcacugggaagacuuuuccagaaucuaacucaaaucccucugccgagggcuaaccccagucucuuccuacacugaggggugggccgggcucugguaccuggcacuuggcauucuccaccucggcugucagccucuggaucaugcgguucagcucguugaucuccuccuuggugcggcgcagggucuccccgugccugaucacuguggccuucaucuccucacacugcaggaagcagagauguucaugaggcucaggaugagacaucccauucauucaggacagcucagaugauugcacagauugugcagugcucggccugugcaaccacacguggcaguccugcccugccaccccaacaugagagcuauugguuuuucucuuaccauccuuagggaucagaaucccuagacaaagaagccuuuucuacuagauaccucacaucccucccacugccaugucuagcaggcagguguccugugccgcucaccuugcugcgauaccaggacucggccucagcccggcuacggguggcaaugucaucauacugugccuugaucucggcaacgaugcaguccauguucaggucccggcuguu

SEQ ID NO: 17965 - RNA, 5823 nt, Homo sapiens
gcuuauauuauaaaagcauuuuauugaacacauucuggagguaguuagaaccaaaacaaaauuugggauugggguggggauucuguuuugaugauuuagauuugggaaaacuuuggguucucgugucagcaggggccaugcugugggaaaccugaaggcugauuugaagcagaauauagaacugcggcacgggagaccaggggcugggaauggggcucuccugggaaccaaagaaugugguucugcaauuggcuuggucuagacuacucuccagaaaaggauaaaacauggcuugagcaacugccuagaagaggcaaucuccaugggcuggguugcugcacuuggaaggcagugacuugcagcagguucuuagcucuugaagcucuuccgggaggaggaggugguggagacaaauuugacgcuggagcugcuacccccgccacugccaaagcccacccccagcccucggccacugcuugcacugaagccagagccccccacacugagcccaccaccuaggccgacacccccacugcugcuggaguaguagcuuccacugcuaccuccggcaagaccuccaccgaggccgccgccaagaccuccaccgaggccaccgccauagccacugccacugccauauccagaggaaacacugcuugugacaacagcugcagggaaaggagggaggacucagugagaccaucugccaggcugauccugcauggcccauuuauuugaucugcugguguuggagcacucuacuggacccccuuuacagaguagcaaacaaggcccggaagaacugucauuuaauuaaggucccuaaaaaagugggugaguguaagaggcaaggugcuagguacugagaggagcuagguacugaggggagcuagguacuacagggagcuagguacugaggggagcuagguacugaggggaggagcuagguacuggggggagcuagguacuagggacaaggcaggggacaggguccaagaagcauaggaugcauggcuuacccuuuaagagaugagacauaagccacauugcuuccugucccaaucuguccuuccccuccaccacccacaacuuacuaaguguauuauuauaaauaaccauaugcugggaugggaaaaguuuggaucuagaaacagcagaauucugaguuggcacuaaauauaucccauauuauugucguuguuaaugucuguucaaagcuacuuacagauguugacugguccaacuccuucuccacugagucugaaaggggaaaaauugaauuaaggguuaacagcucccaaaaagacagcauuagucuauguggcuaacucccauccucaugauucgaguucauuccauaagccaggagucuguacacccaaaagcugcuuaaguuaaaggaagggagaacucuccagagggauuuuccaaugaagagggauugaccuagaaacaaguuguuaggaaagaauuauaauucacauucuucuccacccacuauggggaaaguauaagagauuuggaaaaugugauuaugucgaaagcaguuuuugccuuguaggaguuacauucugugagagaacuuggcacggacagaaauuccuccaacagaaaguaggcaaugggcaaugucagagguugaagcaaacaguaguuugacaauccaaagguagcugaguuuaacucagcuggaguaaacaugaaagccuuccugaaggaagggguacuggaggacaaggguggauggaggugggcaugacauggauauugagguugagcaaaggacgugagcaaaagcagaaaaggcacaagugucaagaagauugcugaguugcucaggugcuuggaggacagccagugcccaggaacaccggugggggaaaagagaccagaaaagugaguugaggucagcuauauggccaugagucagacugaaauaguguugaugaugugucauuaucacgcacaagucacugaucucauguauguguguuguacaccccacaguagagcagcuucgcuuuaucagcugaaggccaucuugaguucaugcugucuacucaccugcauuccucgcccuccagcagcuugcgguaaguggcgaucuccacguccagggccagcuugguguucaugagcuccugguacucacgcagcagccgggccauguccugcuuggccuucugcagggccuccuccagcucggccagcuuguuccuggcauccuugagggccagcuccccacgcugcucggcauccgcaauggcguucugcagauuggcgcacuacagauagaaaggaggagagugggguugcuugggaccugaggugucuccuucugaguuucugggucagacaaaccaaacuaucaugaaucccagagagaaaccaguacaucguggguggcaggacacugaaacacugguacuggaucuagcugcguguguuuagcaaaaguaaaacaaaauaaaacaaaguagguguuucuuuuagaacucaggccccuuccuugcccucuuucaaucucacccuaccuguuucuugacauugucaaucucggcucucagccucuggaucauccgguucaucucagagaucucaugcuugguguugcggaggucaucgccaugccggccagcugucugcugcagcuccucauacugaugcagccaggaaagaggaaagauucuguuuauaugagaaugggaagaacuuucccaaaguucacaggcagugaguacuaagugguggcaaauaguguggggcugguucaggcuuuuccaaggcugagcuagucuagugccuuugcucuccuggagacacuggugugagauucagagugagauuauuucucagguccuuggguuuagauggaaauugucuacacagccauuccuauaaagcaucccaaugggcuucagcagguuccaggagccccauucuuagugucgucauggccuagaauccuagacauggguguguccccucacucaggagacagucaucagagcacccaccuuggucugauaccaggacucggcuucuguccggcugcgguuggcaaucuccucauacugggccuugaccucagcgaugaugcuauccagguccagguugcgguuguuguccauggagaggaccacugaggugucagagacaugcgucugcaucugggacagcuccugcagggagauuuggagucggucaucugguucuguguuguguuauuuaaugucaguuccauucaaaucuuucacucauugugauaugacaacuugaggaaaaaaaacccacccaugugaaaaauuuagauaaguuucuuaccgcaucaaagaacaucuucaugaaguuaaucucauccaucagugcaucaaccuuggccuccagcuccaccuuguucauguaggcagcaucuacauccuggggaaacagggaugauuggcacugcacacaccgucacccuacucaagugagcuccacgcuuagagagcauagcugcaggcugcugguucucucccacccacacgcaccuucuucagcaucacaaacucauucucagcagugguacgcuuguugauuucauccucauaccugguggugaaagggaugggaaguguuugucagaggaugagcaacagguaaggggucuuuauuaugcagucaacuguaagccuacuuuugcagugggaaggggcuucuccucauaggcagagagggaggggacacugguagcaugaaccucuggccaaggucccuccccauuuaaauacugcuuucucuguaacugccuaccauauaauaauucuauuauugcucuaauucaguuguuucaagcagauuccugcagaaaagcugugcuguuucuccccaacugcauuaccuagucaauuucucuaguguucuuuuuugagcuuucagaggcuuuaaaaaaaaaaagaaaagaaacaaaauuaaaucuagcauccuaguugcugguucauaagacuaaagaaauuacuugagccaccaagcuggguuaugucaccagcuccugcuuugagacaaaucuauccaaaggcccauguaccggggaggaaagucccagagagcaagccuuacaucagggcagauuucaccagguagugccaagggcacagagcauguugcucuggcuguugacuaaguuccuugcagagggccugagccuggggcuggaacuuucuaaacaugagccuggcuuguguauuuguuuguuuguuuuaguacuggagguguccauggaagguauauccucccagccccaaaggaaggcaugguaguagacuaguaacaaagcccaucugguaccaagaagacaccacccuccccuguguccacccuccaccccaacucacuuguucuugaagucuuccaccagguccugcauguuucucagcucugaguccaggcggccccguucccccacgaugcuguccagcugccuccugagguuguugauguacugcucgaacaacggcuccagguucugccucacagucuuggugcccugcuccugcagcaggguccacuugguguccagaaccuuguucugcugcuccaggaaccgcaccuggaggggagcaggguuugaagauagagaaacuuggauuucauguucuaugaucaacucacuaaggugccucccaccucuuuccgucccucuaaagcuuuucugugcacugugccuggcccugggccccaggaggggaggugcagacugaggcacccaaacucacuuuuccagggggagauaggacaccuauccagggcacagaaagcacuaggagugcugcuuggagugugucccggcucagggguggcugcaaaggcacucaggcugcugcccaugcacuugucuaccuuccuguacagucagccccuuuauauauggcaugaaauucaucucucuguccaacaguuguuaagaggcccuugugagcuaaccucugaaugggaagaaauaauucucccuucccagcugccagucuaauucagaacguguccacaaauccagggcacagaaacaaacggaaacacagaacuguacaacuauaaaaguauuugcacaaagccaaaacaucuuccuucuuucucucucuuuggcauuuauuucagacccacagugauuuuuuacaaaagaucguagcucaccuugucgaugaaggaggcaaacuuauuguugagggucuugaucugcucgcgcuccucgguccucacccucuggaugcuggggucgauuugcagguugaggggagucaggagacucugguugacagugaccucuuggauaccuccaggagggcagacaggaaagccagggccaccgaagccaccuccaaagccagcuccgccaccgagcccaaagccaccaccagcuccaccgccgaaaccaaauccacuaccggcaccaccuccaaagccauagccgccuccagcaccagcaccaaaccgguuccugaagcugccaccacuagugcugauggauauccucuuggagccccccagguuguagaggcuccggcugccauagccacccacuccacaagcacccgcaaggcugacccugccgaagccaccaccaccgccacccccggaccgggacacggaggugaagcuggugcgggagacagacggggugauggcagaggcggugcugaagcuacgacugcccccgcuccggaaggacacacuugacuggcgagacaugguggcuuguuccugguggagcaagagaaccaggcacuaguggguugggaggugcuggagagaacagagcucagcaggacgcagaagguggcucuguua

SEQ ID NO: 17966 - RNA, 3869 nt, Homo sapiens
cggcuuccgaagcggcuccggggcgggggcggggccucacucugcgauauaacucgggucgcgcggcucgcgcaggccgccaccgucguccgcaaagccugaguccuguccuuucucucuccccggacagcaugagcuucaccacucgcuccaccuucuccaccaacuaccggucccugggcucuguccaggcgcccagcuacggcgcccggccggucagcagcgcggccagcgucuaugcaggcgcugggggcucugguucccggaucuccgugucccgcuccaccagcuucaggggcggcaugggguccgggggccuggccaccgggauagccgggggucuggcaggaaugggaggcauccagaacgagaaggagaccaugcaaagccugaacgaccgccuggccucuuaccuggacagagugaggagccuggagaccgagaaccggaggcuggagagcaaaauccgggagcacuuggagaagaagggaccccaggucagagacuggagccauuacuucaagaucaucgaggaccugagggcucagguaagggguaggagggaccucaacucccagccuugucugacccuccaauuauacacuccuuugccucuuuccgucauuccauaaccacccaaccccuacuccaccgggaggggguugggcauaccuggauuuccauccgcgcaccuagccacagggucccuaagagcagcagcuaggcaugggagggcucuuucccaggagagagggggaaggggacaggguugagagcuuuacagaggaaguggacagcauggagggagguaaggaaaggccuguaaagaggaggagacacuggcucuggcggaauggggacuauuggaggguuaagcggauguggcuaaggcugagucaucuaggaguaaacaagaggccuuccuuugggaggagccaauccaggguguagggggcccagagugaccaggugcacuagggaaaaaaugccaggagagggccaggaagaggacuuguuaguagcgacucacuucugggcaggcaggccagccagcuagccagccugcugaggcuucccaagaggggcagagugcugggaucugggaauccaggaaaggagggaaugggguggggcuagaugaaaagggauagguguccagggagagccucuggcuauuccugggaccaggaaguuuucacuaggauacauaacacuuuuuacacacucaccccacccaucccuggcuuucuauucauggaacaaccucucucuacaaucccuccagaucuucgcaaauacuguggacaaugcccgcaucguucugcagauugacaaugcccgucuugcugcugaugacuuuagagucaaguaaguuugggggcuagagagcuggggguccagggguggagcuaagaaggaucugcuccccaggcugggucaguuaggggcucacagugggauccuguuagguguggguggaugagagucaggguccaucaguguauucauuuaacuguucauuuguauaaccccguuuaagaauacuguccuccaagugccaagaauggugcucaggggauuaccaccuaauugcugacucaaguugcugguuugcaaugggcacagaacuucucuuaguagguggcaugaguugagaagguucuggaucagagauaggggccccucugaucaccuccacuccuauagguaugagacagagcuggccaugcgccagucuguggagaacgacauccaugggcuccgcaaggucauugaugacaccaauaucacacgacugcagcuggagacagagaucgaggcucucaaggaggagcugcucuucaugaagaagaaccacgaagaggcaagcaggggccacuggccaggccagggauugaggggccaagagaagucugggucggagaauagacaagacaaaccaacugcaaguagccuugcuaagacguuuagaaauagcagccugggcucuucuuaaauaagaccguucugaugaagagcauucucagggggucgaguacacccuggcucaccugaauuacaggucaaaaugauauggguuagaaaaugagaugagaacagaaguagaagcagcuaacacuaggagcugggggugauaaaggaaugacagcagauggaguuggcagcgcuuccuaaaagaugguagaaggagcagguuugugaaggggaggguggauaaaggaacagggugaaguuacagagaaaccaucagugaguggguggcauuucuacccacuggaguagaaaggccagaacuggcauugcccugagugcaagccaagggguuccuccugucucuucuccaacuguaggccuccuagaagaggcaaucacagaagaaaggccuuguuggagcucugacccugaacccuccucacuuuugccccugucaccuuuaggaaguaaaaggccuacaagcccagauugccagcucuggguugaccguggagguagaugcccccaaaucucaggaccucgccaagaucauggcagacauccgggcccaauaugacgagcuggcucggaagaaccgagaggagcuagacaaguacuggucucagcaggugcgugaggggaggggauggcugccaaggugugggagggaggcagacggaaugaggggccugauggacuguccccauccugcagauugaggagagcaccacaguggucaccacacagucugcugagguuggagcugcugagacgacgcucacagagcugagacguacaguccaguccuuggagaucgaccuggacuccaugagaaaucuggugagugccuucacaucaccugcccagcuccuccuucacuuggccucagacccaacccugucucaacccaaauccuaucccucauaucaugaguuccuuuagcucagaaagagucaguuuccucuuugcauuucccuccacuccuaucccuuaucccaguacuuggcacauagcaggugcccaaaaaaguuuccaaaagugaagggaugagcaguccugggacucugggcucacccugccccuccucucugugccccugcagaaggccagcuuggagaacagccugagggagguggaggcccgcuacgcccuacagauggagcagcucaacgggauccugcugcaccuugagucagagcuggcacagacccgggcagagggacagcgccaggcccaggaguaugaggcccugcugaacaucaaggucaagcuggaggcugagaucgccaccuaccgccgccugcuggaagauggcgaggacuuuaagugaguggggcucuccuacccacacgugcugggaucaggagaucacuucuccccaaagucugagcuuuuggaagcaccccaugugucuguucacugguauccacugagcacugggccguugcuccgugggugcuccugugucuucaagggaguaacaguuacagaggucucccccuugaagaaagcaaacuaaguauugucccuagcuguacuuaguaugcaaaugaaguuuggccuugaguuucccuuuucuggaggaagaggcugagggugauuuggagauaaagguagaggucaggaggcuuuuucccucuaccuuucuugucucccuucuacuccacggggcuguuuauaacuugggcuuggucuucuguuacagucuuggugaugccuuggacagcagcaacuccaugcaaaccauccaaaagaccaccacccgccggauaguggauggcaaaguggugucugagaccaaugacaccaaaguucugaggcauuaagccagcagaagcaggguacccuuuggggagcaggaggccaauaaaaaguucagaguucauuggauguca

SEQ ID NO: 17967 - RNA, 15671 nt, Homo sapiens
ugaaggaaaggcggggacccggaugugugugguggcggcggccgaagagcuugugugcggagcugagaggccuauggaugaggaggacgcggcggccccgguaggcggggaucgggggcggggucccggaggccucguaucuccccggagccugaagcggaaggcggggguccugggcgggggcucuggggccaggggcggggcccugcgcucuggucacugggcuucuucuguugcugcacccucggcccagugcagggccuggggagacugggcguaggcacacggaugggcuggggcccggcugcucccgggucucaucucagugaucaggccgugcccggggaggagacagggcccaguagggccgccacucgccggugccaagacuguggggucugcgcaaccagcaucuaccugggguugaguccuggcugagugcccgggaguggaaucuuagggcugucugucccacaggugccuacucuucugggccacgugguggguuguagcuacugcauaagagucguaauuugcguauugggaucaaauucagcccagccaaggcuuacuaagcaccuaccgugugcaaggcaaugucaggccucaagaaaaccccugucccaguguuuagggaaugggaagagaagaguacuucaccucuuucucacuuuuggcucccaggaaaaaucauucauucauuuauauguagggacugaugguuguuuaaauaccuggaucaucccacccccauccaucggcgcugcuaccgacuuaguggaugucauuucucaugugaacugcugcaacaacgucugaauuguuugcccacaucuguucuugauccucuugugaucaguucuccaaccagcagcuggaaugaucuuuaggaacugauuaagaucguggcuuuuuuuuuuuuuuuugagauggaguuucugucacccaggcuggagugcagugggacgaucucggcucacugcaaacuccaccucccagguucaagcaauucucuugccucagccuccugaguagcugggauuacaggugcgcaccaccacgccuggcuaauuuguuuguauuuuuaguagagaugggguuucaccauguuggucaggcuggucuucaacuucugaccuugugauccucccacuucggccucccaaagugcugggaucacagacgugagccaccaggcccaggaucauggcauuuuuuuuucuuuuuuuuuugagacagggucuugcucugucagccaggcuggaauguaguggcacaaucagaacugacugcagccuugaccugccagacucaagccaucuucagucuccuuaguagcugggacuacaggugcaugcugccacaccuggcucauuguuuuaauuuuuaguagagaugaggucucacuacguugcccaggcuggucuggguccuggccucaagcgauccuccugccucagccucccaaggugcugggauugcaggcaugagccaucauacccagccaaucauggcauuuccuugcuuacaacccuccagaaauuuccaucuuggaauaaaauccagaguccuuaccauuucauugucuguagggccaugaucugacuccugccuuauucucaucuuguacauucucccucacauucccuauauaccagcuguccaugccuuuuucuguuucucuaccaugccagcucucuuccauccaaggaccuguggcugcccuuccugccuggaauaugccuggcuugucaugccuagcuccuuuucaacucaaaugucaccuccucagagagaccgccucuguccacucuauccacugccuccagauucuuuaucauaucacccuguucuuuucuccacugccugaaauuaugucuguuuauugccugucguguccaccucccagccugugagaaugggaauccuguccaucuuguucacagcuccaucccuagcacggagaaaagcacacagaguaggugcuugguaaauguuuguugaauggaagaaagaagaugaggguuguugaggucaaucugggcagcuggccucaaggccagugccuucucuaccuucugggucacagaggcugaggugcuuuaccuagggcccugcuuucuccucaauccccuucuccccuuggcagguuuguucucaugaacaagauggaugaccucaaccugcacuaccgguuucugaauuggcgccggcggauccgggagauucgagagguccgagcuuuccgauaucaggagagguucaaacauauccuuguagauggagauacuuuaaggugaguucaggagaaugcuuccacauuuucuucucuguuccagaucuuagagaggaaaggguuuuuuuuuuuuaacuuuuauuuuuucagagaaggggacugugcacugcacagggaagggcgaugcucuugacuccagaggccuuucuuuuucuuuuuuuuuuuuaagacagagucucgcucugucacccaggcuacagugcaguggcgugaucucagcucacugcaaccuccgccuccuggguucaagcgauucuccugccucagcuucccaaguagcugggauuacaggcgugcaccaccacauacggcugauuuuuuauauuuuugguagagacaggguuucaccauguuggccaggcaggucuugaacuccugacuucaagugauccacccgcccagaggccuuucugaguggagcagugugugcugcuucacccugcacucaccucugccucugucacuggguggcucuguccucauccagcaaggaggggauccagcuggguaggggaagggaucacaucagacacaggaggcugcuggggucucagaagcuuccuaggugcuuuguugagaagacuccagugggguaacugagucuucugccacugucucagggauuagaucuagugaagaguggcuguuucagagauaguugauuuccuguuuggggaagggccauucuauaguguacccuguccaccaacuccuguauuuccagccccuuagcuuguguguguuuccucccucuuuucuggcuugaaccccuucccugacuccuucugagcccaugcucucacagaguuccacugaagggggaagaaaguaguacuguuuaacuagaggcaagaaagcugaggagugggaacugaaucacugucuuccaaucgaugaagggcuuugguaaagaggauagagaccagccauuauucuccagcuccacugaggacagagccagaggaaaagggcugaagcugcagcaugagagauugagguuacacaggguugugagaccucucuuaggcaaguaagggaggcucuacauucuuuuccuccuggaaaugaagaaaccaggcuugcacuggucugguacggguuggauuccagcuggaggcugcgagaggaguagggugaggugaccuuaaguaucugguucugaugucugccgauguacugaagugcagccugauggauucuccugugugcuggcccuugcaggguaagggugggagaagcugaggcccucccccuacucuugggcuaggcugcuaauggaauuccccccucauuccuccuucaguuaucauggaaacucuggugaaguuggcugcuacguggcuucucgaccccugaccaaggacagcaauuauuuugaggugaucaaggcagugggugggcagagcagggggugagcuugggggugagaucauuaagccccaagaagcuccuuuacuagauguaugaccugggccuuuuaauuuuccaucagggcuguccuguuggcugggaaauaggugcaggauagcauggccccucaucugagagauaggugcccuggaaaccugucacccugucccuucugcucuccuaccccuuagcuagguagacuuugacccauaucccagacuugacucauguccccuaacccaaacccaccauauagggacgugaguccuaucuuucuccaaagcuuuggaguaauuuucuaagugaaauaggcacccacucucaccaauugcccccucugaguaucuuaucuuuuuuccugauucccauguccuuuuucuuuuugagccucagcgcccuuuaaucucuaaguccccuucccccacccccagcaauucaucccauuucccagcccugcugacugugcccugcuuucuucucuccaggugucuauuguggacaguggaguccggggcaccauugcuguggggcuggucccucaguacuacagcuuggaucaccagccuggcugguugccugacucuguagccuaccaugcugaugauggcaagugaguuggcuccugugcaacccggcccuuuuccuaugaauuugggaaucuuagaucugaagaacuaccuugggcuggcuuuucccauuggguguuucauagacuuuucuggucaggacagggaaguggccuggcagcacccuugaaggcuuacagacuagaggagggugaugcucacgccaggacguaaguggguaccaucacagaaugaccaggagcagcaagaugaggaugaggccucugcugucagugcuggggagaaguugggaggccaggcucggguccugugucuguacuacucugucuguaggcuguacaauggccgagccaagggccgccaguuugggucaaagugcaacuccggggaccggauuggcuguggcauugagccuguguccuuugaugugcagaccgcccagaucuucuucaccaaaaaugggaagcgggugagugggaaauaguggugggauuuacguggcugaaaucugcccaaggauuuguggggagugauuaggaagagucugcuggcuggggcuugcccagggacccuugcacugaguucccaucuccuccaguccagccucagauucuccugaagucucuugcguguaggagaagauacuucccauggccagaggaagcugggacauugcccagaugacaggcagagagaggcaaguuaguggagcagaggaugagcaggaauuguggggaacagaauugggugauuugggggaagguuuugagcagauaaaagagaggggaagauuauggccuggccauguaagcuggagguccucuuuggguuuugacuugagcacuuuuggggauauguccuuucuguguccuguuuuccuuguuucacgucucuuucacuauccuguucguagagagacuaggcguggugaggagaugggacaggagccaauaguagagagagacacacagcucucucccuucucuccaacuccaucucccacauugggaaauugguuucucaggccuuggccaagggguccugcugccuuagcaucugcgccucggcacucuccuguccagcacacguacugaaaguauuuggcagcaagucaggagacuuguguuugucuucuagcucuguacauaccuugcuuagccaggaguacuuagcacauuuggaaacuuuucugcaccucuggguugcuuuuuuuuuuuuaaucugucagugugugugauaauuauugguugcaucaucuuuuuuuuuuuuuuuuugaaauggagucucgcucugucccccaggcuggagugcaguggcaccaucucggcucacugcaagcuccgccucccggguucacgccauucuccugccucagccucccgaguagcugggacuacaggcgcccgccaccacgcccggcuaauuuuuuguauuuuuaguagagacgggguuucaccguguuagccaggaugguuucaaucuccugaccuugugauccgcccaccucggccucccaaagugcugggauuacaggcgugagccaccacgcccggcugguugcaucaucuuaaaaguacccuugugagaauuaggugagcuauggaaaagcaggccggguggcagcuccgucuuuccccccacugcaggugggcucuaccaucaugcccauguccccagauggacuguucccagcagugggcaugcacucccugggugaggaggugcggcugcaccucaacgcugagcugggccgugaggacgacagcgucaugaugguggacaguuacgaggaugaauggggccggcuacaugaugucagagucugugggacuguaaguagcgggugggagggugggaggggcugggucggaggaggcugggcagaacaccugugggcacauggucaugucugaauugcugggaauggggagucgggacaguguccgugugggguuuggcaagauagccuaggcucuugacaugaguccuugaguccagaucuguguuuucuuuagcacauguucucuuuucuucacuuccuccucuucagggaacucagguucgcaguuugacccugggaacaaguaguucugcuuugccuuuuuugguuccuucagcuucuggugucuucuacagcccugcacaacugccuuugaggggcuggggguugaucuggaggcaaaaugccuggcccaggcuuuucauucaaaguguuguggggcagguguggucagaaguccacacaugugguggaagguucuuagccaucuuuuuugaggaagugucaaugucaguuucuauugucuuaucccugcauuugauagaggauuagaauggaggcagauaaagauucagugagcauccuuacaccuccaaacuugcuucauuuaucuuuuccucauaccugcuuuaguauggauuuuaagcuucguugggaagcguguggagcuugagaaaggggaauucuuccuccccggauuuuaaguuuuguuggaaaauucaugaaccuugagaaaggaaaauucuuccugucugccucaauacacugugcugcauugggagugaauggacgccaaguccgggaucuggcccugaccucuagugggcugcucagcccucccacuucgaauugucccucuccuacccccuugcuccuggccuggccuuuuucuccacccucuggccuuuccaccccaacccaggcuguuuucaacucagucuuugauaacaaaacagaagcaguggggggugggagcggauuaggagccaggccucccccugguggaguggaacucagggaaaaugacaggaagugugcccuccugcugcuucugacacucugcacccccgucuggcaucagggucccaggcugcagcgaccgagagcuaagaggccucagaugcccacuccgugacucucaugucuuuccuuuuuccccucaaucuaccaucauucugacaacaucuacagaguuaaacuuggggcugcgccagggcgauguuccagcucucaucucugaccucuccucaagaguuuuuuccuggcauccuuucucugccuggaccuguccccacucugcucucagcuccucccaggcaaucuuuucuaauugaugcagaauccuguagacauuuauaaauagccuuccuuccuccccacccuccccccaacaccuucagccacuuauuuaagaguguuuuucuuuuuuagacauaagcuguugaauugggcccuucucucagacccucaccccagcuugggccagguggcagggugggagcacuacuccuggggcacccguuccucuggggccaacuuggaugugagcuuccugagggacaugugccuuuuuccagucaugccaacuuuccuuuuuuuuuuuuuuuuuuuuuuaagacaggcuaucacucugucacccagacuggagugcugguucacuucagccuccaacucccaggcucaagggauccucccaccuuggccucccaaauugcugggauuagaggcaugagccacugcccugggccucaacaguuguuagauuugagucuuuggauauagacagaccuggcucuuucuugaguggaauucuuccccugccuccuguggccuguuucccccuccuaaagagucuaccuccucagagcucugagggguugaggaauugcuggggcacuugccucucaccucaucccugccuccaggccucgcaaagugagguaaugugguggaggggagcugggggcgguagguaacagcugggggauuagacucauucuguguuugugcccuguucacagcuccucugacaacuccuuagugacaggggcaacagcuuugguacacacaggguggugaaugaggccccgcccucccagggguccuccccagacccagcccagagggaggcugugcuggagccugagcuggccaggagaguguguacuugguuccuguuucaguugcuucugggcccucagggcacugagcccuuccuugcuccugucaagagggauuagggucucugcuggcaaggggaggagggcggauaccggcaggggagaagaggcugggaaggugcuacugguagagggaggguguggagugcacgagacuguccacacucuggucugcagccgccacucuguggcacugagucaugucuuuggcuucuuggggcuuuggugguauguguguauuagggggagacccaaagaaagggcuccaucuucccccaccaaaaaugcagagaaacauuucuguugauuggacauuguuugagaggagacacauaggguagaguugucuggggaguggccaucguccugguuggccuaagggaccauuguaguuggaaguaagggcuaagaugaaagaucauuuccuucuuugugaucggcaauuccaacguaaccccauuuacacugauuuagggagaggcagcaauguguauuggucacuucauuaagucuucccacuuguuuuuggaaauucagguaaucuuaucccaguuuacuguugaagaaaccaaggcuuaaggaggugaaugucauuugccugagguuagcggcuguuaaguaauaggaguuaggauuugaacccaggucuguuggauucugagguacagguugagggaccagcaucaagauccuaacaguucagacucuaaggguuaaccuucacuccuccucuagguuccuaacagcuauagaccaaggaggcagaggaauguacucaagaaagaaucugucagggaggccaaauauuccccccacuuccaccccucugaguucucugggaaggcucaggaggggucgggggagcuuuguccaggagcaggagaguggaucaggagguuuaugauggcuuucacugugagggcugggcgguccccucugaagagggcacgcuguacaagccucaccuauacacuguacaaguaccuagucguccaggacaucagcauucuguccgaagugcucugugguuggcagguagagaguggguuuuaaagacccauguugggguaguccguccuggcuuuuagcgugagaaagcaccuccacccuauccagagacagaaaugcagcagcuacccucuucugagcugaggcaaagggaggggcuggccggguauuucccaaggaucagggucuggaucggcugucuuuuggcucuggaaauggagaacacuguguuuccuacaccgaggccaguuggauagaaugggucaaaggcagcuguggggucccccacccaguucugcaaugcuggguggagagggugggcugggggcugcucugccuggguggagucuaaacuaguuaauguggaucaagccacaccccuccuggcuucccggggagagaggcagaggaggaacccaggcugagcagagaauacaccaugaacagaagucaaacaguguggccuuggggaugggcuuagguggucucccgugcaugcugcuuucccccucauccauccccaguuaucuuuggagaggagggaaggauggacuugagguggcggggcugagauccagggcugagaaaggcaccaagccccucuaguccuacucucagaagggguuaguagcaccccgcucuaagcaccugagcuaagcagcggccgucugaggcugggaguggggaugcgggagcagccucugcuggagacacgcacaggcuucugugcuggugcaggugggcauaauuccuuuccuguucaggcaggaaucugugagaggugagaggccggcgucccaaagcuugccagggagacguggaggaggucccuaggcaacauguuuccuucagggcugcaggggugggaggguagaagaaagucgugaggggcaguugggcuaauuaaaaggagauuaaggaaucccaggugaggccgaaggugggggaaagaggggaugggguugagucaucaccccacuauuaccaugacaacugacaaauaaauccucccagauuggggguugccgccccgucgugcccaggcaggaccauugugggacugaagagccccaagaacccaucagucaucuccccuauccuaccuccacgccccuacuccaacuugaaugagcaaugaggggcugggaacagcuaagccugccucugucuucauuuugaccucuccucucccucacaugaaaugagggaguagagcugggcguucugggucccugggcuccccucagcaccucccugacccagcuaagaacagcuguguucacagccaaguaaaacaaggaccuugagaaauuaugucaggcccaucccaggcagaauuggcuucugaacucacccgcuuccccugaauaucugggguuggcaccuaacuucugcauccucccuguccccauuaggcccccugagaaagucaucaaguuuccucucagcuagucuugcuucuccuuuccccuguguuugggacccugggcggaccuuucccagcaggaaaggcugcaggguuuuucagcgggcgaggaugcaucuagagcccccuggugugccgcuccccuagcugugcugcuuuccccggccucccagaaagugugugggggaagacagcgugggcauucagcaaggggugcucuccccuuugccucccaccccauccugcucuuccaugcuggccuagaacuuuggggccacauuguaucucuaggauucuuucccuuucagccaggaguuuuugucagaccugggaaagugggacccagacugccuugggcccagguuuccagggugggugucagccuguccccugacccccaucuggcucuucccccacagcugcuggaguacuuagggaagggcaaaagcaucguggauguggggcuggcccaggcccggcacccacucagcacccgcagccacuacuucgagguggagaucguggacccuggagagaaaugcuacaucgcccuggggcuggcacggaaggugggcacaaaggcugagcuuuuuugcucauggagcugcucaggucuggggcuguuggggcagcaccaggaagcucuuaggagaaaccaggggagcccaggcuuuggagggagggugcuaagcugagauggaacacaguuguaugugucugcuguguaagaguacacaccccaugugaccaaggaccugagacaggucaugacugcaccacacacuaaggccuggggggagggggugggacaugccauggcucuggccuuaaaagcuuaacuaacacuuuccucacccucccugguuccccugaagccccagugccugcaggguaugagugugcaggguuggcacucucugggcuguggucugucccagagguucagaugcuacucgccacucucuccugucuuguuuaugcaugggaccauagauuuucuuuucucuucuuggugcaggacuaucccaagaacaggcacccuggcuggagcagagggucuguggcuuaucaugcaggugaauagcgggcugccugggaaaggugggauggugggagauguggaggcauagggacauccacuuuccccucuccuggccccucacaaauggccuugcuguuugcccugcugcuggcugaccuccccuucccaaaucgcuagugcuuccuccucaucuguguuuuccucccagcucuggaaaccaggggagcaggacaggagagggagaucugggcccagaugggacauuccaggccucugagcugguccccccgugcccuuccugcagacccucauuuccucauuuucuuuuuucuuuugcugcuugguuuccuuggcuuucuuuagaagaaaacugagccuagaguuccucgacccaccucccccugccugcccucccuggguguucauuccuucccuagggcccccuccucugacucauuuccuaaggguucucccuuacccuuaccuugagcagauggauacuacgucucuuuauuuuauuuggugcccccuucccauauaucucgcuccaauuuuuuuuuuuuuuuuuuuuugagauggagucucacucugucaccuagacuggagugcaguggcaugaucuuggcucacugcaaccucugccucccaggcucaagugauccucccaccucagccuccugaguagcugggacuacagacgggcgccaccacgcccagcuaauuuuuguauuuuuaguagagauguuucgccaugcuggccaugcuggucucaaacuccugacuucaggugauccacccuccuuggccucccaaaguccugggauuccaggcgugagccaccgcgcccggccucucucuccaucuuuguuuccgcccugacccuucccuuccucugaggggugggaaguguucagcuucaugagccacucuggggguguggugucagcccuccuuccucaaguguuuguccuuuccccucccuccaacagacgaugggaagaucuuccauggcaguggugugggggaccccuuugggccacgcuguuacaaaggggacaucaugggcuguggaaucauguucccccgggacuacauuuuggacagugagggugagugggguagggguggccagccaggcugcuuggggccgaggguggaaaggcaccacaggagcucagguuuccuggucuccuaggggacagugaugacaguugugacacagugauccugucuccgacugcccgggccguccggaacgugcggaaugucauguaccugcaccaggaaggggaagaggaagaggaggaagaggaagaggaagaggauggggaagagauagagccggagcaugagggcaggaaggugguggugaguacggagaguuugaggugggaccaggguuuuugggucugggcaaaggguggguauuaguggggaacagaacucacaaccagggugggaaagacgggaagcucuggcguugcccaagggcuguucccagcuccagggguugcugagaucgggagacggucuugggaggcuguuuuccggccucagcacgcccucugguggucacuucccauaacaccuuaacugccccucuccagccccgcuggaagcuggggugauugggguucaggccuguggagcuccagcauccucagggaagaggccacagccugcuugcuccauucuucuccccaccuccuccccagguuuucuucacucggaauggcaagaucauugggaagaaggaugcuguuguuccuucuggaggcuucuuccccaccauuggaaugcugagcugcggggagaaagucaaaguagaucugcaccccuugaguggcuagggccuccccuccagaccugcuccuucucccugcucacccucugcugggccaggcacccaguuccugacuucccagaggcuucguuuacccagcaggccccuggagguguguagucacucugcccccacuggcucaggccccugucacgcuucucugugcccacguuucugaccuggugcugccacuguugucagucccugggccugagucccugguuggacaggaauggacccaaagaaugguguugguauguggguggucccacucgcuuuggucagugggcuucugggucccccuuucccucaccggcccuguguggguggagaggcgugagcacccuaucucagcugcuauucgggcaugaugcuuuguagaggguagaguagacagcccccuccccuacucaccaugguauuucuccuugaauuccucuuucuuguuuucuuuccugguugugugaaccaguugcugcugucauaccccuggcagggccaggggaccucucuuuggucaucucuguccuuucacuggcugcugccccaggaagacuccucuaggcucuccaucuuucccuugagagcuggcuccccaccccaaccugcucaggcaccacagaggaucuaggucucuggcuccccauaccuggacccacaugggugggugccuguugcauguuuaagagagaggggcugugaggugacagggcacuagggccuucacuccuuucuccccuuccauccuuucuuuaccagugccacccaugucccuagcucccggguauuggggcugaggcucuggggccugucucccugccagcgugagggcaagaccccagagccuuagcugagcaagcccagaggggcagcguggccccucccuccccuuuuccugccccgucccaugccucagcuugcugcuugugccaguugccuguuucgcuucaguguuugauucuagcacuuacauguguccuccccaccaagcccucuaucuccuucuaauccuucaaccccuggcccccuccccguaacagugacuuuuccagggaggaagaggcagcaggagcuguuggccuugguuugcacagagcggguagggcuguagggaaagcgggugagcuguugugcugcugggccucccuuuggcccucgcuucccacccuacgauguaugaaauguauguacagaccagagauguuuauacagccgauaaagauggaguuuccguauuuaucaguauggccggaaccaggagccuuucuaguccacugggcuaggaacaggacugcuggaugggggcagccgaaggcagcuugcucauggggagauguggaccaauguugggccagggaugggaaucauauguuccaugggccuggcuacaggccugagcacagauacguccccugggagaugaggcuuugaccuuccugugaauaaguguugacuccaauuucggcuaaaguuuauagaaauucuuuauuauuagacaaaaauagacucucuuuuuuccccuauucaugugauccuacucugaaucucugcucagaggaggcagugacucgcuccccaccccucucccaucccugccgugcuggcaccugcagcuggguggaacuggcaggggcugauccccuggagggcugacguucuccugcagguggggcugccugaucuccuucggggcucaacugcugaugccuccucaccccucacacacccaucucugccaucugcucacaugcaaggucaucuugugggccuguccacuuaacuuagcaggcugggggcggggaaggagagcagugucccaggccugaugcccacuccucauuccuaagggagggugcuuucuccugggucuccuggguccaggccaggggaugugagggcuguggggugcugggaggggggcaguguugaugugggcucugagcuuguggccuuccuucauuuucucuggcccaguagaacuuuggugaugaaggugacaauggcgccagcaggcugaucugggucaagcucugcaaagaggugacacacauucucccaggggcuucccggcuucuuggccacgaaaccaaagauccuag

SEQ ID NO: 17968 - RNA, 5441 nt, Homo sapiens
cccagccaguucucacccugcacacagcccucuccaauccuuccagacuccgcaugcgcccaccacaaugcuagggucuccuacgguucauucaaguuguaucccucccugccucccggcccuucccccauuggcuuaccccagucugguuccccucgggccccuuuucuccauagucuuaccucaagggugcuuucucuuacuccuuucccaauuuugcccuuccucuccucugcccuguucuacuucucccaucagcaguagaauuucccaagaccccguuauccacccucuccaucuuuucucugucccuccacauuugcccacuccucuugugauccacacacaccaucucuucucaguucccuuucagcccccgucuucucacuccccaccgggucccugcaugccccucgucguccuacacauacacacuaaguggauugcacucccguccuccccuucuuccgcuccuccccacccuccagucccuccagccagcuguacagcucccaaauuccgggccgagauucccgggaacaaagcaagaaaaaucagagcaauuugggaaguaaacagaaacuggaaagggagagggaaagaagaguggggaggacccagguugggggggcccucuccagucccacccaguuuagggaaugccccugcccucucccccaccccccuucaccuggcucuuaaagggcccggccccuggccggcggcuacuuaagacagaggggcggcggcgggcagcagcugcgcugcgacugcucuggaaggagaggacggggcacaaacccugaccaugaccccccacaggcugcugccaccgcugcugcugcugcuagcucugcugcucgcugccagcccaggaggcgccuuggcgcggugcccaggcugcgggcaaggggugcaggcggguuguccagggggcugcguggaggaggaggauggggggucgccagccgagggcugcgcggaagcugagggcugucucaggagggaggggcaggagugcggggucuacaccccuaacugcgccccaggacugcagugccauccgcccaaggacgacgaggcgccuuugcgggcgcugcugcucggccgaggccgcugccuuccggcccgcgcgccugcuggugaguccgcgccccgccccugccccgcccacgugagacccgcguccuccaggcaggguccuggggagacgggaguggguggcccggcaagccuuuccgcccuggcccuugacgcuuccgacuuuggggggcacauuugugugggggagaaggggcaagugcaggaagcugaggugcagccaggggaccuggugauacagcagaaggugucugcgcucucggccuucuuuuuugcuccauuuauuuucccuugauggagugugcgugcaggugggaacuugggggaggcagggggagaaaugggaggguuuuagggccaucccaugggcuccagcaggcccagcuccuacaacccuagacggccaagcuggggaaaggacccaaauguuguucucagcuuccacuuggagaaaaggggaggggaaccccagacucugaaauucugcacacacugagaaaugacuccuuuccuccuaauaccgguguucgaagcaccuaaacaggaggcgucuagaaccgaagaggccccaaauccaggguuguauuagacuugaguagggacugagggcaggcuagggcguagguuaggggagaggggagaaagaguaggggaaagagggaaucugccaaaucaggguuaugauuuaaaccugcucagaaucguucacccauccuaccccacccugcuccagggaggagagcagaagcugagucacugggugggugggacagaagugaaucagccgugaaaacauggggggcagcggggagauggggagggcaggaaaugcaaacugcgcaucccagaggcucuggguuccuuccacgggaggggauggagaauucacuuggaguuucuuucaguuccaaaugcccgagugcaggcuucugggcguccuccuaaaagguggucuggguggaugagaggaggcaguuuggaacuaaaugguugggugcuaaauguagggaaugaaggagaaggucuggggaggggugggcauccugaggaagaaggaucagacucaggauugcaggggaaaugucuccuggguugugagugguaguuagcugggagcuugucuuuaggcacagaggaagaggaucccuucagggguucugauaucugauuagauguuaggcaaauuccaagcagucaguacaugcuccccuuucugccuuuuccugucccugacuuauuuccucaccccuucccaguccugagcucuccccggacccuccggaaacuuucuccagagccaggagcaaccugcagguuggaagccccucauuccuugcaccuucuuaaucugcccucagccuaucuugguuaaggguugaauccaugugcuccugggaccacugggguugagcuggccugggucacaggguaccagaagggagagguucccacugcagugccccagaaguaaccacaucucaggccugggagggguggguugagucauagcaaggucacagcagggacacacauuccuuuugggucccuguuggccccccuccuacauccguugcucuucugccccagcucuccggcuucgugcgcccccuucuggccucugguggaacagccaggucuuuucacccaaagcccaaagccccaaauaguccuuugaauuuguucuccauuuuuucauuuauuuuauuauuuauuguaauuaauugauugauuuuuaaauuaguuaauuuuuuaaaauuaaguaauuaguuaauuuuuuaaaauuaaguaauuaauuaauuuuuuaaaauuaaguaguuaauuuuuuuuaauuaaguaauuaauuaauuuuaaaaaguauuuauuuauuuugagacaaagucucacucuguugcccaggcuggaguacagugguccagcgucucacugcaaccuccgcccccccgaguucaagcgauucuccugucucagccuccggaguagcugggacuacaggagccugauaccaugccaggcuaauuuuuguauuuuuaguggagacgggguuucaccauguuggccaggcuggucucgaacgccugaccucaagugaucugcccaccuuggccucccaaagugcugggaugacaggcaugagccacugcgcccagccaauaauuuauuuauuuuugagacagggucucacucgguuguccaggcugaagugcaguagcacaaucauggcucacugcagucuugacuucuggggcucaagcaguccuccugccucagccucucaaguagcugggacugcaggugcacgccaccacaccucgguaauuuuauaaauuauuuguagagaugagguucucauuauguugcccaggcuggucucaaacuccugggcucgagcaauccucccaccucugcuucucaaaguucugggauuacaggcgugagccauugcacccauccucauuuuccauuuuugcuuuccaaaauucaucuccuuuauaagccuuaaaaaucaguaugggaaauacuggggaauauugucaggaaaaguaauauaacuauuugucagagaaagaaacuagggccagcaucaugcaacagcggggcauaaggcccucccuuccuuacuucagcaggugaugugggcaaggcccuucuccacauggcucugccugauuucugaccucuccuucuccuauuccuccuccaguugcagaggagaauccuaaggagaguaaaccccaagcaggcacugcccgcccacaggaugugaaccgcagagaccaacagaggaauccaggcaccucuaccacgcccucccagcccaauucugcggguguccaagacacugagauggugcguuuggagcugguagggagcaggaggggugggaagcccuggagacuuccaucugagacugcucccuugggcuuggagacgucuccauugucuguccugggugcuugccuggugggccagaagguuggaauggggagcugggcuggagcgguucuaagcugccuacucucccuuccccagggcccaugccguagacaucuggacucagugcugcagcaacuccagacugaggucuaccgaggggcucaaacacucuacgugcccaauugugaccaucgaggcuucuaccggaagcggcaggugagacuauuuuucuucuccuccugcuccagcagaaggcuccugccagggagugggggcggugcugcuuacaaagcugcauaaauaagacacugccccaucuuuaaggaucuuccaacuuuaggagaacauagagaauauaauuuauuaaacaaacuuagagaauaaucaaccacacacugugagagaaaacccacuuaaggaaugcccuaacucaguggcucuugaacuugaggcaucagaauccuccggagggcuuaugccacacagauagcugagccccaccggcagccuuccugauucaggaggugugggguggggccugacaauaugcauuucuaacauguucccucgugauccggauuugggaacgucacuuugaaaacuacuguuccaggcuagcagaaugcacacaauuuauugguugaagagggggaacuaaagagagggaacacugggccgggugcggugucucaugccuguaaucccagcacuuugggaggccaaggcugguggaucacgaggucaggaguucaagaucagccugaacaaccuggugaaaccccaucuguuuuaaaaauuacaaaaauuagccagaugugguggcaugcaccuguaaucccagcuacucaggaggcugaggcaagagaauugcuugaaccugggagguggagguugcagugagcagagaucaugccaaugcauuccagccagggcgacagagcgagacuccaucucaaaaaaaaaaaaaaaaaaaaaaaaaagagagggaacccccgaggagacgcucagguguuuuuacauccucagacucagauguccccucucauucuccugcuggaagccucuggccucacuccugaccugugugccucucucuccagugccgcuccucccaggggcagcgccgaggucccugcugguguguggaucggaugggcaagucccugccagggucuccagauggcaauggaagcuccuccugccccacugggaguagcggcuaaagcugggggauagaggggcugcagggccacuggaaggaacauggagcugucaucacucaacaaaaaaccgaggcccucaauccaccuucaggccccgccccaugggccccucaccgcugguuggaaagaguguugguguuggcuggggugucaauaaagcugugcuuggggucgcuggcuugu

SEQ ID NO: 17969 - RNA, 2331 nt, Homo sapiens
ccgucacgugaugaagccaucauggcggcggccagaggccugcccggcucccggaagcaggcugugaggggcgggagcgcugcuggaacccgagccggagccggagccacagcggggaggguggccuggcggccuggagccggacguguccggggcguccccgcagaccggggcagcaggugaggcggagucugggcgaggugcaaguggauguggcagggcugggcaggggcuagggggcgcaguggggugccagugaccuggaggagugggccucugagaugcacacgcaugacccugaagcaacucgagaggccugcgcgggugggagggaugcccgggacagaggaugagacacugagggcaaaaagaggcuccgcagcgaggacgggagguaauagaaggaaguguacgggagcugcugugggaaagggcaguagaauuugcgggagcgggauuauugaaagggacucccucuucacaggcaaggauggguugagugcccaguccucuccccugucuucuuaccccucccugccccacaguguccuaggagacagcuuuggcguggccacuccucccacccacccaacuggucccuccggucugagaucuuggggaguggaguuggcagcgggguuggguggagcugccaucugcuuaagacagccccuugaccgugcugcccgaaggauggauauggcucugacucccaccucucuucccaggucguccgggggcccaccaugcuggugacugccuaccuugcuuuuguaggccuccuggccuccugccuggggcuggaacugucaagaugccgggcuaaacccccuggaagggccugcagcaaucccuccuuccuucgguuucaacuggacuucuaucaggucuacuuccuggcccuggcagcugauuggcuucaggcccccuaccucuauaaacucuaccagcauuacuacuuccuggaaggucaaauugccauccucuaugucuguggccuugccucuacaguccucuuuggccuaguggccuccucccuuguggauuggcugggucgcaagaauucuuguguccucuucucccugacuuacucacuaugcugcuuaaccaaacucucucaagacuacuuugugcugcuaguggggcgagcacuuggugggcuguccacagcccugcucuucucagccuucgaggccugguauauccaugagcacguggaacggcaugacuucccugcugaguggaucccagcuaccuuugcucgagcugccuucuggaaccaugugcuggcuguaguggcagguguggcagcugaggcuguagccagcuggauagggcuggggccuguagcgcccuuuguggcugccaucccucuccuggcucuggcaggggccuuggcccuucgaaacuggggggagaacuaugaccggcagcgugccuucucaaggaccugugcuggaggccugcgcugccuccugucggaccgccgcgugcugcuguugggcaccauacaagcucuauuugagagugucaucuucaucuuugucuuccucuggacaccugugcuggacccacacggggccccucugggcauuaucuucuccagcuucauggcagccagccugcuuggcucuucccuguaccguaucgccaccuccaagagguaccaccuucagcccaugcaccugcugucccuugcugugcucaucgucgucuucucucucuucauguugacuuucucuaccagcccaggccaggagaguccgguggaguccuucauagccuuucuacuuauugaguuggcuuguggauuauacuuucccagcaugagcuuccuacggagaaaggugaucccugagacagagcaggcugguguacucaacugguuccggguaccucugcacucacuggcuugccuagggcuccuuguccuccaugacagugaucgaaaaacaggcacucggaauauguucagcauuugcucugcugucauggugauggcucugcuggcaguggugggacucuucaccgugguaaggcaugaugcugagcugcggguaccuucaccuacugaggagcccuaugccccugagcuguaaccccacuccaggacaagauagcugggacagacucuugaauuccagcuauccgggauuguacagaucucucugugacugacuuugugacuguccugugguuucuccugccauugcuuuguguuugggaggacaugaugggggugauggacuggaaagaaggugccaaaaguucccucuguguuacucccauuuagaaaauaaacacuuuuaaaugaucauugauuugauuuac

SEQ ID NO: 17970 - RNA, 2331 nt, Homo sapiens
guaaaucaaaucaaugaucauuuaaaaguguuuauuuucuaaaugggaguaacacagagggaacuuuuggcaccuucuuuccaguccaucacccccaucauguccucccaaacacaaagcaauggcaggagaaaccacaggacagucacaaagucagucacagagagaucuguacaaucccggauagcuggaauucaagagucugucccagcuaucuuguccuggagugggguuacagcucaggggcauagggcuccucaguaggugaagguacccgcagcucagcaucaugccuuaccacggugaagagucccaccacugccagcagagccaucaccaugacagcagagcaaaugcugaacauauuccgagugccuguuuuucgaucacugucauggaggacaaggagcccuaggcaagccagugagugcagagguacccggaaccaguugaguacaccagccugcucugucucagggaucaccuuucuccguaggaagcucaugcugggaaaguauaauccacaagccaacucaauaaguagaaaggcuaugaaggacuccaccggacucuccuggccugggcugguagagaaagucaacaugaagagagagaagacgacgaugagcacagcaagggacagcaggugcaugggcugaaggugguaccucuuggagguggcgauacgguacagggaagagccaagcaggcuggcugccaugaagcuggagaagauaaugcccagaggggccccguguggguccagcacagguguccagaggaagacaaagaugaagaugacacucucaaauagagcuuguauggugcccaacagcagcacgcggcgguccgacaggaggcagcgcaggccuccagcacagguccuugagaaggcacgcugccggucauaguucuccccccaguuucgaagggccaaggccccugccagagccaggagagggauggcagccacaaagggcgcuacaggccccagcccuauccagcuggcuacagccucagcugccacaccugccacuacagccagcacaugguuccagaaggcagcucgagcaaagguagcugggauccacucagcagggaagucaugccguuccacgugcucauggauauaccaggccucgaaggcugagaagagcagggcuguggacagcccaccaagugcucgccccacuagcagcacaaaguagucuugagagaguuugguuaagcagcauagugaguaagucagggagaagaggacacaagaauucuugcgacccagccaauccacaagggaggaggccacuaggccaaagaggacuguagaggcaaggccacagacauagaggauggcaauuugaccuuccaggaaguaguaaugcugguagaguuuauagagguagggggccugaagccaaucagcugccagggccaggaaguagaccugauagaaguccaguugaaaccgaaggaaggagggauugcugcaggcccuuccaggggguuuagcccggcaucuugacaguuccagccccaggcaggaggccaggaggccuacaaaagcaagguaggcagucaccagcauggugggcccccggacgaccugggaagagaggugggagucagagccauauccauccuucgggcagcacggucaaggggcugucuuaagcagauggcagcuccacccaaccccgcugccaacuccacuccccaagaucucagaccggagggaccaguugggugggugggaggaguggccacgccaaagcugucuccuaggacacuguggggcagggagggguaagaagacaggggagaggacugggcacucaacccauccuugccugugaagagggagucccuuucaauaaucccgcucccgcaaauucuacugcccuuucccacagcagcucccguacacuuccuucuauuaccucccguccucgcugcggagccucuuuuugcccucagugucucauccucugucccgggcaucccucccacccgcgcaggccucucgaguugcuucagggucaugcgugugcaucucagaggcccacuccuccaggucacuggcaccccacugcgcccccuagccccugcccagcccugccacauccacuugcaccucgcccagacuccgccucaccugcugccccggucugcggggacgccccggacacguccggcuccaggccgccaggccacccuccccgcuguggcuccggcuccggcucggguuccagcagcgcucccgccccucacagccugcuuccgggagccgggcaggccucuggccgccgccaugauggcuucaucacgugacgg

SEQ ID NO: 17971 - RNA, 631 nt, Homo sapiens
cugcucugcgcguuagggccucuugggggugcggguuucccccuuuuuuccagucagagcucaguuucucagcuaccugucgcuuagucgcuaucgguaaugccaccccuuuuccuccuuuaucuucagagcucaggcaagaguuuaaguuucaagagaagagaaauaacaaaaagaacuuaggaacucacgcgguuuggguuacuagaaaaaaagggcuuagacuucuacgaauuuuuuuuuugauagggucuugcucugacacacaggcuggagugcaguggcgugaucacagcucacugcagcuucaaacucccgggcuuaagugauccucccaccucagccucccaaagugcugacuacgggcgugcaccgccacgcccaacuuccuacgaaauuauuuuaaagaugguuuucuaggggaacuacaaugaguacccguagcgaccuccagcucucucucugccuuccagccuuacuccuucuauugguuguaugagaaagacaagaucuggugcucuucgaugggggagagaggguagugggguggggugggaguugugaguagcaggaagaacuauggaaauucauucccugggauauuucacagucuuuaauggcuuauguuuuu

SEQ ID NO: 17972 - RNA, 21987 nt, Homo sapiens
cguguccgucccggggggccaggggcgggggcccuggaaggagcgggaguucaagccgagcagggacggggcuaggggucggggggugggggcagaaagcugaagcugacacccgugcauccggacaccgcacgagcaucgccugugacagcgccccggguccgguggagggcagcggggggaggagggaaggaggaggagaaggaggaggaggcgggagcagcauccggagcggagcugcagcagcgccgccuuuugugcugcggccgcggagcccccgaggugagagccuggccgaguuguggggggguggggggcagggaugggucuggguccugggauccgggcguggagggagggucgggaugcagauguggccuggugcggggugauggcguggggaugcugaggcuguggggauggaggaacuggggaccuggacccgacgccuguggggcugggaaggaagggaauggagcggagggaugccgcggcccagcuuggagacgaagggccuccagagcuggaaaggaccguauuggggugggguggaggaugauugggggacagacuuaaaggacagagggcaagagaacaucuccucccacucauccucaggaagagagagagggaaggaggagggagaguuuuggcccccucuagggaaggaaaggaagggcaaggacugauauacccaccaucuccacacacacacacacacacacacacacacacacacacacacacacacacacacacacacacacacacacacacacacacacacacacacacacacagcaggcuggaccugaagauuagucagagagcaccuguuccugcaugcccaggcguuggucccccuccccuucaagcugugauccuccuaauccccuccagcuguggcauucaccuccagcuguggcauucaccuccauccagcuguugcauccuccccucccccauucacguguggguuucucccuccucuuucucuccaucuccucuggcuccccuaacccaucucccccagucaggcccuccaaaaaccuccucccuuucccacaaacacuccucaaacucauuggcuuaaaaauaaacaagaguugagacuugcugguaaccaaggccuugacugagaggagggaagagucaaggcucuguagacagugggaggaaacagugaggugucccuuagaauuaagggaggaguccuaccuuguagaugcucaucugcugccuuuuucagaggagcguaggugaguggccuccaaucagaagggagugcacaugaggucuccucaccccacccagagucgucucaagccacagucagugcaucccucuaaacacauuucccuugcaguucucaagguggacuccauugcucuaggagcucugaguuucagccagaggguccuaccaagcuaaggcuaacagaaaggauuuaggaaggauaggacucaagugcccccugagccuuccuguccagacacugaaguuucucugagcuuuagggccccacucccuccuaucucacacuuacaggugaaaaaaaguguguccccucaagcguaucauucauccacucacucccauugucaacugggguaauguuaggaaaaccccagcucucaacauggagacaccagcuaaauauccaucccaguuauggacagaggaggcaagaaguuagacauggcucaggauuuccuaggcuuccuuauagcugaagagggcagaacccuucuaaaaaccaauugcuuuuccccucguggugacacugugguaggaucaggcuuuucuaggaagaggacucuugguucuaccacucacagcccggacucucguaaugcacaguccucccucuccccugccuggaucuggagagaaagaaggaaucaacccuguaagaaguccuugcuaggguggacuggagaucaccccuacauucagguccucagcccuacaccagucaagcccugggacccccagcugccaugcuucuuccagugagguggaaaugucugccccucacgccagccacucaugcauucacucacacuguugacugaggugaugcugggaagaaggaggauacuguugagaugaugccagcaggggacauaggggcuucaugagggccuggccacagagacuggucugucugguucauuggcucccagaaggacuggggucauaugugugcguggagaaggugaggagacugugacagugaccagauuccagaggaggcuaaagaucauucaggauagagcccuugcccuuugguuucuucauucuuuggucuuuuuuuucccucuuguuucuccaccucccuuuccacccauacccucccuacuggcacuugcuuugagagagagaacaagggaaagaagggaagggaaucacauucauaaaaaacuuacaaguguguguuaggcacuuuccauauggcuaaugcuuauagagagcuuccugugugccagguccugggccaagaacuuuauuuugauuuucuuaaucaugcccguaacaagaccaagugagauaguguuaucaucaucucugauggaggagaaaacugaaacuuaaguaauuuguuuaaaguaaaaaaguuaguauguggcaagagguaggauuugaacccaggucuguguaacccagaaccuguguucuuacccaccacauuauguacugcauugccacugugggacauagguaccacuguccccguuuagcaaugaagaaacugagguuuguugaaaagucucaggccaggucacccaacuggccaggagcagagacaagaccucaggaagccacucugauuuugaggccuguguucucuccucuaccaccuacccucucccuauugcacaacuguccuaauaagcuaagugaaggaaugcaugagcaguccaucaaucuuauuuucucuuuuacaauuuaaauuuuaugucuuacuuuaaaagcaauucaaaguuguuacugaaauacuaggaauauacguaaacccaaaggagaaaauuaaaacacucacaauuccaccuaccuagaaacuguuguuauacuuugguauuuauucuuccagauuuuuaaaaaugcccaucccguugaggaacuauauuuguuaacauccgcugaacuucuuccuggucuaucugagguccuagguaggagggacuccugaggcccauccuacccugcucuugcccuccccuuccccgaggccuccauggguaaggcugaggggugauccagggccacgugaucaaagggaggaucuuagcaguacagcugcuuaagagagcagauuccagagacaacuggccagggagugaggauggggugcagaaaaucaggccaucccccuuaguccagaggagacagaauggcaggauuuacagaggagggacuggugaucugguagaggaaugacuggggacuccagcacaaucacuagcacugugaccugguucuacuggaaccugaaaucacaguuuauccugggaaagcagaaggucagagaccaagucuucagccucuccaggauccacaaagaccugguguccagccaaccaggaagacaaagcaaggaggaaacaugcugcucccugcacccccucuaucacccuacuuaaccuucacuacccccagcaggguggguugggcaccacagagagauuacauuccuuaaacuaagugguggcaaaacugggauucuagcucugaucucuccaaaucugaagcugauucuuuuuuccuaaauaguacugucccucccuucccugaaccccuucacugcccaccccacuggaaguguggcagcuaggggucucagggcuugauuuaccaaucaaagacccgaauuuaggggugaucuccaguuuucccccaaguucucaggggaacucauuucucccucaugagggcacuaagaaaagcaauaguucuuuuccucuugggauccuggggccaggacugcggauccugaaaaauggaaaauaaaaacaagcugcagggcacagugguucacaccuguaaugccagcauuuugggagaccuagacugguggaucauuugagcccaggaguuuggaaccagccugggcaacagaaugagacauggucucuacaauuuuuuuuuuuuuuuuuuuuuuuuuuugagauggagucucgcucuguugcccaggcuagagugcaguggcggcggacuacaggugcgcccaccacuacgccuggcaaauuuuuuguauuuuugguagaaacgggguuucaccauguuagccaggauggucuccauugcugggauuacaggcgugagcaacugcgccuggccuuuuuuuuuuuuuuuuuuuuuuuuuuuuggagacagaguauugcucugucgccuaggcuggagugcaguggcuccaucucggcucacugcaggcuccgcccccuggguucacgccauucuccugccucagccucccgaguagcugggacuacaggcguccgccaccacgcccagcuaauuuuuuguauuuuuaguagagacgggguuuccccaugguagccaggauggucuccaucuccugaccucaugauccgcccgccugggccucccaaagugcugggacuacagacgugagccacugugcucggccuuuuuuuaauuuagucuggugugguggugagugccuguagucccagcuacucaggaggcugaagggggaggaucacuugagcccaggagguugaggcugcaggcagugagccgugaucaucccacugcacuccagccugggcaacaaagcgagacccuguuucaaaaacaauacgagcugcagccaaggggacaggaggcauggccacgauugaucagagaccuuuauccucucaggguuucaaagcuugcagagguggaauuaggacuccaaagucuugggucuccuuucccuuugaagacuccccuuccuacccccacucacgagagaaagggaaucauucuccuuuuccugaguaaaaaaaugaggucucagacaguggagagcacucagugugagagcccaagauuuaggcagaugaccuggccucugaacugagccccuaagaccaccaaacagcuuagcauugacauucugcuguuauacaagaaggagcuagagagaauucagagaguuuaccugccacaggcuuccaaaaucucaggccagagaaccuagaaggugggauagauggggggugacuuccuaccccacucuacccuguagccuccuuauggagucacuuuggggccaccagcaaagcacugaauuagggccuguuggguguccaaagagccuccuccccuggcacauguauggcuuagagaucauucuguccccucacccaaugugaggcagaagcaccaucaacacuugguagauaugguugacagugagugacagagagacccacccuccugucacauugcugcccuucccccaugcucugcauaauugauaacggagagacagcuacccucccccagggugacugaacgucugggccaggggcuccuagccauccuagacgccccuccaaagcucuggcgccaaggcccagccagggggcagugggacacagcuggcaggucagaaauaaaggaaacaaaaagggguauguguguguguguugggagagaggaaucuccacuuuacuauagcucccaggggcagcagcuuucccucacuccaggucaauguggaagagccgucaacuagccugagaucuuucccuuggucccaucuccuacuucuucagcuauccccacuaccguaaaagacaaacaggugaaauggcuucucuccuucucuccccagcugcuggcccuggauaccagaagggccucuggggaagccuggugaacuggagggaggcucggcuggcugcaagugucucugagcaugucacccuuucuaugccuaaaccaccuagucgucaaacaaccagaugacggcugaaaaauuccuuuaaaaagccaggugcugugccuacucaaagcucggcuucuagacagaaaaggagauggguguucuccguguuucucacuccccuuucaucuccauuuucucaggguccucugcuuuuccaaacagcuuuucaagccauccuucucgggguugacuccgcuugacgcugcuccggugucuguauaugucucagcuccuuccuccuuccuagcuguaccuuucgccuuuucugugcccugucucccuuucucucauuuccugcuuuccuucccugugguacugcacccccaaugccaaccccacaaguccccuccugccaacaccagacgccucagccgaagaucucucugcaugcgggggcaggggaaggaagggaacacagauggggcagaccgcuggguggggguccgcaccuaagauccucgcagccaucccggcaaccagccaccugggccggcccaggucaggggcggggcccaggcacagccccgcccccacgucgcgcucacgugauccggggcuaaucuuguccuggugacuucacgcgccgccucaggcccagucgucaugguuacgccgcagcgcccagcgcuucccccagccggccgugucccuucccuuuccccacccggaccacccccuuccgccgccgcggcccccgccccagccacgcgccacgugacggccgggaaggaggucgggaagggggagggggcgcuguggccguaaccccuuccuccccacuuucagcgguccugacuugggcuucguccuuccauugcuggugaccaagcuguccagggcacggccccggcuccuccccgagggcuccaaucccgccaucccucccuccuggccugccaggcgagagcgucccagagucuugggccuuguuucugggugguccagaagcgaagcccgggguugcggcggagugggagguggugggggcggggagggagguuggggggcaggcaaaaucccuuggguccuccagacgaaauucucccauauguuggcacuuugcuuggucuguguuugucuguaauuugcauugcaaccuacaccuuaccucuugaagccacaaauaacgcgugggauauguuggggauuuggaagcugaacuuuagugugauuugugcuuucugggccucaguucucucaagaauauaaugggaccaguaguaccuccuucaccuggcucuucugaggauucagggagcuaguuuuguguguguguuugcgcgcgcgcgcgcgcgcagagagagugugcggggcuuaaggcgauccuccggggugaguagagcagugguuccaccuuaccgagcaccuucugcgugccaggugcuguugcaagccaugguucccuugugaugcgaagucaucucucuaaaggcuguccaggcucucaaaggagccagacgcccgacuacauuguccguccaguauaaugggaaccaugauagaggacgcauaguggggcugugucagcccagaaggcgcauuaaccuagagcggaucaggaaagaaggacguccaggauaaagugacaccuggauagagaugagaagcgccuuccaggcugggggugaagcuugagcuucuuuuucuucuucuucuuuuuuuuuuuuuuuuugaaacagagucuugcucugucacccaggcuagagugcaguggcacaaucucggcucacugcaaccuccaccuccugggcucaagcgauucucccaccuuagccucucaaguagcugggaccacaggcaugcgccaccacgcccagcuaauuuuuuguauuuguagcagagacaggcucuccccauguuccccaggcuggucucaaacucccgagcucaagcgauccgcccaccucggcuucccagagugcugggauuacaggcgugagccacugcgcccagcagagcuugagcuucuuaauagcuauggcccugugggcagauuauuuaauaccucuaugccugccgggcgcgguggcucacgccuguaaucccagcacuuugggaggccgagaugggcggaucaugaggucaggagaucgagacuauccuggcuaacacggugaaacccggucucuacuaaacacagaaaaaauuagccgggcgucguggcgggcgccuguagucccagcuacucgggaggccgaggcaggagaauggugugaacccggaaggcagagcuugcagugagcggagaucgugccacugagcuccagccugggugacagugcaagacuccaucucaaaaaaaaaaaaaaccucuaugccuuagucuguaaaacggggcuaauaaugcccagcuuacaguuuugaggauuaaauaugcaaagugcuaaugcaccuuuaccagaagcuaacauacuuaguaagccuguuuuucuuuucuuuucuuuuuuuuuuuuuuuuuugagacagagucucacucugucgcccaggcuggagugcaauggcgugaucuuggcucacugcaacuuccgccucccggguucaagugauucuccugcuucagccucccgaguagcugggacuacaggcgaccgccgccccaccuggcuaauuuuuuguauuuuaguagagacgggguugcaccguguugcccaggcuggucucgaacuccugagcucaagcaauccuccugucucagccuccgaaagugcuagauuacaggcgugagccacuacgcccagccguaagccuuccuuaaguuagccauuaucauuggguguccugguucaaaaacccgacguggccaaguuuguuggugggggugguuguuuuuucuuuugugacaaggucucgcucugucgcucaggcugcaguucaguggugcaaucacugcucacugcagcuucacccucccaggcucaagguauccucccaccucagacuccugaguagcuggaacuaaaggugcacaucaccacacucagcuaauuuuuuuuuuuuuuuugagauggagucucacucuguugcccaggcuggagugcaguggugcgaucucggcucacugcucaaccuccaccucccauguucaugccauucuucugccucagccucccgaguagcugggacuacaggcgccugccaccacacacggcuaauuuuuuguauuuuuuaguagacaggguuucaccguguuagccagcauggucucgaucuccugaccucgugauccgcccgccucggccucccagagugcugggauuacaggcaugagccacugugccuggccggcuaauuuuuauauuuuuguagagauggcuuuucaccauguugcccagacuggucuugaacuuccaggcuucagugauccaccugccuuggccccucaaauuucugggauuaaaggugugagccaccaugccuggcccaaucuguuuuuuguuguuguugagacacagucuuguucugucacccaggcuggaguacaguggcgugaucucggcucacugcaaccuccuccucccagauucaagcaauucucgugccucagccuccugaguagcugggacuacaggugcccaccaccacggccggcuaauuuuggagauuuuuaguagagacgggguuucaccauguuggccagucuggucucaaacuccugaccucaggugguccgccugccucagccucccaaaguguugguauuacaggcaugagccaccacaccuggcccccaaucuguuuuagaaagauccuucugaaggagcuggguggagaauugggguuagggagggcacuuggagaccagcuguccugggccaggugaggacagcuaaugaggguugaacuaaggcaguaacagugggacuggaaaauagcaugcacuggguuagagcuuuacaaaucuagggugcuuguuaaauaugcugauuccaggccuaccacccucaccccccaggaaaaagucuucaagggaaaggccugguaauuauuacaagaacuaucagaguuucccaagccuccuugugugccuguguaaucaucuacugaacccuucuagauguagagauuccugccacuccucccccacugcaauucagaauguauggcaaucauuuccagacuaacccaggggcucauggaaggacccugcuagcuaugaggaacaauuagagggaugcuuguucuugggaaucuucaaaucucaggaucugguaacugacaaguguggagugaguugggagaccagcauggcgccuggggccaaguucuggacaagucugguguaggauuaaggguuugcugugccuuagugacagccaguuuauuccuuuguauagcugaggcucaacuacagcucgccugaggucacauagccauuauguggcagaagcaagucaggauucaggguuuuuguuuguuuguuuguuuuuugagacgggguuuggcuacuucgcccaggcugggauucaguggcuuacugcaaccuccgccaccugggcucaagcaaucaucucaccucagccuccagaggagcugggaccacagucacaggaucaccaugcccagcuuuguuguuuuuuguuuguuuguuuguuucuauuuuugguagagacaggguuuugccauguugcccaggcuggucucaaacuuuuuuuuuuuuuuuuuuuuuugagacagaguuucacucugucgcccaaggcuggagugcaguggugugaucuuggcuuacugcaaccucaccucugggguucaagugauucuccugccucagccucccgaguagcugggauuacaggcauccaccaccacgcccagcuaauuuuuucuuuuuaaguagagacaggguuucgccauguuggccaggcuggucucaaacuccugaccucaagcgauccacccaccucagccucccaaagugcuaggauuacaggcgugagccacugcgcccagccaaggucucaaacucuugagcucaagugauccaccugccucagccucccaaaguguugagauuacaggcaugagccaacacaccgugccagauucagguuuuuuaaugguugcuuuuuauuuauuuauauauuuuuuuagacagaguuucgcucuuguugcccaggcuggagugcaguggcaugaucuuggcucaccaaaaccucagccucccggguuuaagcaauucuucugccucagccucccaaguagcugggauuacaggcaugugccaccacgccuagcuaauuuuguauuuuuaguagagacgggguuucuccauguugaccagacuggucucgaauuccugaccucaggugauccgcccgccucggccucugaaagugcugagauuacaggugugagccacugcacccggccuaaugguugcuuuuuaaauagcacccagcuaugaacugggacacaucuccauugccuggaaaguuuggggagcagaggauggggcaauggagaagaggaaagagaagacaagaccuuguuugaccccugggagagccgcuggacugaagggagggccaagggggaugaagcaguggccuucugugacagugucugcauccccauuggcugcuucugccuuuuuccccaccugugcuggggggacagaacucugugguuacaaccuucacuuaccuuggagaggcccagggguguguuuuagaaugaggcucucaccugaguugaguguuccugagagggccucaguaguaccguguguaaguaccugggugggaggcccgggugcaucgccuguguguaggcagcucaagaaugcuguccaagggugucugaaagguuuaccagcauccugugugugcuucaaugugaaggaggucuagguguuacuauugugugccugagguugaccccgagguaaagguguaaaugugagacccuucugauaccugugugugccugugagucucgggugaaaaaaaugugcugcagcaaugaauuagucaucuuacagggagaagggaacucaucuguuaccauuacucuugaauuugagacauauuuuaccaguguguacccacguggggcuguuaccugagaaugauacucagguacgauaccugucuaccuauuacuugccuuacuaacaugccugagaggaagcccaaguguaucagauuuccuaagauggcucaaggugcaauuuggagggccaugggaaacggagccacaaguguuaccuccagcggggcuacugugaacccagcaccccagucugugccucugggauaaguguccugagcaggcaguccuggggcuuuaacagcccagccccuccuuccuucauucccacagggcccaguguucaccaucauaccaggggccagaggcgauggcuugccuccaugagacccgaacacccucuccuuccuuugggggcuuugugucuacccuaagugaggcauccaugcgcaagcuggacccagacacuucugacugcacucccgagaaggaccugacgccuacccaguguguacuucgagaugugguaccccuuggugggcagggugggggagggcccagccccuccccagguggagagccgcccccugagccuuuugccaacaguguccugcagcuacaugagcaggaugcagggggcccagggggagcagcugggucaccugagagucgggcauccagaguucgagcugacgaggugcgacugcagugccagaguggcaguggcuuccuugagggccucuuuggcugccugcgcccugucuggaccaugauuggcaaagccuacuccacugagcacaagcagcagcaggaagguaggccacguccuugugggagccuccucucuguuucccugagcccgagaucuguuggucagcuccgcuaaagucacgcaauggucccuucccuccccauggcccagcccuagucccuuagccauccaucagccucuaacuucccagcuucuuuuaaggccacccauucauuccuucccuguccccucgaaccuucuucuuggccuauuuuuggcuuucugccucacccuccuuaagucaauucagccaacccaaugcuauccugucccuggccuugaguguggcucuuucugaggcuuguggcacugugccuccugcccacagaccuuugggagguccccuuugaggaaauccuggaccugcagugggugggcucaggggcccagggugcugucuuccuggggcgcuuccacggggaggagguggcugugaagaaggugcgagaccucaaagaaaccgacaucaagcacuugcgaaagcugaagcaccccaacaucaucacuuucaagugagguccagggcaggggcuggguguuggggauacuaugcuaaggccugguacccuccugggcagugggaccuaccccauccuuccccagaggagauccauagguggaaugggugggaauggggguuccagguaugaaucaggugaaugcugagccagcugaggccuucauaccauuguuuggcucccaggggugugugcacccaggcucccugcuacugcauccucauggaguucugcgcccagggccagcuguaugagguacugcgggcuggccgcccugucacccccuccuuacugguugacugguccaugggcaucgcugguggcaugaacuaccugcaccugcacaagauuauccacagggaucucaagucacccaagugaguaagcaagcagggagcaacagaugugcaugcaggugacccacucaagucaguguggccuucucccggcuuccaaaccaugcccuagguccauguggccaucucagaaaccucuuccaagugacagucccaucucagaagggcuguagugagccccucaccuuugagugucccaaaugauuuuaaacugaaaggcaggccggaugcaguggcucacgccuguaaucccaacacuuugggaggccgaggcggguggaucacaaggucaagagaucgagaccauccuggccaacauggugaaaccucgucucuaauaaaaauacaaaaaaauuagucaggcgugguggcgagugcccguagucucagcuacucaggaggcugaggcaggagaaucacuugaacccaggagguggagguugcagugagccgagauugagccacugcacuccagccugagugacagagugagacuccgucucaaacaaacaaacaaaaaaaccugaaaggcagaguugcugcagaguuagaugagguguguggagggguguggaccccagcugacuacacucuuuaccagcaugcuaaucaccuacgacgauguggugaagaucucagauuuuggcacuuccaaggagcugagugacaagagcaccaagauguccuuugcagggacaguagccuggauggccccugaggugauccgcaaugaaccugugucugagaaggucgacaucuggugagaacuaggcugaaaacugagaagaguggguggccagcccuggggggauugugggcaacuucuagggcuugagcacaagugauguccccucaucccuagguccuuuggcguggugcuaugggaacugcugacuggugagauccccuacaaagacguagauuccucagccauuaucuggggugugggaagcaacagucuccaucugcccgugcccuccaguugcccagaugguuucaagauccugcuucgccagugcugguaaggauggucugggcugggauacugggccuggagaaguugagaagcacgguaguacugggcuggacugaccaauaaauggcagggguacauuuaauucaaagagacugacuuucaucugaaucaggcucaugcuaccuucugagcugagucaccagggguaauugguaucuacucugaaccuguuuccucaucuauaaaauacacuuaacgauaucugcauuccugauuugucaugaagugccagugagugcauacaaguacaaggaaggagcagcauaaccaccaagcaugguugguugagccucaaguaaacaaccuuagaacacagaaggaaaggaccccagacccucauuuggaaccuagacccagggaaguuugacgauugcuaaucugucacugagcauuucccaaaaugugguuccuucaaugaaguuauucagaaaaggcuuuuauuuugggagacaaguuggaaaauaugggguucaauagguuuccuuacugcaggauuuugacacacuaaugaauaguguguaauauucucuagagacaguugaccauaaguucuuuugucacagaguacauucuaggauuggauucuccaggacacacuuugggaaaggaugcuccaguuccuaucugauccucccucaaauucuccccucuccuuccuaacuccauuccuuucaggaauagcaaaccacgaaaucgcccaucauuccgacagauccugcugcaucuggacauugccucagcugauguacucuccacaccccaggagacuuacuuuaagucccaggugugcuguggguaggaaaauaaauaccuaacuccccuucuuugcagagaugaugcuauuugagggggaggcugggaaauggguugagugggacugaagagauuggcucuuagagggcugagucaauccacuccuuuuugcuccagcacacacauuggcaguggugugggcaaccugcagagccuuucacugggugaagggauggcucucacucuucaucugcucucaacccauaggcagaguggcgggaagaaguaaaacugcacuuugaaaagauuaagucagaagggaccugucugcaccgccuagaagaggaacuggugaugaggaggagggaggagcucaggugaguucccgugcuuggggaggugauuuuacuaacagcaaggacuaugcacccagucagcuccuacccagccccagggcggguggaaggacuacgaaaggacuguggacaggaauucugagacugagaucuguuauggcccuaggugaacccaguucaccuuggggaaccuuucugcccguugcagacacgcccuggacaucagggagcacuaugaaaggaagcuggagagagccaacaaccuguauauggaacuuaaugcccucauguugcagcuggaacucaaggagagggagcugcucagguaacccuaccuguccuuaugcaccaagcccuggagcugugccugccuuagagguccuacugagacuggggugccccuuccuggucauuugcccagcugagaaggugccuggaucuuuaggcgagagcaagcuuuagagcggaggugcccaggccugcugaagccacacccuucccggggccuccugcauggaaacacaauggagaagcuuaucaagaagaggaaugugccacagaagcugucaccccauagcaaaaggugggacaugaguacugugguuccaauauggcaagagggauacugaaguggcaacagguauauuagcagggagauguguacuuuaguguccaagguuagggagugcuuugaguacauagauuuggcagucuuaaccuuuuacuuuuccucuucuuccaggccagauauccucaagacggagucuuugcucccuaaacuagaugcagcccugagugggguggggcuuccuggguguccuaagggcccccccucaccaggacggagucgccguggcaagacccgucaccgcaaggccagcgccaaggggagcuguggggaccugccugggcuucguacagcugugccaccccaugaaccuggaggaccaggaagcccagggggccuaggagggggacccucagccugggaggccugcccucccgcccuccgugggcuucaucaugaccuccugcuccgcaaaaugucuucaucguccccagaccugcugucagcagcacuagggucccggggccggggggccacaggcggagcuggggauccuggcucaccaccuccggcccggggugacaccccaccaagugagggcucagccccuggcuccaccagcccagauucaccugggggagccaaaggggaaccaccuccuccaguagggccuggugaagguguggggcuucugggaacuggaagggaagggaccucaggccggggaggaagccgggcugggucccagcacuugaccccagcugcacugcuguacagggcugccgucacccgaagucagguaaaguaugggaaggcucccaagcucuuucccuuuuuccuuauccucccugggguccaagucuaaucccccacauuaugcucaauuuuaagccauucccuacuucacccuucguaacuauguucccuucuccuggauucuuagugaccucuuuccacuucuaaucagaccccccccaccccaucucuccugcagaaacguggcaucucaucggaagaggaggaaggagagguagacagugaaguagagcugacaucaagccagagguaagugauggcauuacaagaauuaauggcauucuuguuuucugcuaggggcagaaccaagcuguaaucccccucuucaacauguagguggccucagagccugaacaugcgccagucacuaucuaccuucagcucagagaauccaucagauggggaggaaggcacagcuagugaaccuucccccaguggcacaccugaaguuggcagcaccaacacugaugagcggccagaugagcggucugaugacaugugcucccagggcucagaaaucccacuggacccaccuccuucagaggucaucccuggcccugaacccagcucccugcccauuccacaccaggaacuucucagagagcgggugaguggcacaacagcaaaaagcagauauugaacagggagagcuguaagcagaugccuugucuuuuaacagcuuuuggggagacagcugcacaggccagaaaguaccauaaagagcaaauauccacgugguggaauuucagaagccucuugcacagagcaucuauuacgaugccugaccaguagcuugcauguagcuauaaauugcagccagggaaugauucugaaaggagucugacaccuuggagaauggccugagcaacugaaaucuggaaggaauaaaaccaguaagcuggcugggcauggugacucacgccuggaaucccagaacuuugggaggccgaggcggguggaucacaaggucaggaguucaagaccagccugaccaauaugguaaaaccccaucucuauuaaaaguacaaaaauuagcugggcgugguggugcaugccuguagucccagcuacucagaaggcugaggcagaagaauugcuugaaccugggaggcagagguugcagugagccgagauugugcuacugcacuccagccugggcgagagugagacucugucuuaaaaaacaaaucaguaagccacuggcuauuaaaaugaccccagcaaagaaccccaaggaaucucacuccauuucuacucuuucucacagggcccucccaauucugaggacucagacugugacagcacugaauuggacaacuccaacagcguugaugccuugcggcccccagcuucccucccuccaugaaagccacucguauuccuuguacauagagaaauauuuauauaaauuauauauauauacauauauauauauauaugcgccacauaaucaacagaaagauggggcugucccagccguaagucaggcucgagggagacugauccccugaccaauucaccugauaaacucuagggacacuggcagcuguggaaaugaaugaggcacagccguagagcuguggcuaagggcaagccccuuccugccccaccccauuccuuauauucagcaagcaacaaggcaauagaaaagccaggguugucuuuauauucuuuauccccaaauaauaggggguggggggaggggcggugggaggggcaggagagaaaaccacuuagacugcacuuuucuguuccguuuacucuguuuacacauuuugcacuugggaggagggaggcuaaggcuggguccuccccucugagguuucucagguggcaauguaacucauuuuuuugucccaccauuuaucuucucugcccaagcccugucuuaaggcccagggggagguuaggagacugauagcaugugauggcucaggcugaagaaccggggugcuguuuaagucccugcuuuuauccuggugccugauugggguggggacuguccuacuguaaccccugugaaaaaccuugaaauauaacacuccaugcaggcccagcuguugaggguuuucuugaugaaugaaugggguaccauacaugguuaagauaaagccuugggcuccggacuuuaucugaggugucuggagaaguucuccugccccuccacuuuuuugcaucuacucucacuaaaugaguauaaugucaagccccaacuuucuaaaauuauaggaauaaaugguagcagauacauccuucuaacuuguuauggaggacuauaaaugaaguuacuaaaaacaauagacugaaauuuuuaguuuaaaauaugcaagccugaacaaggggaccaacauucccaagaaacuggaacccagucagacauaugaucaacugcuuaauguguaugccauguaugucaugugucauuccuuucccccacccccucccuaguggaagugcuugccuacuccccuaggacagguaaguccucggaaagucuaauccucaaucuuuugggcacaaguuuuauaagggccaaccaagcauggagucagggaaaaauaggaucgagggccacaaaaaaagauggaagugguaaaauagaagaaaacaucuuaaccggaauaaaggcuuccauucaaaacccaagaaggguccuuugagggauaaaagguacaaaaauaacagcaagacaagaggaauaaaacccacaugaaucacuguggcauccaguuucuauucacaaagaaaaagcuccaguccaucuuuuaauuuuuuugaaaaauuccugacauuacagaacuaaacugaaauguauuaauauuccacucuuacauuuccaugacaaacagaaaaauucaugagccaaaaaaaaaaaaccagggagaagcuuauaaaacuaaauauggaucucagcaucaacagcugaacagagaaaggaauuaaaacgcuuuaauuaaaaaaucacgaguggaugauaaaguguguagaaacugaaaauuuacaaacuauuuaaaaccuggaaucgcugacuguucagaaacuacacagauggaucaugggugguggugaacagcagaaagggauuauggaugaaucugcauuguucuagcugcuccccaugccacccgucuccgaggaaagccuguaacacagaaacaagaacucaguuaguuuccccagugcucagcugcaccucaucucuaccugguucaugaaaugugaagaguaaauaaccagugcuggaguaccaagggagacauuuuaagguuucuuaaauuuaccaguaccaugauccuuuaauccuugcaauucaagcauguggaggucuauuaccucagaaccaagggaaacagcccuuguuauccaaugucccucaaacuauguucucuuuuaguuccaccuccauggugggcuaaccaaggaguguacuuucuggaaacaggccccucuaaagagugcucacaauacacagaagcaauguuucuuuauugcugagcucacuuuggcuccucccaaacugcugacagaauaccaguuuaggaaagaaagagucaucugagaguagucucaaggguuuaaugcugagacaacucaaggccuuuacuuuaaagcccuggaguucuaucaauguguaggguauuaugagguaauaccguuuuaaagguaaaaaaaaaaauguuaaaaagagauguaaaaagaguaacuaugggucaagaauuauacucagauuuacuuauuuauugagacagagucuagcucugucacccaggcuagaguacagugaugugaucuugccucacugcaacuugugccucccuggcucaagcaauucucuugccucagccuccaccugauagcugggauuacuggcagccaccaccacucccagcuacuuuuucuauuauuaguagagacggggcuucaacagguuucccaggcaggucuuaaacuccugaccucaggugaucugccugccucugccucccaaugugcugggauuacaggcaugagccaccgcgccuggccuuauuuauuuauuuauuuuuuugagacugaguuucacccaggcuggagugcaauggcgcaaucucaacucacugcaaccccugccucccguguucuagcgauucuccugccucagccuccugaguagcugcaauuccaggcagcugucaccaugcccagcuaauuuuuguauuuucaguagagacagaguuucaccauguuggccaggcuggucucaaacuucugaccucaggugauccacuugucuuggccucccaaagugcuaggauuaggcaugagccaccacacccggccuuaaaaaguucuuuaaaaaguuuucaggacuuaaaaguagcagacaaaauaauuuguuucaacucuguagcucacucuacaagcuccuagaucuugucaagccauauccuccaucuaaacauaccuggcuacaaugccuuucuguuucaaagagauagucauuugagguccuggaauccaauuuagggcuuucagggaaaaguauuuaaguacucaguaugcuucacugguagguagguaggcagcaagacuuugcccucauuuugaauagaaccaaauguauaagacuucauuucaguucauaagauaaguuauuucauaagauuuuaaacugauuagcauaaaauauuugugauauguggucaugaaaacaugauugguaauucaccaucuguaucccuuccacaacaaugcaaagccaaaagcuggguagaaaagcaagggccaaaaaacugcaaaguccuucgacuacaaacuauuuacuuuuagucagaaaugguuucucc

SEQ ID NO: 17973 - RNA, 5436 nt, Homo sapiens
ggagagagggggcgcggaaggaaggaggcgggacgguauuacaaacaaaaaaauacggccuucucgagaagcgacggcggagggcccgcuccucccagaaggcggugcagccugcccgggcgagccacgcacgcagaggguuguggggcggauagcuccccuccagauggaggcucacgaaguagggugggcgggggacuccauaucccagcgugccccgcggcgggcccuaccggccgcgacuccgggcuuggccccggcccuagcucgucggcuguguauuggggcgcguggaggcugcagucacgguggcgcccgcggggacggaggagggaaugagugaagaggagcaaggcuccggcacuaccacgggcugcgggcugccuaggugagccgucucguaccgauuccuucagggcgaaaagcguggggccgugcggagggaguagcggcgcggccccagcaugcaccuggccugaggguuguucccggcaagcacuggggcagugggcagugguucccggcgugcaccggggcaguggcugcugccuccagcucuaaauaguuugggguuggcccgguucccagacugcacuggaacacugggcuuuaugcccccacauucagugcauuugguggguacuggguuccuggcuugcacugugucaggggguaugcacuuucaaccugcauuggggcacaggaucgugcccaccuuaacugaggcaggagcaaugcauucuuccccccuugcuuugggguagugggcccuacuuuuccagccugcaccuccacuuggaacccagccaauggaugcuagacugucugggguuccuuggacccuaugucccccauaaugugccuaggucugguauggaagugcuuggcuaggugggugcagagaggggaggugugaugugggucugugccccuucccccaguauagagcaaaugcuggccgccaacccaggcaagaccccgaucagccuucugcaggaguaugggaccagaauagggaagacgccuguguacgaccuucucaaagccgagggccaagcccaccagccuaauuucaccuuccgggucaccguuggcgacaccagcugcacuggugaggaaggcuugggcagccuggcuggggugugcauuugcagguccccauggcuuuguuucuuggagucucucucuucacaguccuuuucuccaaggccagugagggaaggagagauuucaggggaaaagcuacugacuggauugggagaacagggcuguaagaagguggguaggacgugggagaguuagaggagcgagcaggacucccacagugaucuggcagauccccaucacccuagaggaaaaguaagagaagauaacugaaaucccaguggaguauuugggggagugagugccuggcgugcugggcucuguucccggugcuuaaccaaauucccguuuaauuuuaaaccucagucuaaccaaugauuguaggugguaguauccgcccccccgacuccuccccccgcccgcccauguugaauaugaggaaacugaguguuugagauaguaaauggcuggugcauggucacaugccuaguauguggcagaguggggcuuuuacuccagagccuacccucucuuauuccagcucucuguauuuauugagggaaaagaaagugcuuugcaaaggaaauuaaagcauuugcgcucagaaguccacccaaggcguuugagcucagaaguccugcuuggcauggcuuaauucuggaagcuaacggaaagauaagggcucuuccuuccagcaauuagugaaacacuuccagucuucagcagggggagguuggucagaaggggcuugauugauucccucuggcuacgaggagagaggcugugggaugcugguuucuuucccguccuuucagugaccuccaguauugcccaugcccccucucucaggucagggccccagcaagaaggcagccaagcacaaggcagcugagguggcccucaaacaccucaaaggggggagcaugcuggagccggcccuggaggacagcaggugagggaggaaccgaggcaucccagaagcccuucaaggaacccaggcccugcaccacccacucugccccgaggccuggccaggugacacuuagccacccugaccuggccucuuccugagagucccucuggaccugaacaggguuuuccagggcuucugcugcuaugaagaauucuugggguggagggguugguuagccccauagagggguuguggcaguagguuggggccuggguuagggagggagagggguagaggcuugaggcuaaagggaguuacuccccaacauaccuccuuguucuagcaagauguccuuccuucacgcgcagguuggaguuuguugcuccucugguucuuggguacaaagauacccucuucucugagacucucuuuucucagucuuuucgccgguguuuggcagcaaaggauccgaggaggaagcuguugguugagccucccugauucuuuggcucaauuuggaaguucucuuaggggauugggaggucaggaggacgugggucccccaccccucucuucccccuauacaugggugugaaucaaaggcccccuuccccucgggaaguucuuuuucuccccuagacucuucacugccugaggacauuccgguuuuuacugcugcagcagcugcuaccccaguuccaucuguaguccuaaccagguaucuguguccccugacugccugagguggguggaggaagggguucugguuuuuggucccucaguccuuggacccaagcuggucaggcaugaggaagucugagaauaaacagaauggaauaguugggaaccagaacuugaagaaaucacagcagcugguaagcucuugggacaagaggucauuugugauuuucagacagccuuaugaaugauguccgaccauguuuaagggucuugcaggccccauuuucuucuggguugaccacaugucaguucuguguuugaggcccaucaggcacuucugggacuggaaauacagcucuucucccacuguccuggcuuagaugauacccaaguguuccagaauggaaaugggcuggggccuggagaaggccucccuugagugggagggggaaggaagccggcuagagcaggaggagcaggcuagauguguggacagacagcuccccacccgguggaaucgggagaugguagucaggaaucuaaaguagugguuagguuuggagcucaugggcaggcucagauggaacccuucaccucaacuuuggcccugugccuuuuccuucaggagcccccccauggaacugcagcccccugucuccccucagcagucugagugcaaccccguuggugcucugcaggugugucccauccucauuucccaugcaugccugucuucccuugagccaggggccaugagggaaggcuauguguguuugggggugggggcgguuccuuguacugaggcccuuuccaccccccucucuccuuccucucaccuagagucugaggcuccugcguggggaccagcgugggugugagaagccuuuuuucacucagccucaugcacccugugucucccuuccaaggagcugguggugcagaaaggcuggcgguugccggaguacacagugacccaggagucugggccagcccaccgcaaagaauucaccaugaccugucgaguggagcguuucauugagauugguaacugggcaagaagggguucucacaacuccucucccgcagcacucuggccccagccacaaagcagcuccuggccucacucugcuacacccccugcucucuuagcuucacagucccuagcucagccccuuccuuuuagcuucuuggcacccuauuuguccccuucucucuggcugaccagguucucacgugcaugggcaggucuugaguuccccuuuccaguugacauucuggggggacccucaauccaaguaugaccuggguggaagcacugggucuguggggaaucauaacccagcagcccucucuccacaugcagggaguggcacuuccaaaaaauuggcaaagcggaaugcggcggccaaaaugcugcuucgagugcacacggugccucuggaugcccgggauggcaaugagguggagccugaugaugaccacuucuccauugugaguggcucaugugggccgggcaccguggcccauccuccaugccagggcagggcuccagggacuugggucugugacucagcagugagccucucugggcccuaggucugcuucugccacaguuuuccuaccagacccaggguuccuggggccgacucagccuugacuguaggcccgcucuguagcucuguuacuggggugaggagggaucccuggccaucuggcccagggccugguaguuagaaggggccacccagggauugacuggggggaggcaagcuggaggaagcauucuuugugcuuuguucuccuuugacguugaaugucucaaugccugggucccacagucucucgcuucaucuuucucacuguucccaucuugacagggugugggcucccgccuggauggucuucgaaaccggggcccagguugcaccugggauucucuacgaaauucaguaggagagaagauccugucccuccgcaguugcucccugggcucccugggugcccugggcccugccugcugccguguccucagugagcucucugaggagcaggccuuucacgucagcuaccuggauauugguauggcuagcuggggagcgagccaggggauggugggggcuggaccggagcaaguagaagggggugaugauaacgugaacgcaccccuccccagggcuaccucccccaacauugccucccuccucucucuugcucuccagaggagcugagccugaguggacucugccagugccugguggaacuguccacccagccggccacugugugucauggcucugcaaccaccagggaggcagcccguggugaggcugcccgccgugcccugcaguaccucaagaucauggcaggcagcaagugaagccccagcuggacucauggaugugcacccuuugcucccugcucuuucugccucugggcucauguaucugcgcagcucugguacccucugugggugccaucucuaccucugacacagacugccugccuugaagcugagaaggcacagggcaaggagccaaggaccacagagccucagccagcccaggauccguccucauuuuauuggugaugaugaaugggaaugaaaucagggggcugucuacuagagccuggaauaaauaugcugcuuuguggauuuuuaagcccuucucuucuguuuccuugagcaguguggauagcagaggaggucaccacauuacuuuugugugccuucccugagc

SEQ ID NO: 17974 - RNA, 853 nt, Homo sapiens
uggcuuuuggggcagcaaauaccugcaaugaugacugagucaguucgggcugggccaaauuucaaugucaucucaugcuuguguuuaugaacugccaggugguccucguuuguaaaucucugaaacgaaacagaaauggagauaugaaaaaacaaaaacaaaaacccgauucggugcccuuuuaaaauguccuaccaaacaucuugcaaugagauuggucccuggaaagaagaacuggagagggagaaaaaacuggaagaggagaagagauggagaaaaaagggugcuagaacgcagggagaagaggagauggggaagaccacaacaccaacugcucuguaauaucagguccaaacaacagaaguggacagauuguugguaaagugggguccaaguaggaggcuccaaaugaaaaaaacauuaaggcaaacucguauugaacaaggggaagcaauuuuuaauaauaauaauagagaagggaagggcugggcacuaguuggccaucacaaaaauaggaaauugagaaugaagcccuccaugguagggcugaauuggacucuuuuaugagggcgcuaacagggagauaaauuaugcaggauuaggagaaccauuuaacuucuuggccccuacagugcugcagcaggcgccugcauggcuauuuggcucagaguuuuaaugagccaggauggagcuguagaggaccaaggcgcaauggccagcaauaauggcacauaccagccccaucggccaaaugcugucuccccucaucgggcagcccgccugggcuccaucagccauaaaaaggccaguacaaugcugaugacuauauaaugguagaauaaaaaugccagga

SEQ ID NO: 17975 - RNA, 417 nt, Homo sapiens
ccucuuccuuucuccgccaucgugguguguucuugacuccgcugcucgccaugucuucucacaagacuuucaggauuaagcgauuccuggccaagaaacaaaagcaaaaucgucccauuccccaguggauucggaugaaaacuggaaauaaaaucagguacaacuccaaaaggagacauuggagaagaaccaagcugggucuauaaggaauugcacaugagauggcacacauauuuaugcugucugaaggucacgaucauguuaccauaucaagcugaaaaugucaccacuaucuggagauuucgacguguuuuccucucugaaucuguuaugaacacguugguuggcuggauucaguaauaaauaugugaggccuuucguuuuuaaaaaaaaaaaaaaaaaaaaggaaagaaaaag

SEQ ID NO: 17976 - RNA, 17414 nt, Homo sapiens
cacgcagcggcaaaagggcgcagaagaaccacaaaccccagaagcccucgcgcccacucuucucccuccccuccagaagucggagugcuguuuuuguuguuggugaaaggugaggggaacagcugauccgucuguuggguaagaaacuuggccuaauugggggcgaucuuaugggaggggagggucaccccacuuuccaguuuggggaaggauaacguaagggaacugucgaaggggaauacaggagcguuuggguuguaacccuuuccguacuggagaagccacccccgcuguuuggggaguucuugguuucaaggggacucugauuggggguggggggcgcccccucgucguccucuccuucuucucaaugcgucucuauaaagcugaucccuucaagggagcugaaaucugcuuauucgcucccaggcaagacguguccccuacacgucuucccucucuccccuacgcaaauccaaaggccuuuacgacgcugaaucccuggggaggaagggggaccuuccaagguguagaaugucaaggaacucuagagcccuacagaguaggggaugggacacccgcucuccgccccaucaugugaacaucugaaucaggcuacacaccuacaucuuaggugcccaaaacuuucuuucggacaugaagaacguuuacagcuguuacggauuuucuuugugggguguauuuuaggguucuccagguauaucuuuggggacaauuuacccccacccuuagaaagcuggaagaauugcauuuggagaaaacauggauuaguuucaaccaggaauuuuucagggagaugaacauuaaaaaaaacuuuuuguucuaccuauuugggggacagaaguugcuccuuuuuguguugcuggcucaccuuuauccacugaguuucuguuuucuuuuaaaguuccuguccccuggacuucagccugguguggguuugugauguuugggggcgugcauaugacuagugacaauggcugguuggacaugucagcugugagugacacaggaaauagauuagugggcuggaaaggagugaugaauaagagggccaucucacagcccuggacugaggaguucuuuugaucguuauuauuguuaucuguccucaccccacccucauauuuuccaauuaacucuccccagcuaacuuggaacaccccuuccucucaaccccauccuguagugugucuccagcuaccaauacaaacagauggaaggauggaggcugaggggagcagagagaaaaugaggagagaaauacuaaagugaaaccaguagguuucuaguccugcugcaggcacagucuggagagaagaauguuagguucuuuuugaacuaucuccccuuuccucaacguuaaauauacauuuccacuucuuggggccccuuacuucccacuuucuagucuguucccugcccugggguggggcuuuccuggcuccaggcccccacauuccaucuccccacccccaccacguuccugcuaagcgccucacuccacccuugaaguugccgccuccagaauucuugacuuccuggaauaauaagucaagggacagaaccugucuuuccuuauauccuccccuucccuuugucucuuggaugccagcagaagcuuucugcuucccuagaauucauggggguaggcagcucagagagaugaaaagagcugagagcucaggagccuaaggauuugggcucaguuccccucgacccccagccauauucuagcucugaaaacucaaccauuccuuucagagauuaguugcugcuuucugaugucauaacucauuccuggauacagcugggucaacaagcuuaggaguagguaaggacaccucucucaaugagagggccccacaccucaguuggauuuuguauucaagagccaggaugugugggagaugggauggagaaauggaggcugucgaccaagucgcaguaucccaggcucuguccccgucaguguccuuuugggagcaaaauuagagaagucugaacccucagaagggucuaugagccagagcggguacagugugagacaggauggggacggacuuggaaggccagaccuacguccuagagacuaagagugauaccucaaaaaugucccguaacccucagggacuagaaaccagguaugccuuaucuccagguguaguggcaggggcugugaguguguggugcuggagcuguggggggaaggagguggacuggaaagacuuuaggcuaucaacccuuucuuucauaggaggacagauaucucaaggccaggauggaagaaucaccacuaagccgggcaccaucccgugguggagucaacuuucucaauguagcccggaccuacauccccaacaccaagguggaaugucacuacacccuucccccaggcaccaugcccagugccagugacuggauuggcaucuucaagguaucucuggaaccccuuuuggcuuagguuuaugggcugugaguugguuggaauaaggggaaugauugggcucuuggauucucaaccucagguugauagagaagaagagagaaagaugucacagaugacagaggccgccuguauaaccaaagcacauauuuucuccaucuuagccuuguucuuuacugacacauuagugucccuccacuuucccuuucucuugucauuguugccacuguagcuccauccugccccccuuauucaaccccucagcccuuucuuccauccauagaagguaguuccaugaccauaccuuucuccaaccuugggcuuucacagguggaggcugccuguguucgggauuaccacacauuuguguggucuuccgugccugaaaguacaacugaugguucccccauucacaccaguguccaguuccaagguacaagggaagauggaaaauugggagagaggagccaagggaguggagguuugaaagaagguagugggcucagaaacauuaaaaguuaggcacaaaggacaaggaaaaauaaacgaaaauaaauauaaugagaauauauccaacagcgcucagcggauagagaaucacgggauuaucgcagaaucagggacauagaaacagaaggaacuucagagggcaucuaguccccuguccuacccaaagaaggaaaaaugggggaguaaggaagagggaaagguagaauuauguggugagaagagggaaagaccuggguucaaaucucaccucuaacacuuacaagcuguuuggccuugggcaaauuacauaaccucccugugucgguuaucuuaacaguaaaaggggaugccuggcuuauagggacauuacgaggauuuaaaaugaaagcugcaggccaggcgugguggugcaugccuguagucccagcuacucacaaggcugaggcaggagaaucucuugaacccgggaggcagagguugcaacaagccaagaucgcgccacugcacuccagccugggcgauggagcaagacucugucucaagauaaaauaaaauaaaaaguguuaccacagugucugguacaugguacgcacucacuacaugguaacuagcauuauuaugauuaugauagaggggcaguggguuugggaaagaaaggaaggagagggacaggcagaaaggagggagaagaguauggccugugggagguggagaagagaagaaacaguauauggaacaccgagcaaggggcuggggccaaggacaguggauuauugggguccuggguccauucuucuucccacagccagcuaccugcccaaaccaggagcucagcucuaccaguuccgauaugugaaccgccagggccaggugugugggcagagccccccuuuccaguuccgagagccaaggcccauggaugaacuggugacccuggaggaggcugaugggggcucugacauccugcugguuguccccaaggcaacuguguuacaggugagaaaagagcaacagaguuauucccagacaagggagugggagacagcauugcaagaggacccuucccaccuuacccuccccucaucuguggcgccaacuaaagaccucguugaaaguuagacaaaguccugccuccaggagagucucagucuaacauagacauacacgaacauguaaggcaggaaaggagaccacccacaggccaguguaacucaggauuucauaagaacuuuugcagccuuccuucuccaugcacugcauccugcccuaugcccuagaggaagaucaaaggguggagagaggcuacuccagggaacauucagagaaaggggagcacaggaccugcuucuaggacgaguggggagugagagcagauaggcaaggccccagaccuguacuguccaauaccaaaggcucuuaacuauauauggcucuugagcacuucaaaugcaauuaauccaaacugagauguacuauaaggguaaaauauacuccagauuuugaagacuuaguauuuuuuaaagagaauguaaaagacuucaauaauuuuuauuuugacuacauguugaaaugauacuguuugggguuuuuuuguuuguuuuuuggguuuuucuuuucuuuucuuuucuuuuuuuuuuuuuuuuuugagacagccuugcucugucacccaggaagauguuuauaucucacguaagugaaagaugugugagcuccuacucucuguugcgguuucacaaucgugauucucauuugagccuuacaacaauucagacuaagggaucauguuacagaugaggacacagagacuuagagaaguuaagaagcuuguucaaaaucacauagcuagcuggguguaguggcaugcaucuguagucccagcuacugggggagacacugagguggaaggauggcuugaggccaggaguuugagguaugguaugcuaugguugcaccuauggcuagccacugcacuccagccugggcaacacagugagacccuaucuuuaaaaaaaaucacauagcuaguaaaaauugcacugaagauuugaacccaagucuguccaacuccagagcagauaggguaaaauuaggggacccaucccuugugucuguguucauugacuugugccacaugagggauuccugcaauugcuggaugaggaaagggccaggccuagaguggggagggguaagagagaugggcaauucagagugccaugagcuggugcaucugacugggugguggacgggauucgguagcacacugagcauccccuuccucaccucuuuauaacccaaagcuauguaacuucccaaacccaaaaugcaccuggagaguggugaggaugggaccuuagaagggguacuccaccagcacacuccccuucuccuucugcugccuguagaaccagcucgaugagagccagcaagaacggaaugaccugaugcagcugaagcuacagcuggagggacaggugacagagcugaggagccgagugcaggagcucgagagggcucuggcaacugccaggcaggagcacacggagcugauggaacaguacaaggugggagcugggccagguaggggacagggccuggcugcucacccagcauccaaaaucugaacccagugaagagggugaaggagagauguuagugggcuuuuacaaugguucuggcaucaaggaaauagguuuaagggguaguggcugggauuaaacuugaugugacaagagacauguuccaaacguguaaugagacucaguucuuugaacauaggaaugcugggguaagguggagguggccacguugauagguaagggaauguucccuuacaguuucuuuuucaaggaaggcaaugugauagccagguggaagcagucagacccuggugugcucuuccuaagccuuuguuccaccacuugagagaugagucccaaccucccuuuucuucugggggaaacuuaauuucaggggauuucccggucccauggggagaucacagaagagagggacauccugagccggcaacagggagaccauguggcacgcauccuggagcuagaggaugacauccagaccaucagugagaaagugcugacgaaggaaguggagcuggacaggugaggggaguccacugaccccgucacuuccucucccuuccaugacccccgcacuccagcccccucucucaggcaagcagaccugcugucugccucacacgcuuucucuuucccucucacccucacucaagcuaguuacuggggauacccuuuucugccgagcucucuaccaucuuuccaaaugcuauucuguauuccuccacuucagaaauaaucauaguuaccacuuauuguacagcaaaagcugagcaagagcuaggaguggaggauuuggaagaagagaauggauggaagucagugcaagauaagagaggauggauuucagauguggccacaggaaagauaagauuagacuguguucuuacuauuaagaaacauuauaacuggugauccaggaauguuauggaaucucugcccuggaaaaaaaagaugcaaaucauaaacucuuagcacugggauuguaagauauguaugaggguauguaagaggucacccucaggaggcagccucuuuaacauuugacagcugucauuuuuguaucucuuguauugagccaaacucuccucuccuauaacuuaccaggggguccugagaccucuggagccacacagaauaaauuucuuucuucuuccagaaaauuguuuucucuaccaaguagcauaaauauuaaccaccaccucccauguccauccuucaaauuuucaccaguuuaaacacucuaguuccuuauuucauuaaaugacaaaauuauguuucauuuacuacugguaggugugauauuuuaaaaaacuguuuaaaagaaagaggcauucuauccaaggcccaaaguaauaagugaguucgucugagaggcuucuucaggauauguuagucucacccuagggagauauuagaugucuacauucuaagucauagguuagaaaagcaguggucagauugagcaucuggaaaagauuaggggcuaucuagaccagaggucaacaacuauggcccacaagccaaaucuagccugccaccuguuguauaucccacagguaagaauaguuuuuacaucuuuuaaugguuaagaacaaauuaaaagaagaauauuuugugacaugugaaaguuguaugaacuucaaaucuguguucaaguuuuauugaaacaucaugcucauucguuuacauacugucaauggaugguccugcacuacaauggcagaguugaguaguugccacagagaccacauggacugcaaagcauaaaaucuuuacuaucaggcccuuuacagaaagagucugccaacuucuggucuagaucaaaaguuuauaaucaauaaugacugcccuugucucaaaaagacuagauucuagucucuugauugagugaaaacaaugggagccaucagcaaaacauuccuuaaaauauuacacaaaaagauaagaaaaacuauuucugucuaaauuguucucuagaaccuggaaucuugguuuccuggggcuuagaacuggaucagcuggcuuggggauuuaugcaucccagagugaaauggagcucugggccuagagcagcagcagcagagcacaagacagaggccugaguccauuccuucucuggguggagcagauugucugacaugucaucccaccaaucacaggcuuagagacacagugaaggcccugacucgggaacaagagaagcuccuugggcaacugaaagaaguacaagcagacaaggagcaaagugagguaaggggcucagaguugauuugcuuucuccauuguccagccaguguuugauucccucucgagagccagacaccaaagggaauaaaaauguaaagaagacauugugugcacucuacuagggaacauaagacauauaccuaaaucaggauuagucagaguggaaaaguggaauauaagagugucacaagagaaauuuuuuuuguuuguuuuuuggagacagagucuuacuuugucuccugugcugaagugcagugguacgaucuuagcucagugcaaccucugccuccuggguucaagcaacucucacgucucaguuaccugagcagcggggauuacagccaugugccaccaugcccagcuaacuuuuguauuuuuaguagagacaggguuucaccauguugggcaggcuggucucgaacucuugaccucaagugauccacccaccucagcuucccaaauugcugggauuacaggugugagccacugcgccuggccucaagagaaaucuaauaaaguauuguggagcuccagggagguguaugaguacacaucuuguuagagacauuagaaaagucuuuuuaaaauggguguggaggccaggcacaguggcucaugccuguaaucccagcacuuugggaggcagaggcaggcggauccccugaggucaguucaagaccagccuggccaacauggugaaaccccaucucuacuaaaaauacaaaaauuagccagguguggugucaggugccuguaaucccagcuacucaggaggcugaggcaggagaaucacuugaacccgggaggcagaaauugcagugagccuagaucacacuacggcucuccagccugggcaacagagugagacucugugccaaaaaaaaaaaaaaaaaaaaaaaaagggagggccauggcugggcgugguagcucacaccugugaucauaacacuuugggaggccaaggcgagaggauuguucaagcccagggguucaaaaccagccugggcaacguagugagaccccaucucuacaaaaaauuuuaaaaauuagccaggcaugguggcaugcaccuguagucccagcuacucaggaagcugagguggaaggauugcuugagcccaggaggucaaggcugcagugugcugugaucgcaccccugaacuucagccugggugacagagcaagauucugucucagaaaaaaaaggggugggguguggggccuaguacuuucaaaccuuuuuagcagaacccuuuccucuccucccaccaauaaaguuuuuaaucuuguguggaaucucacugaauaaacaaaaacaauguuuuauuacuauaaauuuauuuuuauaaauuugaauguauaaccuuuacuuaaaagguaaugaaagcacuuagguaauuuugaggcauaccaaacuuugaaaugagaggcuaucgaagacuguucugccagccucagcaacuaauguauuuccguauuuuauuuugguuguacaauaucaagaacaccuugagucacacacaaguaggugcaaauaacaauuuuuaaacuguccaccuugcaacucaguuuacucuucaauucaauagaaaauacaguagaaacuauucugagcuuugcaaaaaaaugaauuaaccuggaaacauaugucaauuggugaucuccaguguguuaacuugugauuuuauggguuuuauuuguuuuguuuguuuguuuugagacggaguuucaucuuguugcccaggcuggagugcaguggcgcgaucucggcucacugcaacuucugccuuccggguucaagagauucuucugucucagccuccugaguagcugggauuacaggcacccgccaccacgcccagcuaauuuuuuguauuuuuaguagagaugggguuucaccauguuggccaggcuggucuggaacuucugaccucaggugauccgcccaccucggccucccaaaucaugccgagauugcaggcaugagccacugcaccuggccuuguguuguuuuucuuuuuuuaacauaauuguuaauaauuuagaagacauucaaaucaaguaucugcagaacuccuaaaucccuucuucaguacccuggguuuauguggaagauuguuaaaaaacccuuugcucagcagugagaauagguagaauaugaguagacagagaugagugugaggcuauucuaggaacagagaaagacgugagcaaaggcuuaaaggccagaacacucagggcaguugaaugugcgggugaaguguuugagauaaggccuagguuagacugugguggaucuugagcuucauuuuuauuccacaagcgugaaaggcuuugaugauuuuucaagcaggggugacguguacuguacuuauggccagguguaguggcccacgccuguaaucccaacauuuugggaggugaaggcaggaggaucccucgagcucaggaguucaagacaagccugggcaacauagugagacccugucucaucucuacaaaaaaauacaaaaauuaggcaggcgugguggcacacaccuauaaucccagcuacuggggaggcugaguugagacaauugcuuaagcccaggaguuggaggcugcagugagcugugaccaugcuacuucacuccagucuuggcgacagagccagacccuaucucuaaaaaagaaaauaacuguauuuaaagaaucagaacuguaccuaaagaagaauaaucugauucccuuguggagaaugaacuauuuaugaaguuauucaguaguccaagcaagaaaugaccagagucugagauaacgugguuguggugguaauagagaagggaaaauggcugugaccaggauggagaagcaauagguuuuucugugggccgcuagggagaggacagagccaagcauggcaccaagggcaccagguuacuccauccugaguaacgugggagcuaguugguacccuggacggaaauaagaguaggaaagacugggauggggugagagguagacuguugaguuuaaggggccuguagggcaugaagacugaguuuugauuuaagagaaagaauagaguagcagaaaugguacauggaaugccuacacagaagacccaaggcugcgaugcuggauaccucaauuugggagcuggagacuggauaugcaggauugaguuauuugagcugagaacccaagaagggcuggcaauagcugaaggcuugaguguguguuaaaucugagaaguggaaccuugaccucucucaucacaaugguucaccucccgagccaccccaacacacauaccccuuuccuuaccugcuuuccacuucccucaggcugagcuccaaguggcacaacaggagaaccaucacuuaaauuuggaccugaaggaggcgaagagcuggcaagaggagcagagugcucaggcucagcgacugaaagacaagguggcccagaugaaggacacccuaggccaggcccagcagcggguggugagugaggccccuuggcaacaggaaacgggaaauuccaagggcaaguuguagagaagccugcgugucuaaagagaaggggagagacauggcuaaagacuaaacaacacaaccccgaguccuaaugcaguggaguggagggagcguuuaccucccuggcugaugaaugauucacuaggaacucugaucuccaucuccuccuuucuccugaggccgagcuggagcccuugaaggagcagcuucgaggggcccaggagcuugcagccucaagccagcagaaagccacccuucuuggggaggaguuggccagugcagcagcagccagggaccgcaccauagccgaacuacaccgcagccgccuggaaguggcugaaguuaacggcaggcuggcugagcucgguuugcacuugaaggaagaaaaaugccaauggagcaaggagcgggcagggcugcugcagaguguggagguagagggaugggggguaccuggcaaucugauggccacugcccccaccucuguggggacuccuacauguggucagacccucugggaggagagaagagggguugagaaccuuagaggacuuggguggagaggggcuuugagggagguacacuuuacuuucuaggcaugacccaucccuaaccgggguaucccaauccugaucaccagaguaccuuccuuggaacagaaacauuuucuguccuagaccccaggcccugccauaaugcccauuccugaucaagcagcaccugccgucauguccuguccuucauucagaggguauaggaaaugaaggcaaaaaggggaaagugcucuaaaaaugaugcuuuaaauaaaggaaaggacacaguaagggauggugcuguugacaguggcguuccuuuuucuucccccuccacccucccauuuuccuucuuggcuaucucucaggcagagaaggacaagauccugaagcugagugcagagauacuucgauuggagaaggcaguucaggaggagaggacccaaaaccaaguguucaagacugagcuggcccgggagaaggauucuagccuggugaggcauccagccaccaaggguccuguccuauggccuccugaggcauccauaccccuucucucugucuuggguaugggcucagaagugcuagguguccacuaccauguuggguggcauuucacuugcacacgcaagcccucauugguuugaaaugugcauuuuuuucugcucucagggcacacaucugggcccaguagaggugacuuaggagaauuauagaguggccccuugguaugaccaaggccucugcaccccagccuagaggaagucaugcagguccccacucgagaggcagagacuaagacuuagaaaacugaguaucuguggcccaagacaaaguacucauggaggaaguguugggaauuccugugugugugugucagagcagggaagaagcagaggcauggggagaccugguucuagauuguugguccuggucccagaguccagguucuuggagguacauucuaggcuccagauuccauugggcccucuucccucagguacaguugucagaaaguaagcgggagcugacagagcugcggucagcccugcgugugcuccagaaggaaaaggagcaguuacaggaggagaaacaggugagcacccauaacccaggccccguggaugccacaggugaggacuugagggcuagaaacuuuguaaauuccugucaucucuuggcuuagaaacuguucucuccaagagggcccguacccuggcuucucuuauuagcugauuuggcaggacagcggaugaucucugggagaagggagggauguaaguggugaagcaggggugcuggggggagugucugccugaaguugccccaaucuuugcugaaggcaucuaaugcugaggagcuaagaguucuucuugggugcagcuucugcaggcuagcaagguuggcaccuucccauucucuagcaccugccuuuuuccuucccaauuccaggaauugcuagaguacaugagaaagcuagaggcccgccuggagaagguggcagaugagaaguggaaugaggaugccaccacagaggaugaggaggccgcuguggggcugaguccguguagccccaaucuuguaacaccucuuccccacucuaccucccgcuguugaggaaggcuccauguaaccuugcugggagcugccuuugccuucuauguguuuugccuuuucuuucccagacccuggccccuguuuagucuaaugauaccccucauccagaggagacagcugguccaacuccucacaacacauccuuuuuucuucucugccugcuucaucuccuacaggcugcccggcagcucugacagacucagaggacgaguccccagaagacaugaggcucccacccuauggccuuugugagcguggagacccaggcuccucuccugcugggccucgagaggcuucuccccuuguugucaucagccagccggcucccauuucuccucaccucucugggccagcugaggacaguagcucugacucggugagcaguggaggagccugugcagaagcaguaaggaggggcagggccaaacccaagugucccagccuggagugcagcacgaucuuggcucacugcagccucugccuccugggcugaagcgauccucccaccucagucucccaagaguagcugggaccacaggcaggcacccccggcuaauuagagaaggaaucuuagcuauccagggcucucuuuuucccaggggagaggaggcaggcccagccucucuucagugccacaccaguagauaucaucccaaaacccagaccagcccaauagccucacugcuucucccccacagucauucucuuauuauucaccagccccucaaaacgccucuccugccucacucuuccuaagccccucaggucacuguccuagccuuggcugcucuucccauaccugucccaaugugcugcucccccaucuugggacaccaccccaaagcccaacccugucucuuuggcauccaggaggcugaagaugagaagucaguccugauggcagcugugcagagugggggugaggaggccaacuuacugcuuccugaacugggcagugccuucuaugacauggccaggugaguucaaccagcaaggccaggagggaggugggaggaggucagagggaaagggcaucuguguggacagucaccaggcccugcucccaaccccugcccuucuuggccucagccaagaaaaggagauacagguaugguuaacaaggaaaaugacucacugcuccaaaucccagaugccuucagguaaucccuaccccuaucuuaucaaugcacucagagguccugccuuuaacuggcuucuauguuguucuagcaccaucuucugcagagcccaaauugcccugcuuccccucucuccugccucuaccccuuccccaaccaccagguagguaccuaggguccuccggggaggaagggaggugaccauggcccccagggauaggagcagagagaagacugggauccagcauccaucuggcuacaacugaaaugcuuucccucuucccugacuucccuggguaacccuuagggaagggaaccuauagagguggggguuucagguaucagauuguccccuucugccuucccuuuuauucccagguucaagggggcaggcacagggaagagagauuugaucaucuagucccgguuuugccuggaugugagaugggcucagggcagggagggggugaugcugucauccuucucggcuggagcaggaagaugaaggacgaugucagacucauuuucagccucauuaggcagcagacggagauggagggaggagagcaggaggcugggggaugggcucugcacugcagagaccagcagggacuaaagaagagaggacauggggaacuggaaaaauaagccuuccaggauuguggggagaaagacgcugugggagaggccaggaugcugcauuaggcacaggauaaccugggaacccaggcacauggguccugcucuccgaagucugcaagucaagaagggaacagagcacgccgacccucucccuuuccccucugucucucuuaguggcuuuacaguggguacccugucagaaaccagcacugggggcccugccacccccacauggaaggaguguccuaucuguaaggagcgcuuuccugcugagagugacaaggaugcccuggaggaccacauggauggacacuucuuuuucagcacccaggaccccuucaccuuugagugaucuuacucccucguacaugcacaaauacacacucaugcacacacacacucacacacaugcauacacuuagguuucaugcccauuuucuaucacacugggcuccaugauauucuguucccuaagaacugcuucugugugcccuguuuucaucccaagauuucucacuucauccucuccuaccuggcucuuuugucccagggagggguccuguucggaagcaguggcugaauuuauccccugaaagugguuuuggaggaaccgggauggaggaggccuuccccugugggaauagaaucguccacuccuagcccugguugcuucugauacacagccacugcacacacacacucacacucacacucccuugucugaugccccaaagccaauuccuggggcacccuacccucucuuauuuggaguuuccguugguuuaccugaguuuucucuggggucugcacagaggcagcagcauggacaucauggccucucaggucccuuuugguucucaguuucauugguuccucuuucuguucccccauugacuucugugccccacccuagccuuuuccauaaccuuagguauucaguuuggagggguuuuuuguauuuuugaggauuccuguauucuguauccucuccucgcaucuccucacauggaaagaaauaauguauuugugccuucugugaggaauggggggaacaaguggucccagguauccccauuuccaaggccccccucccucuccagguccccccacagcaauaaaagcuucccccugauauccaucccuuuguaguuugaacaaauauauuuauaugauauguaugacuguugucacaaaauguguucuuaucaugaggugugacuggaacacagggcccagaccuccagcucuuagacccugguggagggaggagggaaagaggggacgcaucccugccucauggcaggggaugcugggcaguuacuguccugucgugccuccuggugugcuggccaugaguggguugucucaagugggagucuggcuuggauaaugcggcaguuggggagggagcaaacucaugggucccugucacuucugcucaggguuuagucccagggugggugcaugccauggaaaagugggacaaguuucccacugccgagaacuucacccuucauagcagccaucacuguaccuuaugccaaaggacaggcuuuauuccugucaagagcguacaccuuugaguaucuacuuaguaaaaaaugcccuaagccucauaccucuaaaggcgauuuuauauuccuccuguuucuguuucuguuucuuucucuguugccauccccucauaccuguaugcacacucugccucaacagucacaaaaacacauucauccacucuaaccagcuucacaggcuagacagacacauacacagcaucguaaagcauuuguuaaggaccugcacgcucaccaaggcucucagcaauggccugcacaagcacaugccuacaacccccucguccuccaacccaauagcucccuucucagcugcccuccucucccuucagggccccuguguggaccacccccaccauucccuuucuccauucaccugaaaugcuccuguccacccccuuuccagccccaccuggaugacuucuuacaucguuccuucuucccucacgucuccgucuccuagcaaccccaucccguucccugaaucccuuccaaggaaauuagagauaauggaucucuccucucuccaucccaaccccucuuuauugauccuccuuuaaugaaaguuaauuauaacaaugauuuaauuaauag

SEQ ID NO: 17977 - RNA, 4638 nt, Homo sapiens
uauauucaccacauguaaaacuuuauuuaugcauaaaaccaccacacacacacaaccuacacaaggaaugugcaguccugagucuauuuagcuacaugugaguauauacuccauaaggcauauaaaaccagugcacagaaaaugcauccagauauuaauauaucuacauuuuaaaacugcauggaaaauacauuauuauauauacacaaagugcauaccuacccaauguauggaaaauauauucugugaguuguguuuauauacauacuguguguguacuaaauacauugaaauugcauucuucuggguucaugaacuguuuaagacacaauucucuagcaaucuuaauagcaggaggaaguucaggcauugggaaugguaaucuccaucugcugauuuuuuuucuguucuucuguacuucuauuauuucugucuuuuaaauaccccuucugugucuacaugcaucacuuauuuaaguguucuccuaugucuauuuuucuacugcaacuuuugucccaagcuggggucuauauuuagagugcaaagucccguuugcagcagggucccacugcauaaucacuccuguauggaacaagcauuauauaauuagguuacccaugugucucaagaugcauucuucuagaccuaauauaagcauauuauagaguugcucugugcugccaguuagaaaagcggugccacugugucuuggagaggcguguaacaggcagguggauuccugggugggugcugaaccuucaagagcuuccaaaggcuagggcugguuucacuuuuaaaaauuuguuuuugaaucuuaagucuaggaaucagcacgaagcaaaggcuggaccuuugcuucuauguuccucucaaauuccggagcagcucaaguccccugcauccagccgggacagagaggcuuccggccuacacaaccccuucgcuuccuuguaauucuuaaauugggcugggucuacacaaguagcagggaaaggcuuuccuauaacccaagcuuuuuuccaacaaaacacacucccaaccccuuuggggaagcauuuucugacacugaacggacucuguuugggccuccuaaaauuggucccauuuggaucuuuccuuagcaacuaaaaauccagaacccucugacauuugccuauggaaaaauuauuugagagacagugcacucacgcccaacagauauauuguuuaugaguccauggguuccguguagacgccgccauauuuuacaguccaaaggaaucaauuaauuagcgccucccaguccccccaccgaccgcugcucggcugagcgggcgcggcugagauagaggugcuuggccagcucucuggucuuguuaacaagccucaucauaaagauggagaugauaagaagagcaaggaagccccgguggccgcgaggggcggggcuuggugggcccgguguggggcaguggcugacccgagccgggugcugccccggcacccgcucagguuuuuccagcguucucugggcguucauguggcgagcuaggacccggauuauucucucuguacucccguucccuagauuuucccuuuuccucauggaacaccaaaucagauuuuaaaaaauaaaaauacauaaaccucugucugugagugcccgucuugcccucugccacguuuguuccgggaacugccgccuugcucccuugccugcauuucucugcgugguucgcuuucaccuucgucuggcgcucucuucccuccucuggcucucucucuagcuucgugguugcuuuuucuaccaggucgguacuggcuuaggccccaacgagcuugugaaaaaaaaauacaaaugcccccugguuaucucuugccagagugaacacccccagauaagccagacccaaugaaaauaaaguuaaaaaaaaaacaacaaaccuuggguguaauugcugguuuagguugcagcacuucucucgccaaugugcauacuuaacggagagauauugauauuaaagggcaggagggaauuaauuuuacuuuuauagucaucuauuaagagcagaagaugaucugagucuccuuuaaagggacucaaaaaagggggaagggaaagagaaagaaagggagggggaagggagaaauaugacugaaggggaacaaagaucuuugccugaagaaacaauguaacacuagacagaacuauaaagucugggaauguaagaacgcaggacucucucagcuucccccauuuggaauucuguccccugcacuuccugcugaaauccugacccugacuacacagugguauuccaggaagaauucaugcaauuauucggauaauuguagagggagagagagaaaguauuucucuuuuauugucugacccucucugaugucugugcagaggaggaggggccagggguguaugggauguagaggaaaaggagacaguagggucucccaacaucacccuaagcccuacaaaauggcuauuccuaaaucaaggaggcccuaggcaggagcuuauagauuuuggaacauacucaagaacgcacaagagaucgaguuugaaugccccugauuuaguuucauuuuccaggauauuugcuuggcuuuacuuugucagcauagaccugccuccucuaguauuguaaucauuacaaguaaggggauaauagauaauuacagggguaucaauaauauuauuuuauagccaaacaagauaugauuagaguuaaugucagaggcucggcuggagccugggaggcagcaauagacaagguggagaggcccuuauagucuuucucuauccuauuuuuacauaugcuuuaaucucuauaaaucccuaguucucuaaaucuccuccucagaugucuuaagggaaagcucuaagauuuuaggggcugaaagccagagaagggugaaccacaauuugguacuugaacucugcuccccuccccauaguuucaggagcugugggaucugcuuuccccaugcccccccagccugaggcuuugcucucaguccaaggccacuagggucacagagacuuugcagguggggccaaugugaggaagacagggucuuauccaaaccaauuucauugucauccccaagugggcacuggucccaaagugaagccucuuuugauccuaaauuggccuucccccucucccccaggaacaccuggguggggcaaaagccaggcuggggcugugaaggccaguucaggguagggaugcaggaaggacugaaaauauuuguguuguuguuguuuccgggauuugagaccagaagggaccagaaggcugggaagagagagaaagagaucaaggaagugccugagaacaaggcaagagagaacccagggaagcuaugaaaccagccggcaaggguaaaaagaaugagugaaagaaagggggcaggaagaacagcaggagaaaaagaaggaaggaaggaaaugaaaaggaaaagacagaaaaaagaggaagaaaaagacaggagggaaaugaaaauaagaaagacgagagagaaggaucgaaagauaaaaagaggcgggagggaggcagaagcaagggucggcuguugcucucccucgcccgggcgccugcagcagucugggugggcgggggcgccaugacaaagugaaggucaaguuagcaucguaccuuauaaggaaggcgccgguccuccauuucagccuuuucucugccaggacgcggccguggcauuucuggucuuguaaacaucagacucuuuggggccuuaaaaaaauaaagacgccccuccuuccuuuaccgggggugagccggccggggaaagcggcggacagggaaaucaacuaaugaagacuccgggaaacuuuucucucuuuuucucucucuggcuccgcuccccgccagcuggggacccuucccucccuccuuccucccccucccuucccccgccucucuuuuucucuaucucccagucuucuguaccucucgccgccgucuguaacucugggcucccucucuccacuccccacuccccuacugcaggcuucuaaauccguuccauuccacugcgaagcggagcaggaccuaagaauuggagagaaaauuaaacgucauaaagaaaaguucauuuacagcuuaaaugucugaauguuacgguuuccuucagaaaacaaggcgguacacucgguaaggagaagugaggcagcagggguggggagggcuggugcgguaggaggcuugguuuuauuucuuucucagauccagaggcggaaagaaagggggagaagcaggaaagugcgacagaagcguuuuacccgggcagcuagcaaagaaagaugcugcagucgguggaacuggaagcaaagcgcauaagggcccagugcgggggcagcgauccccgagcgcugagcuggcugcgcugaggccuggcgugcggagaaacaaauauauuggauauuugcuggucuaggggaggggugaggcaagaauggagggagacagggagaccgggagcguaaggcagcgccgcagccggcccggcgagaccgaaagagccccguauccgccgcgacagccuuuggcggugggcagugggcaggcucagcucgaaggcucagggaggaaggaucccgaacugagauccuugauccuu

SEQ ID NO: 17978 - RNA, 2275 nt, Homo sapiens
agagacuaagacggauaacgcgucaucucgccuucccaaauuuuccccccucgcuagaccggguccaaaaccuccauccggagccggcaggagaggagaacgauguuuaacucggucaaccugggcaacuucugcucuccgucgcgcaaggagaggggcgcagauuucggcgagcgagggagcugcgccuccaaccucuaucugcccaguugcacuuacuacaugcccgaguucuccacggucuccuccuuccugccccaggcccccucucgucagaucuccuaucccuacucggcccaagugcccccgguccgggaggucuccuacggccuggagccauccggcaaguggcaccaucggaacagcuacuccuccugcuaugcggcggccgacgagcuuaugcaccgggagugccugccuccuuccaccgucaccgagauccucaugaaaaacgaaggcuccuacggcggccaccaccaccccagcgccccgcacgcaacccccgccggcuucuacuccucagucaacaagaacagcguccugccucaagccuucgaccguuucuucgacaacgccuacugcgguggcggcgacccgcccgccgagccccccugcuccggcaagggcgaggccaagggggagcccgaggcacccccggccucgggacuggcgucccgggcugaggcgggugccgaggcggaggcugaggaggagaacacaaaucccagcucguccgguucagcccacuccguggccaaggagccggccaaaggagccgcccccaguagguagcagcggccggggaacgggcgggcagcgagggagggagcgagagagggagggcgagagaaggggggaggcaaggggagcggggacggccucguguuuugggucaguccgauuuuauguggaguuuuauaagcauucaaaggauuuuauuauaaccuacaaagcccucucucccaacgacucgacuuuuuacgauggagaagggguggggagggagggaaaagggcucuuuggaaaagccgggugaaccccccucccccguuaucucccucggucugugaaauuuuuaaaagcgcaaccauugcgggcgauauuaacuuugaucgugaacuuagaggagcauuuaaggaaguauggggagccgggcugccgaggaguggggaggaggggagggguggagggggagaaaggggagggcgagggaaagacagggagagauccagagagggggagaggugggggagaggagcaauggagcagaaccugagaccggagaggcaagccaggaccgcuaugauccuucuuaaaacuaguuuugaaaauguucaaacuauguguucgcggguccucgagcagaaacccaagcaacucuggggucagcggcgacaggggaauggggcgaggcggcgcaggacuccacugcguuccaggcgggggucugggcguuucucccggguccgcggccuuagugcuugccuagaacugcgguguggaaggcgcugccccgcgggcuucccggggcgccagggccccggaagcggcucucuggugucucggugccugcuggccggcuuccuccccgccucccgacugcucucgccagauuucacugcuucgcgccuguucucagcuuuccccccagauuucugggggagggguugggcuuuccgaaccacuaggagggcggcccaggaagggcccgagggcggagggggagcagacagggggcccgaggggacgcacguguaccuggagggcuuuccuucugucccagacccugucagccgcggcucucgccugagaacuggggacgggguggcgcaguggcggggggguggggacccgcuagaccuggcagggggucgaggcuugcccgggugcugcggcugcaggagagccagccgccuggcgggagggcugcccgcggugggcuaggagaagggccgcugagcgcucagcgggcuggggucgcccgggucucacgugucucucuccccccucuccucgcacuugcccccuccccucccuccagacgccccccgcacccgcaagaagcgcugcccuuauucgaaauuccagauccgggaacuggagcgagaguuuuucuucaacguguauaucaacaaagagaagcggcugcagcugucccggaugcugaaccugacggaccgacaagugaaaauuugguuucagaacagaaggaugaaagaaaagaaacugagcagagaccggcugcaguauuucucgggaaauccucugcuguaac

SEQ ID NO: 17979 - RNA, 2275 nt, Homo sapiens
guuacagcagaggauuucccgagaaauacugcagccggucucugcucaguuucuuuucuuucauccuucuguucugaaaccaaauuuucacuugucgguccgucagguucagcauccgggacagcugcagccgcuucucuuuguugauauacacguugaagaaaaacucucgcuccaguucccggaucuggaauuucgaauaagggcagcgcuucuugcgggugcggggggcgucuggagggaggggagggggcaagugcgaggagaggggggagagagacacgugagacccgggcgaccccagcccgcugagcgcucagcggcccuucuccuagcccaccgcgggcagcccucccgccaggcggcuggcucuccugcagccgcagcacccgggcaagccucgacccccugccaggucuagcggguccccacccccccgccacugcgccaccccguccccaguucucaggcgagagccgcggcugacagggucugggacagaaggaaagcccuccagguacacgugcguccccucgggcccccugucugcucccccuccgcccucgggcccuuccugggccgcccuccuagugguucggaaagcccaaccccucccccagaaaucuggggggaaagcugagaacaggcgcgaagcagugaaaucuggcgagagcagucgggaggcggggaggaagccggccagcaggcaccgagacaccagagagccgcuuccggggcccuggcgccccgggaagcccgcggggcagcgccuuccacaccgcaguucuaggcaagcacuaaggccgcggacccgggagaaacgcccagacccccgccuggaacgcaguggaguccugcgccgccucgccccauuccccugucgccgcugaccccagaguugcuuggguuucugcucgaggacccgcgaacacauaguuugaacauuuucaaaacuaguuuuaagaaggaucauagcgguccuggcuugccucuccggucucagguucugcuccauugcuccucucccccaccucucccccucucuggaucucucccugucuuucccucgcccuccccuuucucccccuccaccccuccccuccuccccacuccucggcagcccggcuccccauacuuccuuaaaugcuccucuaaguucacgaucaaaguuaauaucgcccgcaaugguugcgcuuuuaaaaauuucacagaccgagggagauaacgggggagggggguucacccggcuuuuccaaagagcccuuuucccucccuccccaccccuucuccaucguaaaaagucgagucguugggagagagggcuuuguagguuauaauaaaauccuuugaaugcuuauaaaacuccacauaaaaucggacugacccaaaacacgaggccguccccgcuccccuugccuccccccuucucucgcccucccucucucgcucccucccucgcugcccgcccguuccccggccgcugcuaccuacugggggcggcuccuuuggccggcuccuuggccacggagugggcugaaccggacgagcugggauuuguguucuccuccucagccuccgccucggcacccgccucagcccgggacgccagucccgaggccgggggugccucgggcucccccuuggccucgcccuugccggagcaggggggcucggcgggcgggucgccgccaccgcaguaggcguugucgaagaaacggucgaaggcuugaggcaggacgcuguucuuguugacugaggaguagaagccggcggggguugcgugcggggcgcugggguggugguggccgccguaggagccuucguuuuucaugaggaucucggugacgguggaaggaggcaggcacucccggugcauaagcucgucggccgccgcauagcaggaggaguagcuguuccgauggugccacuugccggauggcuccaggccguaggagaccucccggaccgggggcacuugggccgaguagggauaggagaucugacgagagggggccuggggcaggaaggaggagaccguggagaacucgggcauguaguaagugcaacugggcagauagagguuggaggcgcagcucccucgcucgccgaaaucugcgccccucuccuugcgcgacggagagcagaaguugcccagguugaccgaguuaaacaucguucuccucuccugccggcuccggauggagguuuuggacccggucuagcgaggggggaaaauuugggaaggcgagaugacgcguuauccgucuuagucucu

SEQ ID NO: 17980 - RNA, 1956 nt, Homo sapiens
cuuuuuucucucuuucggauauaccuggauuugguccagaccagguugcccgcgggagggccccgcgagcggcagcgcgcgagggagggagagagagggagggcgagaaggagggagggagggaaggagggcgggcggcggcggccgugguggccggggcuucccuccccaggcgggagccgccuguccuguaucuauggccguggggagcgaaggaccagguaacgaaggcgcuuccgaagcgggauuggaccaaaccagagggacagagucuucugggucucucugccugaggcccuggagggagagaagguagggagaucggcgcccgccgggccuggcaaagaggccucgggaaauguugaaccuguaugugaucucaggcucacacucauguugugggucugucugccucaggagaugcgguuugccuuucugucugagacgccccaaacccugagcucuccuucccaaggcuggaaaaaaaaucgggaaaaacggcggaauuugcacuuucauucauuggguuaucugcaacugagaggggcugguuaaggcguccccaaguuggaagggcgcuuugcuucuguuuucuggaugcagaguccucugacucccucugccacgggcugaguuuccggcuccagguucgcgugucgcccugagguuugaggccagacagcucgcagucgggcagggagggcgggggagagacgagcggcucuggccccuuaauuguacuucgggcucguauugucucuccuuucgccaccuccgcuuccucagucugggcuccaaagucacugcaaauuuccuugcgacacauacaucacacaaaagaucagguaacaaggcgcucagggccacuggggcuccgggcagggcagggagcggcucuagcucuggggcggcucccccuccagccacucccaggcuggaaaaccagaccgcguugggggagccggaaauagccccgcuugcugcggagcgucagggcgggggcgccggcgggaaugcaggcccggcaggccguggcuuugagagagccacguucacaggcccuggggauuucacuccugcugggccucgggaccugacuccugguguguagggaucccagauacccaccuugggugggggcaggacgcggguuuccucgcggcaggccaagagaacucaguuucugcuuccagcgcaggccuuagcuaggaggaguuguguguggguguguuuuucccaacaaagagggaucaggagagagaaggggggaaaguagaggggaaccagggagggggcggggaggggaagagggcaguggagaggugaaaugagcccauuucagggggagaaggaaaaugaaagcaaauggaguacggccuucuccgcgcagggcgggugcugacgagccgggagcgggcucccugccugcggcagccgggauggcccgcuggggacaccggagaaagccuguuuuaaauuuaauccgaacuugacgguguggauugaaccggagggaauuuaaaucacuaaaaggaaggcgcggggcagggggaggggacgacucuaaccugucuaucuuucugucuguccuucccacggugcuaguuugguuguggccgcagcugcccagguuucaggugauggaguaagggugccccucccccucaggggucucuccugugcccagugaagucuuuugggggugggagggaacucuaagaaccagagugaaugcacagcugcgagcuaaagcugggguuucccccuccccaacaagaacucccaguggccuccagucccuggguuugccccagcggugcugaggaaaauugaagggaguaugugggugaggggaagucuggaguauggcagaagauucagaaggaguaacugaaccccaggaagacagaccuuccuucuuggugccccuauauccuuugugccccgccccccgca

SEQ ID NO: 17981 - RNA, 8698 nt, Homo sapiens
cuccccaggcgggagccgccuguccuguaucuauggccguggggagcgaaggaccagguaacgaaggcgcuuccgaagcgggauuggaccaaaccagagggacagagucuucugggucucucugccugaggcccuggagggagagaagguagggagaucggcgcccgccgggccuggcaaagaggccucgggaaauguugaaccuguaugugaucucaggcucacacucauguugugggucugucugccucaggagaugcgguuugccuuucugucugagacgccccaaacccugagcucuccuucccaaggcuggaaaaaaaaucgggaaaaacggcggaauuugcacuuucauucauuggguuaucugcaacugagaggggcugguuaaggcguccccaaguuggaagggcgcuuugcuucuguuuucuggaugcagaguccucugacucccucugccacgggcugaguuuccggcuccagguucgcgugucgcccugagguuugaggccagacagcucgcagucgggcagggagggcgggggagagacgagcggcucuggccccuuaauuguacuucgggcucguauugucucuccuuucgccaccuccgcuuccucagucugggcuccaaagucacugcaaauuuccuugcgacacauacaucacacaaaagaucagguaacaaggcgcucagggccacuggggcuccgggcagggcagggagcggcucuagcucuggggcggcucccccuccagccacucccaggcuggaaaaccagaccgcguugggggagccggaaauagccccgcuugcugcggagcgucagggcgggggcgccggcgggaaugcaggcccggcaggccguggcuuugagagagccacguucacaggcccuggggauuucacuccugcugggccucgggaccugacuccugguguguagggaucccagauacccaccuugggugggggcaggacgcggguuuccucgcggcaggccaagagaacucaguuucugcuuccagcgcaggccuuagcuaggaggaguuguguguggguguguuuuucccaacaaagagggaucaggagagagaaggggggaaaguagaggggaaccagggagggggcggggaggggaagagggcaguggagaggugaaaugagcccauuucagggggagaaggaaaaugaaagcaaauggaguacggccuucuccgcgcagggcgggugcugacgagccgggagcgggcucccugccugcggcagccgggauggcccgcuggggacaccggagaaagccuguuuuaaauuuaauccgaacuugacgguguggauugaaccggagggaauuuaaaucacuaaaaggaaggcgcggggcagggggaggggacgacucuaaccugucuaucuuucugucuguccuucccacggugcuaguuugguuguggccgcagcugcccagguuucaggugauggaguaagggugccccucccccucaggggucucuccugugcccagugaagucuuuugggggugggagggaacucuaagaaccagagugaaugcacagcugcgagcuaaagcugggguuucccccuccccaacaagaacucccaguggccuccagucccuggguuugccccagcggugcugaggaaaauugaagggaguaugugggugaggggaagucuggaguauggcagaagauucagaaggaguaacugaaccccaggaagacagaccuuccuucuuggugccccuauauccuuugugccccgccccccgcaccuacaaaccuggauuugagggaaaucugcagguccgcuucaaagcccuggucugccacccacaccccuccaaauguggagaaugggggcuacaggccacaugcaguuguggaccugcggaaccuccgcccaguggacuccggaacucccagccucuucuagccccccuccccaaggccgccucucuccgaagggcgcagggaaaaugaggcauuggcugggaaggggcugugggcgaggccugcuuccugauccacagccgugccugccucugagugggaagaguucggaggucauagucccagaaaauaaaauaaaauaaaggaaagcgacaaucuccuugguuucacaggggauuucacggcagcagggaucccgccggugagccucacugcccgcugcugccgccuccgcagagugggcaggcagggugcgcaggcagcucaagaguugaaaagaaggcgguguucaaaggggguaggagagaagggggcaucucuuuacggccccaaugucuauuugaggaacucucccaaauagcagaggcccauaggggaggcuccuuagggacucuuuccuccaggaaagcugaggcuggggcagcuggccuugucgcuuggagaagacgcaaaggaagagcaggggugaaaccucuuuccucuucuguuucuucgcuccuugaauagagcagggcucagcccccagcugccuaagcggcugucuggaccaauaugggguucuauaucccugaggccuagaguacccauccgagcaagucuccugggaggggcaggagaggagcccucuuccgccuuuguguccagacagaaguggccgccgcgcccggagccggucccgcggcaaaggcccggcaagccagcgggcugcacaaugccacggcugcuccgccagcucgccccugccccguccugccugccuacggccgcccuuccuccgccucccucucugcacgccugccuuucccggcucuccuaucucuuuucaucuugccuuccuucuuuuaauucucccccuuuuuucccuuuauucuaaugcuccgcuuccuucuuuccucucuugggccugacuccauguuucaguuggucugucccaggcugucucggguucagucucucucaggcucuguccccugauguccucuuggucucagucuggccccgggccccgcugagggcuaaacgucucugcucaucgcugccagcagccgcccaagugccgggcccgguccucagccgcccugggcugggggaggugcuggcuguacuggggauuuggagaaagccucggcagggggacuggaaccuccugucuuuuccuugaacuagugagggagauuuuuugauugacagcuaacccaacuccaucaaggccaaagagauauucuguuucuuguuguaaguugggcuucccagcucaguccagcucaagggaggggaagacaguggcgccaaggagcugaacccccaagucgccucuccccaaccaaacacaucccucauccucccccaugaguugaaaucccagccccguuaagccgcccccuuagaccaaaaaggaaaaggaaagagccagagagggggaggagcagagacuugggagggggccuauggagcuggggucggugcugccagcugcagcugucucccccuaacuuuccuccccccggaacacacauacuauacacacucuccccagccccucuccaccccagaggagaaagauccauagagacgcaggagaaaacuagcccccgccccuaccccuggcguuugguccccuccuggggacaggagagggaaagaagggcaggcguggccgggucugggaagacuccuacccugcugccuccagagccugcaucucaaccucagcuccugucuauuuucccuggccacagacugggacucuuccuuucugacccugaaauugcaccccuccuuuaaauucacucuacccugccuaagugcaccauauuucuggggguuucaccugucccuuucuccccaccccccagccaaccuccaugcccccucuucuucacccacccugauaauuuccuacuugacuaaagccccccuuuacuacaccaccaugggacagucugaugcaaagcagagggcugggcacaaacccucaauugaaggaggaggguagcaaccaacuuauuggggggaggaauccaaguugucugauauuccucugcaaucacacugcccccucuggaauuccugcauccgaccccaaagaaauugcuuucuccuguuccuccguugcuuuuuucccguuccaaaaacagccuacaauuuuauuuaaugaaagauacauuuaugaacaaucaaaugauccucauaaaaauuuuauugagggacguaaaaacaagcuacuugcccacgaccgaggucgcucuuuugccuugcccgcucucacccuggcucucugcagacagagcccgggagcgacuuuuuggggggaguggggguggggaagugucgcagagauggaguugggggcaaaggagggugcgcaggaagaugggauggggacgccccacuuaaguuguguagaucucuccuacacuucuucaagcuggcaaagaaagauaaauagauauagacaauaaauuuaaaauaaaggcgccuguauaucugugccaaagcaaagagaagacuucugaggcugcugauaaagguguaugagauccugagguucuaccccucccacccagggaccaccuuccccaggcuuccccuaccccagauuuggggggcagaguuggccaguggcagaagaacgcuccccuucccuccuucccucccuguaucucagcuuccccaguccccucccacccucccucccucaccgccccugcugcuccugaaagaaauacauacauacacacuauuuaaaaacgcauuuuuaaaagccacguuccgaacugacaaucgcugaucucggcucgcgcagagacugcgggagcgucggggccgacagagacggauuacgucaagaaauaguuccuccaccuaccucggucggccuccccgccccugcggggcucccgcgcccagcucggcccuggggguccgagaacccuggcuucggggacuggcauuuucaccccauuaaaaaauccucaugguuggggggaggccaucugcuuauggguggacaugggcacaggggcuucucagaugagcuaggagccguccugagggggugaccggugccuuggguccagaguuccggacccccaggaaaucgcaggucgcggggagcagcagagagaagggggugggagagggggaaaagaaggcaaggaaaaaaaagccccugcgcauugauccgcgccguauuuuuggguaaauacgaucacgugggggccggggagccaaugagcuguggggaaaaggcuggaaaaauaauuaccugacuugauuguucugugagcagauaaaaaguacauauacaguucauacaauaaucuuauguauguaaaaccccguuacgaugucggcgacggggcccaucaguaacuauuacguggacucgcucaucucucacgacaaugaagaccuccuagcguccagguuuccggccaccggggcucaucccgccgccgccagacccagcgguuuggugccggacuguagcgauuuuccguccuguagcuucgcgcccaagccggcaguguucagcacgucgugggcgcccgugcccucucagucguccgugguauaucacccguacggcccccagccccaccucggcgccgacacgcgcuacaugcggacuuggcucgagccgcuguccggcgccgucuccuuccccagcuucccggccgggggccgucacuacgcccucaagccggacgccuaccccgggcgccgcgcggacugcggcccaggggagggccgcagcuacccggacuacauguacggcucgcccggggagcugcgcgaccgcgccccgcagacacugcccucgcccgaggcggacgcgcucgccggcagcaagcacaaagaggagaaggccgaccuggaccccaguaaguugggagcaauuuuccuuuacaaccggcgcgggaggggaggggaggacgggcgggggcagccgaauuacagcccucccgaaccgugcagggagcgcgggagaggggcgagggggcgaggacucaauaaaagcgaauuaccuuggggagcuuucaggggcaggaggucugagaauggggcccagggagacagguugggagagggccgaggggagcuccucucucaggagcuggcuuugaugagagaccccugcccccuccucccagcccaggcuuuuuggcucagucaccacuuucgaagaaaggcggacagggccaggggauggggcugggggcgaaguucaguuuaugauuugagaugggacagggaagaggugaggaggacacugggggcacagaggagauacccccagcgagaaugaccccugcuucccagucagcguggagguccucaccccacuagagauucacaaaacagaagguccauggacuucucccccaggagcacugggugaggggucugagguauuucgaagccugagaacuuggagagaucaggacuuucaaagagaaguggggauaaaaguggggucugagccuccuuaaacuugagaacccucuucugagggucuuggaggggaaggauugagaauggggaucagggaugaggagugggcaucuccccagauuagagaauucuacacacacacacacacacacacacacucacucucacucacucacuccaaucagggagacaggcgccuucugaggauugcacaggagggcuaggguggggggcaggugggagcugcagggccagaaaaaggggaaagaaggagaaacagcaggggagggggugcagaccccugggugugaggaagugucugggggagucccaggagggggcugcaggaaaucuuuuccuccagccccauaaggggccagggccuaauuauacuccucugaaggcuucccucccugcccucagcuacucccauaaaccugaaauuggaggcuuggcuccugcagagccuguccuggggcuggcaggaggggggcacuggaggccaaacaggaaaacuaagauauaggggagccuguccccaaggccagcggcucucuggggagaggagaaagacuuuucccgucucagcaucacccugagaauucgccucagcaggguugaacuccaagcgggaggauggugcugcagaggguggugagggguuuagggauucucagggucaggaagcagaacugcuaaaauuucaggacuuggucgugggcugggaggaugggagggggcagaggaggagggagguggggaggagagagaccuugcuauaaaaauaaaaaacaagagagagaagcguuuaugggccuaugaaacgguugggaauuuggacuuuuuaugaggauauucucaaauuacuacucuugaagcugaggaccagacuagaggggcuuugauagcuuuggauuuccuacaguuuuaggugcuggaaacugaaaagggggaagcuggggaggggacagaaugcaaaacgaggaaggaggaaaauuccuaaagcaaaauguguccaaauucagguucaguuauugcauuuggggagccuggcuaagucuagggguagaguagcagaaguccugggcuggaaaggggcuccacugaccccugcuuguguuuggcccuccaggcaaccccguggccaacuggauucacgcccgcuccacgaggaagaagcgcugccccuacaccaaguaccagacgcuggaacuggagaaggaguuucucuucaauauguauuuaaccagggaccgucgguaugagguggcccggguucucaaucucaccgagcggcaggucaaaaucugguuucagaaucgaaggaugaagaugaaaaagaugaauaaagagaaaaccgacaaggagcaguccuaaacccuacccagccugcugccucagcacagccaagggaaaaacaaaaaccccacaaaauaccccaacacaggcgggggagagacgaaaaagaaaaggaaagagcaagauagacaaaagccaaucagcuuaaaaagaaaaacaaggaaggggaaaagaaaacucuugcgauuugggaggguucaguguugagauauugguguuuuagaguuaguucuacccagcgaggaggaggcggggagagaaacugcguucucuuuccccagcgcaaccgaaauaaaugacacauacaaaugugauuuuuuuccuccuuucuucagagaagccaguacuugaaucgcuauauuucuauuuuuuuuucccuguaucguauuugguccaggucaucccuccccgggccuggggcgcucugcgugcagauuuuguacaaaaaaaaaaaagacacacacacauacaugauaaugauucccagcccaggagcugaggggugagggcuggggaccaugccgcgggcuaggucgggcccgugcaggccggcgccuugggcuguacauaguguucccucucauccccaggguucguccccagcguccguccuguaacgugcuucuguuuguuaugguagaacagcccuguguuaauauauugaagucacuuaaccagaaacccaacuguauccaguucucguuauuucuccucccugugguucccagucugcuguuguggaggaggcaagugcucaggucaucuagcggaggcuggagccagagaaugggcuccuucuaccuuggaagggcaaacgucugcuucugcagcugcuucucuccagucagggagggguggggggucucugggggugggguggaggcugcugaggcccaggcccagcuugugc

SEQ ID NO: 17982 - RNA, 8698 nt, Homo sapiens
gcacaagcugggccugggccucagcagccuccaccccacccccagagaccccccaccccucccugacuggagagaagcagcugcagaagcagacguuugcccuuccaagguagaaggagcccauucucuggcuccagccuccgcuagaugaccugagcacuugccuccuccacaacagcagacugggaaccacagggaggagaaauaacgagaacuggauacaguuggguuucugguuaagugacuucaauauauuaacacagggcuguucuaccauaacaaacagaagcacguuacaggacggacgcuggggacgaacccuggggaugagagggaacacuauguacagcccaaggcgccggccugcacgggcccgaccuagcccgcggcaugguccccagcccucaccccucagcuccugggcugggaaucauuaucauguaugugugugugucuuuuuuuuuuuuguacaaaaucugcacgcagagcgccccaggcccggggagggaugaccuggaccaaauacgauacagggaaaaaaaaauagaaauauagcgauucaaguacuggcuucucugaagaaaggaggaaaaaaaucacauuuguaugugucauuuauuucgguugcgcuggggaaagagaacgcaguuucucuccccgccuccuccucgcuggguagaacuaacucuaaaacaccaauaucucaacacugaacccucccaaaucgcaagaguuuucuuuuccccuuccuuguuuuucuuuuuaagcugauuggcuuuugucuaucuugcucuuuccuuuucuuuuucgucucucccccgccuguguugggguauuuugugggguuuuuguuuuucccuuggcugugcugaggcagcaggcuggguaggguuuaggacugcuccuugucgguuuucucuuuauucaucuuuuucaucuucauccuucgauucugaaaccagauuuugaccugccgcucggugagauugagaacccgggccaccucauaccgacggucccugguuaaauacauauugaagagaaacuccuucuccaguuccagcgucugguacuugguguaggggcagcgcuucuuccucguggagcgggcgugaauccaguuggccacgggguugccuggagggccaaacacaagcaggggucaguggagccccuuuccagcccaggacuucugcuacucuaccccuagacuuagccaggcuccccaaaugcaauaacugaaccugaauuuggacacauuuugcuuuaggaauuuuccuccuuccucguuuugcauucuguccccuccccagcuucccccuuuucaguuuccagcaccuaaaacuguaggaaauccaaagcuaucaaagccccucuagucugguccucagcuucaagaguaguaauuugagaauauccucauaaaaaguccaaauucccaaccguuucauaggcccauaaacgcuucucucucuuguuuuuuauuuuuauagcaaggucucucuccuccccaccucccuccuccucugcccccucccauccucccagcccacgaccaaguccugaaauuuuagcaguucugcuuccugacccugagaaucccuaaaccccucaccacccucugcagcaccauccucccgcuuggaguucaacccugcugaggcgaauucucagggugaugcugagacgggaaaagucuuucuccucuccccagagagccgcuggccuuggggacaggcuccccuauaucuuaguuuuccuguuuggccuccagugccccccuccugccagccccaggacaggcucugcaggagccaagccuccaauuucagguuuaugggaguagcugagggcagggagggaagccuucagaggaguauaauuaggcccuggccccuuauggggcuggaggaaaagauuuccugcagcccccuccugggacucccccagacacuuccucacacccaggggucugcacccccuccccugcuguuucuccuucuuuccccuuuuucuggcccugcagcucccaccugccccccacccuagcccuccugugcaauccucagaaggcgccugucucccugauuggagugagugagugagagugaguguguguguguguguguguguguguagaauucucuaaucuggggagaugcccacuccucaucccugauccccauucucaauccuuccccuccaagacccucagaagaggguucucaaguuuaaggaggcucagaccccacuuuuauccccacuucucuuugaaaguccugaucucuccaaguucucaggcuucgaaauaccucagaccccucacccagugcuccugggggagaaguccauggaccuucuguuuugugaaucucuaguggggugaggaccuccacgcugacugggaagcaggggucauucucgcuggggguaucuccucugugcccccaguguccuccucaccucuucccugucccaucucaaaucauaaacugaacuucgcccccagccccauccccuggcccuguccgccuuucuucgaaaguggugacugagccaaaaagccugggcugggaggagggggcaggggucucucaucaaagccagcuccugagagaggagcuccccucggcccucucccaaccugucucccugggccccauucucagaccuccugccccugaaagcuccccaagguaauucgcuuuuauugaguccucgcccccucgccccucucccgcgcucccugcacgguucgggagggcuguaauucggcugcccccgcccguccuccccuccccucccgcgccgguuguaaaggaaaauugcucccaacuuacugggguccaggucggccuucuccucuuugugcuugcugccggcgagcgcguccgccucgggcgagggcagugucugcggggcgcggucgcgcagcuccccgggcgagccguacauguaguccggguagcugcggcccuccccugggccgcaguccgcgcggcgcccgggguaggcguccggcuugagggcguagugacggcccccggccgggaagcuggggaaggagacggcgccggacagcggcucgagccaaguccgcauguagcgcgugucggcgccgagguggggcugggggccguacgggugauauaccacggacgacugagagggcacgggcgcccacgacgugcugaacacugccggcuugggcgcgaagcuacaggacggaaaaucgcuacaguccggcaccaaaccgcugggucuggcggcggcgggaugagccccgguggccggaaaccuggacgcuaggaggucuucauugucgugagagaugagcgaguccacguaauaguuacugaugggccccgucgccgacaucguaacgggguuuuacauacauaagauuauuguaugaacuguauauguacuuuuuaucugcucacagaacaaucaagucagguaauuauuuuuccagccuuuuccccacagcucauuggcuccccggcccccacgugaucguauuuacccaaaaauacggcgcggaucaaugcgcaggggcuuuuuuuuccuugccuucuuuucccccucucccacccccuucucucugcugcuccccgcgaccugcgauuuccuggggguccggaacucuggacccaaggcaccggucacccccucaggacggcuccuagcucaucugagaagccccugugcccauguccacccauaagcagauggccuccccccaaccaugaggauuuuuuaauggggugaaaaugccaguccccgaagccaggguucucggacccccagggccgagcugggcgcgggagccccgcaggggcggggaggccgaccgagguagguggaggaacuauuucuugacguaauccgucucugucggccccgacgcucccgcagucucugcgcgagccgagaucagcgauugucaguucggaacguggcuuuuaaaaaugcguuuuuaaauaguguguauguauguauuucuuucaggagcagcaggggcggugagggagggagggugggaggggacuggggaagcugagauacagggagggaaggagggaaggggagcguucuucugccacuggccaacucugccccccaaaucugggguaggggaagccuggggaagguggucccugggugggagggguagaaccucaggaucucauacaccuuuaucagcagccucagaagucuucucuuugcuuuggcacagauauacaggcgccuuuauuuuaaauuuauugucuauaucuauuuaucuuucuuugccagcuugaagaaguguaggagagaucuacacaacuuaaguggggcguccccaucccaucuuccugcgcacccuccuuugcccccaacuccaucucugcgacacuuccccacccccacuccccccaaaaagucgcucccgggcucugucugcagagagccagggugagagcgggcaaggcaaaagagcgaccucggucgugggcaaguagcuuguuuuuacgucccucaauaaaauuuuuaugaggaucauuugauuguucauaaauguaucuuucauuaaauaaaauuguaggcuguuuuuggaacgggaaaaaagcaacggaggaacaggagaaagcaauuucuuuggggucggaugcaggaauuccagagggggcagugugauugcagaggaauaucagacaacuuggauuccuccccccaauaaguugguugcuacccuccuccuucaauugaggguuugugcccagcccucugcuuugcaucagacugucccauggugguguaguaaaggggggcuuuagucaaguaggaaauuaucagggugggugaagaagagggggcauggagguuggcugggggguggggagaaagggacaggugaaacccccagaaauauggugcacuuaggcaggguagagugaauuuaaaggaggggugcaauuucagggucagaaaggaagagucccagucuguggccagggaaaauagacaggagcugagguugagaugcaggcucuggaggcagcaggguaggagucuucccagacccggccacgccugcccuucuuucccucuccuguccccaggaggggaccaaacgccagggguaggggcgggggcuaguuuucuccugcgucucuauggaucuuucuccucugggguggagaggggcuggggagaguguguauaguauguguguuccggggggaggaaaguuagggggagacagcugcagcuggcagcaccgaccccagcuccauaggcccccucccaagucucugcuccucccccucucuggcucuuuccuuuuccuuuuuggucuaagggggcggcuuaacggggcugggauuucaacucaugggggaggaugagggauguguuugguuggggagaggcgacuuggggguucagcuccuuggcgccacugucuuccccucccuugagcuggacugagcugggaagcccaacuuacaacaagaaacagaauaucucuuuggccuugauggaguuggguuagcugucaaucaaaaaaucucccucacuaguucaaggaaaagacaggagguuccagucccccugccgaggcuuucuccaaauccccaguacagccagcaccucccccagcccagggcggcugaggaccgggcccggcacuugggcggcugcuggcagcgaugagcagagacguuuagcccucagcggggcccggggccagacugagaccaagaggacaucaggggacagagccugagagagacugaacccgagacagccugggacagaccaacugaaacauggagucaggcccaagagaggaaagaaggaagcggagcauuagaauaaagggaaaaaagggggagaauuaaaagaaggaaggcaagaugaaaagagauaggagagccgggaaaggcaggcgugcagagagggaggcggaggaagggcggccguaggcaggcaggacggggcaggggcgagcuggcggagcagccguggcauugugcagcccgcuggcuugccgggccuuugccgcgggaccggcuccgggcgcggcggccacuucugucuggacacaaaggcggaagagggcuccucuccugccccucccaggagacuugcucggauggguacucuaggccucagggauauagaaccccauauugguccagacagccgcuuaggcagcugggggcugagcccugcucuauucaaggagcgaagaaacagaagaggaaagagguuucaccccugcucuuccuuugcgucuucuccaagcgacaaggccagcugccccagccucagcuuuccuggaggaaagagucccuaaggagccuccccuaugggccucugcuauuugggagaguuccucaaauagacauuggggccguaaagagaugcccccuucucuccuacccccuuugaacaccgccuucuuuucaacucuugagcugccugcgcacccugccugcccacucugcggaggcggcagcagcgggcagugaggcucaccggcgggaucccugcugccgugaaauccccugugaaaccaaggagauugucgcuuuccuuuauuuuauuuuauuuucugggacuaugaccuccgaacucuucccacucagaggcaggcacggcuguggaucaggaagcaggccucgcccacagccccuucccagccaaugccucauuuucccugcgcccuucggagagaggcggccuuggggaggggggcuagaagaggcugggaguuccggaguccacugggcggagguuccgcagguccacaacugcauguggccuguagcccccauucuccacauuuggagggguguggguggcagaccagggcuuugaagcggaccugcagauuucccucaaauccagguuuguaggugcggggggcggggcacaaaggauauaggggcaccaagaaggaaggucugucuuccugggguucaguuacuccuucugaaucuucugccauacuccagacuuccccucacccacauacucccuucaauuuuccucagcaccgcuggggcaaacccagggacuggaggccacugggaguucuuguuggggagggggaaaccccagcuuuagcucgcagcugugcauucacucugguucuuagaguucccucccacccccaaaagacuucacugggcacaggagagaccccugagggggaggggcacccuuacuccaucaccugaaaccugggcagcugcggccacaaccaaacuagcaccgugggaaggacagacagaaagauagacagguuagagucguccccucccccugccccgcgccuuccuuuuagugauuuaaauucccuccgguucaauccacaccgucaaguucggauuaaauuuaaaacaggcuuucuccgguguccccagcgggccaucccggcugccgcaggcagggagcccgcucccggcucgucagcacccgcccugcgcggagaaggccguacuccauuugcuuucauuuuccuucucccccugaaaugggcucauuucaccucuccacugcccucuuccccuccccgcccccucccugguuccccucuacuuuccccccuucucucuccugaucccucuuuguugggaaaaacacacccacacacaacuccuccuagcuaaggccugcgcuggaagcagaaacugaguucucuuggccugccgcgaggaaacccgcguccugcccccacccaagguggguaucugggaucccuacacaccaggagucaggucccgaggcccagcaggagugaaauccccagggccugugaacguggcucucucaaagccacggccugccgggccugcauucccgccggcgcccccgcccugacgcuccgcagcaagcggggcuauuuccggcucccccaacgcggucugguuuuccagccugggaguggcuggagggggagccgccccagagcuagagccgcucccugcccugcccggagccccaguggcccugagcgccuuguuaccugaucuuuugugugauguaugugucgcaaggaaauuugcagugacuuuggagcccagacugaggaagcggagguggcgaaaggagagacaauacgagcccgaaguacaauuaaggggccagagccgcucgucucucccccgcccucccugcccgacugcgagcugucuggccucaaaccucagggcgacacgcgaaccuggagccggaaacucagcccguggcagagggagucagaggacucugcauccagaaaacagaagcaaagcgcccuuccaacuuggggacgccuuaaccagccccucucaguugcagauaacccaaugaaugaaagugcaaauuccgccguuuuucccgauuuuuuuuccagccuugggaaggagagcucaggguuuggggcgucucagacagaaaggcaaaccgcaucuccugaggcagacagacccacaacaugagugugagccugagaucacauacagguucaacauuucccgaggccucuuugccaggcccggcgggcgccgaucucccuaccuucucucccuccagggccucaggcagagagacccagaagacucugucccucugguuugguccaaucccgcuucggaagcgccuucguuaccugguccuucgcuccccacggccauagauacaggacaggcggcucccgccuggggag

SEQ ID NO: 17983 - RNA, 601 nt, Homo sapiens
aguucggaacguggcuuuuaaaaaugcguuuuuaaauaguguguauguauguauuucuuucaggagcagcaggggcggugagggagggagggugggaggggacuggggaagcugagauacagggagggaaggagggaaggggagcguucuucugccacuggccaacucugccccccaaaucugggguaggggaagccuggggaagguggucccugggugggagggguagaaccucaggaucucauacaccuuuaucagcagccucagaagucuucucuuugcuuuggcacagauauacaggcgccuuuauuuuaaauuuauugucuauaucuauuuaucuuucuuugccagcuugaagaaguguaggagagaucuacacaacuuaaguggggcguccccaucccaucuuccugcgcacccuccuuugcccccaacuccaucucugcgacacuuccccacccccacuccccccaaaaagucgcucccgggcucugucugcagagagccagggugagagcgggcaaggcaaaagagcgaccucggucgugggcaaguagcuuguuuuuacgucccucaauaaaauuuuuaugaggaucauuug

SEQ ID NO: 17984 - RNA, 4080 nt, Homo sapiens
gccugucuucaugucguggauugaugaacgcgaaucgcguguaagcgccgccaccgccgggagucugaggaauucgccugggcuguuagaggaaagagcuaagugagagagcgcgagcucuaccuaccgacagugaggagcgccgccgccgccgccgccgcccgcucgccgcccgccgccgccgccgcccgcgccccagccccgggagcucugcugauccggccgagcucagcaccgaggcgccccccaaccugcccagcccccagcccaccagcccagcccagucccggggagccagcuggccugggguucggucccggggggaggggaguuucggggguacugggcgggguacucgugagccagaggggagggggccgcggguuuucauguacccagcaugagcuccuacuucgucaacccccuguucuccaaauacaaagccggcgagucccuggaaccggccuauuacgacugccgguucccucagagcgugggcaggagccaugcgcugguguacgggcccggcggcucggcgcccggcuuccagcacgcuucgcaccacguucaagacuucuuccaccacggcaccuccggcaucuccaacucaggcuaccagcagaacccgugcucgcuuagcugccacggagacgccuccaaauucuauggcuacgaggcgcuccccagacagucccuuuauggggcucagcaagaggcgagcguggugcaauaucccgacuguaaauccuccgccaacacuaacaguagcgaaggacaaggccacuuaaaucaaaacucgucucccagccucauguuuccauggaugagaccccacggugagaagccuuuucucuuucccccuuggucucccgcgcuccaggguuucccccccucccucgccuccuuuuugucugcccucgcuuuuucuccuggcuuuggggucucucccgccccacccccgugccugugccugggugguuuucucgaaguugggaaggcuccgcuggggcggggcagggagggggugccuagaacauuuaggggauuggggugaaggugagagaaagcugguguguggccgcaaaggguuaaaaaucguuuucuccaucucugucugucugucucucucugacucucccacuccccaucucuaaagucaaaguuggggagguggcugggaaugguacccugaguacccugagacugucagccuuuggaacaaaccaguuucuccagaggcagggagccuggaguccaggacacuggccaggcugucuuggggcaaagggagacagaccccuguugcucugcccuagccagaguguggugagacucuaaggacaggcucucuggcucucuagggcacccauaaccuccucucagagaaccagccugagggccacuaccccaacuuuuuuauacuucccccaguugggagaagacgggggagccugagaggagggggaaaaaagagugcucaaaaggagagaggccauagagauuagggguuccugagguccagaagacccuagccgcccccccaaucaaggacuuguggggucucccugagaccugcagaguagcuuaggucaugagccccuccaaggguggccccucauggcccaauuucgaaguacagggggaagcgauaaagcgacaaguuccggcggggauggcccaugauuuauuugcuggucuccaguuagcaaucaggcggagcggugacacauuccagcagaucaauuauuuuucuuauuggaaaagcauuaggcagagagagacaaggagagggcagugggcagagccccucuucuuuacccccagcuuuuuuuccuuucuuuuggaaacagucuguccccagccucgcucacuaaaugcccugcugcacuuguaaacaaagcugcaaaggccaguuccuaggauuacaggccuggugggggggauucuacagggcuccccagccccugaaaggccccaguuuccaaacagacccuagcccccacccccaccccaccucccaaggugaagccaaacaaaaacaaucccccaacuuuucugcccuugucugccuucugcucuagccuuuuccauagaggggaggcgaacugaggagaucagagaggggaguuuagaguaggaagaguggcaaaggaaaaccaagcccccauccaaacguaaccagacugggguuuucuucuguccagcuccggggaggcgcaguggacggcaaacuuacagccgguaucagaccuuggaacuagaaaaggaguuucucuuuaauccuuauuugacacgaaaacgucggauugaagucucucaugcccugggacugaccgagagacaagugaagaucugguuccagaaccgaaggaugaaguggaaaaaggagaacaacaaggauaaacugccgggagcccgagaugaggagaagguggaggaagaaggaaaugaggaagaggagaaagaagaggaggaaaaggaagaaaacaaggacuaagcaaaaaagaaagacccccccccccuuagcaacucccuugaaguuucguuuuaugguagcagauaaauugagaaguuuacgacugucauuugcuuuuauagagaauagaaugacacucacaacucuaacuaccugucagauacuugcagcucugguuuuauuaccuuuggacuucccccacucuuuauuuguuugggggcuggaggggggagacggagaaacagugaaaaguucggacucucugucucacuccuugccccacacacacuugucccugcccccacccuucugaguccuuccuggauuuuaaggucugagaccuggccuccgugcuccucggucugucucucaccacacucccaccucccugcuucucugguauuuauuuuagaggggagcccccucgaaaugcagaaaaggacuugugguuuuguuuuuaugcuaaggcuaguguacuagauguacuuuuucuaaaaaggaaaggacagaaaaaaaugaagaaaggaaaggaagacaaauguaaagaaauaaggaaaaaagcaaggaauauccccucccccucccccucccccuccccagggcucccugcuuagaaaaacccccuugacuuucucuaggaaccugauggaaaccugaaggagaugugggucuuuccccuccccccauuuccagaaggguagauaggagccugcagucgccucuaaaauccuaccuaaccaucccauggucacucgggcccaugccuuccucuccuucgcuguuugauuucuauucuguugggcccgccuuccucugagcugcauuaguguuagugcucagaaaucaccauaaucacgaaaauaauaauaauaaaucuuuaacauacuaccuaaagggaaccugcaauaaucuugaaaaagaaaaagagaaaaauuuuaaaauccugcuauaggagaaaaaaagagaaaaaaauaaaaaucaaaaaaaaaaaaaagaaagaaagaaaccuccagcguauuuuaucacuaccuauagaaagaaauccugcuuugagaguauuuguaaugcgguuuuguugucguuuguugcugcuuauuucacuaagaaaacccaacaacugagacugccuagcccgccgguccugugcgcuuuuauugugcuucuaaccccaguagaguagaacuaaauugcacugaauguauaguuaacucugucuugaauucucuguuuaugcaaugugcucgaaagaaaaaaauguuaaaaauauaucuauaauaauaauuuuuugucauuugucuuuauguccagcuaugaauguagauuuugugucccgacagcccuguuccugguccaaguacuuuguauuguauacgugagucauaauaauaaaaagaagaagaaaaauaauagaagcuggaaugacuugcuuuuucuccacagcucuucccuauucucuaccuucucucuccuuaucccccuguccaacucucuggaaaaggucugcuucacugcucuggcuuugggguucagaaacucacguggagagaagccugggaauugagaaagcaugcuggccugggagggcaggugaaaggggugagggg

SEQ ID NO: 17985 - RNA, 570 nt, Homo sapiens
ugcccuccaaauccugaauugguucacccauuuauuuuucucccuuggaaaaaucagagagggguacgauuuuaaugcagcagagaaucuauggagccgcugagcucucucagccggcagcuuguuacuggggaggggaggaauauggguuauccaacggucaguaugguaauccaggcacaauaaggccucacacacaauggacacauauuuuucuucagcgaugucagaagggaagcgcuuuguacugaaacguguuuccgaaagagaaaccaaaucgagauuuagaaaggagaugggguggaggggcaauugcagagagcauuuggaugcuggcaaaagguagucagaaaaaauaaaaauaaauaaaacuggggcaaagugagguugaggacagggcagaggugcagccccugggccagcaaggcgggaggcaggagggugaaacacaaaagaagacaggaccagauacaaggauucaucacagaugagagcugcuuuaguacccccacccccucccaauuaagccauugcuaagugcaaaagcccuuccaacggauuuuauuucug

SEQ ID NO: 17986 - RNA, 7099 nt, Homo sapiens
ugugccccagcccacaacauucccucgaccucuucuggggcggcgcucagggcccccacauggcgaaaagggagggugaagggaugaggcgccccucccgccuuagccccuccucagcccccacgccacagcccccccuuucuccccagagccgagggacagacagagaauugcgacuagaauucgaucgauugguacgagggaccacguggccaggggcuggccaaugaccaggccgcccgggaugagcuaauaauggaagcaauuuguaacuuucaguagcucucuaggccuggguaccggagggagggaggcgggcagaggaggggagaugggcacccccagucuuuccauccuccucauucgucuaggggcacccgaauccccuauuccuuauuuccccuaucacucaggcacuggcaggguccuuggcccacuccuguuggccgccgcggcuccaaagcgagguaagcugguccucuaccccucaaacucuucacaacccucaccccguuuacuagcaccugcaaaccacagccucccuuccugucccauucgugaauuuaaaucggauuuuguuuuuccucuuaguugaaagaaaaaaaauauguuuguauucuuuuguguaaccuaucuuggauuuggagaaaauuuuaauucaaauuaauacacuuauauuggggggggugagugguacuuucuuccuuuucaauaaauuuguauacuugcuacuuuauggagaguuuacuuuucuuuggggaugaguuacaccuuauguuuucacauguguuacuucuuuaaugauaaguucaacuccuuucuccauuccauccuccaauuuugcuauuuauaaauaucaccuaauagauuuagaguuuauucauuuuucuccucccucacuaguuuuucagcuguuacagaaucaccacaauuuauuuuccucuguguguggaugagguuuugcguugauuccucuuuuuguuuuguaaaugaauuuauuguuugggaaacucuugggggguguguguguguaaaaaaggucuuuugauuaauuccaaccucuccucuucugaagaacaauuugcuugaaauguuuuguguauuuuccucguuuuuauuuguuuaaauuugagguauuuuaccuucuuuaaaaccuggccucuuuuuaaaauuuaaccuuuugcauguuaaaccauuuuuaagguuuuuauuuuauaaacuucaaugguuaguagauuuacuugccuuucccugaccuccuucacgcgccugccuccuccaucucagaacucccaucuccagcuuccacaauucucagcuuccaacggacucauccuccccucuccucccagccaaggagggaugccugggaaguagacaguguccuucuugggucagaaccuaugcucugguucuaguucaggacaccuccagucugaccuccaagccggcaaaacgagugagagcagaauuucuguucaacuuuuucauuugggacuaaguucuuuacacuuggcuguauucuggagaacucugauacaugaaauugaauuuuaaauucucauuuuuucccuaaauucuaagaaaagugcaggcagauuguuuuucuuccuuaaauguaagcugaacagcuuaggggucagccccuugggucuuuuaccuccugggggagacuucucagagagacacacaguguugauucuuccuuuuaguuuugguuaagguagaaggggcagggauuggggaagcccauauugaucucuggcucuagcucugaacaaagaaggguagagagcuggccuggggacuugucccuuuugucaguaagguuuggcuuaggagagaguuugaaguaaaucccagcucugaggaaauucuucuuuuuagcauuacugugaaaauaaacuauuaaaauggugugacauggcuucaaacuauucagauuccuugaaguaacaaaaauaaaauuacaagaguaauucguguuucccaaagguccgccuccagugacuauccauuucucucagggaaacggaacccaacugggcagaaguaaaacugccccccuccccuuucaguuccccagucacauugacauucugggcacauuuggcccagcccccgucccuguuucucccaaguaugaaucuaaauuacuauuaauaaggggccgcucgaaguuaauuggcauuaaaagaauucauuucgauuuguuaauauuaaaugaaugcucugcacuuuagcucccuucuucgcccuggauucccagaugagugaugggaagagggggcagggaaguagaaugaggauuuuauuucugggucuccagcuuagccacuguggugccuccccugggggugugcgaucaggcacagugggggccugcuuggggaaagucugauggucuuuuuuggugaaauucaucuguuucagcaggaguugugggggaggguggguggggagcagagggagagggacagaaugguuugggggacuuuguggggagcggagggacuagggagaaagugggaagggaaagggacggaggucaacaggaguuuuggagaacaaggguuguaggcugucggggguaaagcagauuugugaagaacuggugauaggaacuaaacaacccaccuagaagaggaggggcuucgagcagggguggggaggugggauuugaggcaaaacagcuagggguucugaaacuauuaauaucuagcugugugacucagggcaaguugcuuaacuuuucucucugccuuaguuucuugaccuguaaaacagggauacuaauaauagaacuuaucucaggggguuauuuggaauuagaagaaauacaugccauguguuuuccacaguguuuggcacauagaaacugccaguaaauguuagcucuuuuuauggcagagugguuaacaggauggauucuggagcuagacggccugguuuugaaucucagucaugccuuaugugaguuguaugaccuaggcaaguuacuuaaccccuugugcuuuaguuuccuugucuguaaaaugggguuaauaguaccuagcucaaagguugcugucaggauuaaaugaguuauauguacgaagagccuggaacaaugcccaucccauaggaaacacuauguaagcauuaguugucauugauauuguugcucuucugaucuaggaaggcugaaaauagaggcacaggugagcuacuacuuacaggcuaagauuggaaucagaucaacucuuucacuccuaucccugaagcuaguccugcaacuggggcuccauaugagggcuuggggagagauccuauaacccuggaagcuaggauauccaaguccuucuucugcucuagcucuuggguugguggucccuccaagacccauagacucgaagucacuucuuuuucucugggcaggguugggguggggcugguaaugggagaauuacuuucuuggucuaauaacucccuuugguagagaguuaguccugggagugugaguugggggagguugaguagagcagaggagauuaaauauccuuuauguaccagcccacacacacuugaccucaccagaggguugggaagacagagauucaaggagaggaagugaucugacaaaguucuaaagcuagaacuuggcagaguuggcaucugaacucugaucugcuugaugacaaacuuaaagcccuuccauugcugcaugcuuuuugaagggagggaugggacacaugugaacuugggccaggaccaugggguagauggaagaugggcgaagauagaguauuggagugggaaguggccaagcaggaauuuuucaaucauggaagauuucaugagaaaagagauuccacaucaggguucagaugguaggggaaugaggauaggaaguaaagaagagggagggagccaugcauugacaaggaaggagaagaaaaaagaauuuaugcaaaggcugggucagaguaauggacaugaauucgauuugccuuggguuugccuuaccauuuauugaaggcauacuauguacuagguacauacaugaucacauuugauguucacaacagcccugacaagugggcuucuuaccccuauuuccaaaagaguucauugaaguucugagagcuuaauccccgcuuuaggcuacacaguaguagcuggauuuccuggcaucagaacccucaccuaggcugccucugagcauggcuucugugucccagucucaauuuccaugaaguuucagguccuccuguucccccgcauuuguagucacucuuggugacugggaacaaagggcuagagcgugagcugaaacugagacagggaguggcaggcaggcaguggggagagaaacuuuucucacauccacccaugugaagaagauggacaaaaggguggucuuucuggagggaggcuuccaagccacuuucccaagacugcugaucuugggaugaauggcagggaccugauugggguaggggauggguggucacauuguuuucugggcuguagacuuuauuucccuuccuuugggaagagaagaggaagaggacagcucggguguggguuugagcccuggauuaagacugcccguuguccacuaaaaucucuucuuuccuugcugcacgaggguagagagacacccagcuggacacuccauuucccagcugcucuuguugccagguguagacacaggggaaugugaggcaagcauguccucaaagccugaugacauuggguaaauucuccuuuguguucucucuuucaugagcugggcagaugugccugagacagguuugaccaggcaacugaaaagacaucccuaagggaagacaaagcaaagguaugaaaggaacacacgucccugacugacuaggaggaacagagcugccugcugucuggaaccgcuuccucccagacuaagugagaaauaaacuucuguuuucuauaugcuacuguguuuuggggccuuuguguuauagcaguuuugcugucauccuuucuaauucaccuucucacaccagauauuucaaauuaaaaagauuguaucgggccaggugcaauggcuugcgccuguaaucccagcacuguguggggcugaggcaggcagaucacuugaggccaggaguucgagaccagucuggccaacauggugaaaccccaucucuacuaaaaaauacaaaaauuagcuggacacgguggcacacuccuguaaucccagcuacuugggaggcugagacaggagaauugcuugaacccaggaggcggagguugcagugaacugacaucaugccacugugcaccagucugggcuacaaaaugagauucugucucaaaauaaaaaaaugauuacaucagaucacggaauaacuauaauaauauuuauugggccagauaaguaugcgaaggacucuaugcacauuauuuaguguaaucuaugugacaauccucugagauauguguuacuauuauuccaauuuacacacgaggaaacagguucaaggaagguaaguuaugugcugagggacacacaggaggggguggagcuggauuucaagcccacugggugugcagaacugagccucuucaccaugggggcaaaucccuccugaggacggggcuggaaaagccauggagaucaucuugugcuuggacaagccucucgccagucaccacagggcccugagacucccauuccuaccuucaagaagcucagcagccuacuacucauguucauguugggucacugcauacgguuuuauuugaaggaaggaccccagaguuaaaaucauuugaaaaccccugauaaauucaguccccucccucuuuuuacaggugaggcccggagacaagauaugacuugcuuaaggucacacacuuaguuucucugucaaucuuucuaaaucgaggacgaguucucuucccgcuguaucaggcugccucaacaaacagggaaguacaaaaauagccaaauccaggaaggagggcaguggucugugucuccuccaauuauuucaugggacagccaagccuauuuccuugauuucccuugugccccuccugucggauaucugcuuugggacccaucucuuuugggcuugcagagaggacgggcugcaccaguucucuacccuccucaucacccagauggucaaacaugcaaagggaaaggagagcuggggccagagcuaaggcaggcaaagagacuccucgacccccuccagucuuuccacauuuauauuuuuggaauuucaggcucccuccucccccuagaccuuuccuaguagcccaccagggagaagaagagggaaaacugccauaaauuucuccuauuuauacaagaugacagaguuucuugugccagaaaaaacacagaaagggagcugucaagggagaagggacccagcccuauuccaucuggggucaauuuaucuuuccgaaucauggcuugggggcuacccuaacauugccuguaugaaaugcaggcuuugacuuggggcagccaggccagacagccccugagcuuugcuucugaucacaguuuuccugcuucaucucaacugccccccaccccuuacgcugucuuuuuaaaaagcaacuuucuugagguauaauucaugugucauacaauucaccauuugaaauguacaauucaaugguuuuaguauauucacaaguaugucgaaccaucaccauaguuaauuuuagaacauuuucaucaccucaaaaagaaaucuuguaaccuuuagcuaucaccucccuauccccccauauuccuucuugcccuuaacaacacuaauguacuuucagucucuguagauuucccuauucuggacuuucauaugaauggcaucauauaauaagagaccuucugugacuagcuucuuucauugagcauaguguuuucaaaguucauccauguuguagcauuuaucaguacuucauuccuuuucagggcugacuaauauuccauuguauggauauaucacacuuuguuuauccguucaccuauuggugaacauuuggguuguuuccaccuuuuggauauuaugauucucucuuuccucuuauucucuagacaucuuggauaguauccagu

SEQ ID NO: 17987 - RNA, 2710 nt, Homo sapiens
ggcgggaggggcgccucaucccuucacccucccuuuucgccaugugggggcccugagcgccgccccagaagaggucgagggaauguugugggcuggggcacaccagcacggcagaaacuggagaaagcgagagacgucgccagggacccagggaccucucccuccaguuccccgggcccgcccggcccugauggccacucacgcuauagcgcccacucuguccugggccaucccgcgccagcaguguagcccccagcccgggcgccugaaugcucucccuccggaucgcugcucggguccccacuuuggcgaccgugcccccgaguccugcuuccccggggccugcucuguaucaggcgccugcgccuucaaggguacccggcccgccugcccuccccaagagccgaguuugcgcuccucccggaaucguuugagagaaggacaaacuuuuggcaggauggaaaucuagaugagccuguccggagcagguaagcugggcccgggacgggugcgauucagcccgagaacaaucugucucuccccgucccggucucucccuccccuuaccccuguuuccccugcaggcugacauauuaaucugccuucccccgggagaaauuugggcugggguugggcuucugucagaugcauggggucagagcagcuuuccuccccgaguuuagggacuaaggugguagcuggcaggggagggggaggguugcuuccgaaacugaggauugaggggaggguuaggggccgagaaacccagagucugagggagacgacuucuuuccucaaacgcaacuugggggaacuucggaaaaguuuuuugaggggagauggagaagggagcggaguugggguuucgagggcuaaagugggagagagggugcuccgcuucccguacugaaggaaggaugugugugcuuauuccccagucgggaccgauuaccagccuagaaaaacccagccgcgucccaaacccgcucaccccagcaggcccuuagagacgcuuggagauccccagacacgccccgcggaaagggaaggaaaugccagcccgaguugccgacucugccgggacggggcgggggauccgcccagagcgguccccugcuguccugggcccuuacguugauucuaaguuaggagugaucugagagagggaauaacucccaaaaaucuuuuuuuuuuuuuucugaauccaauuugagucagagacccauuuccuugagauggagccaagcgagugcccccucccgccuccagcacaaucucccgcucuucuccaguucccaaaggagggcaaggaaaaggccccuacucuccucccagggcugagauuuccucccccacccaagagaugccccaggaggaaggaauggagagguucuucaaagggcagucaagagcagaggguggguucagaggucacagcugaacuuggggcccaggacaagggggaagggcgggcccaggccgguguagaagcugcgggguggccuggggaaguggacaagggcagaggccgcugcagguguugggggguacccuggagcccgggguguuccugggcggggagguccagccaagcggcaagggucugcgcugugccuuuaguuuuuagguugggccccuccuggggagcacccagcuggaggagccaggcaaguggcagaggacaccuuccgacuccuuggaaagggccaggaagcgaucuggauccuaggagagaaaauuccuacguggaacaugugguguucuggcccuuccuggguagacaccugcagaggccacuuggcccugccgggucagaagccacaaaucugcccaggccuuuguuuucacuauuccugaaguuuuucugcuguggcccagcaccugcccuggcaccugcucggcaucugcucauuggcaagccccggacggaguuggacuggccuagcugagagguuuaggagggcuuccgcuggcacugccaacagggaguuuggcuuggucucccaaaaaaagggccuuugagaaggacauguccaggggcagacacgaaauccacugauacgcaaaacgaauguaaacccuuuucuuuccucacaucuuguggcccuucacaccucugcaguucagaggauuuggaauggaaggccucauccauccccagucccaaagcaaacgugggagccagcuugggcgucuucuugcaggcugcuggggcuuugugugcucugagagaagaugucugguccucugccuaccccacucccccuuugaugaaugugguccuuuuugcuccugccucuccaauacuaccccucgccccacccccccacccccaacccagucccacagaucuaugggacuaucucucuuuuucucuuuccuugcuccucuuccccuuucuucuuaggauugauggacugacagcaguuuggcaaggcuucccuaagccuguaauagggagcuguggacccagcccugacuucucaaguagggggaaacagcucuauucccgggcccuugagauugagucucaaguugacaggaguugagaaagaaaugcaugaaggauggcugggcuuacgcaggacaaaaaccucuacuggggaggggccaguuuugugccuugugccuacugcugagagggaauuuagaaacaaaggaagauaagaagaaggccuagggaaacagcauaaaggacuggaaaaauuca

SEQ ID NO: 17988 - RNA, 871 nt, Homo sapiens
guugguuccuaaagaugguucccaggucaugggaggaauaggacagggaauuccagaaccaaauuucugucuaagaaagaaacaauuaucuaagaaauugugaguggaauuggacugaacguggaugagucagggcucuugaaaaagaaaguggccgucccucuuugagucaguucugcaagaguggacagaaacuuuuccagacucccaggccucucugcucccucagagcuugaaaagauuaaagucauuccuccucaaggucuucagugaaacccuggaaaucuuuccuucaauuuuaagagauuacaguucuucccauugucuagccucugucacuacuugcuguagcaugagguggcuucccugggggaaaguguaccagucccgcucauuggucgucuaagaccucccagcauuccucaagacauuucugccucaugaugucagaagaagggcugucaaauagauuuuaaaaccccaggcucggccaggcacaguggcucacgcuuguaaucccagcacuuugcgggaaucacgagagcagaagaucgagaccauccuggcuaacacgaugaaaccccaucucuaauaaaaauacaaaaaauuaacugggcauccuggcagacgccuguagucccagcuacucgggaggcuguggcaggagaauggcgugaacccggggaggcagagcuugcggugagcagagaucacacaacugcacuccagccugggcaacagagcgagacuccaucucaaaaaaaaaaaaaaaagacuuggcuccucacuuguauugugggaaucccagccuaaauuggacauguggauguugagcaauagaggacagacaaacaaaggaaucuccagaccc

SEQ ID NO: 17989 - RNA, 24423 nt, Homo sapiens
cccgccucgacacuuuuuucucccucgcccucucugcagccuucuggucuguccgcgugcgugucucucgcucuggucucuguuucuccaucucuuggggugcaugcaccucgcccuaaccucccucuccagcugcucccgcgucucacgaugccucucccguuugcucucucgcugggugucugccucucccuugcgcugccugucuguggcuucugccaucugucagcuuuugcuuuucucgcugcuguuucugccucugacuuugaccccuuguucuggccgaugcugccuccacuucucucuguaucaccguaucaucacagcuucuggcugucuuugcucccgucuucuugucucuggccuucugcauccuuccaccuucaaacccuucccuucaagccgccuugccuucuccccaugacuuagagaccccaccacaccaggcuguccgcugaguccucagccuuucuccaccugugugcccguggggaaggccugcagacugggaacagcuagaaagggccgaggaggaaaggaagggaagcuaaguuaagaagagugggagcagguggugggcuuacccuggcugggccuaggcccagcgggagacgggaggaauacauauguggugaguggaugacuggaagagacccauucuucccuacauccuuuaggagcagagcagggaggaccaccacauucggggucaggggagugguuccuuuuugggaggucugcaggagcaccagagagaugugauuccuucagggcuucaggaucuuuugagguuaggaugcagauggguauuuucugaagaacuagaguggggcacguccccccugccccgcaggagaccccccaccugagcuccugaagccagguaccugaggaagacagaggaagcaaggcgggcauuuuguuucuugugcgggaccugacuccauuguuuccucuucaguucacucccuuucuuaucccugcucaggcgccccaacauauggagcugcaguuuagcagaugcuacguggcauacagauuuccggguaagaguuucccggcuaagagaacagcgagggcaaaagcccucaugugagcaugucugguguguuggaagaacagcaaugaggcugauauggcugaagcagagaaaaucagggaagagaauaagugaugagaucuaagaggugauggggagccacaucacguagaaacuaauaaguuacaguaaaacucacacuccgaguaacaugggaagucacugcaggguuucaagcaagggagugacaugaucugccuugucuuuuuacagaaaauucuugcugcuguauugagaacagauugagaaaacaagggcagaagcagggagaccagucaggagcugauugcaguaucagguaagaggggaugagggccaggaccagggagauggcagcagaggugaugaggaguggucaaauuuuugauacauuuugcagggagagccaagggauuagugagagcguaugaaagaaagaggaguagaggauaagaccaagauuuuuuggcccgagugaccacagcaauggauuugccaucaacugauauggggaaauaccacaggaggagcugguuuugggaguaguauuaguuguggacauguuagcuuugagauaccuguuaagcauccagguagaggaggcuagcagguaaaucaauacacaagucuauagcuuuuuuuuuuuuuuuuuuuuuugagacaagacucuagcucuguugccaggcuggagugcaguggcaugaucucagcucacugcaaccuccgccucccagguucaagcaauucugccucagccuccggacuagcugggauuacaggcacgcgcugccacguccagcuaauuuuuguauuuuuaguagagacgggguuucaccauguuggccaggauagucucauuuuccugaccucgugaucugcccaccuuggccucccaaagugcugggauuacaagugugagccaccgcgcccgaccacaagucuauaguuuaauggugaaguccagacuggagauagaaauuugggaguaaucagugacacuggaugagauccccuaaagagugaaagcugauagaaagugaagguggccaggcgugguggcucacaccuguaaucccagcacuuugggaggccgaggugggccgaucaccugaggucaggaguucaagaccauccuggccaacaugcgaaacuccaucucuacugaaaaauacaaaaauuagccagaugugguggcggacgccugugaucccagcuacuugggaugcugaggcagggagaaauguuugaaccugggaggcggagguugcagcagugagccaagaucacgacucugcacuccagcaugggugacagaaugacacuucgucucaaaaaaaaaaaaaagaaagaaagaaagugaagggcauccaaugacagagucuaggcgccgcaauauuuagaaguuguagaggugcauuuaucugucaugggauuaagaaacaaaaggggccaggugcaguggcucacaccuguaaucccagcacuuugggaggcugaaguggaaggaucacuugagcccaggacuucgagaccagccugugcaacauagugagaccucugucucuacaaaaaauaaaaaguuagcugagugugguggcacgcaccuguagucccagcuacucaggaggcugaggugggaggauugcuugugccugggagauugaggcugcagugaaccaugauugugucauugcacaccagccugagugacagagugagacugucucacaaaaaaaacaaaaacuaaaaaaaguuguggagguacaaaaaaaaaaugcugagacaucucagggaggaggcuuuagggaagaggugcggggcucuuggcuugaucauucuuuuucauucccagcugcccugguggccaggcccucauuggcccauaucuagauggucccaguccacucucugggccacugcuucauuccccuccaaacaccacacaacagccacacugaccacuucaugccaugcuugcucaagaaccuacagggacuccugaagcucagcauuauggucccagagcuagggaaagagagcugcggcuagaugggaccugaaacucuuaguucaccuuuacugcuuugccgcuagggaaacugagaaacagugagcuucucuuuuugucuuuuuuuuuuuuuuuuuaagacagaguuucgcucuuguugcccaggcugaagugcaauggcgcgaucucgccggaccgcaaacucugccucccagguucaagugauucuccugccccagccucccgaguagcugggauuacaggcaugcaccaccacacccggcuaauuuuguauuuuuaguagagacgggguuucuccauguuggucaggcuggucucgaacuaccgaccucggguuaucugcccgccuuggccucccaaagugcugggauuacaggcaugagccauuguacccagcccaacagugagcuucucuaaugucgcccugccauuagguggccagggcccuaaacauagcugagugcuguuuauaucagcccacccugccuuuugaaucagcucucaacaagccacagauguacuauuaccugauuuuacugaguaccugauuuuacucacagcaugcagaauagcaguggaggacucuaaggugcccaguggaaacagaagaugcaauuuuugcccucaagaaacuugaacuaaggauucuugaaugauuuucucaucauuuuccucuaucucugcuuuccuuucuuaugacuucucaacauggacucuccucuuucccauucucugcccuagguuuuuccuuacccugacucauucuuccagaaccccuccccagaucacuuuuuuuuuuuuuuuaagccugacccacugcugacagacagaucaccuuuuauugcccuaaccuaccuaguagcucaggccccaaaccugagagucaguauccucuuuuccucucuuccccaucccucauucauaugcaaguucuauugaccuuaucauccaaauauaucccaacucugacacaucaucucacaaucuccacugguacaguccuagccaugcacuguuuaucuugccucugcugcugaccaugacagcccccuaacuggucuccccugcgugucccccuacaguccauucuccacacagcagucauguuccucugaagcccucagcacugucucuuagggcuguguguuucuugcuauuccuguguccuucaaaccaaucugucugccuuuuggucauuuccccccagaugugaccugucuucuccccucucagacccugggguggagggugcuucccucucaugggaggcaaucugacugggaguuggggugggggccauugugcuagccuagaggaagucagugagcugagcaugguugaguaugcuucugaaauggcaggaaguauuuucggggacugucuuagacucccuuuuucucauuuccaucuucccugguuccuucuguucagcauucuuccuugcucucacucuuccuucccuucuggcuuucacugacugauucucugucuuuggauuggggagaggaaagcaucccucaucagcuuuggggucuugagagauucuucagucaaauguaccccuguucccaacucaagccccuccccccaacucugggaggugggcugaaacaggccagguagggaacauucaucucauccucugcagucugcacaccuaaucugagucauucaccauuuuauccccaaugccuagcacaacucugugcacccaguagaugcuuauuaaguauuuauugaauggguaaaugaaugaaugaaugucuuaggcauucaguuucccuguuggacccuggucuggcauuucugguucuuuagaguauugcuuucaaacuuuaauguacauaaaaaucaccuggggaucuugcuaaacuggagaguuggauugaauaggucugaguugagguccaagaaugcauugguaccacgcuuccagggaugccaaugcugcuggcucugaagucacauuuugaggagcaagacuccaagaggaggguucucucaggcagaugguauccucagccuaaaucugaaaaagagaaugaugaagauugagggagacugagaaauagggagagaggaaccaaagaaagaggagguccaaggucacuaguuuaaaggccuuuaaagccccugagagguacccaggucaguggucucaggaagccuagaagcaccugcagcaucucucacaacagcaucucucucaaagaccucaccccugacuuggggagguggggcucuggagauaacugacaucuccaugucccugauuggccuccuuacuccugaugaaccccacgggucacagaaaagaaaacuuggcagagaacagguuuggaguuuucauucaauuccaugaacauuauccagacuaccugucagcacacaggugaacaggaggccugucuaguggaggcagacaucuugcaugaauaaaagaaguugggauuuaaaucuggcuuuagaggaggauggagagagcuuugauaagcauaugggggccuuggaaagugguggagaggucauuccagacaaaaugggcuggaagcaggauaguucagggcauauuccuugaacgauaaagggaccaguagcuggggugaggaggaaggauguaggaggaaaagcuguaggaguucagugugguucugcauuaaggagggcuuugcaugccuauuugaggaaucaguacuuuggugugaaugcaguuuuuuucugaaugcauuagggcaccauggacuggaguuccaugaggagagacguguaucugggagaggugcuucuggggaaggcuuugccaucuacugauuuaccugcuuauugggugggacccuucuugucggucugucuguacucccuggaggcuuggucaggcuuugaaauugaaagaguggucccuggguugugggggagcuggagugagguuuuccuguuuguuuguuuuuuguuuucccucugggaaagagcuagaguaauuuuguucaguggaaaauuuuaugagcuucuguccuaacuccaggguuuucuuuuguuuuguuuuagacuagaagccccugauaacaaacuaugccucaggcaagggagaggaaggggaaaauaaggaggccauuuuucauggugggugagcuaguaacaucauuacugguccaugcuggugaacacugggacccagcugccuaggaauguccgucaguuugauuuccacccaccacucaaucccccacccuccaggcaauuccagugucuccugaccuuggagcgggggcccuaggacauauugccaaugccagaugcuuggaggcuuuuccugcuuagauaucuccagcgcuugccagacugggugucagccuuccuaagaacuaacuuaaguuuaauaccuaugcauuucacacacaggcgugugaggguggagacuauuuuuuggcuggcugcugggaaggggcagcauuuugugauuauuugugggaggagucuggcuugcaagucugggguuuucccugacaaggauccaucucuuuccucccugugugucuccuguccccugugccugaggucacucucuuguacucauuccuccagcaggccagaaauuaugucaacagagagggcagauuuuguuucugugggagagugugggagauuauuuucauuugauuuauuacagugccugaugauccucaugcugaugugcuaacaagcaggagaagccaggagcagcccucacagcaucacacggagggcuagaccaagacuggcuggcagggacuuagucccaaauggcaauuuaggagugggaagggggcugaaagggcuuggggacagggcuaucacugacaucucagacucaguuucucaguucugggagggggacuagcacugggacaacuucaugugggccguucuucuuccuguguccuauggccucugacauuuauuuaucuauuuauuuaugugacacagucucgcucuguugcacaggcuggaguacaauggcgugaucuaggcucacugcaaccucugccucccagguucaagcaauucuccugccucagccucccgaguagcugggaucacaggcucccgccaccacguccagauaauuuuuguauuuuuaguacagacaggguuucaccauguuggccaggcuggucucgaacuccugaccucaugauccacccaccucagccucccaaagggcugggauuacaggcgugagccacugcgcuccaccgggcuccaacuuuuauauuccucacugcucugaagcucuuuuagcucagaguccuuucaaauguucuguggcaaaugugaccaggacauuucaggcaaaaucuucucacacuuguagagugaauagaaaauuccagguccucaauguugaucaugucuuugaugcaugacuaauaguaggugcucaguuuauuucugguguaggcgaagaggcuuuuaagcuacuaccugguuucaucuaggaagcugagggcuaaguuuuggguuccucugcaguaacuguccauucuuggguuucuuuucccaggacauuuuaaaauccucacuucuuuaucuguucuuguucuuucauggguguuucgaugguucuguuauaucugucuuuuuaauuuuauuuauuuauuuauuuacaaacagugucuuacucuguugcccaggcuacaguguaguggcaugaucauagcucacugcagccucaaacuccugggcucaaggggucuucccacuuuaguuucccuaguagcugugauuauaguccugcaucagcaugccuggcuaauuuuuaaacuuuuuguaaagauggugucucacuauauucccuaggcuggucuggaacuccugggcugaagcuauccucuugccuuggccucccuaaauguuggaauuacagacaugggccacuacaccuggcgaucugugucuuauacgguaggccaucucagaucuuuuuagaaggaauguggguaaaagugcucugaagacauuguuguauuucacuucagcugcuguaugauuuuuucagggguugcuaccugacaacuggccccaaaacgaagggucugcugaucaugugcagucacaccagguccugcuggugguuggagggguugccaugagagugaacagaaagcuaacuugaaguuuauugaggcagcaugauuggaaagggaauuaagggaggacaugagaagaugagagaauagaaagagcuuggcaagggaagacaggaggagagaucagaggaacaaagagggagggguguaggauggaagguacuuaccaucguaggccucagcuugucaucuguaaaacgggaauaauaggguuguugucaggagcaagacaguuaauacaugugacauucuuagcagaaugauauaauuguuugaugauaauaaacaggguaauacugccuccgucacaaggguuguuaugagaccggggcauguaaaacacuuugcaggcugcaaaaugcucauguuuucacugcuacuauuauuauuccacucuugcacuucuuucagccacuguccugucuucaugcggaugaagggggagcugccagaaggagguguggaccccuggguucuguucugcuuuggggacuguuuccuuccuccccuccucacccccuggugaacagaguccaagccccucccccucccccgcuggcuuguaugcccucaggcucaguggagagaaaguagaggcuggcaggaggggcgcaggagggaggccagggggaagccaagcugaaaaugaaagcuggggagggggcagcggagcgcgccuggaaucauguuugcauaacgagcugugcuggcucuggcuugcuguuuuuccagacagggcucucccuccuuugucucucagcuggugcuccagucucuuuccuucuuuuuuuucuccuggccacugccccucauuuacuuugccccucaguacucccugcagccaccuggacuccagucuuccccuuccguuucccugacuucugcucugaggcucugcucauuuauaccuuuguuucccccauccccaucucccucgugugccccccuucucugccauccauuucugccccaguggguuccccucugucucucuccccaguucucccuucuccaucucuguggcauccccuuuacucucuuucuggcuggaagucccccaucuuuucucuuccugccuguuucugucuugcucuugcauuccugggucucuuucuucuuacuaaccccuucugccucccgggucaggcuucaccuccugccuuccuccccuucucuugccuucccucucugacaaagcacuuuccugucaguuauacugcuuggauucagggcacuuagcaccuagauucagggcccacugugaagcccuccuuuguucacuugaugaaauaauugcaguaacaagacuaaaauuuaaugaacacuuacuaaacgccuuaucuguguaugaucucauguacuucucucaauaauacuaugagaugaauauuauuauccccauuuuacagaugaggaaaguugagagauuaaauaacuugcugaauaacucacaguuaaucagaauuggggcuugaaugcaggccugcuugccuaaggagccugugcucuuaaccacaggggucgauuccagcccuggaagaagcuggucucacuuucucucccagugagacuaacauagcccuccuccuuucuuuaaacaucaucuuggcgcccccagcuuccuccaaaggucauuuggucccuucucuuuucucugcacaaguccagauucaaccuagucucaagacuuuauuuuauaugacagugcuacuaacgauacauugccuggcacuaaucuaagcacuuuaugcauauuauuuuauuuaaucaucuuaguaacugugggaaguagcuacuauucucacccccauuuuacagaugaagaaacugaggcauagggaagucaaauaacaugucaguggucacauaguuaauaaguggcagagccaggauugagcccaggcacuuuggcuucagggaaccuggccuaacagccacacugcuucacaguuccugggaaaacagguuuuggucccucaccucuuguuacuaguccaggugcuuugagcaguucuugugguccauccucaagcccauuucugugggcacugccugcugcgguguaaagucugccaccagcacugacagcccucaagaucugguaggccacuugcccuaaucggugccugaggggauuuauugguggcugcccccagggaguggggacaaguguuuuccucuccagcucugcugugcagccuccuagcccgacagcucccucguuccggcccaucgcagcagcugauuuaccucuauggcugggggauuuagcugcuggccuggcuccuacuauaaaucccugggcaaauaaccaagcucugcaucaaagcugccaacaggggagugagcaggagcagauggucacuuuggccaugggguggggagggcaggggcaguggcuccagggcuuucuuguccaccccuguccacagagccaggcugcaccuuguucaugcccaugggguugccacucaacuuucagaggauuugacggccccauccuggcaucucccgaugcugagugccggcagguucugguuaauguucagucuuauaccugcuacuccauuugaagucucuuugcuugacaucacuagagaaggagagaacugacuaccauacuggguuuuaucacccuuccaagagccgagcuuugggugguuuucuggaaacccaucccauacaugugggauguagguagguucuguccuccugagagaggcucagacugaagcaggaauuaagaacuucucaguggaaaggaaugaaagaccuagaauguaggugaccuagagcggaggcugagugaaaccuccaaaaaguaggccaaagucaggguggaagaacccugaaggauaaagguacucccuaaaagugagacuuguggaagcugugguuggaacccucaaaccuuccauguguggcccuggcucaggaauaugauaugacugcagggguccacacuggaucugggggugcagugggacuggaggggucauuguucuaucaguguuccuugcuucucuggcuuccuccccucuuucucugacuccuuugguggcuucucccugccacucccugccuguccccugcucccuucucuuugccauguucuccccuguggugcugucacuugcugguagccagaaagcacuuccugcacucaacugaccagccugcgguggugggauugggcuguagcucagggcucugguucugcuccccagaaccuugcucagccuggagccuguccccagugucugugccauuuuguucuuaugcuccucauuuaucuuuccugucccccucccccuaccacugccgccuccgccugggagauuacagucacugaaucagcagccagcuccagaguucugcugacaggggacuuucugccucugagggcuccuuggugggaucagggucccuccugaggcccagggauuugggguaggggaagagaagggcuggaaagaagaacagguggauguagagggacagaugaaggcaaaagguaaaggagagaggcgggaauauggagagagaaagggagagaugaacagaauuagaagaaaauauaggcaaagauggaagaacagugggagaaguggagagagaagcagaggcuggggagaugggaaagaguacaagaggaggggugugggaauuagguagggcaaacucuguugagcauccugcaaguccaggcccagcccugcccucugcccuccccuggugccuggggaaggccccuuggaggcccaaguucacugggacccagcugagagguacaggcuggggccuguuggcccuuggucuggggcucugccuuguaccucccucucuccuccucacguggugguuuguacuucaucuuguuugcggggcggcugggccugcucucgggguuuaaugaucugugccauuauuuauagcuuugcgcgccgagaaacacacugaauuuauugcuugcuucuauaaauaacccuggcaaacgggugcccagggaggagggcgggagggggagggagaagcgaagaaaggagagguuggggguagggcaagggaggacucuguggacucuguccccaaaauggggugacgaugugcacaaggacaguggaggcuggugggacucuuucaucgugggugugugucuaaggacacguuaauauaacaggacagugugugcccugugaggggagagggaguguuugcauguuucugagggcaugcaugaguugacuguguguuacuguuuguguuugucuccggugccacgcugguggcggugagguugaaaaagcacaaggcagccuccagccacggcuggucucgaaauggauguccagcagggcugagagacaaguguugggggugcggcuugacuagagucgggauucuuucucuaagguugggguaacagaaaaggucacagugagacuacuuuucuggauguucgaugguagaggugauaaaaggaagaaaugaggccuuggggggcaggggccagggccaccuguuccaggauccagagagaccuucacuuuugggcuucguggaaggagaggugguggauggagagagggguggggugugugguuggccguagcacuccuccuacgacccuccuggcaaguccugucccagaaugggagugggggcucugcgcaggccagccugcccaggcagagccaagggccuggugcuguggccugcagauugcaccaugccugccuauagcaggccuucccccuggccagggcucuucccuaccccuccucaggacugcccaggguagcaggucuugaggaauggaaacucuggcacggcccagccacagggcugugguccugccuccucucucucccuuagcccaccacacagaaccugcugcagcagcagcgauuagcucugggaagugcugugcaucucuaaugagggcauuugcauauauaacgaagaaccuucacagguguuggcagagccaccccuccucuuuucucuuucuucuuuccugccagcugccaucuuugaccuguggcuguuggggugggggggucccugcccauucagcugggagaugugcugugcugaaggaucccaggcacaggugaguuucaggggcuccccucucugggucagaaacugucaaggugaaagcccauugugucagugugcauggacaggcccagcaaccuguguacaugugugaacaugagccugugcacacacaaagaaggcacaaggucaacacgcccaucugugcccaagugcacugcagugugguaauguacccuggucagugcaaguaugcaaaacacgucccaggcugcgcccuggcugaugcuccgaugcgcagugcacacggcugccagcacaugcuccuucacacucacauccuggcacuagugcagacaauuagacaaaaaugcaccugcaccgacacuuccuccauccacacagggcccccucccucccuccuuuccuuucucccucauggaaucaucagcccuuauucaggccaggaaacuaccucccacauccuacuuagaccuaugaaguacacaagagaccauuuuccuuuuaaaaaugaauaugaggggcccuuacacauagauaaaugacauugaaggggaagagaaaaugccagggccagaguggcagguaggaccucaguugggaacugggggcagguggagagauuucuggggaggagaagcgccaggggugcugaaguccccacaaggucauucucagguuguccccgacagcccugacucuccugcugcagaccagccaauccccagcccgaggccuccccacacucuccuguugguccggccgagccacgugacccucccgcucuguggcagcugcuuggaugauggaugcagcugcucagcucuaccuguugggggacggacugcacagcuccuaauuaccuccuucuucagugagggcugagggcugggggcucgacgccgggcuguuaugagaccccucuccuccgcuggggcuggggcuggggcuggggcugacaaccugaacuacagccaggcuuggaggcaggcagcauucccugaacugcccuagggugaggagggugugggggcacuaaccugggguguggagugcgaggagugcuucuggaagguugacagagggagaaagugcaucauaagugacuugggaaacugggauaggauauuaaaugaaugaccuuucuccaaggccaucccacagagggcaagauucagguuaaauaucaaggcaaacuuccuggcagccagggauaagugcacuugagcaaaagacagaaagguggagauagagguuuggaaagcuuuuuauaagaugaaucagaucaucauuuuccugucugguggguggcucguggcaaauagcugcagaaguaggcuggaguuagaguaggagggcuggagguagaacuuggaaugauuuguuggagcgguggguugggugacacugaacuggacgcuugaggagguugugacacaucagugugggaggcuccaggucuggccuggcuuggggagggaugaggaagaccccaggauuguaaagaugauggaacuccuccagacuucuccccgggggcacugagguguuagggggcagaggcauguauucaacaacaccccagugcaaugggaugccuggugggugugagugccccuggcuggaggcaggcaaacaggugguuugggaaugggaccacuacaagauuucuucugauucugagauccuaggaaucccaaaauuaggauucugcagguuucaagaagggaaaguagggaaggguugggcacagagcuggugaguagcaccaggcauuuuggcugccagcccccuucuccuggugguaggggcuaugaugauguggcuaugauaauugcuauccuuauuaaaugauauugcaacucacaguaaugacaacuccaccaggauucauugcucauaguccucccauuuugggggaucucuuggcugaggaagagggggaaggggaccuugagucccuuuccacccccggucccaaaaggaggacaaaauaaaccaguuguccagguaagcagaccuugaggggucagucaguguggauagagaggaagggaguuggggggaaggcagcaggaaggcuccucauguuccagugaguccuuuuuuuuuuuugagauggauucucacucugucgcccaggcuggagugcaguggcccaaucucggcucacugcaacuucugccuccuggguucaagugauucuccugccucagcuuccugaguagcugagauuacagccugccaccacgcccagcuaauuuucguauuuuuaguagagaugggauuucaucauguuggccaggauggucucaaacucccgaccucaggugauccgcucaccucagccucccaaaguacugggauuacaggcaugaaccacugcacccagcuccaguaaguccuuuucugaaugguccccugccaaucuuuauuugucucccagggcauuuuucccaaucacccccaccccuggguuuacguggauugcaaauuguugggcuguccucagcagcagugcccccucauucccccccaccugacuccucacuguccuccuaagcucaucaggcugugggguggacccucccucacccuuguccuuuauagugcccugggugcccuucucuauuggcaugagucuugagggaaaagguuagguaagagguugcuuacugugcucccuggugugugugcgcgugucucugcuucuaggacaguuucuucaugugcgugcugggguucaggguacacagacuguguggggaggcagcuaugcuuuugcccauucagggugguuaugaaagggagacagaagggguggggaucuggugauccaucaucuccccaccagggcagacuggagcaguuuugugaaaccaggcuuuccuggucuuagcacuacacuugugugugugcguacacacacauacacacacacucacaccacagucaccccaagaggcaacccacagaugcauugacaugcuugaugccucagguuuuuuccaaggaagucugcccuguaagcugcucccuaauuuauuacccuacuuuauuagaguaaauuuccuaguaagucccuuugcauggaucccccgucaccccagacagaaaccuuccauaacuccccagugcccauggagugaagcucaggcccucuagccggcacucagguucuucucuggucugucuauucccaaccugccuuuccagccuugucucccauaauccuccagcaggagugucuuccccaagaggacuauuccugugcacuuacauuuccucccgccuggaucaccagagcgagugcccuccucccacucacaccucuaaucauuuuuuaggcccacccccuccagguggccuuuuugacuuccccagcuuagagcaacuucuuucuuagcaugugguccuuggcaucuggaggaugucuuucuacaggcugggucgggggagccugucuccucacuucugagccucucaaggcagggccuguacucauucaucuuuauuucccuggugccuaauauggugucugacaucuguguauguaaauaguugagaaccuggcucuaggaaagagcagccuucugaauugguuuaagucccugcccugauucuucuggcucugugacccuaagcaagcagcuucccuucucugggcaucaguucccuaauugcaccauggggagguuggaccuccuuacucugagauucuguuuuugugguggugagaauggagacuaucagccagauguaaauagaugcauagguagccccuuacaacacagcaggugaggaggcuggggggugguaacuagauaaauggccaggcccauuugaucuguagcccaugugaucugggcuacuuccuuugccucuugcacccucuauuuauugauaugaaaaaugggauugacguuacaagauuccuuuggacuuuagguaggcagaagcuuaauucacacacaguacacagaaggacuuauuuggagaauugugucuggggccccucucccuucucauuucuucccuaauggucucugcucuguuucuuuuccucuugauaauugccugggagaaccuguacucaccucccuucacaucagccccaguggcuugguaucaggccugagugcagucccugacugguagucuacgggugggucugggcugcagaaugccucagugagccuccaggcagcuccucugguggagucuccuuugcaaauguuguugcugcuucaggaaccacaggauuucccaccaccccagauucccauauuccugacuccucugccucccacacauccugccuucuaucugacccugaccuugggggucucucccagccugagaaaugucccacuugccucauuacccuucccugggaauacugaggcuggaauuguccguggaggccaggaaaguuccucagaaauguaaggaaggggguggggucuugagugaggggagaccccuauucuacauuaugaccucuggcucacccccacuucccaagucacccuugggagagcacuggaugcaggccucagaguguacccccaaacccaugucccagucuccauaaggccuuagaggugggagauuuucuuugcagggagccgaaggggaacugguguauguucaaggugccccagggucccagcuucccagccccugcccacugugugaucuccaaggaccuugcauccagccucaggaaagccgcucuguuuacagugugagagguuuguucccacugaugccacucagccuagagcucuggagggaagaggggaaggacugugggaaaaucgaggggggaaaccacaugaacuuuggaaggagguggaguuggugacuuuuccccuccuuggagcagcugggaggucuagcaaaauuuagcccuuucuccuagggaagaaggaccccagaaaacaagugaagaaaccaagugggggaaauugauggcagggaaggaucagcaguuugcugggggcgguaguuggcgggagggaagagcuagagagauccaaaccagagaguacaagucaagacucauugagugugauuuggcugcaaauacacagcaucugggucauugcaagggugagggcccuagaggcuggggcugagucacauguuucauuuuuaccacugagacuggccuuugcuugcaggaggcccagagagggaaaauauuugggcaaggucacacagcacuugccucaaucagaggccggccuggcuuucucuugcucuuauuuuucagccacucuugaccugaccuaaaaaauauauauauucuccagucuguacaaucucccaugcucccucuucccccuaaauaguuacgugugaacuuugaccugggaauucgcuucgaggggagcacuuugggaaaacaugauaaagccucguaaagaacuccaacagcuugcaaauagccugugcuaaauugccccuucaagugacaacuaaagcaaaugucuguuuuauggccauguuuucuugggcugcaacuauggcaggagugcaggcagcucagaacugggaagcagagagaagguggaggcacaucaggugugggaucccuggacagguagaacaagcugcuccgcagaggcccucuggaccguucuucugcaucccugccucuuccaccccuuuucuguauagagagggugucaagauaauccuguccccaggaagcccuucuuaaggccucuccucuucucccaguguggcuuuggagaguucuuggucuucugggggcaccagccuccuagagugccagugguggaagcccugacaucaccccggccaaggucuugaccuggggucugugaccucccaggguuucucugacaggccucugagguuguugcugggguagaggggcucuagaccaucccacccccugcucuugcaguuuucuccagaucuaguccacuuuugcauagugcgauucuaagugaggauuguuugaaaagaaguucuaaggcaauaauaauaauacaauaauaauaguaauaauaaugaugaugacaaaaaaggaaacuccugaucuacucuaaucccuucacugcacaauugaagaaacuaaggcccagagaggaccucuugggggaagacccuugguuggaugaaaggaagucugggaagagaagcucugauucugacccaagucacuucccuucucugguccucagcuuccucauggguaaagccagaugagcagauucccugaacuucaaagguucuugucaggccugugaacccuaaguaaauaaguacguaauaaugacaacaauagcccguguuuuuugaccccagggaugugccagguccuaagugcuaugcauuuucuuuuuuuuuuugagauggagucucacucugucgcccaggcuggaaugcaguggugugaucucagcucacugcaaccucggccuccucgauucaagugauucuccugccucagucucccaaguagcagggauugcagguaugucccaccaugccuggcuaauuuuuauauuuuuaguagagacaggauuucaucauguuggccagacuguucucaaacuccuggccucaagugauccaccugccuuggccucccaaaguguugggauuacaggcgugagccacugugcuuggccgcuaugcauuuuccaugggccaucccauuuaagacucaauaacuuuaugaacuaucguuauucccaugaggaaacuaaggcacagagagguuaaauaacuuggcugagguccuuaaauggcaaaggcagaauuugaacccuggcagucccucuccagggcuugggcccucaguuacuacucauguaaggggacugggacccagcccugcugaccugugagccagugcuccuuccacuguaccaggccaccugucuagcaagggcggugcuggucucaggcucucuggaggcugcuggggucugcuguacucagugcugggaagccuaaugcucagugcacaccuugcagaaggggcuuuggggcagaacaggauuucuuuuuuuuuuuuucaaugaguuuccugagcgucaaagaacagggcuucuugaaggaggccucaaaggcugagaagagcuucuaugggacuccaggaagcugugaagauucagggcagccaugauacaauaguauauaaaauucccucccugccccucacccaguggccugccaccuaggaaacccugcaacaggcagccagacuggcccagccugcaaaaccuuucagugaccacacacacacacacacacacacacacacacacacacacacacacacacacacacacacacacacagugucccuucuaacuucuaaccuggcuaucccagccucuucucugaagcuucacugcuagaacuugagaucuggcuuccuccucagaagacaauuuauggcaacaugucgaagacucuguuuuaaugaaguugcaaaaguagguuaaugggcuguggguguuuuucguuccccucccccugccccaucuccaccccuggguggaugaaugaugccucucccggcaagaugcaaagucaggcugaggaucucgggccuggacucaagcucacaucccuuccuuggcccucugcucagcuccucagcaccacugcucucugccacugggaaggugcucaaaaugucuagccccaaucccuccugcuguagcugugguccagaaggugcuccagggucugcccagaggggaggagcauggcauauuugaguagugggucuggggcaaggacugaggcaggggugggacucugaggaagaaguaaaaugcuagggaauggauuucuuuuggauuggagaggcggggagguagaagcucagcuagcauggacccagagaacucugaagcuggugcuaguauucuggaugaggacugaguuucuggaagccucuccaguugcugucccugccuguguaauucaucuguguguuuccugguaccaugcugauguagagcugcucucucgauuguuugcuaagugaaugauggauacaagagugaaugacucuucuuucccuacgccaagucucuggggcuaaacuacccucauccuuccucaccucugcaccuucccucagcuguugcuacuuggaacccucucccuucucagacucugcccaauccuggcucuacacuucugucucuuggggaguuuuucaugauuaagcugcaagaagaguucucuauucacuuggguccaagauuagggucugucaucccuguaaguucaggguccccagggagaagggucuaugucguuuuccuccggacucugcccugccccagcaacacccagggcagggcuccaagacugaggugggagcucugggcucaguuauuguuggggacauacacccaggaggaccauacugcugcccaggaccaggccugguccuuccucccuacagaaagcccggggcuugcacagcaucucgccugucaucacuccaggggagcaagcagccuucuucauucccagacccucacugccaacaaaggaggcuguuggccaggguuugggacuugaauaccaagaugggguagagcagagccuugcugcucugcaacuucaaauuauccccuccucuaggaagcugggucaccuccguccuucccccuccaaacucccuagcuuucuuuuacagccuuaucucccucccuuccucugggccagguaguagcacaggccuguggccuuuuggaguaacccuauaaaaaccccagagcaacccuagugugaagcccagaaaaccccaccauaaucuccagggcaacuccacaguuguacuccaaacucuaugacagcauccaaaaucuacaguaacaccccaaaucccuauagucacauccagaacuacucagcccaggcagugccacagagccaccccaaacauggcacaagaagcucaacacaggccccuucaggagcagcuaagccuucuaagcugaucuucuagcugacccagaaaggggggucuuccuggagacuccaaagcccucacuggaccuugcuccccacugagcuuugaugugguagagggaggggugggugcccagggcauggacaugaagguuuccccucaccugaggugcugagggaagaagucugggggaggacaagccagauugucccuggagggucagggaaacccagaggcaaugguagucucauaccugaaaugggaauccguggggcuucuguggaaauuucuguggaugaagaggagacaggacucccggguucccauggucacacgcacaugcuuuacagaucuguuuugggucugagucuucagggggcgugggaggugguguggagacaauggguaugguggggguuaguaguuggcaguucagagggaggagacgcaggccuguuccccuaguccgaugagagagaagagagucacaccaggaccugauuuaggaauugcuggaggggcuuguugagugcaggaagaaaccaagaaaaggggagccaaggguuucaaaucaggagggcuucacggaggagaagaauaggcaggagguuggaaaacaaggggccaggcgugguggcucaugccuguaaucccagcacuuugggaggcugagguggguggaucaccugaggucaggaguucgagaccagccugaccaacauggagaaacccuaaaauacuuggaagggaggcucccacccucucugccccugccccuggcagcaccacccccaauuugagcagggcuugguccccagagccuggggguggguguaucuacugaaaauacaaaauuggccaggcguggugcacaccuguaaucccagcuacucaggaggcugaggcagcaggagaaucgcuugaacccuggaggcagagguugcggugagccaagaucgugccauugcacuccagccugggcaacaagagugaaacuccgucucaauaauaauaauaauaauaaaaagaagggaggaacagagcugggaaggucccugccaggggugggggcgggggcgcucuguggcuuucgaaggguugagggcugguuucaggccaggcugaguucaaccuguggagucaccagacauuggcaucucuggguguaaaauccugagacgggaagaggaugaauguggaaucaggaggccgagggaccgcaggcuccacccuuggcuuuugaccucagguaauucccacacacuucuagugucaucguucuccagucuguagagagggaauaacaacauccagcauucuugaauuuuuaaaaagcuucucuagcaggugagaaaacuacuugggagaaagcuauuuggcccacgauuuaguagauguaaacggugccagccccucuguggugcaugagaugucaaguucuaaguucccagcucugccaccagacaguccuuuuuucaggccucaguuuccccaucuguaaaacaaggggaguugcacuuguucauuucuuggggccccuccuccaucugguaucuguucaauaauuuucaagguucuuacaaugauaauaaaugccaacaagcuuuguccaaguguaaagugugcuucugaugugaggggcugaagggcucccuggaugcagagaaaggugcuuugagcugggccguggcccacagucuauccuaggcuuggaccccuggaaggaaaaugcagagagcccugcucaaguuuaucccacccccuucccagagcugugcccaugccagcaauauucugcucccccuucccagccaacccccaggcucuggggaccaagcccugcucaaauuggggguggggcucccaguggcaggggcagagagggugggagccucucuuccaaguggcuccgagcuggagcacagcaauuacgcgggaggauuuaugucccuuugccuuuaaucggaaacuccaugucaagaagaaaaaucugcacuguccuccggcccggcuuccugcuuuaucauuauuauuggaggaagguugauuuggaaacuuaaagaaaagugggguugggggugggagccacuggggaaggagagguguggggcacaaggauggccuuccu

SEQ ID NO: 17990 - RNA, 12267 nt, Homo sapiens
cgggaagcugguugcauaacucagugggguguuuggcaacauugcuuguggcuugaccugcugcugcuggugguguacacacacguuaugagggugaggguagggguggguugaccaggugugacaagaagugaaucuuuuagggaguggguuagcagcauacguggagaaugauaaaauaguaaagauauguggccgugguuuucuccguaucguauucugucucugcuaccuuugaugaagugggagaaucuugaggauaggaaaaccuuagacaucccugcuuuaccaagucuuaggcacuauccaacccauucaggcuggcuccuaauguuuugcaauuuguaaaucaaacaaaggagacuuaagguagaaagguguuuggucuggauuucaggaaucugagaggaaggggcuaaaggaaccauccccuccuuugagggcuguaaaggguguucugccuccagaacacagccugagaaccacagugaaguccucuuuuucuguaggagaggagugagggugagaugggagagacaucuccaccuagccagucaccuuauugaaggaaggcugucucuucacuuagaacacccuacuugacuaugucugucccuucaaauaaguaguagaugaccucaaacacuucuaugaaucccuacuauuuauaggauaaaguacacucucccuagauugacucucaagacauuguauaauuuagccccugucaaauuuuccaggcuuaucuucuccuacuucccaucccauaccccaaccuagcaaacccaaaguauugcucuguauuuuaugccuccaugccuucacaucuuugcuuggaauacucuuuuccacuucucugccugggaaauuccuaguuuuucuccacagccuaacuuaauugucaccuccucuguaaagccuuccuugaauuucacugggcagaauuuauuuccucuucuucuccauagcacuguauauacaccuuuauuuuuuuaauucaaauuuuuuuuuuuuuucuagauagagucuugcucugucgcccaggcuggagugcaguggcacgaucucagcucacugcaaccuccaccuccuggguucaagugauucuccugccucagccuccugaguagcuggaauuacaggcacaugccaccacgccuggcuaauuuuuguauuuuuaguagagaagggguuucaccauguuggucagacuggucucgaacgcccgaccucaggugaucugccagccucagccucccaaaguguugggauuacaggcaugagccaccgugccuggccuauuuuauuuuauuuuauuauauacaccuuauuaauguaauucccugacuagacuugacugaagauacagacugucuugcucaucuuuguguuccugggauguaaaacauaguagacacucaauaaauauuuguugaaugaaugaaugaugagccuuguguuacccauaauugucuaugcaacaccaguauccugaacugauaauucuuauucaauaaauguuuguugacuaucuauaaccugauaucauuauauagucagccacaagugugacuguuaccauucuucauccccucugaguggcccaaauaaauaugcaaaugagagaauuauaucugagagccuacauaugugacccagauucaugcccaagucugaagagauucugaacccacauguaacauguaaugaaggcauuggauugccuccugucuuaccuugaucaugcaugugcagucaugaucuacuggaaaagggauggaauucaaagcauuuaaccauagguuuggcaugggcauuggccaauuccagcagaagcaggcagcacaggaggcuccuuaugguaccagcauugccucuuuacuuccaugguuguguugcuggguuguuggggaucuuagaggagaacuaggcuauugguggagucgugggggacacuuagagggcucacagcagcugccuuuuaucaacuaggacugaacauuuucauuauuuuaacagcaaauacaaucccaucagagcaugcugguugaaugccaguccuacuccagaguggcaccuaucugcuuccccagucuucagauguuucuaauuuaacuugaacauuguaagaagaaaaaauguaagcugcagaugucaggauugaagcuagacauauagagcugaaagccauuacaaauuaggaggaagaaaggcucuuuucucacagucuguggagaaagauguuugaccuggggcuuuggugguguagcuugcaggcaaaaagaugaauaagugggcugggugagguggcucaugccuguaaucccagcacuuugggaggccaagaggggaggauugcuugagcccaagaauucaauaccagccaaggcaauauagugagacaccacuucuaccaaaaaaaaaaaaaaaaaaaaaaauuagcugggcaugguugcacugacccauagaaccagcuacuugggaggcugaggugggaggauugcuuaagccugggaguuugagacuguagugaaacauguucacaccacugcacuccagccugggagacagagugagccccucucuggaaaaaaaaaaaaaaaaagaugaauaaggguacuuacuggccuaacagaguugggugccauguggcuggggugcuuugccugggagaaaggaggacaaaggacaccugggguccccuuuacgggaggugaauaaucucccugcuggguggccccccaccuaacucccuucacacacugacaaaaaccuggccaagaaagaauccuuuguccugggacuucugaggcugaggggggaggggagaaggcuacaggugaaaggacacaucaaagcagucaguugccccuccuccuccaaauaguuccccugcccuuguucccagagcccagguuuucuguaaaugaaggcuauacccuaaacguccaacugccuagacagcugggaagcuagacaccugguccuuaccuucagcugccuuccaccuugauaugacucaguuucccugucccuaggagagccguggggacacaaggcgacgacaaccuguauaaaguuuaaaggucacauucgaguggaccaucagguuggaauucgucaaaugcaugggagaaacgcagaccuggcuggacuccugggcugaaaaggagggcugggagaggcuuggagccaugugugcccccgcuggccaggagcaaggugggggcggggugugggcagaaaccacaucgggcucaaguuuccucucuuggccgaaaggggcaggaggagaggagagccacggggaaaggggaggguuggaggaaggacugagaacucaggccgagggcuucagacgcuggugcgccugcuuggggcuccugugcucagcucagccugagcuuccacacucagcgcucagcaauggcccgggggcggggcgcgguccucgcagauucucaaagguagccgggauccucguccagcagugucagcucaggcucagccuccccagagacaacaccgggagccucaucucucuccucacccugcugugacuccaccacaggugccugaaaggcaggguguguguggggggggcggauuccagugagauccgaggggcaggcuggggggugaaggaggugaggggggaaaauaaccaacuuucgguauccuaggagaccucagacuuucuagauugccccugguuuaggaaucugacauauuugggaacuccucuaggagaagaccuaagugguuucuugggugcucugggauccuugggguggaggcugugaauggggaucagagaggggucuccagaggcaaggcaccgcugaggggcuggggaguagccaggaggaauccuucaacuggugggcuacccugagggaaccaauagacuacccuuuccccaacuccauuccauuacucugcccugucuaggcagcugagaagguuuagggaaagcugaggaauuggaaacacuggauaucugaaccucugagaaguguugcaaggugcggggguuggaugggagauugccucuggguuguuggcuccuuugcccuuucucuucucugugcccaggggcaguagagaucagcuggaccuggagggagaaggaagacaucccaaccccagcauaguugcuucuaacuggaacucuuggcugcuugggaaauaggggcuugggaagcaguggaagagaagagaggagguaucagaacugcuggggcugggauccccuagacaucgguaccaaaggacuggaguuugggguccagggaugaagugacacaauagcagaaacucgucccccucuucuuuguucucacacauuuguuugagucaugcaugucccuagggcacugagcucacuaugcuuaaaucucucucccuccuuuuuuuccccuucauucugucucaucucugugugucucucucucuucgggaguucucccuaaucuuucuaaauagguugcuuaccgguuaaccaauaccccaaguuuuacuaaucccuccucauccuuucacugcaccuauugacaccuggagaggugagguggucaaauaagccucagaaaagggauccugaggcaagcccccucucaucguucccccucguuaaggaaguuaagagcccuggggcagcagcuaaggccaaauguauuccucucuccaucaucccucuccgaauaguccucacucuguauuccuaaucaugaagcuccguaucauucugugaguacuuagggauuaugauaaaaaucuuucuggguaggaccaccaggcuaagaguaaggaggauggacuuuagucccuggugacaaccccauuucuaccuaauccauaauguuggggaguaagagaaggaacagacaacccagugggaguaagaugguggugugaccccaaaaugcaaaagcuaaacuguaaagugggagcuucuuauuguaaaagaaagggaacacagggaagcccacuucacuuucccaguaucuccccaguuucuauacccucuaugguguucuauuugauccaauucuaucuaucucccugaucuaucccacugccugccagcucugcuguccucugaaagguaggcucuggaaacccagagggacccuaugccugguguauagaacaccauccauccuugagcgucuagggaaaagcauccugcuccaccugccaccugguacaaacuugcuacugcacccaagagcugguuggaauggauccagagguucuccucaacucucucucccccaaacuccugccuccccuugcuccccuucuuuuuuuuuuuuuuugagacagagucuuacucuguugcccaggcuggaguguaguggcaugaucucagcucaccguaaccucuaccgcccagguucaagcaauucucaugccucaaccgccugaguagcugggauuacaggugugcgccaccagaccuggcuaauuuuuguauuuuuaguagagaugggguuuugccauguuggccaggcuggucucaaauuccugaccucaggugauccacccaccucagccucccaaagugcugggauuacaggugugagccaccacaccuggccacugaggcacuuuuaaaaugcugauuccuggguuuauggauucaauucaguagauuugaaguggcuuuuaggaaucugugucuuuacauguagcccaggugaauguggcacacaaugaaguuugugacucccugagcuagaugcaaccuauggccuuuaauagcaauuagguuccuaguccugucuccauuuaauggaagggacugaaugagaagcaauuugcccacggucauguaucuuuuuuuuuuuuuuuuuuuuuuugauguggaguuucacucuuguugcccaggcuggagugcaauggcaugaucuuggcucaccacaaccuccgccuccuggguucaagcgauucucccaccucauccccccaaguagcugggauuacaggcaugcgccaccaugcccggcuaauuuuguauuuauaguagagacaagguuucuccauguuggucaggcuggucuugaacucccgaccucagguaauccucccaucuuggccucccaaagugcugggauuacaggcgugagccaccgugcguagcaaggucuuguaucuuaagugccagagaaccuaggucucuggccuccuagggcaggaucuuuguacugcaccuuagagucagauccaagaagauaaaaggagagacaaauggggggauuggggugaguaaagaacugugaagcaagagucauugucucugccuccuaaaccccuucuccauucacuuugccuuugggcaauuuccgccagaaccuggguggaggagggugggguuccgguguugaaauggcauccuggacagacauaaacaccccacccacucugcccacuggcagaguugccuacaccaacucccaucucuggggauggcaguaaaacaaggggauggaggcaagggcuaggggagauacucuuucaaaaggaucauuuguaguuccuacuaauuuugugguaagucgaagagaagauuccauauuaaauugcugugaugggccauccuuguggugaguggucuaaggucaugcaauuugaggucauacaauccuauccucuguccuucuuuuucuuucuuuucuuuuuuuuuuuuuuuuuuuuuuuuuccgaaacagagucucacucugucgcccaggcuggagugcaguggugcgaucuuagcucacugcaaccuccgccucccggguucaagcaauucucccugccucagccuccugaguagcugggauuacaggcgcccaccaccaagccuggcuauuacuuguauuuuuaguagagauggggguuucaccauguuggccaggcugguuucgaacuccugaccucaggugauccaccugccucagccucccaaaguccuaggauuacaggugugagccacugcaccuggccguuuuuuuuuuuuuuuuuuuuuuuugagacagggucuugcucugucacccaggcucucgagugcgguggcacaaucauggcucacugcagccgugaccuuucagguucaagugauccucccaccucagccuccugaguagcugggaccacagaugugugccauuaugccuagcuaauuucugcauuuuuaguggagauggguuuucaccguguuucucaggcugaucucaaacuccugggcucaagcaauccuuccaccuuggccucccaaagugcuuccccucucccauguuuccuucauccuagccugcuucccuauacugauauggcacgguaugucugugugcgugcacauagacacaaugucugaccguagagaucaggaagaccuugccaaaucuacuuggaaucucuugcugacggcagggaaaacagaugcaaggaaggugggugucagggaauagggagguagcaugaggagagggacugacagaagaagauaaagacacgggugaggguuugcugagaauucuaagcuauccaagcagaaagggaccuccaaggucaauuuguccaacucccugguuuuacaaaugaggaaacagaggcccagagaagugagauggcuugcccaacaucacacugcugcuuuguggcagagcugcaacuagaacccaggucaaaagaaaagggacuggagggcaguguauauucaaggcucuaaagagacauugcccagaaggagaaagagagacugacacuccacagaaagaacugaugaauguagacuuccaguagagguuuggaguaugaagauacaggggcaggaggggaaggugccuagaagacauuauagucagguagagucagguucuggaccucauccugcuauuauuuaucagcuucagucucaguuucugauguaccuuuagaaucuuugugaaaaccagucuuuuuuuuuuuuuuuuuuuugagacauagucuaacucugucagccaggcuggagugcaguggcgcgaucucggcucucugcagccuccaccuccuggguucaagugauucuccugccucagcuucccgaguagcugggacuacagacaugugccaccccaccacgcccagcuaauuuuuguauuuuuaguagagacgggguuuccauguuggccaggcuggucucgaacuccugaccucaggugauccaccugccuuggccucccaaagugcugggauuacaggccugagccaccgcgcccgaugaaaaccaaucuuauaaacuaagcuugcaauaccagcacaguucuuaacaagugcuuacuaagucuuuacuaagguuauauuaccucagaagaggaaagacuucugauuguauggguuaagguauggcccaaaugacccugugaggacacaggacagagguccagugucuccagagcccauuccuucugugccucugcugccugcaacugauaaaccucuuaucuggcccaggcaggggagcccagggccaggauaggaggagagggcagagcugcuaucaaccaccaggccugggccauaucuuggagaggaggaggggcugucugcuugccucuuuccacaacuuguucuuggggauccucaagcauauacugucaucaucuuggaaagaaaaggcugagaacguaaaacugaggacagaggaggaaagcagggugaccccugauguugcccuagaaaauggaaaacaaaacacagcaaaacagaaaaacagaagaucugacucugccuuuagccaggaaaacaguuugggggaguaaaaaguauuagggaaaagagugggcauuuugccuggaaaaaagguaaagaccuccugugcuaccaaaggaacugacuguggccauaguuggcgagguggagaucacaacacaggaaaagacuuuccaucuuaagggauugaugaauccagcaugagugaggauggggaggaggcggucucuccuucccucaggggaagcuggagggagccccuccaaggagguagugcaaacuugcugacccuagcagguguagcucuaacaccucuuuuccuuugacacagguuucuagagccaucugggcuuuccgggaaccuggaccagacucuggcccaguaggauguccccguguccuccccagcagagcaggaacagggugauacagcuguccacuucagagcuaggagagauggaacugacuuggcaggagaucauguccaucaccgagcugcaggugaguaaggggggauagggcaggggaggccgugugucggagaagagagaagcagggaguuggccaggacugaggcagagggcaggagcaagcagggcucagggcugguaaugcuccaggcacugggaaaggaagggaaagauccggauggaagacacugaggaacguugaggaggaggaguggaggagcagugguggggagggaaugaucugauugggaguguaggcucucucagcagccacuugacucacaucucucucuaccccaccuccugcucucccucccgugcucaccuucuucucuucugaccugccucucugauccugccaucuucuucccucauuaccuccgccugcccuuggcaacugggcccguuuaccccagguaacagagcaguaguucaggggccucaggaaggggagucggacuaugccaggguccucuccuccugcuacuuggacaaaggggugucuguuggcuugacaaugaugccuuuguccccagcugggcuggagcaggguggcucccugauguagguugggggccuuguuucuagcauguucucuacuucucgcugcaccugggcagggacagagggacugaagaggagaaggcagagcuugugcuggcuccccaaggugcuucuuagcccccagccaccccccuuuuacuacccugcuaccaugcuuagcacccucaggaucugcccuaggcccucuucccacacagcggcucccucugcugggcaucuggggcauggccaggaucugaacuugacccuuugacccuagauaacugcagcaggaaaggguucugaggggucaucuuggauaaaaaggcuuugacuuccugaaggaaauaaaggaacaugagccauuucuuuuuuuuuuuuuuuugagacggugucucgcucuggcgcccaggcuggagugcaguggugcaaucuugguucacaucauucuccugccucagccucccaaguagcugggacuacaggcgccugccaccaccccagcuaauuuuuuguauuuuuaguagacaggggguuucaccguguuagccaggacguucuugaucugauccugugauccgcccgccuuggccucccaaagugcugggauuacaggccugagccaccaugccuggccgaacaugagccauuucaacccaguaagagcuucuccaaggagaguucauaauuguuccaauguuagguagucuuuucugcaguccaaccucagugacuuccauucuugcuaaagcugcauuuuucauuuuuucuuuuuuugagagggagucuugcucugucgcccaggcuggauaguggcacuaucuuggcucacuucaaccuccaccuccgggguucaagcaguucuccugccucagccucccaaguagcugggauuacaggcauucaccaccaugcccagcuaauuuuuguauuuuuagcagagaugggguuucaccauguuguccaggcuggucucgaacuccugaccucaggugaucugccgccuuggccucccauaguguugggauuauaggugugagccaccauuccuggcuuuaagcugcauuuuucuugcaacaacuguaucauaacuuugcaggaagcuucccgugauuuguggcaacuuuguuuccuuguuacuaccucacugcgacuuucagaagaauccagcuuguuccugagagaguguugguuucucuuccuuagucugucuccaaaucucuuugugucuuuccuugcagggucugaaugcuccaagugagccaucauuugagccccaagccccagcuccauaccuuggaccuccaccacccacaacuuacugccccugcucaauccacccagauucuggcuucccacuuccuccaccaccuuaugagcucccagcauccacaucccaugucccagaucccccauacuccuauggcaacauggccauaccagucuccaagccacugagccucucaggccugcucagugagccgcuccaagaccccuuagcccuccuggacauugggcugccagcagggccaccuaagccccaagaagacccagaauccgacucaggauuaucccucaacuauagcgaugcugaaucucuugagcuggaggggacagaggcuggucggcggcgcagcgaauauguagagauguacccaguggaguaccccuacucacucaugcccaacuccuuggcccacuccaacuauaccuugccagcugcugagacccccuuggccuuagagcccuccucaggcccugugcgggcuaagcccacugcacggggggaggcagggagucgggaugaacgucgggccuuggccaugaagauuccuuuuccuacggacaagauugucaacuugccgguagaugacuuuaaugagcuauuggcaagguacccgcugacagagagccagcuagcgcuaguccgggacauccgacgacggggcaaaaacaagguggcagcccagaacugccgcaagaggaagcuggaaaccauugugcagcuggagcgggagcuggagcggcugaccaaugaacgggagcggcuucucagggcccgcggggaggcagaccggacccuggaggucaugcgccaacagcugacagagcuguaccgugacauuuuccagcaccuucgggaugaaucaggcaacagcuacucuccugaagaguacgcgcugcaacaggcugccgaugggaccaucuuccuugugccccgggggaccaagauggaggccacagacugagcuggcccagagggguggaacugcugaugggauuuccuucauucccuucugauaaagguacuccccaacccugagucccagaaggagcugaguucucuagaccagaagaggaugacaauggcaacaaguguuuggaaguuccaagguguguucaaagaggcuugccuugagggagggcuggaaucugucuucccugacucggcuccucaggucuuuagccuccaccuugucuaagcuuuggucuauaaagugcgcuacagaaauggcuu

SEQ ID NO: 17991 - RNA, 26880 nt, Homo sapiens
aggcaguuuggaaaaaauguuuuauuccucuuugcacagagcaguuuaugaaggugguuuucuccugacuccaugcaucuuuuacacaaagaugcccccuuaaauaugccccguuaucugccccaccucagugcuggagaacuggcaguuaguaaguggggcagaaugcuuaagucucaggaagguuuuuaaaggcauuuuuguggggaggaaguucugggucaaggggaaagauuagacccaagagugaguauuccauucuccaucuuccuggggaaauccaaaccccaaagguuuuaugaagaaaagcaccucucucagcgaccuagagacagggagagcacagaccuacugcuuggguguaaggcugaggcagagagaggguagguugcagcgacugcagacccacggcagagaguaaaugcaugucggggagcugaggggacagagacagccuagaggcccaagucauaaguuccacuccuuccccaguucugaguagaaacuuuucuucccaagacuagaauggaguuuuaguuuuaggaacuggcuuugcuccaggacacagagaagacaaaccaggcaacgaucccacagguaguaaggguggacaguuaagguagcuaacuaagagauggacacucgccacugcaguuuugaagcuauaugccagaucaggguacagaaugcauuuuauaugcccuguucaauacaauuuaaaucgcuguuucuuccauguugucccuucccuaugaacuauucccaaagccucuuccaaggcagaggacagggcaguaagaaggaauggaagaaaacacugaggucacuaagugggguuagggcuuagauuggauaaaucccuacccauccccgcccccacucguucuauagaaaagaauucucuuucucucuccccuugcugggcuguugggaugagggccagguagaggcaaagggaggaaaacacucagcacauucuuucuccuacuuuaaucugaaguguagcuacagcaaagggcacagaauuuacaaaaaugucagggcaagggagcaugugagcauaauccagucuagaaagaaagagggugcuuccccugcccuauuaucuaaauaugcugggagcuuuacucccagaacugcaagaagaaugaaaaagaauaggaaggguguaggggagguugagggggcaaccacaaacagaauggagauuuaaggaucccugugauccccgagaugacccugagagcaucgauuggggaacuagaugaaaauucacagcagacaugcaaauuuuuugaagaggaugaagagccaggaacagugaggucuucaccgaaggagugaccacuugaucuguucuuuggcugacugcagcaccugcagagauaagagcagcauugaggaaagcuugcugacagggcaggguaaggaugagggcuggggaucuccuuccccucacuugucuucccuguccuuagaagaauggagaauagaaaauccccaaggguaaagagaugggaagaagcucucuaaggcccuagcagauuguuuggaaaauuccaaaaaaauucaaacccacugaggggaugaagagagaagagguauaccugguauaaaagaaaaaaaaaaagggaguuacuggacauauguuaaaaggggcggcgggcagggggcggguaacaaauccagauggacuucuuggugagaauuccaaguggguagaaaacggaaccccucccuucccccuacaucagguagacaaucuaucugcagucaagguagcaagauggaucugcaaaaccugcauauucuagaauaugcauuuccagcuuagcccucaauugaauaauaagagaaagagagugugugugcacaaaugcacacagaccaucugcuuaaggcaagccucugcuggggaauaaaucacugaaugaggcaucaggcaggcagggaggguuugaaggguacagagcaaggcugacagccacugcucacagguaacugagaaaggaguuggaaguagggguagggaguggcuggcuguaugagucccaguucucuggaauaagagggagccaaggaagaugugucuugagucucuaguuucacucagauuugagagguauggguggaaugcuguucuagccucuuuagugacccaguccaucuggaaaggaagaagggagagucauaccugagacacggucugcuccguaagggggacaucuucacccuauggcacagagauacaagcauuuagugugggagaaagcuggaguaagaccugauuggagucugguauuagagaagaaaaaagugauccuuuaaacugaaacaaagggcagaugcacugaacuucucagucccuucuagggacuaguacagcuacaauuuuacuuggccagagggacuaugaacaaaaaagggucauuucauccagcuuccauuuuaaggcaggaggacuucuuaaaagauuuaacuccauucagaguaaccagcagguuaucugauccucaacucccuuaacguggggguggaggaccugauucccuagucagaaaaggccuuuucugaauaucaguaucacuagggaaaggaugagggggagccaggagugguuuaauggaucccgcaaagccugauggguaacgacagcauguuaauuugaagaaauaaacugcugcaacagcagccuaagaagacaaagcggggaguugaugggggggacccucucucuugccacacagagacauauguuagaggagaagauuaaacuaugcaaauggagcccacagcaguuaagagagauuucccauuaccaagcacugucagccuucacucuguggaggucagagccaggacauucugugaauggggagauuugcuuugcucagacaucuuugcacccguauaauuuguuggugggcucucucugcauccaccauuaucuccucagcugaccuggggccuucuaugguuaacucagaggccccuuucugauaucaccagcaccaaagaggacugagguucuggcaaauaaguacuuccuaauggagagguaccauccucaguuauguaacacuuuauuauuauuauuuuauuuauuuauuuuuuuugagacagagucucacucugucgcccaggcuggagugcaguggugcaaucucggcucacugcaaccuccaccucccgggcucaagcaauucuccugccuuagccuccugaguagcugggaucacaggcacgcaccaccaugcccagcuaauuuuugugucuuuaguagagacaggguuucaccauguuggucaggcuggucucgaacuccugaccuugugauccgccagccucggcuucccaaagugcugggauuacaggugugagccaccacgcucaguccuauguaacacuuuaaaagacaaaacagacacuccucugccucagaugacuggauccaucuccaagaagggaauaagccaacuucaaguugcuuuauaauuucaaaaccauaaauauuaaaguuuauuuuaucauuuauuaaauaaguauguauuaaauguccacuuugugcaaagacuguaugagauguuaggcaccauauuagggguagaaauaaguuauuucugcuucuuucuuugggacaauaagaagagaagggaagagaaaggcugaauguauuugaaagaaaaagagaagguuguauguauccuaugagccccaacuacuggacacauccagcaggucuggcucuggaggguguuugugaauagaugcggggaugcaaagaaacacauucuugcuuacccuuaaugccacccgguguaccaccugcuggggaucacucucuaggaucacccugcaaaaacaaagaagagaucauuguucacucugucccgaaggcccaacucacugucggggaacaggaccucuggccacugagccugcuugacuuaggacaggggcaguuaucccgccaccucacccaagaucaaggcaggucagagaacuuacccuccaucuacaauuucauccacagccaagaacagccccuccauguucuccagcagugcucgcuuuucuacauuuuuccugaguccccaagagaagagaagagaauaaccaacuuguaugugaaagaaauccuaggaccuugucucaauugaggaaccuaaacuagaccaauaaacaucuccaccaaccacacaaagaaguaaauaaggugaagaacuuuuuagcuaguucacucaaaaccccuuucuacucguuugcugaauaaggaauguauggaaagagauucaaauaacacagucaauuucugacuauucagggguugauuauccacgcuauuauuucuuuccuaccugccaugaugcugcucauaacauugcucauaaacacugacaucaguggguggaaaaaaacaauauaaacagagcuaagacucagucuggagguggccggaggugagagggguucaaugcaaaccuuauuuguacucaagcucugacaaaccuccugagacauucucuguucccucuucucccuaucccuuaccagcucugcucaggcccugaaaagaagcccaaagagggggcagggucugcauacaccagccucagauccguugguuggugcauguggccugucacaucugucaguuugagucuuucacuagauuacccgaaugaauuacuauucauucaccuggauaagaaauaaaucauccccuuccugaggaaaucugagccauucacccugcugauuuugcagggcugagagugccugcuguucuggucuggauggcugucuguacuggguucacuugggagcugcugggggaaugaaguucagagcccuggauguuuucaggaaaaguaacuuauaucucuucuauuacccaucuacacggguaacagagaacagagggcuagugggaagguggaaagggaggagaggguaaauggcagaagcuuccuguuuuuuguuuuguuuuguuuuuugagacagggucuugcuaugucaccuaggcuggagugcaguagcaugaucacagcucacugcagccucaaccuccugggcucaagcaaucuuccuaccucagccucccaaguagcugagacuacagguaugcaccaccacaccuggcuaauuuuuuuauuuuuugcagagacagggucucacuguguugcccaagcuugucuugaacucgacucaugcaguccuccugccugggugcuuccuguucuacagaagggaaaaaacaaggacuagaagucaaaaaaaaacuggucuaaguggcucaugccuauaaucccagcacuuugggaggccaagguagguggaucauuugaggucaggaguucaagaccagccuggccaacaugguaaaacccugucuccacuaaaaauacaaaaauuagccaggcgugguggcacgugccuauaauugcagcuacucuacucgggaggcugaggcaggagaaucgcuugaaccugggaggcagagguugcagugagccgagaucacgccacugcacuccagccugggugacagagugagacuccaucucaaaaaaaaaaaaaaagaaaaaaaaauugggaguguugcuuccauuccugaaguacugaaugacauuucaucugggacacuuccuuaugcuuggccuuucccuacuucuaaugucaagaaugaagcccaggaaagcaccuugaggaugcucagaucugacaggaccacaggggauuacaagaguaaacacagagguaaagauucggcucccucccaguccccuuacuuaguaagagaauuauucuaugggagggacauacucuccauccaguccuccccaguagcaugaauuacugugaauuaauaaacccaacuuuuuuuuuuuuuuuugagacagagucucacucugucgccaaggcuggagugcaguggcgcgaucucggcucacugcaagcuccgccucccagguucaugccauucgccugccucagccucccaagcaccugggacuacaggcgcccgcuaccaugcccggcuaauuuuuuguauuuuuaguggagacaggguuuccccauguuaaccaggauggucucaaucuccugaccucaugauccgcccgccuuggccucccaaaguacugggauuacgaacgugagccacugagcccggcaaaacccaacuucuaaaacuaaaucaacucccuggagccuuugccaauccccuacaaucccugggccugaagaaugguuacuuuaucucccaaaaagaaaucaacaaugcccugcucuuuccaucauaacuugaggggaaaaaaaagaauguccugcucaccucagcaucuggcucaaugagucgaagagacaguucagaacagccauaagcaucagcuguugggaaacagaggaggcagaaggauaagguucaaggcccugaaagcugcuaccuaaaaacaaaaccuccuaauucauuaaacaucaaaagacacaggcuuucacaaaggaccaaaaacauaaaguggaagugagagcacaacaggaaaaggaucugugauuucucacagaaauaaauucugcuacaugauuccacaauucaacaucuuuuagccaaaaguuuaaacagaacuucccugucacaguccucuacaaugucuucaccaacuguauauguguuaccugaugucuuagguagagaaauuacuaaccaagcaauagcugaggucagaggaaggcuucagaguuaguguaaaaagcauggacuuuaauuggcugggcacagugggucacaccuguaacgucuagacccugucuagacucugacucuaucccagcacuuucggaggcugcagcaggccgauugcuugagcucaggaguugagaccagccugggcaacauggcaaaacccugucuacaaacaauacaaaaaaaaauuagccaggcaugguggugggcaccugcagucccagcuacuugggaggcuaaggugguagaaucacuugagccugggagccagagguugcagugagccaagaucgcaccacugcaguccagccugggagacagaacaagacccugucucaaauuuuuuuuuuuuuuuugagagucuggcucugucacccaggcuggagugcaauggcgcaaucucagcucacugcaaccuccaccucccagguucaagcaauucucuugccucagccucccaaguagcugggauuacaggcgcccaccaccacgcccagcuaauuuuuguuguuguuguuguuuguuuguuugagacggagucucgcucuguugcccaggcuggaaugcagugguaugaucucggcucacugcaaccuccgccucccagguucaugccauucuccugccucaaccucccgaguagcugggacuacaggugcccgcaccacgcccagcuaauuuuuugcauuuuuaguagacaugggguuucacuguguuagccaggauggucucaaucuccugacuucgugauccgccugccucggccucccaaagugcugggauuacaggugugagccaccaugccuggccuguauuuuuaguagagaugggauuucgccauguuggccagccuggucgcgaacuccugaccucaagugauccgcccaccuuggccucccaaagugcugggauuacaggugugagccaccacguucggccuaugucucaaaauuuuuuaaaaagcauggacuuuaagucagacagauauggguuggaauccaagcugagccauuuucuacaugugugacccugagaaaguuacuagguugaaccacaucagauaacugccacuuuuguacuuuucucaauggucacauacaaguaauuucauauaguucuucaugguuugguuuccucauuuguaaaacaaaggcaccaaugccuacaacucauagaagugcuaugagguuuaaauaacaauauacuuuacaaagcacuuauaccaauaauaagagcucaguaagaguugacuuucucaaacuuucacuuuugccucaaauuaucugggggcuuauuuuuauuuaucuauucuccuagaaguugcuaucugaggcaaacagcuuuuccugcauauaggaagcagguuaggacuauacccaaggucuucuccagugauccauucagaauguaugguuucaacaugacccagguuguuagcuaauuggcucaaacucagucagguauggacccuucauagaagaagcaaguaucccccugcagucuugaccauaccucagaaauccaucuuaaaaaacacuacucagggaaagguauuaaaacauauaugauguuuccuaauggaugcaaaagauuaaucuaggaaaacuuccuuucuaggcgauucauuugccgggccauguuugugaggcuggugggaucucugacaacuucauuagcuuggucagaagccagaggaacacggcucuauuagggccccaaaccaguggcuauguacugccugugguuuagaaaguaggaucagaaauagcaaagagggguggggauucucaccucauuuucauaggagcugccaaucacauagaaauagagaucuauacugcuuuuguauaccacugucaggccuuccaagagggcaauuucaccuggugggggaaaaaaaguaaaaauaguggguggcuugagauaaggaaguaggaaagaaggaguuaccagccaggcgcaguggcucaugccuguaaucccagcaccuugggaagccgagccuggcggaucaccuaaggucaggaguucaagaccagccuggccaacacagugaaaccccgucucuacuaaaaauacaaaaauuagccgggcgugguggugugcaccuguaaucccugcuacucaggagggugagaugggagaaccacuugaaccugggaggcggagguugcagggagccgagaucucgccacuguacuccagccugggugacagagagagacucugucucaaaaaaaaaaaaaaaaaaaaagaaggcguuaccaugaauuccuaguauccagcucuuuugggcuaaggugaggccgccuguaaugacuuccaaagccagaagaugaucugcacuuuuugggugguggcaggagaagagaaguaugaacuugggggagucuaaauguaucuucuguaaccaccauccucuguuccugcccacuauaccuauuucccuacuuguauaugagacaggauacuagucgauccuucggaggugaaaaugcagagcggucaccuuuacagacuuccauuuaccugcccuaauggaugcgguacaauaagcagagcugcaauuaaauuugucaagugaggcucauaaauccagggacuagacagguagcuaacagccaaccuuccagcaugguauucccgcgugagguacacucaccuccccauuacauucugaagaguuuauuauacaaggggaagaaggaaaaaaaaagaaaaaggcagagucauuucauccuuucucugcagcccuguuaccacccccuuuccaccaugguuccccccagcacggguaguagugaaaggaaaaugaccuacugucaguccgaugggucuuguugaaaauguucuucucaaaggccuuuugcuccuugacacugggguaggugucgucauaguacuggucagagggaaagaagacaggguugggucacuagagcuggaagccagaaugauuagugacuauguuuugcccugggaucuuggauuucucuccuucaaggcauggggcaagggagaaauacugacauggaaaaggaaggauuguagaggcagagaaugggcagugaguaauccaagaaaaauaaauaaaagacccugccauaagcaaccccaccucacauuuccaagacugucugaaggcagaagccuaccagcccuacagugaggcucugcagcugucugcaaucuagaccucuccuaaaaccauucucaucaaguguuuccuaggagcuaccccaugucaggaagcagugccagagaacacaaaaaacacuagaagcacagaacacuuccauagacccucacucacuguaugaagcugaggaauggggaaaggcuacaaaaaccuccuccaaagaaaggcaaacccugcccuaugaucuaucuuagcuuucuuuucugcaagcugaaagaagcauccagcauaccacugagcccauucccaggcucucccuggcaaagggggcggagaugcaggcugcuaaaucgcuagcucuuuaggggcuaauccgucgcagucagcugaagacccaugacaggucuggcauuuaguaacuggauaacuguuucaaaagguguccugcauaguuacauccaauuacagggaggaacagcuggugaauucuaaacuaaucucuaccugcugauugauuuaugcuacgcucgcccggaguuaauacaccagggacagaagaaauuucuacaggagggggagaauauggagggagagaggguguccuuucuucuuucuuccaacagaucuaaaguuggaaacaucacucugggaaagucaggagguaacaagcuugauggugacuauaaaccuaggaauggaaaccuggaacugcaagacaauucucuggaaaaacccaggcagggugacaugguaugagggaaggggacaggaaugauggacaugggcggacugccucuuagcaucuacauacugcuuuguuaggaaccaaaguuucaaagcuuuucccugaucugaugcugacaacaaaggaggucaaagucugaggacagcaagcagggcagcaguacaacuaagggacaaaagaaaacagguuuuaucuggaguaggcaagauaagauggaagaauucaggccgggugugguggcucacaccuguaaucccaacacuuugggaggccaaggcgggcgaaucaugaggucaggaguuugagaccagucuggccaaccugcugaaacccugucucuacuaaagauacaaaaaauuagccgggggugguagcgcgugccuguaaucccagcuacuugggaggcugaggcugcagugagccaaggucacgccauugcacuccagccugggugauaagagcgaaacuccaucucaaaaaaaaaagauggaaguauucucaaaauuauacuacugaggaacauaaguuaauaagguaucagucccaagauucaaaucucagaauaaaccuuugugcuguuccuaaacuaauucgaaagggaaucucaccuuggcaaaaagucgaucuccaucauuguccagaaucaggauggcuuugacaguauacagggaagguuccugaagagauacgaacauaccuucaguccugaagccucccaucaccacugguaaaccagauaccuuccccuagucccacuggggcugcaaggggauacagagguaccucuguaagucccuuaccucaacuuggucagauuuugauauuucccauugagaaagacccaggguaaguaaacugaauugacagagaaagcauuuaaacaaaggauuccaaaguaccaucagagaaacaguuucucugacucacagggggcuuaaucaagagaggucaugcuguuauuuccaaauauuaugguacaguuauuuuccaaauuacccucucccuuccugcucucccauguacagguggcuauagaaugugaccagauuaauuaaaaggcacugaacaaagccauuugaaaauaggguugaauguccuaguauacuuggaaguuucugcaguccgaaugcaguagcaaugcagaagcauaaagcaagccuucccuaaaccacccacacacuaagcagagggaaaagagcguuuacacacacacacacacacacacacacacacacacacacacgcacaggcacaccaguucucaaugcagccuaguaaaacagccaucuucaaaaacucuccuauguucuccaauucuuccacuauaccuuaaccacuaccacuuaacuuccaaggacaaaagccaaccugaauuuugggggaguuaagaagcagugagaagaugaucuaucugagaaacacucuggggccuagagugagugagcaagaggguaauuuuuuuuccacuaccaagaaucaaauaaggaaucacggccucagucuuaaugguucuucuucaacuguaaguauaucacuugcaaaaccugugguggucuguugcucuccucuaccacugcaacuucaagggagccagcuaacuaggagaaggaaaaucgcaggaggcugaggcaggaggauugcuuaaggccaguucaagaccagccugggaaacacagggagaccccccaucucuacaaaaauaaaaaaaauuagccaggugugguggcgugcaucuauaguccuagcuacucaggaggcugaggugauaggaucucuugagcccaggaguuuaagaccacgcugagcuaggacugcgccacugcacuccaggcugggugacagagugaaaccccaucucuaauugauugaauagaaaaaaccaaaaguguggagagauagugaugugugcaugaaagguauuugcagccucacauuccuugacuuucuuuuuuuuuuuuuuuuuuuuaagagaaaaggugucacuguauuguucaggcuggucuugaacuccuaggcucaaacaauccucccaccuaggccucccaaagugcaagugugagccacugcgcccgaccuacauuccuugacuuucuaaucaacauuacuuaccauugauaucccuugugcugagacaaggcuguugcuuugcuaccucuuuccuggccuuauuuaagaaacccacaguccucacaggagccaaacacaaaaguauguguuugacagauauccaagagugaggaggaaaaaaucauugccaagaacccagaaacugcagccucuacaaacauaaauugccucaugaggcuucaggagguuuaugguuccaugcaaagaaucaacccuguuugcgggggcagaggagggcaguucagaauggaaguaaaaggaacccagucuuuugacaacaaggugaugaggaacauaagcuuucccuacuugaauucuugaggacugcaauuuuuguuuuguucgcugguuugucccauuuguccagaacaaugccugacacauacuaaacucucaauauuuggugaauaauucagagaauaaaggaaguuugagaauaaaguuaaaauaccuugacgcaguaugcaucuaagggacuacuuauaauuagaccuccacauauaaguggauuuucugauguggccacuuugggugauauuacuaccaacuuuaucccuccucugauaaacacuccuuagagauguccauccuguauauauaacacucuggaauaaacaaggcaugaguaacuccucucucaaacuaaagaacuuuguugccuaguggagggaaguccucuagagucuagucuuaaaaggucacaaguagaagcagcucuccuaacuccuaauuccucacagaaagaucuuccuguaaagcaggcucaguucuauaacaacuuggguccucaauuccaaaagggagacaacaaugggaaugaguuuucuuaauggaagaaaagaaguccaaaaggaacaaaauuuagacgaaaucauuuuuucccacaaccuuuuccuggaaaucuuuggcucuguuccucuauccacauucacagcaacuuuagagagcugcccauuaguuuaagcugggcauuaaccuggcauaggaaacugguucuugcagccauagaguuuggcaucccuagaacccaaagaaaagcaaagcccuaauggcccccagccaacugggagagucagacaauguccuuuguggccaacagggugugagugccuacaacagccacaccggcaaagagagaacauaucccuggguucugcucuugguucuuuucacuggcuuccuagaagacauuaucaaagaaaccccaaaaauagaaacauuggaucuuccugggaagaauaaaagacaggcuaaggaggacaaggauaaagacuagauuugacauagagcuuacuggagcucucaaaagggaaagaaggcauuacagaaaaggcuggucauuucaaacuuccaaaggaggaagcauacuaaauaaagcugagaauuuaggcaggcgcuuaaaugccgcuucaauucuccauucugcuacagcuggagccagcagcuucuuuacuucuccugccaccuccugacugcagcugguuccacuucagccuggggcuuuuaccucucaggaguggggagggcuaugccauaaaacuagccaguuuaaaggccccagaagucauuacugauaauguaauuucauuuuaaguuuuugcaaagggcaaguuuauaaauaacucccagcuacugagaaaugggcuuccaggacaauggacuaggcuugaccuuguaacacauuaaaugcugacuguugagaaagaccuuaucagcuuagggccacacugaaagaauuuaaaaggucuauucuucccucccacucccaaaauggguagcugcuagaaagcuuucgagacaaaguucugugaugcacugacuuucagagagccacagccugaguguauaacagaacuucaccucaaaugcuaaucgugcuuggaaaugauguauaggcagauuguuuugugggagauugggugacuuagacagauuuucauguauuuauguuuuuauuaucaagaaaacaagaaugcuguccucaagacaggugaaacaccacagaacaagcaacuaggcugcugcaaaugaaucuuugaucucaggggcuucuuuuuuuuuuuuuuuuuuuuuuuuugcgacagucucucucugucacccaggcuggagugcaguggagcaaacuccgcucacuacaaccuccaccucccggauucaagugauucuugugccucagccucccggguagcugggacuacaggcacacacccccaugcccagcuaauuuuuguauuuuuaguagagacgggguuucaccaaauuggccaggcuggucucgaacuccugaccucaugaucugccugccucggccucccaaagugcugggauuacaggcgugagccaccgugcccggccucaaucaggggcuucuaaagccuggugaaaagcaucaacaucuccaagaacucucuccccuagcgcauagaggacuagagggaaagagucauuccuagugcugcccccugugggccuucucggugaccugcagcuuccacaggauuacagucauaagcaaaaauauuuuucaaaggcagcucuggauaagagcuuuuuuuuuuuugagacggagucucgcucugucgcccaggcuggagugcaguggcacgaucucagcucacugcaagcuccgccuccugguucaagcucuccugcuucagccucccgaguagcugggacuacacgcaccugccaccaugcccggcuaauuuuuuguauuuuuaguagggaugggguuucacuguagccaggauggucucaaucuccugaccucgugauccgcccgccucggccucccaaagugcugggauuacaggcgugagccaccgcacccggcaaaagcucucuauuugugugucuuguaggacaaacuaguagagaugggcccugaaaaauaagugaauuaagucuguucacaauguauauaguaagagaacucuuugggguaagaucuuaguaagccaccagaagacugggagaauauguuuggggaagguagagaggauacuuggaaacuauaaugaauuauuugauucauuuaggggaaaaaaccaagaagccucuauggagggaauuacaggaugccaucuacagagcugaaagagcacaaauaagaauauggaggccaggcgcaguggcucaugccuguaauccuagcacuuuuggaagcugaggcaggagaucacuagagccaggaguucaagaccaaccugggcaacacagugagacccugucucugcaagaacuuaaaaaaaacaaaaauuagccaggcaugguggcaugcaccuguagucucagcuacucaggaagcugaggcaggaggaucgcuugagcuugggaguucaaggcuguagugagcuacaauugcgcuacugcacuccagccuacacaaaagagugagaccgccucaaaaaaaaaaagaagcugacugagaucacuaaaaaguucuucauugucuacuuaaaaauaaauccuuccagccuggccaacauggugaaacccugucucuaccaaaauuacaaaacuuagccaggcaugguagcagacgccuguaaucccagcuacucaggaggcugaggcaggagaaucgcuuauaccugggaggcagagguugcggugagcugagaucgcaccacugcacuccagccugggcgacagagcaagacuucagaucaaaaaaaaaaaaaacauucccuaaggccauaccaaaagggccugauguggcauuacccugauguggcaaugggucuuggugaauuaaaaacuguaacaagauucucuugucucaauccuguuuauaaaguaaaacuaagaagguaaaaacuagaaggagaaauuccuagauaccacucccagcuccaaauggcuaaguagguauacuuccugacucugugccaacacuuuuuuuuuuuuuuuuuugacagaguuucacuuuguuucacuuuguuguccaggcuggggugcaguggcacaaucuuggcucacugcaaccuccgccuccuggguuccagcaauucucgugucucagccuccucaguagcugggauuacaggugacugccaccaugcccagcugauuuuuuuuauuuuaguagagauggaguuucaccaucuugcccaggcugguccugaacuccugaacucaggcaaucugccugucucggccucccaacaugcuaauauuacaggugugagccacugcaccuggccucugugccaacuuuuauuuauuuuuuuauuuuuuugagacggagucucacccugucgcccaggcugaagugcaguggucugaucucggcucgcugcaagcucugccucccggguucacgccauucuccugccucagccucccgaguggcugggacuacaggcacccaccacuacgaccagcuaauucuuuuguauuuuuuuuaguagagacgggguuucaccguguuagccaggauggucuagauauccugaccucaugauccacccgccucauccucccaaagugcugggauuacaggcaugagccaccgugcccagccugugccaacuuuuuuaaaauuaaaagcuccucugggguuaagggcuccaauuugccagccacaauccgauagacuucagaugaaaagaaaagaagaauuagcuaaagucuuugacagggaagagcaguuuuuacauaucagauuuuuuuuuuugagacaguguugcucuguugcccaggcugaagugcaguggcgugaucuuggcucacugcagccucugccucucggguuccagcaauucuccugccucagccucucaggcagcugggauuacaggcgcuucccaccacgcccggcuuauuuuuguguuuuuuguagccuggcuuauuuuuguguuuuuuguagagacgggguuucgccauguuggccaagcuggucucgaacuccugaccucaggugaucugcccaccuugaccucccaaagugcuaggauuacaggcaugagccaccacgcccagccuauaucagauuuauuaauauuauuauuauuucuugucacccaggcuggagugcaguggugccaucacagcucacugcagccucaaccucccaggcucaagcgauccuccccguucagccucccaaguagcugacuacagguacaugccaccacacccugcuaauuauuucuguauacacacaagauuagauucaaaaagcacagcucaggaaagagugggagccacugguaccacagaacacuacccagcugacaugagaccaaauauugguuauaaagaaaaaacucaacacaugacucgggaagaacugacggcaggaagagacaccuacaaucuuccuaucugacacagacccaaaacauguaaagcacagucaacaagaguuuugauauuacaggagaaaaugucucuaaacuccuacaauccaucucuuaaauagagacagggucuugcuauguugcccaggcuggaccugaacuccugggcucaaggaguccugccucagccuuccaaauagcuaggacuacaggcaugcaccaccaugccuggcuacaauacuuguacuauaauggggaucagccauuaacucaaauuuucccuuucucugagauucagcuucuucaucagagaaaugagaggcuugaccuagaucaguuaagguuaaugccuuuuuugaguuacagcagaccccuuugauaaaccaauuacaucuauggaccuuauucccagcaaaauacauucacaaauuuuuuuaugauuucauggcuaggcaugcugguuccuaccuguaauaccagcacuuugggaggccaauguggggacaaauagcuugagcucaggaguuugaggccagccugggcaacauggcgaaacccugucucuacuaaaaauacaaaaaaauuagcugggcaugguggugcaugccuguaaucccagcuauucaggaggcugaggcaugagaauugcuuaaaccccggagauggagauugcagugagccaagaucaucgcaccacugcacuccagccuggaugacagagcaagacucugucucaaaaaauauauauauaaauaaaaauaauuuuuuuaugauuucaaagaguucacagagccgaguuuagaauuaaaugagauucucucuggagauaauaagaugguguggagggggcaggaaaaagaggggaaaugagugauacuuuuguaaaccacccccucuacucuaccuggcauccaguaaugcuggauaaauucaauaaauguguguguggccuucauaaauuaauaaauaugauugagaaaacuaacagccagcagggggaauaaaggucagcaaccacgcucccuccagcuuucuuuuuuuuuuucccuuuuuuuuuuuaagacugaguuucauucuuguugcccaggcuggagugcaauggugcaaucucagcucacugcaaccuccaccucccagguucaagcgauucuccugccucagccucucaaauagcuggcauuacaggcacccaccaccacaccuggcuaauuuuguguuuuuaguagacagggcuuugccauguugguaaggcuggucucgaacuccugaccucaggugauccgccugccucagccucccaaagugcugggauuacacgcgugagcuaccaugcccagccaccuccagcuuucaauggcugaauuugaugacugugaaaugggcaggacaaagacaaccaaacccuaagcuuuuuaggaaugcaaagucucaggaccuuucucaaaacucagaaagccugucuguuggaaaauuuuuuuuuuuugagacggagucucacucugucgcccaagcuggagugcaguggcucacugcaaccuccgccucccggguucacgccauucuccugccucagccuccugaguagcugggauuacaggcgcgugacaccaugaccggcuaauuuuuguauuuuugguagagacggguuucaccauguuggucaggcuggucucaaacuccugaccucgugauccgcccgccucggccucccaaagugcuggauuacaggcgugagccaccgcgcccggccuugcuggaggauuuuuuacccaggggucacauagucccuaauucuucaacuaucauggaagugaaagaaucacagaaaugagggacaaagcaguacugcugggaagagagaugaacugaauaaggagaaaucagacuauacuccagaccugaggccugagagcaccauuagaacauucugccuucucaguuugguaauccaggagcccucacuuaaauaacacucagcaaaggaaaaaaaucaaaaggggcuagauccauuccugaugaguccugggucacgauuuguaucaugauuuaucccuuuacucccccccacaucucccugcuuuugcuccugaaaacaaaaagcuagucucugagagacugaauugacagacucuguguuaucuuucagucuauuuaugcccccaaaucaaccccgaggcagaauugcucuauucuccucugguuuuagucucccucuaaaaccacacaacagaaaaggaguugcagaaaauuaguugaccgagcuauccagggcaauuggcuauggaugggauaucugcauugagagugagaaaauaggccgggcgcaguggcucacaccuguaaucccagcacuuugggaggccaaggcauguggaucacaaggucaggaguucgaggccagcuuggccaacauggcgaaaccccgucucuacuaaaaauacaaaaauuagccaggcaugguggugggggccuguaaucccaacuacucgggaggcggaggaaggagaaucgcuugaaccuggaaggcaaagguugcggugagccaagaucaugccauugcacucuagccugggcaacaagagcaagacucugucucaaaaaaaaaaaaaaaaaaaaaaaagagugugaaaauaaaaagccaaauaaaaaagcaggcuucaucugcagcauauauaacuuagauuacacaacaggaaggacuuccugaagagauggguguggucaaacaccagaagaggugacacaggcuagggaauguaaggccaggagagaucccccuaauaaucugauguaaggaaaccuauucugcccaaaaacaggagggacagaaugugagagggcccuugccagcacaagcaucuuacaagugcauggacucauucucugaauccaucuucaucagcuguccccugggcacucugccuuuccucuuccuaauuacuccagcacaaguggguacauagguacugauucuuuaucccugcuccaucugauuugcuccucuaguuucccuuuccacaaccuguuuucuugucaacauccagacucuaaucaagccaugucaauggaguaaaguaagaaacagcagcaaguaucuagauaaaaaagacccuaaaccugccacuaggcuccgucaaauaccuggauaauugcacucauccucugccucccaaggcagaccuggcuucucaagggucugguuuuccucacauggaggcccccuccuccucuucugaccaugugacagcuccccuagaucuuugauauaauuuauaccuugccagggaccaacucuuucccaccacugugaagaagagggaaaaaauauauauaaauacgucggaaaucuauaacaaggucuucuuggagggcaagacauggggagaguuagaagcagcgucaauugcucuuuggggguuuuaguucaagccgaggucugcuuccagcaaucaaccauuaaaacaagcuggccagaguaacagcacaguuuauucugaucauuuaauuugaagugucaauaaauuaaacuucaaucaauuaaacuaggugugcaauaacccagauggacaccccgacaccaacauaaucacaauaaaaauuuuuauugcugccagggaccucaccgggggcagugcuggcacugcucgcgcccuagcugagaaauauaucuccacagcgcaggaaugaggagauugcuucuccuaacaaaauggagggggccaggcaccagcaaggacgcagcugggagaggggcacaggggacugccaggaacgagaugggagugcuuuaggggcuuaauguaauugauaccuuugcccagagcagggggaggggggcauuuaggccaaguaccucuacuguuagggccaaaggaauuuaacaaaagccccauuaagaugauucaggaagcaaaggccaaggagcaacaucaaccuuuaaagucauugacauauucugcauaguuuccuccuccauacauacucauauccuugugcacuuuggauggccugauuuuuuaaugaggcuuagaauuuaggauuugguuaugguuuuaaaauauuaagguaagacaaaguacagaauuagaagucuagucuguaaagcacuggagaagcacucugaaagugaauccagagaggauuaggaaaaauaaaaccuaugaacaaagauuuaaagaucuaaaccgauacagaauucaguuuuguuuguuuuuuaagacagaguuucacuuuuugcccaggcuggagugcaauggcccucggcucacugcaaccuccgccucccagguucaagcgauucuccugccucagucucccguguagcuggggauuacaagcgcaugccaccacgcccagcuaauuuuuguauuuuuagcagagacggguuucaccauguuggucaggcuggucuugaacuccugaccucaggugauccacucaccucaggauuacaggugugagccaccgagcccggcccgaguaauucagcuuuaaagaaaaaaaguaaagcaggaaggaggaaggggaaauccuuaucuuuaagauuccacagguuauuaauggagaauggugaucugcagagauccucuucauucacaacucaaaaagcgagaaccagcagauacagcaagagagaagaagccaaguccaaagaugcaggcugagaucacuauuauuaagcauugggaacuaaaagagaugaaagggucucuuuccuuagagccuaaggagaccugagagagauuagacaaaucugcuugaaagcuagagcuggauuacuuaauucaagaaagaaaugugaccaugugacccacuguaaaguaccuaaaagaagggaacuuacuguuauuuagaaauuccacaaucaaugcaaacuuugaucaacaguucuucuugacccccuguagcuuaccugucccuuuuucucgacauccugcagcuauguauguaccuuguagaguuaaggacagaagaauaugcuuugaucagauugucccuaaccgcauuacauagguuucccauaacaaagaaccagugugguuuuaaaagcaaaguccaggguuaccugaucaaguuagcagggaucugugaaugcagccuauuaggcauagauuaaagcaaaagaauaaggaagaagcaggcugaaacagacuucacugaagaagcagagacagagaacuaagggaagagaaaugugacagagagacuuucuuuuucuuuaacuuuucugagacagagccuugcucugucacccaggcuggagugcaguggcgcaucucggcucaccgcgaccucugccucccagguucaagugauucucuugccucagcuuccugaguagcugggauuacaggcguggccacgcccagcuaaguuuuguauuuuuagcagagaccggguuucaccauguuggucaggcuggucuccaacuccugaccucgugauccgcccaccucggccucccaaagugcuggauuuacaggcgugagccaccgugcccggccuuuuuuuuuuuuuugagauggagucuaacacugucgccugggcuggagugcaguggcgcgaucucggcucacugcaaccucugccucccuggcucaagugauucuccugccucagccuccugaguaguugggacuauaggcucgugccaccacgcccagcuauuuuuuuuuguauuuuuaguagagacaugguuucaccauguuggccaggcugguuucgaacuccugaccucaagugauccgcccaccucagccucccaaagugcuaggauuacaggcaugagccacugcacugcgcccgacagagauacuuucacauauaacucccccagcuuacccacuacacacaggcccauuguuaaaagggcuccccaauuauuaucuuccucauuccuuuaccuuuaagcaggcucccuucuaaacauauauagguaagucuaaaaacuuccaaaaaaaccaauucccuagaaucuauccuagucugcuaauuggguuuagggggagguuuuuuauucuuauuuuuuuagagacagggucuggcuuugucacccaugcuggagugcaguggcacaaucauagcucacugcagccucaaacucccaggcucaagcgauccuccugccucagccucuuacagugcugggauuacaggcaugagccacugcacucaaccucuugauuaagaauacuugcugccgggcacgguggcucacuccuauaauccuagcacuuugggaggcugaggcagguggauugccugagcucaagaguucaagaccagccugggcaacacagugaaaccgucucuacuaaaauacaaaaaaguuagccagguguggcagcacgugccuguagucccagcuacucgugaggcugaggcaggagaaauugcuucaacccaggaggcagagguugcagugaggugagaucacaccacugcacuccagccugggugacacagcgagacucuguuuccaaaaaaaaaaaaaaaaacuugcuaacuggccggggugcagugacucacaccuguaaucccagcacuuugggaggccaaggcaggcagaucacuugaggucaggaguucaagacuagaccagccuggcaaacauggagaaacccuguuucuacuaaaaauacaaaaauuagcugggcaugguggcgcgugccuguaaccccagcuacucaggaagcugaggcaugagaauugcuugauucugggaggcggagguugcagugagccaagauugcaccacugcaccccagccugggcaacacagccagacucuaucucaaaaaaaaaaaaaaaaaaaaaaaaaaaaaaaaaaaaagaauacuuguuaacugcuugguacagaaaauauuuaaaacuacucagauuuuaagcuuuuuaccuauauuugaccaaccgacauaaggaauuaacugucuuuaacugaaagagaggaauuaaaaccuguuauucuuuuaucugaugaggaucugaauguguaugcuuaggagaucugaaggaaaauaaaagacaagcuucuuuggaaagaggccuagaguucaagccaauuaaggaagaaggcugggaguuaaauuccuacacuauacuaccuaccuaccuacacacacacacacacacacacacacacacacacacacaccccuccaaaucgcaaaauagggcacuuuugagagaaauucucugguccaguucuaaaaagggguaacagguauuuuauuuguuagaacaagcauaaagcaucauauggacaagagggcuaauacagcccuuuagcgaccacaauucucauguaaccagagagggagaaauuagcauccuagaucauacaauaagaauuccuggcccggcgcaguggcucacgccuguaaucccagcacuuugggaggccgaggcggguggauuacgaggucaggagaucgagaccauccuggcuaacacggugaaacuccgucucuacuaaaaaauacaaaaaauuagccgggagugguggcgagcgccuguagucccagccacuccggaggcugaggcagaagaauggcgugaacccgggaggcggagcuugcagugagccgagaucguaccacugcacuccagccugggcgacagagugagacuccgucucaaaaauaauaauaauaauaauaauaauaauaauuccuggccaggcgcggugguucaagccuguaauccuagcacuuugggaggccgaggcgggcggaucacuugaggucaggaguucgaaaccagccuggccaacauggugaaaccacgucucuacuaaaaauacaaaaaaaauagccgggcgugguggcacgcgccuauagucccaacuacgcgggaggcugaggcaagagaauagcuugaacccgggagguggagauugcagugagccaagaucgcgccacgugcgcacuccagccugggugacagagcaaggcucggucucaaaaaaaaaaaaaaaaaaaaagaauuccuaaggucuaaauggguagagaaaaggagaacagaauaaggagucuagaaaaaauauuccacaauccaugcuaacuuuaucagguaucccagaacuuugauggaauacugauuauuugacaaaccuauauaauagggauuaacaggaaaccgaagacaaaacaguuuccugaaggaauguggcagggaaucggcaauggagagucaaacuugggaaaccaucaggaggagucuguaacgacaaaacaucuguauucuuuucuuacaauauggggcgaguuuggugguuugguaaauuaaaaucaggguaucauccacaaugcuaaaaauaaggggcaaccugaaggguccuaauccaguacgccuacaggucuguguauccuaaggaguccaugugcugccuucaacuuuccaccgacucuaugcccucuccccggcagggcuuccuacucuaaaccaaggcuuuagcuccuacacuaggccacacacuuauuccaaaggucagcagaacgcucaguccccaagaauuacccggaacucucuuuccccgucucccacucgggcugaacccugacucccggccccuguggacaccacagcaucucugcugccccuccagcuccuaccaaaaucagcgccuccaucuugccccgcagcuggugccgacguggagccgcaaaagaaacgccgccgcugauuggccauacguucccauuaggccccgccuaggauaaggaucauuggguaaggcuugcuuuauuggccaauuauuguacuagcuugcuuaccggaagcaaaguguccaaccagaaggcucagguguuugauugucagc

SEQ ID NO: 17992 - RNA, 24205 nt, Homo sapiens
uucuggucagugggggcacugggucagauuuauugcacuugcaacagaguuuaaauaaguccugggugucuggugccaaggugagggaaggguugggcagagagaugaggggcagcaucagugcagcuggcaggcagaacccaaauucugcaggcccaggacagugggcuccccuuucucuggggaacagggagggccugugucuggccaggcugagguuccagaucuguugccaucauggccccuucaggguccugggaaauuccuggcuucuccuaaaucagggugaacugggccuccaggaucaggucuggagcaggcccaaauauaguccuggaucugccuggauuaggugccaaugucugagucuggguuccagaucaacuccagaccccaggcuggaucuggccccauuugaguucugauuccccuuggagcugggcucugggcccugggccagcaucuauccuuguguggcaucuguccugagcugguccuggggcaccaugcauaguuaguguucuuuguuggcccaccaggguggggcuguccagagcugccaggucuuaacuccccaaguuccagguucuuagcugggggcuucuuuuggaucucuggcaaggcugaggacagaucuuugcagguuggagcuggacaggaaguccuuguggcaugucuggcccaaagaacugugaauggauuuccuaguuaucuuuccaaguuguuucaggaaacucuccaaaaugcaaaggcuucagggaggcuggggccucugucccuggaucugaguucccccauccaugaagaggguauguguaaacaaggguccuucacagugcaugggggggagggauccccagcuccucaccccccuggcucuggcccuucaaguaugucucugggcuggggagaggagcuucucccuggccgucagcaccuucaagaaguacccagaccccuccuuuucaguagaaugaggguggggggacugguucuucaggaaugggagucugaaauugggaggacucaggcaucagagguggcuggaggcuugagcugagcuuuuuccauggcggugccauaugggagggagcguuugaagaauccaagcugauaaaggggaaaagagggagaguuuagguacuauggcugccauuucuccacagcucuuauuccaagaaguaauaaggaggacucuagugccuccaaccucuacauccugcaaaaguggccucugaauucaggcuaggacuaccccucuaaguugugcaauggacccaggaggaccaaacuugggggugauuuuguaugggggguaucuuuuaccagugccuuuaaaauuccccaguuaagccagaaauggcagauagguuugaacucaaaugccaagucugauugcuuaguaguggcugcuucuguuuguuuguuuguuuuugagacagggucucacucuguugaccagccuggagugcaguggcaugaucauggcucacuguagccucaaacuccugggcucaagcgauccucccaccucagccuccagaguagcugggacuauaggcacgcaccaccaaaccuggcuaaucuuuguguuuuuuuuguagagacaagguccuaguguguuacccaggcuggucuugaauuccugggcucaagcugucuucccacccuggccucccaaaauguugggauuacaggugugagccaccacaccuggccauggcugccucuugagagagauucugaagccacuucuaggagaugaucaguagccauuucuagguuagugauggcugccauggauuuuuggagaaauugacagcacaaaugccacguauuugucaucuuuggguuccaaugauuuugcaaguauaggcaaacuuaucaucuugagucaagaggacccuuucuaagcuaggggcuauagaaugaagggggggaucuuauaggaaggguuaggaugggaugcauguagccaggacagaggugggggcacauggcuggugaacuggucuagagguagauacuugggacugugccaggucaagggcagagccugaugagaggguggccaagucacaagcaggauguggcugaccuuguagaggauguagaugaguagaccuaggagcaggaggccaaacaggauggcuaggaugaugauccacagugggacgccauagcugccuucugccuugguccauugcacagcuguggccaccuggggagcaaguugggugaagucaaugaaagcucagaaguucuuucuacccuauacuuggcccccacuugucauuggaucugcagagcccagugggcuccccuuucucuggggaacagggagggccugugucuggccaggcugagguuccagaucuguugccaucauggccccuucaggguccugggaaauuccuggcuucuccuaaaucagggugaacugggccuccaggaucaggucuggagcaggcccaaauauaguccuggaucugccuggauuaggugccaaugucugagucuggguuccagaucaacuccaccucuuauuuugaacuaacagcauucugaacuuaaaaauugaaguuccuaaaauguacaauauugucucuuacuuucgggcuuucauaucauauccauuuuuuuuuuuuuuugacagagucucacucugucacucaggcuggagugcaguggugugaucucagcuuacuacaaccucugcauccuggucucaagcgauccuccugccucagccucccgaguagcugggaccacagauaugcgccaccacaucuggcuaauuuuuguauuuuuuguagagacaggaucucacuauguugcccagguugaucuugaacuucugagcucaagcaauccacuugccuuggccuuccaaagugcugggauuacaggugugagccacugcgcucagccucauaucuguuauucaccucuccccaggauaucccuuuccugaauggcuagccugguuaguuccuauuuauucuucaggucucagcuugaacaucacuucuuccaggaagccuucccugacccaguuagacuggguucagguguuccuauuauguguuuucauaaauaucaccacacuuggaacacuguguuguuccacgagacugugaacaccaggagcaaagauaccauguugaucuugcuuaccacucugucucuggcaucugcacagugcuuggcacauaguacauucucaacaguuguuaacaauaccaaggccagcccucacccaagucccagcccuguuccagcacucugagcccuguauucccucauccaguccucuggcccuagacucaccugacgcucuuuuuggggcagcugccgaggcaggauucgguagggcaucuucagggcuuuguacacagccucacacugcaggcuaaauggcuggugcucccgcuguggguaggggaaaguugguuagcacauccucucuugggauccagaggacauaggguuccccaucgucuggcugggguugugaucuuucccuauuuugggcucauucuuccugagucucucucucucucucucucuuuuuuuuuuuuuuuuuuuuuugagacuaggucucacucugucccccaggcuggagugcaguggugugggcuuaggucacugcaaccuccaccuccugggcucaagcaauccuccugccucagccucccaaguagcugagacuacaggcaugugccaucaugcccagcuaauuuuuguuuuguuuuguuuuuguagaaguggaguuuugccauguugcccaggcuggucucaaacuucugggcucaagggauccgccaaccuuggccucccaaagugcugggauuacuggugugagccacugugccuggcccgugagcuucucuugauguuccuuauaugagauaauaaauguguaacugaauaauuguaacuugauaauauauaauuagaugacuacguguucaauaaaaauuuuuuuaaaauuauuaaugugcuuugacaccaggacagugccuagccugcagugugugcucaagaagugacugcucuuuacuauuccuacauguguuuaccucuccacuauggauucaucuuccaucuuacuguuuuucuaucauucuuugcacacuggucucccuccagcccucccuccucugaaugggccaggaaagggaagcugcugcucccacuguggccacuagauggcgccaaggacauacagccuggucuagacaagggcaaggaaggggagcuggagugcugggucccauucaccaaaggagagguggcuacugcaguggagaaaggggugggucagucuaagcaggcccaaaggucaggggucagggcugagguaaggcucccucaccugcaagaaagucuuggcccagacucggaaaugcaacugcagacuuuggcucucuuguuggugcaggggcccgagcucacagcgcagccugaaacacucagccuccgggcauuucuaggaagaaagaagcuugaaccugguguucugcccuugugauggcccugagaaccccagaguacucaacacuuugguccacaccucauucccugccugacuuaccaggaucugaggucccgaggaagcagagcugcggcuuggagcuucccguuuuugcugguggugcagggaacccucgggauccaacuauaaaagaaaguguugggccccuuucccaucucauuacagcuucuaagucagcuugcaccuggguuccagagcagcuucaaccuauucuuucaucuaucucuuuauugauucauccaacuguccaccuccuaugcgcaaggcacugagcucaggguuaaaauauggaaaugaggaaaacuugguucuuggagaucacacuggaggagaugcuuaaguaaauaauuaggucuguguuccuguuuuugcacuggauguucccuugguuuggaaugcucaucccugagucuuauagacagguucaaccuuaucuuucaggccucaguucagcugugacgucuucaagagguuuuucuaugauccaauuuaaauagugucccuacagcuuauuaacucuucacuucaucaccuuucaaucccuguuaauuuuucuccuucucuuuuucuuuucuaugucuaucacccuucacuagaauguaaguuccaugaacguggagaccuugucaguucuguuuggugcaauauuuccugggccuaacaguguucaguacagucacuuauuuaauuagauguuaaugaguaaaugaacuauaaaacaggcauucgggcccagaggaaaagguuugaagaaggcuuccuagaggagguggcacauaacugggcccuagggguaugccgggaaacaaagaagggauaguucaggcagaaagaaacacaguggaugaaaguccuuuuuccuccagaggauuuugagguaacuuugggccuugugacccucaacccuagcuauaggcacauccucauugccucuugcaggcccccagcaaccuuccccaaccccucagccuugguccucugaaucugcuccucuuccccaugccaguguucaggaucucaccuccaggcccuuuggguuaauggggugauugguggugcaguugagucccguaacucuggucacauauaggagcugcugaccuuccagagccuggggacagcugaguuccagcacacccuggcuaauggagcuggggccuugguugaugagcugaggagggaagagcacaaucaucaugagaaggaagggaaugcuucugccccauugagacccuggaucaccauggcuccacuauacccugcugucaggcuccuaucucagagaugaagcagggaagcaaugggcagaggugaaauccucucuagccaacacuuuuggagggggcuccaucuuucuuuccaagccacucaauuggccugucucuccucuggcuguuucucacaggacucugccucaugccuuugcauaucacuuacuccucccuccucucuuucucucagucccucacauggguuccagccaucugucacucauauuagcuccuccuuucccaucauucauucuggcccugccccuuccccccuuaccucauagacaugguggacagcaggucccagguccuccuccuucugaggcuggucucggggaugccagucgcuuacugggaauagcacugccucaggcuuggagacacuaaggaggagggugguuuagaggaggguggaaggaaccccauaugcauccuucccuagaagucuguguccccucucagaaagaccccauuuugccuggcacugacccguucagggugaccugggccugagccuccacggagagccgaaaggaaaccacgucgcuuugcgaguuguugagauucuugcugugggauggaggcaagacugaggugcuggagugcagccagugagaauggcgcccagcccucccuuccguccccagcucagccccagccuagacacacucacucccuaccugaggaucuggaagucaaacuggaugguuuucuuagugucccggagaugagggacuguaaaccgaaggccaccccacagcuggggacagaaaaagaggaaaagagggcaguuagacuguguauuucacccucccuccgcaccucacagcugugcucucggcuggcugguuaccgcccucaggucugcucucccucugucccauccucuuucaucccaaacuuacacuggcuccugccuucaugggguugcccaggucacacaccagcaggcggcucugguucacggcaaaguagucacagcucaggcuggagaaguucuggagauggggugggcacuggucagguuuugguguccccucuagagggguauccucccaaaucccacucgagagucucaucucaccccugggugucugacgaguccugaguacucagccucuggaggggcggugacccgaagcucagccucauaggcgccacccucacccacauucugggcauggaaagugagguucagggcauucuugucacccagguacacaugguucugcucccuggaagggacacagaggguaagggacauuggugaauuaauccucaaaccaggacaaaggaccauuauaagaguaguaauacgaggccgggugugguggcucacaccuguaaucccagcacuuugggaggcugaggcggguggaucacgaggucaggaguucaagacaagccuggccaagaugaugaaacccugucucuacuaaaaauaauaauaaaaaaauuagcccggcaugguggcaggcaccuguaaucccagcuacuugggacgcugaggcagagaaucgcuugaaccugggaggcggagguugcagugagccgagauugcgccacugcacuccagccugggugacaagggcaugacuccgucucaaaaaaaaaaaaagaguaauaauaaaguaacaauagacacugcuuacugaguucuaacucuauggcaggcacuaggcuagauuuuuuauguagauuauuucauuuaaucuuuccaaaaagucugagaaauaaaugcuacuauucccacuauacagacaaaggaguuaaagcucagagcagcucagcaacuucccaaggcgacacagcuaguaugucccuagcugauuuuuucaggugccaggugcaccuggagcucccuagcuuaccgucagcccuacuuacccaaacacuuccagcugcaggucaggcacacagauguugucuucuccacaguccagcaagaucugagccuggggagcagggcagccuugagaggggaaguuuagacccauuccugggcuguaggcucuucucuuuccauggcccugcccccccaauacccaggccucugucuucccaggucccuucucccugcccuguccucaccuuguccucuauccggcucuugcucugauaauguagggcuggccugaggccguggcuguccacuggggcuuggggguccaaggagaaguugagagcgaugugaaucggcgagaguuugucucgaaauucugacucguucuggggccagaggagagaguucacggagucaggggacucuggagacuuaguggcccugcuccucagccucucucaucucccuuugucugcuuagggcccaauuccgaccauccucauuguuucagaggcccuggcagccugcuucccagcuccucugacagaaggucucccuuucucagccccuacaagagucccaagcccuucacuggagucccccagucuuuuucccuucaggaggugcccucaguucuguguggccacccucccuggccaguccacaccccgcccucugggccauacccugagguagaucuucaucucucugcaauccucucgagccccauucuggaugagcagggucugggucaggguugccugccuggaggccaggaacagugcccgccguaccccucccuucugcuucugccaguccagcugaaguuccacugugaaaccugaagccagggacauauaaagggaaacugccugucuuuccucaucuuuucagagagaagaaauguccccagguccccagucccuucauucucuguccuagggccugagagauccaggcagucucccucaccaauggagucagcaacguguuuuccagaagcauugaggcagaagcuaagguugaugcuggagagagaccaagaagaaagcuggugaauccaacuggaacagacauccuauccucuaccuaucucccagccagacccagacuaggacaccaccauuuuccccuuuuuaaggcagacuuggugccccugcccacucccaggcucaggucucugcaauuuccugggcaccagcucaccaggccacaggguuccccucuaagcugcagcuccgcuccucuggguugaacauggcggggaagauggugagggaggcacuagcggacacgauggggcggccccugccaagagugaauguggggucaauagaauuaggacuccucuguaaccuggacacaggaaacugaugcccaagcgccagaauguguguccucugcauugauuuucccaaccucagcucuguugagaaauuuccaguuccaguccacccagguuguccccucaucucccuuuggagcucauaccuguauaccacagccuuguccacaccaaaggaccccacaaucagaucuguaagaagucaagaaaucaccucuuacagcaagccccagaucaggauccuuucuuccuaaccccuccugguuucaacgcucagggagguugaagugagaagacagcgcccucuguuggaauuagccagaacugcacccaggaacuuaaggaaaggugcagaagagagaguaggggucagugaccagggaauuuuaaggugaaaaggggccucaggcacaacucaccaggauauccauugccauccaggucucggccuccucgaagggcagagccaaagaagucugggguguggcuggcugcccacaggggcugcagaaccugggaaggcuuagagcccagcccuccugggcccccaggaaauacaaacacuacucccugcugggucuccccaccaaagggagccccgauggccacaucuggaagacacagaacacacacuagucagcaggccaggaauccaugggcucuaaucucuacuaccagaccccaggaccuaggauccuauuuuuucccaucugucagucccuauauucuaaucuucaaaucccaagacccagacagugggauuuuaaccccucgggaagucguggaggucuggguaucuuagcugacagaugcccucuccccaaaucccuucugacuugggccccugccuccucuuucacucucugagcccaugguacucaccauuguagccauccugguccaggucccccaggggggucaaggagcugccaaaucggccaaacucaucauggccagugaggguaagggugggcgugggcucuaugccggcugggugcugcagguagacguagacccugcccaccuccugaggccgcccgucagggguccgauccaugagcaggggugcccccaccagcaagucauccagccugaggggaagggcaaacccaggcaucucgauacccugucuugccaccccaccccaauccuagugcuagaaaucccggacacucugaauuccaucacgucagaagaccugaggucucugaucaucagcucucagcucuuuccuugucccugagcaaggggaaugcagguaugagcgagagucuagagaaaaagcccuggagaaacucuccuugcauuuucugucccauucccacucuucccucuugguucugggaggguaucacagugcgcucauuucccaccacucacccauccccauugacgucuguggcggccacugcauagccaaaguaggaggccaucuggggaggacaaaggggcagcgcugggucagaacuagaagguucaauccacaggaucaagaggggcugggaaguugggcugacauuauuaggucagggcuggggcuucguugacagaggccaagcuggggugggguugagggguauccuuaccuguuccccugagaaguuguagagggaucgaaugucugagccauuaaggauggugaccugggagaugaagagauaggcccauugguccuggacucccagaauaucccaugguuaaagaacagauguguacaggacacccaggggcaggcauuccuuagagacgcagaccacugucccuagcucccucuucagcuuugcccucauauucccaccucuaugccagguaguuccacccuaugucugcuucacuauuuuucucccuaucaaucaccaaccacugacagauuuuguauuuaucuguucguugucccucucuacccacuagaauguaagaucaauaggggcaggaacuugauuuuguucuuugcuuucuccucagaaccuaaagucaugcuuggugaguaguaggcacucaauaauaauuaugacugaaugugugcuggugccucaaacccaucacguucaaaaccuaagucauccucauccuccagucccccgaaccacaaacaccauuucuccccuauauucccuuagugacuggccccaccaggccucuugaauccuggugugagcccuuucccaggacugcuggacagaugucuugacaaugucccugccuccagcucucccagcagaucuaggaggcuaccucuggcuuggaaauccaguggcccccugcagucacugcccaaagucucaacuucuuggcugguccuccaaagcucuggagaaucuggcccuaaccuaucuguuuuugcucaaccuuuccauauucuacucauccucaaucagcucaugagucugcuaaguugggcugaaauuguuuccuuuucuuccaccucauucaugcuccugcacaggaugcccuccugccucaucucugcugaaccuucauagaaccuucucucaucuguccucuuccuuuuuaaaaauuuaaaauuuuuauuuccugacuccccaaacuuguuaccauccuuuuccuagaaaggagauuauucuuuccccuaaacugcuaugccacuguauccacuuugcugaaguuuaccaaaaugcagaaagaaugcugauuuuggauuaagagagaccugauuuuaaaccuacuuacuaacugggugaucuuaagcaacuuacuuggucucuuagaaccucaguguucucauaugcaaaauacagaugauaauaucuaccccauaggcuuguugugaagaauagaaaucaugaauagauagugccugaugcacugaguagagaaugaauaguugcuccacuuuagaucauaauuguaugugugucuuaucuaacauacuugauuagaagcaucuuauaagaugggguaugauaccuuauucaucuuaucucuuaccuugccuuaauaaauguuguuaauugaaugaaauccgauggcacucuuaucuguaucuuuuaaaaagcacuuguccuggucuaauaauaacaucugccaguuguacauugccuaacaauucacugaguacuuucacaugcauuuucucauuucauccuugccagagccucgugaggucagaacgauuguuaucccaguauacagagaagaagaaggcucagagagguucagcaggaagcagaguaugaauaaagagcagaaugauucugccagaguaagugccagaacuugaaugccagucugccuccagagcccauguucugauccaccuuuuugagcccuugcaaacugccaugcacgguucuuugugauuaggcaggggaggagaggaagugaggggucaggcugggucuuacauagccguaagugagguucccuuugggcacaccagcaacaaagucugcaaagagaagagaaaguugugaccuaaggguggggaaagggaagcagauaaugguaaguggccaaguucaugggcucucuggcccugugccucuaaccaucccccucccuuggccccagccuggggacacacucaccuucugugucaucaccacugaauucaccaacagccacagaguauccugggggacaggguggguggauguuaggauuccugcuuugaggaccccucugcucuggccuauccaccaaucccuuccccaccccuacugggccuucauagucagcaggcacaugacaaguauggcaggggugcuggggaugccugaguaggagaggggaggcgagggggugaguggggacaggagcacuugagguucucccucugccaucccuuccccacuugcuugcucaccuagguagcugucaucauagauggaacuggccuggcgagucugcagcugccccugaaccagguugaucagguacucgggguaauaagauucugcaaucugcuccugaguggcagacaggaucuggccuggagagaguaugaagagggaguagauggagaggaaguggcagagggggcuugggacucugggggcugacuggguaguauuucagaagucugguucaagaaagggaagcauggggagggugguggcauguaagcuucaggaaaggaagaggagaauugggaguagggugggaggcuaugugccaggggacuuaaagaauggcagaaacaggcagggcgcggcggcucaugccuauaaucccagcacuuugagaggccaagagggguggaucacgaggucaggaguccaagaccagccuggccaagauggugaaaccccuucucuacuaaaauuacaaaaauuagccaggcgcgguggcaggcgccuguaaucccagcuacuugggaggcugaggcaggagaaucgcuugaaccugggcagcagagguugugccacugcacuccagccugggugacagagugagacuucgucucaaaaaaaaaaaaaaaaaaaaaaaagaauggcagagacaggacuuaccuugccagaaauagcuuccugguccaccuaaaaccacacggccagucugugggugaaaggaggggaguccaacaucuggucccaauccccccauguccaccacccacggccccuucucucccagaccacucucucaccuuggugaacucggcacugaagccuccuuggcaguaacccuguccugcugcccagcugaaaucugugaggggagaagguggugaaaaugagcccugcauagaugggucauccaggaaagaagagagggcauagggaaggaggugggagagagaaccagagaaagggccuuccuggaccagacaguaagcauaaaggcuaacgaacuggguuagccuuuaucuuaagcaaccuagaaccucaugggggcacaugguaggugcgagucaacccuaaguaugugagacacuucaaguauaugagaaggcagacauggggcacaggcccccucuugccccuaccugagcggcagggugcauacuccagaauucgggugaaguuaucuguggagagguagcaggugcccacggggucgcucaguggcuccuucucugugcgccagcuguacaguggagcgcaugccugggagggcccaggaggaggggccuucagauucaguccaauaaggcccuuccucccucccuccaggcccggccuuacccaaccacugcccauccccuggccaccacaccacugagcuugcuggccccucaccaagauggaggagccaugggcucgaacuguugccccgaaccacugcaaggacuuguacuccacaggcuccucucccucugagcuggacagugaggacuccaggagccgagagccuuguggaagugagaagggggagucuuacugagccauggacauuugagcucuagggcagccccuacccucagccuggggauacccaacaaacgcuuccaagcccugagacuccaugacucgcugggaguguggaauugguaaggagcuuaauucugcuuuguguagucuguuuguguagccugacuuaucucuccacuacacacauacacauacacacacacacauacauacacacgcacgcacacgcacacagaaccugggcuuucuuuuuuuuuugagauggagucucacucugucacccaggcuggagugcaguagcaugaucucggcucagugcaaccuccgccucccugguucaagggauucuccugccucagccuccucaguagcugggauuacaggugcgcgucaccacaccuggcuaauuuuuguauuuuuaguagagacgggguuucaucauguuggucaggcugaucucgaacuccugaccucaugaccugcccgccucagccucccaaagugcugggauuacaagcgugagccacugcgcccgcguagaaccugggcuuucuagaguugccuccccaagguuccugcuuucucacccaacugagacaaggaugccugcuguggagcaggggcaggaggaugguggggaacaguggcuauuucccaagagaguaacccuuuggcugcacuucuuugucuauacuuggacugugucucuaacaccaucuuguuccaccuccuuuuuuuuuuuuuuuugagauagggucucacucuguugcccaggcuggagugcaguggcgugauuauggcucacugcaaccuugaccuccugggugcaagugauccucccacaucagccccccaaguggguggaaacuauacccaacuaauuuuuguguuuuuuguacagaugggguuuugccauguugaccagguuuauuuuaauuuuuuuuuuuuuuuaaacagggucuugcucugucacucaggcuacagggcaguggggcaaguagcacucauugcagccuuggcugcagugacggagaaucacucaagugauucucccaccucaaccucccgaguagcugggacuacaagugcucaccacuaugccuggcuaauuuuuuuuuuuuuuuucuugagacagagucuuucucuguagcccacgcuggagugcagugacaugauuucagcucacugcaaucucugccuccugaguucaagcaauucuugugccucagcuucccaaguagcugggauuacaggcaagugccaccaugcccggcuaauuuuuguauuuucaguagagacgggguuuugccaugauggccagucuggucucaaacuccuggccucaggugauccaccugccuuggccucccaaagugcugggauuacaagcaugagccaccacacccagcucugucuaauguuuuugguagagacagggucucacuauguuggccaggauggucuugaacuccugggaccaagugauccuccugccucggccucccaaagugcugggauuacaggcacaugccaccgugcccagccuguccaguuuuuauuucuggagacagauggcccuaguucauauccucucuccaauguuugcuagcuguauaaccuuggauaagcuacuuacccucugucuccucacuuagaaaauggggauaauaauaccuuauacaguuguugaaaagauuaagugaacuaauauauguaaaguguucacaacugggccuggcacagagcaacugauagcuguuagucuccaucuuccucccauccaucugugucuacucagaccuugagcuccuugagggcaguggcuuagucaucuuucagucccugcagcaccagcacagugccugucaugcacugucacuuagucaguacuuaguuaaaggaacugaauaguuugugcaacauucccugucuuugucuguguuacggcccuggccucccagaauugugggugauucaggggaaaugagagccacauguuucugaaucaugcccguccuccuugggcugggcuggaugggagaguggagugagugccauggggauccacuguaagcaguuggagcaccagagcuggugcugagaggucacguggccgggguuccagcaggcuccaccccucgccccaggccccacccaggccuugcccccaggcugcagucccaccccccagucccucccugaauuucacuggccuaccuuugcugucaaauucaaugggggugcacuguguggggcuggcaccccaaggacagagguagacagcaccacccugcagcacuccuggcuggcugguauuagccuugggugcucccaccagcacacugacccugugggggggaaaagcgaggcaguugaggauggcuccuagcuuuucauuggugucuggaggcaggaaggacccaggccucuaggcuggggcuggcuggggguggaguagaugcccccugcguuguauuuauaucucagaagaugccacagaugccagaggcacaggcuggagucaggcgguccccaugugccgcugucacuaacacaacccuccccuccucccgccauucucuguccucuccuaccuuauccuguucauaaagagaggaggaaccacagucaauuucuagaaggggaagaggggccagagccuguaccccuggcuucucccucuccucuacguaccugcugagauuagauguauagcuucuggagcgccaagguccuguggagccucagggucucucaucuagccuauauacucuccucccaagccaaauccccucccugggccaagacccaggcauccggcugcccagccacccagccuuggggcguguaggaggaaaaugugagucuuggaaaucaggcagcaggaguggagagaggagcuggaggacagugaaaacagauuguuccacugggccugggccugcccucaccccggcccuggugugggccuccccuuccuggcugggucuguguuucagcccuugaaccccuuucccauagaccacccccagcugacugaauucagagucugcucuaccggggucccaguucuggacacagugcuucuguucccccugauaugaggggaaguuugcccuguguaaugggguggucauagcuaagggccugggcaguccuccugccgucagcucugccucauucaucccuaggucucuugccuccaagaccuccacaccgcucuuggcucucuugguuuccccuaagggucuccugccaggacuuguaucuggcagccugggcaacucgacccagccucuggaccagugcuccugccagccuuggccucugcucugcucugugucugccucuggcacugcuucucaaucccucugucccucugccccuaugacugcuugcucucuugguuuugguuuuugaauccuaucucucuaucucagauuuuacauuucuccaucucuauugguuucuguucacuuucagcuuucaacccguccaauaccuacccuuucccugauauuugaauaccuuccucagcuuucucacuaggcaagaaggcccaaagugaaggauuaugguagaggucacaagagcuggggguauuuuccaagaagaccagguauacugaggcggggaggaguggcccaggagguauaggggauggaagcagcagagaggacagguccgaggggacggaagaggagagugaggaggggucugugagggccaguggugagaauggaggggagagaaggcaggguccagaggaauaggagauggguaggcugaagagggagagcuccugaaguuaggagggguggggaggggaggugccagucuccguuacucuggggacaggaaauguuuacugccuguggcuuccugucuguuuccaaccucucacuucuccguuugucucccacacccccaccuccgugccaggccccacccuucucacuuaggcaugacauccacuuguggggucuggcugcaccgcccuagggcugggugaugugagagaaggagaccccucucucagcaggggcagcccccagagaacuugguugcugccuucaggcucuagaaagcagaaagggccaccaaccugaacuagaccagaacagcagagguacaggaagcagugaaaggagcacuggaccaggagccaagaguucugguucaggcacuaacuguggacuugggcaauacccucucccucuuccucugggugaagaagagguucucucaaaguuuccuggagcacagggcuaaggccaagggacccuauuccugcugccaauuucuccaacacccacugcucuuggagaggagcugagccugacacuccugggguggccugaggaaguagccuggaguuuagcaggguugcaagacagagaguuuacaaagcuuguaaagcccacaagccaggggcauauccauuccggcugugcgaugguucaggauaccuggcaugcaggcaagggacacagaccuaggccuccuuuccucccggcacacuacccauggcuuauuccuggacaggcaguggcccuuccaucccagcaaccuaaagucaauccaauaaauagugccuccccugccaacacgccaagugaggugacuggugccauggauggcaugcaagcuaguuuguccuuauuuucccacaucuuuuuccugcuuccuaaauccugcagcaguugggcacuuuuaggggucuaagaagguaacaauggaggguccgugugcuauuuucaauauuucagaaagccuaacggaaaucaugcauuuaccagauaagguggccuaggcuaauuaaaaccucaaguguauuugcuuuuggcuggaauuauaucaacuuaugugggaaccugguuaucucaugcuggucagaaacucugauuggcagcuauagauguuuuugguuaauaaaaaaugagaaaagcgccaggugcgguggcucacgccuguaaucccagcacuuugggaggccgagacgggcagaucacgaggucaggagaucgagaccauccuggcuaacauggugaaacuccgucucuacuaaaaauacaaaaaaauuauccgggcgugguggcgggcgcuuguagucccaccuacuagggaggcugaggcaggagaauggcaugaaccugggaggcggagcuugcagggagccgagaucacgccacuacacuccaguccagagacagagcgagacuccuucucaacaacaacaacaacaacaacggccaggcgugguggcucacgcuuguaaucccagcacuuugggaggcugagacaggcagaucaccugaggucgggaguuugagaccagcuugaccaacauggcgaaaccccgucucuacuaaaaauacaaaauuagcugggcgugguggcacaugccuguaauuccagcuacucaggaggcugaggcaggagaaucgcuugaaccagggagguggggguugcggugagccgagauugcgccauugcaucccagacugggcaacaagagcgaaacuccgucucaaaaaaauaaaaaauaaaaauaaaaagaaugagaaaaggaauucauuauuucuuacuaaaugcagguuggcagguacacuuuucugaaauagagucugagagaagaaauaacugccagaauuuauucugaagccucagaaauggaaggguugguccuuggagacacagacuaccacagcuagaaggcacuguagagagcauccacugguuuuaagacuucacuguaggugccugaggccacauggcauaaaggcagacuggccucguucugacacucccuaagaaaaaguucaaagcugcucaccucgucccauguucucauucugcagaugggaaaacuaucucagaggaguuaaguaaugggcuuaggucacucauaaucccucccagaauaugaagcagaaaucaggaauccugauuucuacgacagcauucuagucuaccccauugccaacuuauucccuccucucauaucugcuaucuccccagcuuuugauuaaccaagucccaguucaauacuggguuacuguuugacucuguuggccugacaaggucagggguggagagcagcaaguggaccagcgcccagcuccuacagguccuacagcagcaugggccaggccagaggaggacaccugguuugggguccccuagugcauucacaagggauauguaugauuggcuggggaagaacagcugucuccacuuguggcaguugcagaagggaacaaggagcugagcugagacuggccugccucucaagcuuucaaguguccugggccaagucacugccucucuucaagcuuuggauucucuggcauaaaaugauggauuucccuugaauguuuccuaaacuaacuucugguucaaaauuucuaugacuccugaagccucaguuguuuuuauuuuuuguuuguuuguuguuguuuuuuugagauggagucucacucugucgcccagucuggggucgcucaguacagaugugaucucagcucacugcaaucucugccucccagguucaagggauucuccugccucaguuucccgaguagcugggauuacaggugcgugccagcacgcucggcuaauuuuuuuauuuuuaguagagaugggguuucaccauguuggccaggcuggucucgaacuccugaccucaggugauccacccaccuccgccucccaaagugcuggcauuacaggcgugagccacugcaccuggccagccucaguuuuuguauaucuaaaaauggggcaauaaugcuuccuuugcuuuaacacaaggauuuuuguuacaauccaauggaaaaaucgauaugaaagugcuaaaggaauaugacagacuauuguuacuaucacuaguauaagcaaauacucaaagcaaguaagaaaugagggaacuaggcgguagccaggaaggagagaaccagaaacagaaacagcuaccccauaaaaaccaugccgcccauguauugaucacucucuguggaccagguuccuuuuguauauguuuucucauuuaguccucagaacuccguuagucaggugucugauuuucacgggaagaccaggcuccaagagcuuaaauaccucucccuagguacuaggguaccacgcaaaaaacuaguaaguaguggggacucacaccuaccucugucugacugaaagcuuugcccuuuccuaccaucuaacugcuuuggugcucgcccuguccuuuaauacuauuuugguguucaccacaagaggugaugcaggaagaacaagaacacugaggcucucccucuuuggcaauggcuguaggugaggggcuguguuugucuuguguugugggaaagggggugaaggccuagcuguggugggaggaggucacuggggagguagaauguuccacuguaagaggguauuguaaauaggaaaugagagggaaggagugcaagcuggacaccuggguucucuugggaggggagaugagcagaaggggagggggaagggaugagagagcuagguccuguuuuagaagaggacuuuagggacuacaggaucaggccaggggccagacagacaccuaggggaccaggaaugugugaaguccagauguuuuagaggaguguuuuaaagggaaauuuaggggaggggggaguaaagagaagguuaaaugccagacaacuagauacucugaucugcgggaggagaccucauccccuuccuccuucccucuuuucuacuccauuagggcugugauaagaaguuugagggaaccugggggagaccaggccuggcagaggcuccaggccagggugaugaugcaaugggguuugggcaaaaggccaggggggugggguggggguuggguggggaccuugaauagcccagaacaacagucggggccuaaucauuuuucuuuucucccauccccaaguccuccagacaaaggagaauuugccuuucuccccaguuguauuagcuagauuaaccccuuuucuccaaaaacuauagggacugaguagagaucaguuaacugucucauguguaaaaacaggucgcuucugacagaauuccccucaaacccugagauccugggguuggggugggggugagcaguaggaagcucccagcucagagauguagaagaaaaaggauuacaccagucauuguggaggaccaggaaucuggcaucuauggccuagcccaggagcaaccaccuaccucucuugcuucccaaucuccccgccaucccacauuuaaacagacacccuugguucuaauguugcuuccacucuaacuccuguuucccaagccugucaguaccccauuuucuaggcacucgggguccgggucugcuuaucacugugcugaguugggaauaaggauccuccuuugagauuuccaggguccugaguccuucauucugacguucuuggccccacggagcccccgucuccccagcuuccgaccccagccccagaagucccggucucagcacagcuccagccgaccagcuacaggaaaccagcuuuucucuuccucccaagagccagaggaagagggaaaccgcccaccccccuucacgcgcgcacacaccccucccgacacaucccagcacccgcccuuggcugaguucgcccccagccccagggccccagugccaggguccccgcacucgcccccaguucucggauccccucgccugaacagagauugggggcggagggaggaguaggagacagaggagaaaggagagggagccgccguccucucucgggucuuuccccggucugaguugaggggggaggggaggaugaggcuggcccccauuuaaccuuccgacccccucagucuuugacuuuccuccuacuacacguagcucauucggcuucuacccguucucucgccgcacaauggccccuacggaucccgaggucuccuggagcccccaaaagcccuucccggccucugcgcccccucugcgcccccacccgccccaggucccagcagcccacagacuucagccagagacccucagcucuccauucacgcgcucuccucucccuuggcccggagaccccugcccagacuucuccagcuccguguccucuccccaccggacacaugucuccccacugaucucaaacgccagggccccuccucacccgccacggugcccucccuacuccagcgcgggcccccaacucuagccagggcccccaacugcagcucuauuccuuacaaacuccacccucaaacuuaagcccugguccccuccagaccccagccgcgcccccagucuccaggcggcucccccacccccaucccgucuccagcccuccucacucacccgucuguucccggccgguaaaacuccacugagaauccgaagaaggagcccgggggccccgagaguacugcuggggccuccgcgucuaaguugaagcccccgacccuggguggcggcggcagcagcagcaacagcagcggcagcagcgggggucggcgccgggggccccagcgcagcugcacggcguggagaggggacucuggcguccggcuccccauagcgcccgcucuucccuguccuggggccaccgacccggagccgcuuccuaaaccucccagaggcgaaugacucaacgcggggaggaguuugccaaacucccggcugagcccuccccccgccugccgagggggcuggcgggggggcauuccugggucccuggaacucugagcccgcgucccccaccccuaaggggcguggggggggggcgcaccccuccaacccccuuuccccagccccagcuggaagccgguugucuggacuggguuagacug

SEQ ID NO: 17993 - RNA, 24205 nt, Homo sapiens
cagucuaacccaguccagacaaccggcuuccagcuggggcuggggaaaggggguuggaggggugcgccccccccccacgccccuuaggggugggggacgcgggcucagaguuccagggacccaggaaugcccccccgccagcccccucggcaggcggggggagggcucagccgggaguuuggcaaacuccuccccgcguugagucauucgccucugggagguuuaggaagcggcuccgggucgguggccccaggacagggaagagcgggcgcuauggggagccggacgccagaguccccucuccacgccgugcagcugcgcuggggcccccggcgccgacccccgcugcugccgcugcuguugcugcugcugccgccgccacccagggucgggggcuucaacuuagacgcggaggccccagcaguacucucggggcccccgggcuccuucuucggauucucaguggaguuuuaccggccgggaacagacgggugagugaggagggcuggagacgggaugggggugggggagccgccuggagacugggggcgcggcuggggucuggaggggaccagggcuuaaguuugaggguggaguuuguaaggaauagagcugcaguugggggcccuggcuagaguugggggcccgcgcuggaguagggagggcaccguggcgggugaggaggggcccuggcguuugagaucaguggggagacauguguccgguggggagaggacacggagcuggagaagucugggcaggggucuccgggccaagggagaggagagcgcgugaauggagagcugagggucucuggcugaagucugugggcugcugggaccuggggcgggugggggcgcagagggggcgcagaggccgggaagggcuuuugggggcuccaggagaccucgggauccguaggggccauugugcggcgagagaacggguagaagccgaaugagcuacguguaguaggaggaaagucaaagacugagggggucggaagguuaaaugggggccagccucauccuccccuccccccucaacucagaccggggaaagacccgagagaggacggcggcucccucuccuuucuccucugucuccuacuccucccuccgcccccaaucucuguucaggcgaggggauccgagaacugggggcgagugcggggacccuggcacuggggcccuggggcugggggcgaacucagccaagggcgggugcugggaugugucgggaggggugugugcgcgcgugaaggggggugggcgguuucccucuuccucuggcucuugggaggaagagaaaagcugguuuccuguagcuggucggcuggagcugugcugagaccgggacuucuggggcuggggucggaagcuggggagacgggggcuccguggggccaagaacgucagaaugaaggacucaggacccuggaaaucucaaaggaggauccuuauucccaacucagcacagugauaagcagacccggaccccgagugccuagaaaaugggguacugacaggcuugggaaacaggaguuagaguggaagcaacauuagaaccaagggugucuguuuaaaugugggauggcggggagauugggaagcaagagagguaggugguugcuccugggcuaggccauagaugccagauuccugguccuccacaaugacugguguaauccuuuuucuucuacaucucugagcugggagcuuccuacugcucacccccaccccaaccccaggaucucaggguuugaggggaauucugucagaagcgaccuguuuuuacacaugagacaguuaacugaucucuacucagucccuauaguuuuuggagaaaagggguuaaucuagcuaauacaacuggggagaaaggcaaauucuccuuugucuggaggacuuggggaugggagaaaagaaaaaugauuaggccccgacuguuguucugggcuauucaagguccccacccaacccccaccccaccccccuggccuuuugcccaaaccccauugcaucaucacccuggccuggagccucugccaggccuggucucccccagguucccucaaacuucuuaucacagcccuaauggaguagaaaagagggaaggaggaaggggaugaggucuccucccgcagaucagaguaucuaguugucuggcauuuaaccuucucuuuacuccccccuccccuaaauuucccuuuaaaacacuccucuaaaacaucuggacuucacacauuccugguccccuaggugucugucuggccccuggccugauccuguagucccuaaaguccucuucuaaaacaggaccuagcucucucaucccuucccccuccccuucugcucaucuccccucccaagagaacccagguguccagcuugcacuccuucccucucauuuccuauuuacaauacccucuuacaguggaacauucuaccuccccagugaccuccucccaccacagcuaggccuucacccccuuucccacaacacaagacaaacacagccccucaccuacagccauugccaaagagggagagccucaguguucuuguucuuccugcaucaccucuuguggugaacaccaaaauaguauuaaaggacagggcgagcaccaaagcaguuagaugguaggaaagggcaaagcuuucagucagacagagguaggugugaguccccacuacuuacuaguuuuuugcgugguacccuaguaccuagggagagguauuuaagcucuuggagccuggucuucccgugaaaaucagacaccugacuaacggaguucugaggacuaaaugagaaaacauauacaaaaggaaccugguccacagagagugaucaauacaugggcggcaugguuuuuaugggguagcuguuucuguuucugguucucuccuuccuggcuaccgccuaguucccucauuucuuacuugcuuugaguauuugcuuauacuagugauaguaacaauagucugucauauuccuuuagcacuuucauaucgauuuuuccauuggauuguaacaaaaauccuuguguuaaagcaaaggaagcauuauugccccauuuuuagauauacaaaaacugaggcuggccaggugcaguggcucacgccuguaaugccagcacuuugggaggcggagguggguggaucaccugaggucaggaguucgagaccagccuggccaacauggugaaaccccaucucuacuaaaaauaaaaaaauuagccgagcgugcuggcacgcaccuguaaucccagcuacucgggaaacugaggcaggagaaucccuugaaccugggaggcagagauugcagugagcugagaucacaucuguacugagcgaccccagacugggcgacagagugagacuccaucucaaaaaaacaacaacaaacaaacaaaaaauaaaaacaacugaggcuucaggagucauagaaauuuugaaccagaaguuaguuuaggaaacauucaagggaaauccaucauuuuaugccagagaauccaaagcuugaagagaggcagugacuuggcccaggacacuugaaagcuugagaggcaggccagucucagcucagcuccuuguucccuucugcaacugccacaaguggagacagcuguucuuccccagccaaucauacauaucccuugugaaugcacuaggggaccccaaaccagguguccuccucuggccuggcccaugcugcuguaggaccuguaggagcugggcgcugguccacuugcugcucuccaccccugaccuugucaggccaacagagucaaacaguaacccaguauugaacugggacuugguuaaucaaaagcuggggagauagcagauaugagaggagggaauaaguuggcaaugggguagacuagaaugcugucguagaaaucaggauuccugauuucugcuucauauucugggagggauuaugagugaccuaagcccauuacuuaacuccucugagauaguuuucccaucugcagaaugagaacaugggacgaggugagcagcuuugaacuuuuucuuagggagugucagaacgaggccagucugccuuuaugccauguggccucaggcaccuacagugaagucuuaaaaccaguggaugcucucuacagugccuucuagcugugguagucugugucuccaaggaccaacccuuccauuucugaggcuucagaauaaauucuggcaguuauuucuucucucagacucuauuucagaaaaguguaccugccaaccugcauuuaguaagaaauaaugaauuccuuuucucauucuuuuuauuuuuauuuuuuauuuuuuugagacggaguuucgcucuuguugcccagucugggaugcaauggcgcaaucucggcucaccgcaacccccaccucccugguucaagcgauucuccugccucagccuccugaguagcuggaauuacaggcaugugccaccacgcccagcuaauuuuguauuuuuaguagagacgggguuucgccauguuggucaagcuggucucaaacucccgaccucaggugaucugccugucucagccucccaaagugcugggauuacaagcgugagccaccacgccuggccguuguuguuguuguuguuguugagaaggagucucgcucugucucuggacuggaguguaguggcgugaucucggcucccugcaagcuccgccucccagguucaugccauucuccugccucagccucccuaguaggugggacuacaagcgcccgccaccacgcccggauaauuuuuuuguauuuuuaguagagacggaguuucaccauguuagccaggauggucucgaucuccugaccucgugaucugcccgucucggccucccaaagugcugggauuacaggcgugagccaccgcaccuggcgcuuuucucauuuuuuauuaaccaaaaacaucuauagcugccaaucagaguuucugaccagcaugagauaaccagguucccacauaaguugauauaauuccagccaaaagcaaauacacuugagguuuuaauuagccuaggccaccuuaucugguaaaugcaugauuuccguuaggcuuucugaaauauugaaaauagcacacggacccuccauuguuaccuucuuagaccccuaaaagugcccaacugcugcaggauuuaggaagcaggaaaaagaugugggaaaauaaggacaaacuagcuugcaugccauccauggcaccagucaccucacuuggcguguuggcaggggaggcacuauuuauuggauugacuuuagguugcugggauggaagggccacugccuguccaggaauaagccauggguagugugccgggaggaaaggaggccuaggucugugucccuugccugcaugccagguauccugaaccaucgcacagccggaauggauaugccccuggcuugugggcuuuacaagcuuuguaaacucucugucuugcaacccugcuaaacuccaggcuacuuccucaggccaccccaggagugucaggcucagcuccucuccaagagcaguggguguuggagaaauuggcagcaggaauagggucccuuggccuuagcccugugcuccaggaaacuuugagagaaccucuucuucacccagaggaagagggagaggguauugcccaaguccacaguuagugccugaaccagaacucuuggcuccugguccagugcuccuuucacugcuuccuguaccucugcuguucuggucuaguucagguugguggcccuuucugcuuucuagagccugaaggcagcaaccaaguucucugggggcugccccugcugagagaggggucuccuucucucacaucacccagcccuagggcggugcagccagaccccacaaguggaugucaugccuaagugagaaggguggggccuggcacggaggugggggugugggagacaaacggagaagugagagguuggaaacagacaggaagccacaggcaguaaacauuuccuguccccagaguaacggagacuggcaccuccccuccccaccccuccuaacuucaggagcucucccucuucagccuacccaucuccuauuccucuggacccugccuucucuccccuccauucucaccacuggcccucacagaccccuccucacucuccucuuccguccccucggaccuguccucucugcugcuuccauccccuauaccuccugggccacuccuccccgccucaguauaccuggucuucuuggaaaauacccccagcucuugugaccucuaccauaauccuucacuuugggccuucuugccuagugagaaagcugaggaagguauucaaauaucagggaaaggguagguauuggacggguugaaagcugaaagugaacagaaaccaauagagauggagaaauguaaaaucugagauagagagauaggauucaaaaaccaaaaccaagagagcaagcagucauaggggcagagggacagagggauugagaagcagugccagaggcagacacagagcagagcagaggccaaggcuggcaggagcacugguccagaggcugggucgaguugcccaggcugccagauacaaguccuggcaggagacccuuaggggaaaccaagagagccaagagcgguguggaggucuuggaggcaagagaccuagggaugaaugaggcagagcugacggcaggaggacugcccaggcccuuagcuaugaccaccccauuacacagggcaaacuuccccucauaucagggggaacagaagcacuguguccagaacugggaccccgguagagcagacucugaauucagucagcuggggguggucuaugggaaagggguucaagggcugaaacacagacccagccaggaaggggaggcccacaccagggccggggugagggcaggcccaggcccaguggaacaaucuguuuucacuguccuccagcuccucucuccacuccugcugccugauuuccaagacucacauuuuccuccuacacgccccaaggcuggguggcugggcagccggaugccugggucuuggcccagggaggggauuuggcuugggaggagaguauauaggcuagaugagagacccugaggcuccacaggaccuuggcgcuccagaagcuauacaucuaaucucagcagguacguagaggagagggagaagccagggguacaggcucuggccccucuuccccuucuagaaauugacugugguuccuccucucuuuaugaacaggauaagguaggagaggacagagaauggcgggaggaggggaggguuguguuagugacagcggcacauggggaccgccugacuccagccugugccucuggcaucuguggcaucuucugagauauaaauacaacgcagggggcaucuacuccacccccagccagccccagccuagaggccuggguccuuccugccuccagacaccaaugaaaagcuaggagccauccucaacugccucgcuuuucccccccacagggucagugugcuggugggagcacccaaggcuaauaccagccagccaggagugcugcaggguggugcugucuaccucuguccuuggggugccagccccacacagugcacccccauugaauuugacagcaaagguaggccagugaaauucagggagggacuggggggugggacugcagccugggggcaaggccuggguggggccuggggcgagggguggagccugcuggaaccccggccacgugaccucucagcaccagcucuggugcuccaacugcuuacaguggauccccauggcacucacuccacucucccauccagcccagcccaaggaggacgggcaugauucagaaacauguggcucucauuuccccugaaucacccacaauucugggaggccagggccguaacacagacaaagacagggaauguugcacaaacuauucaguuccuuuaacuaaguacugacuaagugacagugcaugacaggcacugugcuggugcugcagggacugaaagaugacuaagccacugcccucaaggagcucaaggucugaguagacacagauggaugggaggaagauggagacuaacagcuaucaguugcucugugccaggcccaguugugaacacuuuacauauauuaguucacuuaaucuuuucaacaacuguauaagguauuauuauccccauuuucuaagugaggagacagaggguaaguagcuuauccaagguuauacagcuagcaaacauuggagagaggauaugaacuagggccaucugucuccagaaauaaaaacuggacaggcugggcacgguggcaugugccuguaaucccagcacuuugggaggccgaggcaggaggaucacuuggucccaggaguucaagaccauccuggccaacauagugagacccugucucuaccaaaaacauuagacagagcugggugugguggcucaugcuuguaaucccagcacuuugggaggccaaggcagguggaucaccugaggccaggaguuugagaccagacuggccaucauggcaaaaccccgucucuacugaaaauacaaaaauuagccgggcaugguggcacuugccuguaaucccagcuacuugggaagcugaggcacaagaauugcuugaacucaggaggcagagauugcagugagcugaaaucaugucacugcacuccagcgugggcuacagagaaagacucugucucaagaaaaaaaaaaaaaaaauuagccaggcauaguggugagcacuuguagucccagcuacucgggagguugaggugggagaaucacuugagugauucuccgucacugcagccaaggcugcaaugagugcuacuugccccacugcccuguagccugagugacagagcaagacccuguuuaaaaaaaaaaaaaaauuaaaauaaaccuggucaacauggcaaaaccccaucuguacaaaaaacacaaaaauuaguuggguauaguuuccacccacuuggggggcugaugugggaggaucacuugcacccaggaggucaagguugcagugagccauaaucacgccacugcacuccagccugggcaacagagugagacccuaucucaaaaaaaaaaaaaaaaggagguggaacaagaugguguuagagacacaguccaaguauagacaaagaagugcagccaaaggguuacucucuugggaaauagccacuguuccccaccauccuccugccccugcuccacagcaggcauccuugucucaguugggugagaaagcaggaaccuuggggaggcaacucuagaaagcccagguucuacgcgggcgcaguggcucacgcuuguaaucccagcacuuugggaggcugaggcgggcaggucaugaggucaggaguucgagaucagccugaccaacaugaugaaaccccgucucuacuaaaaauacaaaaauuagccagguguggugacgcgcaccuguaaucccagcuacugaggaggcugaggcaggagaaucccuugaaccagggaggcggagguugcacugagccgagaucaugcuacugcacuccagccugggugacagagugagacuccaucucaaaaaaaaaagaaagcccagguucugugugcgugugcgugcguguguauguauguguguguguguauguguauguguguaguggagagauaagucaggcuacacaaacagacuacacaaagcagaauuaagcuccuuaccaauuccacacucccagcgagucauggagucucagggcuuggaagcguuuguuggguauccccaggcugaggguaggggcugcccuagagcucaaauguccauggcucaguaagacucccccuucucacuuccacaaggcucucggcuccuggaguccucacuguccagcucagagggagaggagccuguggaguacaaguccuugcagugguucggggcaacaguucgagcccauggcuccuccaucuuggugaggggccagcaagcucaguggugugguggccaggggaugggcagugguuggguaaggccgggccuggagggagggaggaagggccuuauuggacugaaucugaaggccccuccuccugggcccucccaggcaugcgcuccacuguacagcuggcgcacagagaaggagccacugagcgaccccgugggcaccugcuaccucuccacagauaacuucacccgaauucuggaguaugcacccugccgcucagguaggggcaagagggggccugugccccaugucugccuucucauauacuugaagugucucacauacuuaggguugacucgcaccuaccaugugcccccaugagguucuagguugcuuaagauaaaggcuaacccaguucguuagccuuuaugcuuacugucugguccaggaaggcccuuucucugguucucucucccaccuccuucccuaugcccucucuucuuuccuggaugacccaucuaugcagggcucauuuucaccaccuucuccccucacagauuucagcugggcagcaggacaggguuacugccaaggaggcuucagugccgaguucaccaaggugagagaguggucugggagagaaggggccgugggugguggacauggggggauugggaccagauguuggacuccccuccuuucacccacagacuggccgugugguuuuagguggaccaggaagcuauuucuggcaagguaaguccugucucugccauucuuuuuuuuuuuuuuuuuuuuuuuugagacgaagucucacucugucacccaggcuggagugcaguggcacaaccucugcugcccagguucaagcgauucuccugccucagccucccaaguagcugggauuacaggcgccugccaccgcgccuggcuaauuuuuguaauuuuaguagagaagggguuucaccaucuuggccaggcuggucuuggacuccugaccucgugauccaccccucuuggccucucaaagugcugggauuauaggcaugagccgccgcgcccugccuguuucugccauucuuuaaguccccuggcacauagccucccacccuacucccaauucuccucuuccuuuccugaagcuuacaugccaccacccuccccaugcuucccuuucuugaaccagacuucugaaauacuacccagucagcccccagagucccaagcccccucugccacuuccucuccaucuacucccucuucauacucucuccaggccagauccugucugccacucaggagcagauugcagaaucuuauuaccccgaguaccugaucaaccugguucaggggcagcugcagacucgccaggccaguuccaucuaugaugacagcuaccuaggugagcaagcaaguggggaagggauggcagagggagaaccucaagugcuccuguccccacucacccccucgccuccccucuccuacucaggcauccccagcaccccugccauacuugucaugugccugcugacuaugaaggcccaguagggguggggaagggauugguggauaggccagagcagagggguccucaaagcaggaauccuaacauccacccacccugucccccaggauacucuguggcuguuggugaauucaguggugaugacacagaaggugaguguguccccaggcuggggccaagggagggggaugguuagaggcacagggccagagagcccaugaacuuggccacuuaccauuaucugcuucccuuuccccacccuuaggucacaacuuucucuucucuuugcagacuuuguugcuggugugcccaaagggaaccucacuuacggcuauguaagacccagccugaccccucacuuccucuccuccccugccuaaucacaaagaaccgugcauggcaguuugcaagggcucaaaaagguggaucagaacaugggcucuggaggcagacuggcauucaaguucuggcacuuacucuggcagaaucauucugcucuuuauucauacucugcuuccugcugaaccucucugagccuucuucuucucuguauacugggauaacaaucguucugaccucacgaggcucuggcaaggaugaaaugagaaaaugcaugugaaaguacucagugaauuguuaggcaauguacaacuggcagauguuauuauuagaccaggacaagugcuuuuuaaaagauacagauaagagugccaucggauuucauucaauuaacaacauuuauuaaggcaagguaagagauaagaugaauaagguaucauaccccaucuuauaagaugcuucuaaucaaguauguuagauaagacacacauacaauuaugaucuaaaguggagcaacuauucauucucuacucagugcaucaggcacuaucuauucaugauuucuauucuucacaacaagccuaugggguagauauuaucaucuguauuuugcauaugagaacacugagguucuaagagaccaaguaaguugcuuaagaucacccaguuaguaaguagguuuaaaaucaggucucucuuaauccaaaaucagcauucuuucugcauuuugguaaacuucagcaaaguggauacaguggcauagcaguuuaggggaaagaauaaucuccuuucuaggaaaaggaugguaacaaguuuggggagucaggaaauaaaaauuuuaaauuuuuaaaaaggaagaggacagaugagagaagguucuaugaagguucagcagagaugaggcaggagggcauccugugcaggagcaugaaugagguggaagaaaaggaaacaauuucagcccaacuuagcagacucaugagcugauugaggaugaguagaauauggaaagguugagcaaaaacagauagguuagggccagauucuccagagcuuuggaggaccagccaagaaguugagacuuugggcagugacugcagggggccacuggauuuccaagccagagguagccuccuagaucugcugggagagcuggaggcagggacauugucaagacaucuguccagcaguccugggaaagggcucacaccaggauucaagaggccugguggggccagucacuaagggaauauaggggagaaaugguguuugugguucgggggacuggaggaugaggaugacuuagguuuugaacgugauggguuugaggcaccagcacacauucagucauaauuauuauugagugccuacuacucaccaagcaugacuuuagguucugaggagaaagcaaagaacaaaaucaaguuccugccccuauugaucuuacauucuaguggguagagagggacaacgaacagauaaauacaaaaucugucagugguuggugauugauagggagaaaaauagugaagcagacauaggguggaacuaccuggcauagaggugggaauaugagggcaaagcugaagagggagcuagggacaguggucugcgucucuaaggaaugccugccccuggguguccuguacacaucuguucuuuaaccaugggauauucugggaguccaggaccaaugggccuaucucuucaucucccaggucaccauccuuaauggcucagacauucgaucccucuacaacuucucaggggaacagguaaggauaccccucaaccccaccccagcuuggccucugucaacgaagccccagcccugaccuaauaaugucagcccaacuucccagccccucuugauccuguggauugaaccuucuaguucugacccagcgcugccccuuuguccuccccagauggccuccuacuuuggcuaugcaguggccgccacagacgucaauggggaugggugaguggugggaaaugagcgcacugugauacccucccagaaccaagagggaagagugggaaugggacagaaaaugcaaggagaguuucuccagggcuuuuucucuagacucucgcucauaccugcauuccccuugcucagggacaaggaaagagcugagagcugaugaucagagaccucaggucuucugacgugauggaauucagaguguccgggauuucuagcacuaggauuggggugggguggcaagacaggguaucgagaugccuggguuugcccuuccccucaggcuggaugacuugcuggugggggcaccccugcucauggaucggaccccugacgggcggccucaggaggugggcagggucuacgucuaccugcagcacccagccggcauagagcccacgcccacccuuacccucacuggccaugaugaguuuggccgauuuggcagcuccuugaccccccugggggaccuggaccaggauggcuacaauggugaguaccaugggcucagagagugaaagaggaggcaggggcccaagucagaagggauuuggggagagggcaucugucagcuaagauacccagaccuccacgacuucccgagggguuaaaaucccacugucugggucuugggauuugaagauuagaauauagggacugacagaugggaaaaaauaggauccuagguccuggggucugguaguagagauuagagcccauggauuccuggccugcugacuaguguguguucugugucuuccagauguggccaucggggcucccuuugguggggagacccagcagggaguaguguuuguauuuccugggggcccaggagggcugggcucuaagccuucccagguucugcagccccugugggcagccagccacaccccagacuucuuuggcucugcccuucgaggaggccgagaccuggauggcaauggauauccuggugaguugugccugaggccccuuuucaccuuaaaauucccuggucacugaccccuacucucucuucugcaccuuuccuuaaguuccugggugcaguucuggcuaauuccaacagagggcgcugucuucucacuucaaccucccugagcguugaaaccaggagggguuaggaagaaaggauccugaucuggggcuugcuguaagaggugauuucuugacuucuuacagaucugauugugggguccuuugguguggacaaggcugugguauacagguaugagcuccaaagggagaugaggggacaaccuggguggacuggaacuggaaauuucucaacagagcugagguugggaaaaucaaugcagaggacacacauucuggcgcuugggcaucaguuuccuguguccagguuacagaggaguccuaauucuauugaccccacauucacucuuggcaggggccgccccaucguguccgcuagugccucccucaccaucuuccccgccauguucaacccagaggagcggagcugcagcuuagaggggaacccuguggccuggugagcuggugcccaggaaauugcagagaccugagccugggagugggcaggggcaccaagucugccuuaaaaaggggaaaauggugguguccuagucugggucuggcugggagauagguagaggauaggaugucuguuccaguuggauucaccagcuuucuucuuggucucucuccagcaucaaccuuagcuucugccucaaugcuucuggaaaacacguugcugacuccauuggugagggagacugccuggaucucucaggcccuaggacagagaaugaagggacuggggaccuggggacauuucuucucucugaaaagaugaggaaagacaggcaguuucccuuuauaugucccuggcuucagguuucacaguggaacuucagcuggacuggcagaagcagaagggagggguacggcgggcacuguuccuggccuccaggcaggcaacccugacccagacccugcucauccagaauggggcucgagaggauugcagagagaugaagaucuaccucaggguauggcccagagggcgggguguggacuggccagggaggguggccacacagaacugagggcaccuccugaagggaaaaagacugggggacuccagugaagggcuugggacucuuguaggggcugagaaagggagaccuucugucagaggagcugggaagcaggcugccagggccucugaaacaaugaggauggucggaauugggcccuaagcagacaaagggagaugagagaggcugaggagcagggccacuaagucuccagaguccccugacuccgugaacucucuccucuggccccagaacgagucagaauuucgagacaaacucucgccgauucacaucgcucucaacuucuccuuggacccccaagccccaguggacagccacggccucaggccagcccuacauuaucagagcaagagccggauagaggacaaggugaggacagggcagggagaagggaccugggaagacagaggccuggguauugggggggcagggccauggaaagagaagagccuacagcccaggaaugggucuaaacuuccccucucaaggcugcccugcuccccaggcucagaucuugcuggacuguggagaagacaacaucugugugccugaccugcagcuggaaguguuuggguaaguagggcugacgguaagcuagggagcuccaggugcaccuggcaccugaaaaaaucagcuagggacauacuagcugugucgccuugggaaguugcugagcugcucugagcuuuaacuccuuugucuguauagugggaauaguagcauuuauuucucagacuuuuuggaaagauuaaaugaaauaaucuacauaaaaaaucuagccuagugccugccauagaguuagaacucaguaagcagugucuauuguuacuuuauuauuacucuuuuuuuuuuuuugagacggagucaugcccuugucacccaggcuggagugcaguggcgcaaucucggcucacugcaaccuccgccucccagguucaagcgauucucugccucagcgucccaaguagcugggauuacaggugccugccaccaugccgggcuaauuuuuuuauuauuauuuuuaguagagacaggguuucaucaucuuggccaggcuugucuugaacuccugaccucgugauccacccgccucagccucccaaagugcugggauuacaggugugagccaccacacccggccucguauuacuacucuuauaaugguccuuuguccugguuugaggauuaauucaccaaugucccuuacccucugugucccuuccagggagcagaaccauguguaccugggugacaagaaugcccugaaccucacuuuccaugcccagaaugugggugaggguggcgccuaugaggcugagcuucgggucaccgccccuccagaggcugaguacucaggacucgucagacacccaggggugagaugagacucucgagugggauuugggaggauaccccucuagaggggacaccaaaaccugaccagugcccaccccaucuccagaacuucuccagccugagcugugacuacuuugccgugaaccagagccgccugcuggugugugaccugggcaaccccaugaaggcaggagccaguguaaguuugggaugaaagaggaugggacagagggagagcagaccugagggcgguaaccagccagccgagagcacagcugugaggugcggagggagggugaaauacacagucuaacugcccucuuuuccucuuuuucuguccccagcugugggguggccuucgguuuacagucccucaucuccgggacacuaagaaaaccauccaguuugacuuccagauccucagguagggagugagugugucuaggcuggggcugagcuggggacggaagggagggcugggcgccauucucacuggcugcacuccagcaccucagucuugccuccaucccacagcaagaaucucaacaacucgcaaagcgacgugguuuccuuucggcucuccguggaggcucaggcccaggucacccugaacgggucagugccaggcaaaauggggucuuucugagaggggacacagacuucuagggaaggaugcauaugggguuccuuccacccuccucuaaaccacccuccuccuuagugucuccaagccugaggcagugcuauucccaguaagcgacuggcauccccgagaccagccucagaaggaggaggaccugggaccugcuguccaccaugucuaugagguaaggggggaaggggcagggccagaaugaaugaugggaaaggaggagcuaauaugagugacagauggcuggaacccaugugagggacugagagaaagagaggagggaggaguaagugauaugcaaaggcaugaggcagaguccugugagaaacagccagaggagagacaggccaauugaguggcuuggaaagaaagauggagcccccuccaaaaguguuggcuagagaggauuucaccucugcccauugcuucccugcuucaucucugagauaggagccugacagcaggguauaguggagccauggugauccagggucucaauggggcagaagcauucccuuccuucucaugaugauugugcucuucccuccucagcucaucaaccaaggccccagcuccauuagccagggugugcuggaacucagcuguccccaggcucuggaaggucagcagcuccuauaugugaccagaguuacgggacucaacugcaccaccaaucaccccauuaacccaaagggccuggaggugagauccugaacacuggcauggggaagaggagcagauucagaggaccaaggcugagggguuggggaagguugcugggggccugcaagaggcaaugaggaugugccuauagcuaggguugagggucacaaggcccaaaguuaccucaaaauccucuggaggaaaaaggacuuucauccacuguguuucuuucugccugaacuaucccuucuuuguuucccggcauaccccuagggcccaguuaugugccaccuccucuaggaagccuucuucaaaccuuuuccucugggcccgaaugccuguuuuauaguucauuuacucauuaacaucuaauuaaauaagugacuguacugaacacuguuaggcccaggaaauauugcaccaaacagaacugacaaggucuccacguucauggaacuuacauucuagugaagggugauagacauagaaaagaaaaagagaaggagaaaaauuaacagggauugaaaggugaugaagugaagaguuaauaagcuguagggacacuauuuaaauuggaucauagaaaaaccucuugaagacgucacagcugaacugaggccugaaagauaagguugaaccugucuauaagacucagggaugagcauuccaaaccaagggaacauccagugcaaaaacaggaacacagaccuaauuauuuacuuaagcaucuccuccagugugaucuccaagaaccaaguuuuccucauuuccauauuuuaacccugagcucagugccuugcgcauaggagguggacaguuggaugaaucaauaaagagauagaugaaagaauagguugaagcugcucuggaacccaggugcaagcugacuuagaagcuguaaugagaugggaaaggggcccaacacuuucuuuuauaguuggaucccgaggguucccugcaccaccagcaaaaacgggaagcuccaagccgcagcucugcuuccucgggaccucagauccugguaagucaggcagggaaugagguguggaccaaaguguugaguacucugggguucucagggccaucacaagggcagaacaccagguucaagcuucuuucuuccuagaaaugcccggaggcugaguguuucaggcugcgcugugagcucgggccccugcaccaacaagagagccaaagucugcaguugcauuuccgagucugggccaagacuuucuugcaggugagggagccuuaccucagcccugaccccugaccuuugggccugcuuagacugacccaccccuuucuccacugcaguagccaccucuccuuuggugaaugggacccagcacuccagcuccccuuccuugcccuugucuagaccaggcuguauguccuuggcgccaucuaguggccacagugggagcagcagcuucccuuuccuggcccauucagaggagggagggcuggagggagaccagugugcaaagaaugauagaaaaacaguaagauggaagaugaauccauaguggagagguaaacacauguaggaauaguaaagagcagucacuucuugagcacacacugcaggcuaggcacuguccuggugucaaagcacauuaauaauuuuaaaaaaauuuuuauugaacacguagucaucuaauuauauauuaucaaguuacaauuauucaguuacacauuuauuaucucauauaaggaacaucaagagaagcucacgggccaggcacaguggcucacaccaguaaucccagcacuuugggaggccaagguuggcggaucccuugagcccagaaguuugagaccagccugggcaacauggcaaaacuccacuucuacaaaaacaaaacaaaacaaaaauuagcugggcaugauggcacaugccuguagucucagcuacuugggaggcugaggcaggaggauugcuugagcccaggagguggagguugcagugaccuaagcccacaccacugcacuccagccugggggacagagugagaccuagucucaaaaaaaaaaaaaaaaaaaaaagagagagagagagagagagacucaggaagaaugagcccaaaauagggaaagaucacaaccccagccagacgauggggaacccuauguccucuggaucccaagagaggaugugcuaaccaacuuuccccuacccacagcgggagcaccagccauuuagccugcagugugaggcuguguacaaagcccugaagaugcccuaccgaauccugccucggcagcugccccaaaaagagcgucaggugagucuagggccagaggacuggaugagggaauacagggcucagagugcuggaacagggcugggacuugggugagggcuggccuugguauuguuaacaacuguugagaauguacuaugugccaagcacugugcagaugccagagacagagugguaagcaagaucaacaugguaucuuugcuccugguguucacagucucguggaacaacacaguguuccaaguguggugauauuuaugaaaacacauaauaggaacaccugaacccagucuaacugggucagggaaggcuuccuggaagaagugauguucaagcugagaccugaagaauaaauaggaacuaaccaggcuagccauucaggaaagggauauccuggggagaggugaauaacagauaugaggcugagcgcaguggcucacaccuguaaucccagcacuuuggaaggccaaggcaaguggauugcuugagcucagaaguucaagaucaaccugggcaacauagugagauccugucucuacaaaaaauacaaaaauuagccagaugugguggcgcauaucuguggucccagcuacucgggaggcugaggcaggaggaucgcuugagaccaggaugcagagguuguaguaagcugagaucacaccacugcacuccagccugagugacagagugagacucugucaaaaaaaaaaaaaaauggauaugauaugaaagcccgaaaguaagagacaauauuguacauuuuaggaacuucaauuuuuaaguucagaaugcuguuaguucaaaauaagagguggaguugaucuggaacccagacucagacauuggcaccuaauccaggcagauccaggacuauauuugggccugcuccagaccugauccuggaggcccaguucacccugauuuaggagaagccaggaauuucccaggacccugaaggggccaugauggcaacagaucuggaaccucagccuggccagacacaggcccucccuguuccccagagaaaggggagcccacugggcucugcagauccaaugacaagugggggccaaguauaggguagaaagaacuucugagcuuucauugacuucacccaacuugcuccccagguggccacagcugugcaauggaccaaggcagaaggcagcuauggcgucccacuguggaucaucauccuagccauccuguuuggccuccugcuccuaggucuacucaucuacauccucuacaaggucagccacauccugcuugugacuuggccacccucucaucaggcucugcccuugaccuggcacagucccaaguaucuaccucuagaccaguucaccagccaugugcccccaccucuguccuggcuacaugcaucccauccuaacccuuccuauaagaucccccccuucauucuauagccccuagcuuagaaaggguccucuugacucaagaugauaaguuugccuauacuugcaaaaucauuggaacccaaagaugacaaauacguggcauuugugcugucaauuucuccaaaaauccauggcagccaucacuaaccuagaaauggcuacugaucaucuccuagaaguggcuucagaaucucucucaagaggcagccauggccaggugugguggcucacaccuguaaucccaacauuuugggaggccagggugggaagacagcuugagcccaggaauucaagaccagccuggguaacacacuaggaccuugucucuacaaaaaaaacacaaagauuagccagguuugguggugcgugccuauagucccagcuacucuggaggcugaggugggaggaucgcuugagcccaggaguuugaggcuacagugagccaugaucaugccacugcacuccaggcuggucaacagagugagacccugucucaaaaacaaacaaacaaacagaagcagccacuacuaagcaaucagacuuggcauuugaguucaaaccuaucugccauuucuggcuuaacuggggaauuuuaaaggcacugguaaaagauaccccccauacaaaaucacccccaaguuugguccuccuggguccauugcacaacuuagagggguaguccuagccugaauucagaggccacuuuugcaggauguagagguuggaggcacuagaguccuccuuauuacuucuuggaauaagagcuguggagaaauggcagccauaguaccuaaacucucccucuuuuccccuuuaucagcuuggauucuucaaacgcucccucccauauggcaccgccauggaaaaagcucagcucaagccuccagccaccucugaugccugaguccucccaauuucagacucccauuccugaagaaccaguccccccacccucauucuacugaaaaggaggggucuggguacuucuugaaggugcugacggccagggagaagcuccucuccccagcccagagacauacuugaagggccagagccaggggggugaggagcuggggaucccucccccccaugcacugugaaggacccuuguuuacacauacccucuucauggaugggggaacucagauccagggacagaggccccagccucccugaagccuuugcauuuuggagaguuuccugaaacaacuuggaaagauaacuaggaaauccauucacaguucuuugggccagacaugccacaaggacuuccuguccagcuccaaccugcaaagaucuguccucagccuugccagagauccaaaagaagcccccagcuaagaaccuggaacuuggggaguuaagaccuggcagcucuggacagccccacccuggugggccaacaaagaacacuaacuaugcauggugccccaggaccagcucaggacagaugccacacaaggauagaugcuggcccagggcccagagcccagcuccaaggggaaucagaacucaaauggggccagauccagccuggggucuggaguugaucuggaacccagacucagacauuggcaccuaauccaggcagauccaggacuauauuugggccugcuccagaccugauccuggaggcccaguucacccugauuuaggagaagccaggaauuucccaggacccugaaggggccaugauggcaacagaucuggaaccucagccuggccagacacaggcccucccuguuccccagagaaaggggagcccacuguccugggccugcagaauuuggguucugccugccagcugcacugaugcugccccucaucucucugcccaacccuucccucaccuuggcaccagacacccaggacuuauuuaaacucuguugcaagugcaauaaaucugacccagugcccccacugaccagaa

SEQ ID NO: 17994 - RNA, 481 nt, Homo sapiens
aagggagauaggaggaugugcggugcugguggugcuggugguggcagaaguagguguugcaguuuuagauggaguguccaggaaaggccucuuugagaaaguaacaauugaguaaaccugugaggacacugagaaagccacgcauguaacuacuggggaaagagcauucuagguagaggaaacagcaagugcaaaggcucugagguucgaacaugccuucuagguucaagggacauggagaaagacagugugucugcagcacuaugagccugggagagacugguaggauguaaggugagggaggucagaaaaguggcagauuguguaugcgcuuauaugucauuguaaggacuucggcuuuuauucugagugagaugggagauggggagccuuggcagguuuugugcaaagcugcaaugauuagacuugacucaauauuuuacucuggcuacauuagcgggggcaaggacagaagcaggga

SEQ ID NO: 17995 - RNA, 9159 nt, Homo sapiens
gaguccccggagccgcgagcugggagcgcugugccgggagccgggagccgagcgcgccgggcuggggccggggccggagcggagcggagagggagcgcgcccgccccagccccgagucccgccgccuucccucccgccgcagcgcgggcccaccggccgccgccccagccauggagcaagacaacagcccccgaaagauccaguucacggucccgcugcuggagccgcaccuugaccccgaggcggcggagcaggugcggagcagggcggggcggcagggcacucgcccagccaaggacgagggaccccuggacuggugggacccaggaucccugccuaguccucccuuagcagugcgcccuuuugaggacgaacgcucaguuugcggggggcgggggggggucuucuguccccucccccaccgucggagccacaucucgaaucugugcuucuuugagacugaccgaaggaagagcgccuccacucgaugccuggccccgcgagagucgcucucuuccuccccaguccugggggagggggccugcuugaggacacgaccccucccuccuuaaacaacccugcaucccccacccagucaacccccacuagaguuucugagcuuggugguggcgcugaagggaaucagcagcagugcgggaggggccuggggaggggucgguaauggagagggagccuggaagggugggaguuggaagaggagaaacagcucucccuguccccuccuaacugggggccaccuugcugggcuccgaaagugauaacaggaagggacugaggaccacugagagggcuggggcuccagggagaggggagagggguggucgaguuguaggcugaggcucccuucuucaagucuccgcacauggcccuuauucccaacuccugcccuuuggaguggggaguccaggugggacugagccagcagcacugggaggccagagguggagucuuuccaggggcugggguccaagcugaacaauaugcaagggagaagcacugugacagccuuggcucaaggggugggaguccagggcccuggcccagccuccuagccuggucuauuuuuagcucagagcagccuggcagagggggcaguguaugagagugugugagcaaguguaugccucggugagagugagcguauguguggagaggguggccacccgugguccuuacuacuccuuguuugccaaauauuugcuuauuugccuauugcuccaucucuuuguaaucucuguccauuugccuagacauucccauuccuaaagaauaucaauuucccacaaggucaguucucuguuucucucaacaagcugccaggcucuggcuggccacccccaaccugaaaaaaacuuugugaccucuugggaugagguggagagaguguuuuuugucauuuuuguugcuccagcuguuugguagaauaaggucugaugugaagggaagcgggcagggguacacacucucccuaccacuucagcuucccaauguggagauaggguuagguaccugcgucuccguccucucucuggccuggggugagccaccaccucagagcucuaaggugugacuacgggaaggcucuuggugaagccucacaaaucuguagaggaugaggaggauggagagccaucagcauggguuguguucccugggagucaggggaaaggcugcuaugccuggaggcagggcaucagccaggauaaccucagacccaggaaaaagggcucaagagucuggacuguggagguuggggaugcaguuccaaggagaacugccucccacuggcacagacagggcccgacaccuguaucuguuggguguuggaggaggcagguguaguagguggguagggaggaggaggaggaaggccagcugguucagggaucuaggagacaagggaggggcacaaggcaauccugaggagucagagggaaaaaagagagccgggacuugggccuacuuucacuaaucuucagaauuugugucucuuaggccugaaauucuuccuguggccuaaccucagccccuccugcuguguuaggcaaaaagcuccaggcuuggcaggugcuccuaacccagaccaacaugggagggcaaaaggaguuggaagcucugaguuauagagcacagaguggcaggcgguggaggggugcccacagcuuccagauccuuggcaugacugcuuuggaaagaaauccgaggcgaaguuaucacaugcuccugagagcuaggauuugggauagguaugagaaaaggaaaagagaccaucuacuuauuucccacuaguucaggugccugggagguaccucaggaagucugacuuuccuccuuccugcuguaaggguaucacgauucccaaggacucugaaugcuuagaaaccuuguccaaagcaaaggaauaggucaaggaagugauguguccaagaccagacagcccugcugcccucugucauacuugcagucucuuucuugggcuccccacucugauguuaucucaacccacugaucgccacuccacccuccuugucucuuuccuacuaccaccaccacacccugccccuccaggauggaaagaaguagaggagucuucuaguugaaggauggcccccaccccauauacaugaagcagaugguccccagcccauguguaucaggaaugaccagagacgacucacaguuaaugucugugcggcucauccaugugcacacuuacacacauacacaaaggacugguacugcggggaccuugcaaugucaccaaaaacagaugccacugaauucuccugggaaaaugaugcccuacccccacauacccccauucuuugcauccuguuucuucuuuggaaagaguuccccccucaggcuuaaacagcccaucuuaccauagccaguaccccccacuuuucugggcauagagaggggcaguguucaccucugucauccccccacggccaguggugaugauucuaaauaauggacaugcaaagauaaggguuugaucauucaguguccucauccuacuccucucagcccaggauaauucuagcccuuuucccagccccauuugccuucccuccccacugcuaaccuagagggucauccucuaacccccauccuuccacuugcuuccaagccucuaaagccuccagagaaagggggaaaacuacaccucccaggaguccuugaacugacuucaacaacaaucaacuuuauuggcagcgugacaaaagaacaacaguggggggaaagggggcucagaggcagggcagucagucagcuuuauauguuaauuucuuagacuaggaccuggagccuaggauaagauuuuucagcuacgcuuugggcccugaccaggguccugccuagggcuccuccuuguauugauauuauaucuaccaugacaaggauucccccaaccccauuucuugacaaaucagaaaggcaauguauccaaggacagagaggacauuagggagugaggggcacaggccagaggagaugcacguucagauccuccucugugcuguccucccaggcuggggggcgcuugaaaaggaugcucucuccaggcgcugucacacaaaauguuaacaucuugcuuggggaguggguuagaacacugagagaaagcccugugcccucuuaaguuauuucugaccauugauccaggauggacggaaggacagcaagccagagaucaaugcauuagagcagauaugcuuagauggagagcuggggccaggaccagggggagguggagagacagaacaggggaaugggggcaugcagggaggcgagguggucuucuggauccuuaggauuagcucuccccaggggagggggaggagcccagggauguucacccugguucaccaauguaacauggcauuuuuuuuucaacuuuuauuuuagauucagggggguacaugugcagguuuguuacaaagguuuauuacauggugcugaagucugggauaugauugacccagagagugaacauaguacccaauagguaguuuuucagcccuugcccuccucccucccucucuuuuauuccccagugucuauuguuccuaucuuuauguccaugaguacucaauguuuagcucccacuuauaagugagaacacgcaguauuugguuuucuguuucugcauaaguuugcuuaggauaauggccuccagcugcauuaacauggcauuuuuugagguguguuaaguaggcuagccuggauuauguuacugagugguuuuggguggggcuuugaugcuuccacguguacuugaccucuuccccauuucccaccuucccucagauucggaggcgccgccccaccccugccacccucgugcugaccagugaccagucauccccagguaagccaagggauagguugcugaagggcgugggggccacuauggcagcaggucccaaugagaagaugggcgcuagauggaagaagaacagcucugagaaggcggggauguccucaguacugaaggcaggaaggugguggcuagauugcagaauauucuuugcuuuuggaaagauggagcaguucuaggaaagggagggagaccaccuggcuccuaagccccccaggaauugggguggucaacugagugcugguugcugcgacaacagccuuccagauuucuccagcaacugagaugcugccacccccacccccagaggcagugucagcugugagggggagggaccgccuccaccagcucuucacagcccccagagggggaggggaagguuagaagcagcucagggagcagcugagauucuggucaccagcauccccaucgaggucuggggagaaaacaaguucucagagaaugguagagagcuugacaggaguauggaagcgagggggacaggcuaagaagcuaggcugggguucaggaugccggggucuccagcuugccuccagcuauaccuuccagacccugcacagaauaaauugacuguccucuaucacuguucccuccuaugcagggcuuaguucuggcugacccuggggugggggaaugauuggaaagagaaagagacauggauacuucagaggaggaaaaaaagcaaaaagacuacagauccugccuuuggggaucuccaggucugaggcaaagaugcagacgcaaauugaccacagagccaaggacgggacuagaugcagagggauggaggcagcggaagcacaggagaggagcuucggggaggaggucuggggcagccaugagggccaagagccugggggcagaugugagggacagaucaggaggagcauggcugcagaauccccuccccugagaagucagcucuauggggaucccugguuuccuguccuuaucacccucuccuuucccuguucccuucagagauagaugaagaccggauccccaacccacaucucaaggugagcuggcccaucccacuaagcccagcccaaaaaacccccacauucauuaggggauuauuccuuaaaacccugccgcccaucucuaggaucuuuuugacucccgcuucccuguaccucuaccccccaaaugugcaugagugaacauauacacaugcaccccacacacacacacucacauacacacacacacucacagucuccuugcucaccauugucgaggugguuggggaagcaggcguuuucuuaccccacuuuuugaagcucacaccuaccccaggcuccaauccaaaagccuggcaaggcagaggaggaaggcaaggggggcuggagggcauggggggcuagagggcaagggaggggucuggagagcaagggggggcuggcgcccaucugugcucugugcccuucacaguccacuuuggcaaugucuccacggcaacggaagaagaugacaaggaucacacccacaaugaaagguuugcaagaccccucccaucccuuuuucuccucugugccugaagcugaagaggagaccgaaugcccuuuggaagggaggucguuaaaucugccuuuauuaugguagaacuguugcuagacgaacugaggcugaaaucccaguuuugccacugacuagcugggugaucugggagaaacugcuuaacuuacugagccuugaauacuaccucauuauggcagauaaaauaauauaugugaacucaccggcacagugcacaacauguacaagauacucaaauuuuucuugaaucuaaauugagccuuuccaccuucccccagggaagaccauguaucccagcaagugaggaguaucccuuguucuuaaagccucuucuccuaugccucccuuaucugugaagaagaguacuuuuuauggucuaguuuucauuccuccuuauugccagcuaauguccccuccuuguucagaucucaguggaugggaaagucaaacacccagcaaugugugcugagccuuuaguggggcuguugaauccggaggcccacaggggagacgcuaggcagucauauccaguguucccucccuuucucuguguccccagagcuccagaugaugguugaacaucaccuggggcaacagcagcaaggagaggaaccugagggggccgcugagagcacagaaacccaggagucccgcccaccugggaucccagacacagaaguggagucaaggcugggcaccucugggacagcaaaaaguauguucaggcuggggagggccccaggcauccuauuucccagcccagcaggaggcaagccuuacccacugcggggaggggaaagaguuggagccugggagaggccuaguaguaggcaaaaacugucucaaggauauggaucuguuggcauguucggcauauauuugaaucuucacuuuuccuuacugagugacaccaagcccucccaacuugaaccucagagccccacuguggcuacaugggggaaacccaccuucaugggaacagcaaucacaggcuagaauccuggcucggccacuugcuaccuuaccagcugagaggccuugaacgacuuaaccucaggguauaaaaugauaaugagggugccuguugcaguggguugugugugacuauuaaaugagacuggcuguugacacagcacccgacacacacagagcaugcaauaaguggaagcugguagcagugcgcuaugucccuuauccuagauauauuccagaauucagaaugcuuccaauuuuaugaagauauaguacauaaacuguguaucgcauaguauucccggcagagaacccuacaaucaaacacauaauauuucugcaauccagugaauggucucacuaagcagaauaaagacuaaaaacagccuccuaugaguucaugucagguuuagacacauauugaguuuuguuuuuuaaacuguagaggguuuauucuuuccaauuugauugaagauuuuuuaaaagugaacauauaguaguaauugugaucaaagaaaacccuguuggucuugccugauugcacccaacuugguccuggggcccucucaggggccacugggguaugggugcagugaggagaagcaguucccuccccaacaccuuuaugaaugccaccucuuccucccaccccuauguucccuccccagaaacugcagaaugcaucccuaaaacucacgagagaggcaguaaggaacccagcacaaaagaacccucaacccauauaccaccacuggauuccaagggagccaacucgguaagaccccagggcugggcugccaggucauaggagaggaggcuaauauuguggacaaaagcaaggggcuaauauuuggagucuaggaaaaggaaaacaaagaaccagcuucagucccuaaaaaguuauucuuuaugguaaaaggacuuguaucuccucugacagacaaaaagaaauggauagcugcagcaagaaggauugagauuagacuuuguguaggacuucuggcuccuggaaugggugagagcaguaggccauggauuuuuugauaaaggggauuuggaacccgaagggagauccucaccugcccagcugaagugggcaguggcucucccugccuggaggaugcauugaugagauaacuuccugagcuuugauuucauaauccgcagcccccugcauagacuggacacaggaaggacugcucucagacaucagaacaagcuuucugagacauuagauguugacaaaugggauggccagaaggggaagggacaaaaugacccucuggccucucaccuucucuuucuguccccuuucccccauaacaggucugagagaggaggagguaucuugggaucaagacugcaguuugggaaugcauggacaccggauuuguuucuuauuccuucacuuuuggggaaaaucucuuguuuuuaaaaagugauaaauuugguguuagguccuuggcacuuuccuucuuuuccaacugggagaauccuuucucccugccuucuugcccugcccucucuguagcccccacccuccugccaagcugccucugggaaggaagaaacaggagcuaggcagaagccuugagcagggaagaguucuucccuuagcccugacuuuacuugcugugggaagagagaugagggucagauaggugggaggacuaacuuccagggugccaagaaggaagaaaagccccagguucucuuuucuuauugaggaacgauccgaccaccucacaggccugcccugcagcuggaagacucggcgcucuaaggccugugccguguccagcugugacugugcggugggcuccaucugcuggacaaaaggggaacugcaccauggcacuuggcccaugggaaagaggguaugguggugugccgauaccuccucgccugcccuccaagccccagcugccuuccuuuuggauucccaagcuucaggauguguucccucuuccagcugugggaccgcugucccuuauuucaacccguuagcaacaauggauagagaacacaguggcuauuaaugaagaggcccaugcuggagacuggaaggguucccuuguccuagacauugaggggcccagauaagaccaaaaccaagcauaagagaagaaacugucucagaucucacggccaggccucucuccugcugcuguuuuugauuuucccagguagugggagagaggaaaggagggaaggcaaga

SEQ ID NO: 17996 - RNA, 2012 nt, Homo sapiens
agccuugcucagaguaggaguccaugcggacaucggcuaagauuccagaaugacuaccgucuugacuuacacuuuuaaaaagugcacuucugaugcacuucucacugcaucagaauggucccucagauuuuccauaagaccucugagcuauuccucccaguugcgagcugcccagccauccagaccgaaacgaggaagacauuagccaaacccaauauaaggaauauuguggugguggaugguguucgcacuccauuuuugcugucaggcacuucguauaaagaccugauaccacaugauuuggcuagagcaacacuuacggguuuguugcaucagcccaguguccccaaggaaguaguugauuauaucaucuuuggcacagucauucaggaagugaaaacaagccauguggcuggagaggcugcccuuggaacugccuucucugacaagacuccugcucacacugucaccauggcuuguaucucugccaaccaagccaugaccacagguguugguuugauugcuucuggccagugugaugugaucauggcagguggugucgaguugauguuccaugucccuauucgucagucaaggaaaaugagaaaacugaugcuugaucuaaguaaggccaaauuugugggccagugacugucuucaaucucuaaaugccaauugaauuucccagcaccugagcucccugagguuucugaguucuccaccagugagaccacgggccacucugcagaccaauuggcuguuucucgacuggaacaggaugaauaugcacugcgcugucccagucuggccaagaaggcacaggaugaaggacuccuuucugaugucguacccuucaaaguaccaggaaaagauacaguuaccaaacauaauggcauccguccuuccucacuggagcagauggcuaaacuaaaaccugcauucaucaagcccuacggcacagcgacagcugcaaauucuucuuucuugacugauggcgcaucugaggcagaggaaaaggcucuggcaauggguuauaagccgaaggaguguuugagggauuuuauguacgugucucacaaucugaaagaucaacuauuauucagaccaacauaugcgacuccaaaaauucuagaaaaggcaggauuaaccaugagugauauugaugcuuuugaauuucacaaagcuuucucagguaagauuuuagcuaauuuuaaagccauggauucugauuaguuugcacaaaauuacauggguagaaaaagcaagguuacauugcuuccuucggagaaguuuaauaacugggguggaucucugucccuggaacacccauuuggagcuacuggcugcagguuggucguggcagcugccaacagauuacggaaggaaggaggccaguaugccuuagcggcugccugugcagcuggagggcagggccaugguaugauaguggaagcuuacccaaaauaauagauccagaagaaaugaccaggaguuucugugcaacacuaacacuaggcaacggcauuucagugcauuccuaaaugacauuuauaguuccuagcuccuguuaggaaaacgauucuuguggccuucuguuaaaugcuuugcacuuaagccuugccaguguucugagcuuuucaauaaucacaguuuacugcucuuucagggauuucuaagccaccagaaucucacacagacguguguaggugguuguuuuuguucucucuugucacuaaagacuaaaugagugcuugcaauugggaaagaggucagcugagauucggaaaucaucuuuguaauauuugcaaauuauacauguuccuaucuguauccuaaagaaaauuguucucuauaaaauacaaacaaauuucccuaaauuaacuuaauucuggaaaaauaauucagaaucuaaacaucacugaaaacuuauaaaaaauguuuagauacauaaauaucaugguggucaaccuuaauaaaguggggaaauauuggaaaaaauguaaaaacacaca

SEQ ID NO: 17997 - RNA, 2986 nt, Homo sapiens
guaaauggccaagaccuaaagaaccugcugcaccaggaugcuguagaccucuuucguaaugcaggcuaugcugugucucugagagugcagcacaggguagguaucacuuugagccagaaaccuggcaccaggcuuuugcacuguacuucugaauaagcccaauguguguaaucuucaguguugcuuuuuguuuuacccucacuccccugaagaguuucucaggcaaagggagggguccauugguacuucugcuuaucauugaaggacauucaggccaggcacgguggcucacaccuguaaucccaacacuuugggaggccaaggugggcggaucacuucaggccaggaguucgagaccagccuggccaacauagcaaaaccucaucucuacuaaaaauacaaaaaauucaggcacgguggugcacaccuguagucucagcuacuugggaugcuaaggugggaggauugcuugagcccaggagguagagguugcagugagccaagaucauaccacuauacuccagccugggcaagagagugagacccugucucaaaaaaaaaaaaaagaaaaaaagagaaaaaaaagagaaauucacaacaguauggcuuauaaccaagguccuugcuucaagauaauaugccuuaaagauaaagcuugacaaccaaauuaaaacagaugauuaaagaaaagccagguguggugacucacaucuguacucuuagcacuuugggaggccaaggugguaugauugcuugagcccgggaguucaagaccagccugggcaacauagagagaccucaucucuuaaaaaaauaauaauaaaaauaaauaaaaaauuuuaagagugacauggaccaauggaaaauaaauaaauuaauuaauuaaaaagaugguaaaaaaacguagccaauuuuacuuuuugguagggaaggaaccauaugucuaccgcugaaaacuuauuuauaaaaccauuggauaaaacacuacaaagaugguggguuuucugguacccacuauaugcuuuucccugucacugccaugaacccuucauuuaucaacuuggugacccucuuaaccaaaucuuuaguguucauaggagaacuccaggaaaaaggaaauggaauucagaauucagucaaggcagcaccuaucccugcaucuguuucuuauuuccaaguguuuuauaauuuggaugaugauguaaagggaagccuggguagauauaauuccuccuauagcauugagaauuucugagcauauucacaaaacagguuccaugugccuuuaaauuaaaucaauuugcuacuucuuaaauaggugcacucuuccucacucaguggcuaaggauuuagaagcuuaagaacauuuagaggaguuccuaaaaaaguagagaaggcagaacgugaaagauaccugagaaaacaaccaguugcaagcagaaucuggguguaauggauuagaaaacagguuaauaagagauaauauuggucaucaguugcuucugccuuggcucuucucuuucuaaagcaugggagcauuugugcaguagauaaaaacaaguaaauauagggacacacuucaauaugauuacaauucuuuuggaagguaugugagaaguuauuuccaguguucacuuuuaaggaaacauccauaaauaauuccuaauaaaaaagacccuuauguucaggcaauuggccuagcccuaaaaaccaugccuucuuauugagcauguccuuucaggacagcucaucagcaaaugaaugaaaaacauagagguggaauagaggguauaaugguauuucaugcagucuugccuuucagauugaagugucaguuuuaugaguuguaaugaggcaguuuaacugaaauacgaugaugccauaauuauugcaaguuagccacuaaaaguugauauuaagaagagcuacccugaaaaccaucacuaaaaugaagaccauccagccucaaaaggaaacacuuagccaauagaaaauuauaagcacuaggauauaauuucuuuuugcuuuuuuacaucuguuccauauagauucaccuucaucucucucuaguauuagaaaugagcagaugaagggcaaaaccccaucuuuggagggaguugggugccuucugggaucuggaaagcauuuuucaaguaauggcauuggacguauguugguauugcaccuauguugacauugcccacaucugcucuuacuacauuuugaugacugauuaucuaaguaaacauuuccagaaagaucccccuucuuccucaccaaguaauauccaaguucccuauaagaucauagguuuuaucucaugucuucauuuuccugauacgauacacaaauagcaagguagaggcaguacagaaacagaaauuaccugacuugcccucacgggucccuuuaggucagcaagguuaaaugccuccccauuagaccuauuuucuuuccaaagauccugugacacugaugcaucagcucaggacaaagagaggacuccuucugcuagguauugcuggggguuacaguuuuggguggucuagagucuacaaacccaggugauguaucaaccugggcguuucaguugcaaacacacauuagucacuagaguuaacauuuuucuuucccuuccaguuacaggugcagaauggaccuauaggacaucgaggugaaggggacccaagugguauucccauauuuauggugcuggugccaguguuugcccucaccaugguagcagccugggcuuucaugagauaccggcaacaacuuugaaaaacuugcucucuuucaauacucccaaugaagauacauuucacucacccuccaccccugcuauucugccaugucuuucccucucucugcauagccagauuugaagugacugauacccaccccaaaccuugcuguucacagucuccaauucuucauauucuaaugggaaaguaaagguauuguuugaaggaaaacugaagaaaag

SEQ ID NO: 17998 - RNA, 913 nt, Homo sapiens
ugggagagggcagggcaaagagguaagaaguaguuaguucuguaaggaaauguuagagaccguuuuggaaauguauucauuauuuuaaggcaacuaacaaaugaucaucuuucaguuaggacauuguagcagcagccuuuacgggucaugaaauuugcauaauaucuaaaauuguauuucuggaaauaggucaaugucgauuaauaguagcuuuguauagaaaggcagaugccagcuagcauaaaagugguaguacgugcagacggugguaguucuggaguccuggaagccacgaggugcucauccaucacaaggccaucacagccggguagaaaugccugaggaaagcagcggagcugaccgugccagcauuuacacagggaacacuucuugggcagccaggugucauggggcacagacccacaguucucuuugcgcacaucgugcucacaguuccguccguagaaggagggagggcaggcacaaaaggacuccagcaugcagguucccccauucaggcagcagguucuguuuagcuccuuacugugcuguauucccaugggcagcacacgcugggaagaccgaggccgaauugcaggcuccuccuggggccaaaugcugucaucucugaaggccaggucuccccgagauggacgagcaaauuccugauggcccagcccggcaacuaaucccaguucaaaggcuuuagaaauggccaugauccaaaucacacuguaagagaagcggaccaucuuccugcaguccauagcuuuuaacaauuagggggaaaagaggcguuagcaucgcuuuaauucagagucauugccaaaacagccaaaggaaaacauucaucuccuaaagcgaaaauggcaauuuaagaagaaaaugagaaauucgcguuccccagaagguc

SEQ ID NO: 17999 - RNA, 8013 nt, Homo sapiens
ggaaauuggucacgagcaggcgccgugggcuuguggacgccuaacuugcgcgcugagauuuccggcgugggagcagaggucugagucuugcguggguccucuauauagggugagaagcguggcgcucgguuccugccucggggaaguccuggcgcagaugggccacggggccggcguggcggcgccugggaccgacugaggccuaggcgccggagccggccgcgccugggcuggagcggggcuccucggccuggacugggagcccccggccccgggcuccugcuggcgccguccaaccuuacauggguucagggcgccuucguaggcgggcacggcugguuucgggcuaaggcgcucuggagaccugacgauggcgucgggcccgggcucccaggaacgggaagggcuccugauagugaagcuggaggaggacugcgccuggagccaggagcugcccccaccugacccaggaccgagccccgaggccucccacuugcgcuucagacgguuccgcuuccaagaggcagcugguccccgggaagcccucagccggcuccaagagcuuugccauggguggcuucggccugagaugcgcacgaaggagcagaucuuggagcugcugguguuagagcaguuccugaccauccugccccaggagauccagagcagggugcaggagcugcauccggagagcggcgaagaagcggugacccuuguggaggauaugcagagagagcuugggagacugagacaacaggugagagagagagagagcuguuuuaucugugguuuguuuagcccugagcacugggacauugcgcccccggucgaauucaaguaaauugcccugaguagaccuuacguggggaagaggacuugugauuuaaccuggaacacucauccuccagauuuucccccaaaugaacgaaagcagugaagagugcccuguuuccacgcggaggcggugucccugcaacaguuaguguuagccauggaguuagaucgccagcguucaaauccucaaucugcuaguacuagcuuuguuacuuuggcaaguuacuugaucucuuucggccuguuuuccuauucguaaaaugaggauauuaacauacuuucuagggcuuagagggagagcagcauguaaaguugugaacacuacuagcuuaugagugcuuaguacuuguuaccuguuguuauguuaggguccacggucuggucuucucugcaaagcugggccuccguuaauugugaacuuugaaagauaauuuggcaccgaggcccugaggucauugguccccagggcuaccccaauuuagccuauccuauagugaggaauagaagcaccuagaaaagguggggagagcaaaagggagugagguguaucuuaagagcuguguggggaaggugugcucugggagugggcccuuucccuaaccccucccccugcacaugggaucaaaaaagccuuuaguguaaaccauuuuucuguuaccugggcccaaagggaucgccugagguucucuguugaagguuugcucucaguauccuauacuaauuucccuuccucuugggcccuguugugaugaugagugauguggguugguucccaggucacaaaccaugggcggggaacagaagugcuuuuggaggagccuuugccucuggaaacagcacgagagucaccgagcuucaagcuggagccaauggagacugagcgaagcccuggccccaggcugcaggagcugcuaggccccagcccccaaagggacccccaggcuguaaaggagaggggugaggcacaguuaucugggcaggugggagggaggaggggcuuggggguugcccccgacacuagcuggauguagcaaugaugcgaaggagaaggaauuucugaagaucagguucucaccuguggaaugaaagaccugcaguuggugguguggguucuccuggggcugggggaagggaagggagucucaguagagcccuuuuuuaugcagaacagaggcgauuuagaaccacuugaaugacgcaggguuuggagugcuacucuugguacuccuucccucucacccugucauuuuggauaucagcugauuaggccucugugcaguuuagcgucauucccaaaagcagaggcuggguguuggggaauggauacuguguuuuaauaauccuuggguugccaagaguuaggaaugccauucucauuauaauuucugucaccuucagcauuaucugcucccuggcuuucucuuuuuccuccugaagggaacauggaagacaaggagaugacugggccccaggugauguggaaguuuccauugucuccccccagcacccuuccuccccugaguguuggggguggggguucuccauguggaagguccuuugucccuuaccacagcgucucccccacugcuuugucuauuucacaccucacuuggaggccugauacccuucuuccccccugacaugugcuuggcaucccuggauuuugccccuuuaacccaugacucugcuugaauuguucuuggugcaucaggggcuaaaggagaucuugugcuguuucaguugccugagagcuuagaggacguggcaauguacaucucccaggaggagugggggcaucaggauccuaguaagagggcccucuccagggacacggugcaggagaguuaugagaauguggacucacuggguaaggacuucuuuuccagggaugaugacugcgccauuucugaccaggguccugcccguuauucauucaccuccuggacacagacucugaguuuugccaagaagccuccacaggagacuucccuuugucuaaaguccccuguacgagagucauguaucugccaagugguacaguuggcacaggcagcccgggacuggagucccagcugccagagccuaaggcgagucugagccaugugcacuuccuagggcagagcaaacccaaugcggugacaaccugccagcaucacacacaugcaguauuccaggaugcuggggggcucuaaaugguugauuccuugcaauuuucagaugcuuauucuuaugagcucgccaguguuuccuguguuccguuaguguuucuaggcucguccccaaagacaaaaauuucagggguaguaggaucaacauuccagccuaucaucucucacagcccauaaaaauucagaaaguggggagggucuuguggaaauuuggaaacaauguauagcuccaaaguaggccauaucauaaauuaagauuuaccuaugucuuguacuguacucagaguuuuaaaauuaugccuacggaauaugacagacugacauauaguuggauuuagguggaggauaugcuuguauuuauuguacaauucccucaacuuuucuguauguaugagaauucuuuuaauaaaaaguuggggaagucuuaacauaaaacaagacuguguguacauuaugauuauaccuauguugaaacacaccaguagaaagacucacuggugugguggugguagucccaguuacucaggaggcugaggggagaaucaccugagcccaguaggucaaggcugcagugagcuaugaugaugccacugcaccucaaccaggugacagagugagacucuguuucaaaacaaacaagacacaccgcacauuguuuccauauaucagguuugccuaaaaaguaucacaacuguacauuuguugacacuaauucugcaaacgcaaucuugcucacugcaaccucugccucccggguucaagugauucuccugccucagccuccagaguagcugggauuacaggcaugcgccaccacacccggcuaauuuuuuguauuuuuaguagagacaggauuucuccauguaggucaggcucaucuugaauucccgaccucaggugauccacccgccucccaaagugcuggaauuacaggugugagccaccacacccggccuuuuuuuuuuuuuuuuuuuuuuuugaagugagucucacucuguugcccaggcugcucuggaacuucugggcucaagcagucuuccugccuuagucaggaagugugccacuguaccaguuuccauauuacuuuucacugcugugauguccaaaguugaacauggcccuuuuagugagagaugcuaaauaggaaaagaucagauuacagcuuguuggaauuaaacuucuguuggaguccauguuugcuggagguggagguuuuuguuuuucuuuuuggcacagcauagaaauggcacuuguggguuuuaaucucaugguccucuuagagcccuggguccuuuucugauugucuauuauguuauauuuucuuucccuggaguuguccggucaaauuuaguucuauuuuguauuuauauguagagacaaggcccuuuuaugauauuaaauggauuauucaaggaacugaccauguucauuuuauaguuauuucaauuacaguaguguacauucucauugcaaaaaaaaacauuccaaguaccaugaauauuuaaaaaaaaaaaaaauuggccgggcgcaguggcucacaccuguaaucccagcacuuugggaggccgaggcaggcagaucacuugaagucaggaguucgagaccagccuggccaacauggugaaacuccaucucuacuaaaaauacaaaaauuagccgggugugguggugcacgccuguaaucccagcuacuugggaggcugaggcaggagaaucgcuugaaccuaggaggcagagguugcagugagcggagaucgugccacugcacuccagccugggcgacagagugagacucugucucaaaaaaaaaaaaaaagucucccuccccuaauuucuuucucuagagguauccacugggaacaguuuguguauauuccaaguaacugcugucagauuuauggagcauucuguauuuauccacugagggcagggaacaagacuguuucccuacccugguagaggaaaguggcaguacagaaaucuguuucuuucauugugaacagagucucacauucccagucaggaggucccaggcacccaggugggacaaggaggaaagcuaugggaucccaguguccagagcugcaaggagggccugagccccagaggcccagcuccagguaaggaaugaagacaaguggccugcgcagcaagcagcaaggcucuugcaguuaagagugaggcauuuuuugguuuuguuuuguuuuguuuugagauggaguggcacucuuguugcccaggcuggagugcaacagugcgaucucggcucacugcaagcuccgccucccagguucaagcgguucuccugccucagccucccgaguagcugggauuacaggcaugcgccaccacgcccagcuaauuuuuuguauuuuuaguagagucgggguuucuccauauuggucaggcuggucucccugaccucaggugauccacccaccucggccucccaaagugcugggauuuacaagugugagccaccgcccccagcagaguaaggcauuugaggauuugggugcagggccggcccagcacagcugcuagagagguacauuacguccuuugacccugccauucuccaucccagugaggcaagugaggaacccagggugcagaguucaaggaggcccuuauucuugagcuuacuugucccacccuacucucagcccugcuccaucccacccauuccugaagggcagaaucgagaggcucagguggaaaggaaaauucuaagacuggucucggcucugauuccuugaccaguggcccgacccuuuauccugaugcuucuccagagugcuuuaccuuuaggagaggaugggauucugagguagaagcagcccuucugggcugcugaccuaacaggcagcggcagacaggugggauuuucuuuucuccagcauagaaauaauguacggguuugguuucucucucucuaccaggagaagagaaauuugagaaccuggaagguguuccgucuguaugcucugagaacauccacccucaggugcugcuuccugaccaggcccgaggggaggugcccuggaguccugagcugggaagaccucaugaccggucgcaaggggauugggcgccucccccagaggguggaauggagcaggccuuggcaggagccucaaguggcagagaacuggggcgaccgaaggaacugcagccaaagaaacuccauuuaugucccuuguguggcaaaaauuucucuaacaacucaaaccuaauuaggcaccagagaauacaugcagcugaaagacuguguauggguguggacugcacugaaaucuuuggugggaacccacguuuccugucacuacacagagcacaccugggagaggaggcccacaagugccuugaaugugggaaaugcuucagucagaacacccaucugacucgccaccaacgcacccacacgggugagaagcccuaucagugcaacauuugcggaaaauguuucuccugcaacuccaaccuccacaggcaccagagaacgcacacuggggagaagcccuacaagugcccugaguguggggagaucuuugcucacaguuccaaccuccuucggcaccagagaauucacacuggagagcgaccuuauaagugucccgagugugggaaaaguuucucucggaguucacaccucgucauucacgaaagaacucaugagagagagagacuuuaccccuucucugaguguggggaagcugugagugacagcacccccuuucuuacaaaccauggagcccauaaggcagagaagaagcucuuugaauguuugacuugugggaaaagcuuccggcagggcaugcaccucaccagacaucagagaacacacacaggagagaaaccguauaaauguacccuuuguggggaaaacuucucucauagauccaauuuaaucaggcaccagagaauccacacaggagaaaaacccuauaccugucaugagugcggagacagcuucucucacagcuccaaucggauucgccaccugagaacgcauacgggagagagacccuauaaauguucugaauguggagaaagcuucucucggaguucccgucuuaugagucaucagagaacucacacagguuaguaacagugggguuucucuuugccccaggugagguggcauauucagaggagccuguuggcaagagcugguauucccugcccagccgaccaaaugaccucugcauucuucagguaaugggggcucauugugagggaggugcagaggcagcagaggauuggcauaaaacugaaaaggaguucugucugcaugagaaaggauggcaagucucugaggugaccucaggguggaauucucuguuaaguccacccugccccagggugcuccuacccucuuggucuuuuuaaagccaaggugcgauuugggcaccugacuguccaguuuaccuuaacaaguuugggaauccaugugauguuuuugauacuucuuccucauuugggacauucaguaggagcauuugggcuuccggggccccugagaccaaagaagaggggccaaguacccugggaaaucagcugaaggucaacaaaagacugguugugaguugcagcugucccgaaggccccaguugggaagccaugggcaguccagaucaagccaccacgugcccuacgauggccuaacaggagugcccauuggcagauuacacauguaaauaugaccucagacaaaaaggaaccagaggcccaagggcaauaauaagguggaauuugcaggucagcccaggaauuggcagaggaaguaggugucugauaacccuuuguggagaaugagauuccccccaccugugugagaaaaauaaacagcucuggagucuuguuccugacuccagaggaacgagagcauuccaggaaagagagauucccuggaaaauugaaaaugugaauccuagggggaaauuggggauugugucuuucccuguugaaaauguuuggaugggaauaaauaucuucaggaaacauaaau

SEQ ID NO: 18000 - RNA, 941 nt, Homo sapiens
cucagccaacuucucuuccuuuccccagcaaccuccucagugcgcccuucacuuccauguuccgcagcguguagaugaggggauucaccaugggugugaccaacgaguagaacagggaaaugaacuugcccugguccuguuugcuguucuuggccggaagcagauacccauagcuggcugagccauagaagaggaacaccaccagcagaugggagaggcacguauugaacgccuuucgccuccccucugcagagcggauuuucagcacugccugagcaaugaggcaguaggagaucacgaugaugcuuagugggacugcagugaagaaggugcagacaccauugagcacagccugguugagacuugugucgccacaggccaguuugaucauggcaggcaccucgcagaggaaucccuccacccuccggugcccacacaaugggagcugcagagugaauguugacuggaucacagaguugcccaagccacccaggcaggcaaucacagccagcagccagcagagcuggggguucaugauggcgguguagcggaggggccggcacacugccacguagcggucaaaugccaucaccaccagcaggaugcacucgguggcccccagccaaaggaagacauagagcuggguuaugcagccaccauagcugauggucuugccugguccccauaaauugaucagcauuugggggacugaacuaguagcgaaagcaagguccaaggaggagagguugcugaggaagaaguacauggguguauggagccgggccuccaggcgggaaagcaagaugaugguugaguucccaaguagggucagcaaauaggagaagaggauggcuauaaaaaagaucaucuccagcuggggauggucugauaugcccaucagaacaaagcccugcaaggagcuaucauucaccccguccauc

SEQ ID NO: 18001 - RNA, 18526 nt, Homo sapiens
gcuuuuuugaugaaaaaaguugacacaaacuuugaaaauggaaaauaaacaagaucuugccagccaccagcauuuccuugaguguucaccucagacugacugaaccucaugcucuuggcagggcgguggcagggaccccugugcgucuuuguggaagcgggaacugucacaguccaggugaugugggcuggcgguggcaacaugaguuaaaaaacuguucuuggcugggcgcaguggcucacgccuguaaucccagcacuuugggaggccaagguggguggaucaccugaggucaggaguucgagaccagccuggccaacauggugaaaccucaucucuauuaaaaauacaaaaauugggccgggcgcaguggcucacgccuguaaucccagcacuuugggaggccaaggcaggccugaggucaggaguucgagaccagccuggccaacauggugaaaccucaucucuauuaaaaauacaaaaauugggccgggcgcaguggcucacgccuguaaucccagcacuuugggaggccgaggcggguggaucacgaagucaggaguucaagaccagccuguccaagguggugaaaccccgucucuacuaaaaauacaaaaaaauuaucugggcauggugcaggcaccuguaaucccagcuacucgggaggcugaggcaggagaaucgcuugaacccagguggcagaaguugcagugagccaagauuguggcacugcaccccaaccugagcgacagugagacucugucucaaaauaauaauaauaauaauaauaauaaauaggccugguggcacgcaccuguaaccccagcuacucgggaggcugaggcaggagaaucacuugaacccgcgagucagagguugcagugagcugagaucacaacacugaacuccagucugggugacagagugagacuccaucucaaaauaaaaauaaaaacguguucuucagcccagcaauuuaacugcuggaaacuaaucuagagaaauaaaagcugcagugagugcauagaucagacucugcccaggguugccugagagccaguggagccacgcuggaccgugggccuuggccaugugagccacccagccugccugucucuccugcaguucucgugggccuaaggucucagguucccaagacugugacaugaaccgggcugugaggcagcaaaacuaacccuacacacccuagaaacuccaugugccucuguccuccugaccuugucucucuggggcuggggcuggauucgccuguuaaugaccauguccugggccuuuaugcccacuguuuuuuuugccugcuccgcucagaggggucuuggccucauuguugaugagcagccguuagcagccucagccucacauuccccuuaagggcggguuccucccugucagggaaggcauuguaaacucaaacgccugucagcugugaaccuggcucuuccuggaaucacuccacuccccuagucuucaguguccagaagucucacagauucucguaggcacuccuccaguguccaagggugagaagggcccuaaaaucuucacucaccugguggaggaacagggcccugcugcugacucuccaugaguugcuuccauggagacaguuucaugucggauaaaauuauuuuucccgggccaggcgcgguggcucacaccuguaaucccaguacuuugggaggccaagacgggcagaucacaugaggucaggaguuugagaccagccugaccaacauggagaaaccccaucucuacuuaaaaaaaaauacaaaauuagccgggcgugguggcacauaccuguaaucccagcuacucgggagaccgaagcaggagaaucgauugaacccaggaggcaacgguugcagugagccgagaucacgccauugcacuccagccugggcaacaagagcaaaacuccgucucaaaagaaaaaaauucccaucagagauccccaguccugucuagacagaucacugcuuuaagaagguggcugugacaguuagguagagacuuaagugaugggcacacuccucggcagccuuagagcagcaggcagaaguggcccagagcucccugugguucugaugucuagagcacgaccauaguuggacuugaccuguggcagguucaccugaguauguucuguuucucagguacccagacucaugguaucgugauaucacauccaacaagaaguucuuuucccuugcugcaaccuacagaggugccauugugggaaugauaguagcugaaauuaagaacaggaccaaaauacauaaagagguacguacgugugugcagugaggacuuggcagucacugucauuggacgggccaagggggcuugcgauggaaucaugcugccugcuccacagccgucguccaaggagccugugacccaaggaauccaaguggccaacgacacuugucccuggcuggugcuuuucugugugugugugugugugauuucauggugcgugggccuccagucgugcccagcagcaggcuucauaaccacugucguucugaagcaggcaugagcgcagaugaugcauugagaaucugcaguuacaacgugcuaugaaaauaccccugauuuguguuggcggcagugucauagaaaccgcuaagacugcuucagcuuguugaaggaaaugcuaguuacaguuagaggucagggaaaguacagagauaauuuuuuuuccucuaacuucacagagcccuuuaagaucuaagaacccuuugggcauccguggacccaccucagucucacuucaggcuagcaaaccccagucugaauguaaacaguaagaccauggccauauuguuccaaaugguugaguuuagucaagauucugugugaugauguuggucaucccagcaucugagguaauguuuaccacccgaggauuuagccaaggagggaaaaacccaccaacaacuggcagaugguucaauuuguuuggcuugagguuauuucuuuaaaaguuagagaaggggccgggcgcaguggcucaugccuguaaucucagcacuuugggaggccgaggcgggcagaucaucugaggucaggaguucaagaccagccuggccaacauggugaaaccccaucucuacuaaaaauacaaaaauuagccgggcgugguggcaggcgccuauaaucccagcuauuugggaggcugaggcaggagaaucgcuugaacccacgaggcagagguugcagugagccgagaucgugccauugcacuccagcccgagggacaaaagcaagacuucgucuaaaaaaaaaaaaaaagaagaagaagaaaaguuagagaaggccugggcacaguggcucacaccuauaaccccggcauuuugggcagaucacgaggucaggaguucgagaccagccuggccaacaucgugaaaccuugucucuacuaaaaguaaaaaauaaauuagccaggcaugauggcgcuugccuuuaaucccagcuacucaggaggcugaggcacaagaaucacuugaacccaggaggcaguggagguugcagugagcggagauugcacuuuugcacuccagccugggugacagagugagacucugucuauaaauaaguaaauaaaagugcaagaaggccugucucucccuuuaaggacccgaauccacuggcaucuacccuguuuugccuguggucauacucugucuggcacagcuuuuuucuccugagucacuuuuucugcccuagcuuccuccugagcuuuuuucuuugauuuuuaagagcuaagauguagcagaaagcaagugucaacauucuuuucucuccucuuuuuuuuuuauugaaacggagucucacuaucacccaggguggagugcagugaugcgauccugaucccggcucacugcaaccuccgccucucaaguaggauuuuagacgugcgccaccacaccaagcuaauuuuuguauuuuuaguggagaugggguuucaccauguuggccaugcugaucuggaaucccuggccucaagugauccgccugccucgcgggagugcuaggauuacaggugugagccaccgugcccagccugaucucucuuguuaaugggacacguggucccccccuucccccaaugacucauuccccugaaccccaucccccuccggguggcuuuccugagugcccccuggugacugugugccugcccccagguggcggcugggucucuuccuccucuggaauguguuuguguucccucgaggccgacauggggacccuuuggcucauguucccggcucucaguagagggcccucuggccugcacgcuggcacucauucaucuggccccuuccucucaggcuuagugaguucaaggucagggcaaaguagacccuguuaagagaugucagcuggggaacagacacccuuccugcaggccuggaguaacaagagugauaaggacgccuuccucccuggacugacauaucugggugaacuguggcuugaagagggcugggagagcagggagccuggacaggcugaccccagcccagcacgugggagcagaaaggccuucuuguucuuuacgaguuggaagaugauaagagccucaugcugaucagauucaugacucccacccggaauuccaucucuagaaccaagagaugguggguggcuuuacgcagguguggcgguguccucugccugugggggcagcagaagggguuggacggccgcccaagucucacuccuccaagaucaccuggggcagcgugcgauucuuuaacugaaccucuaaaacuuugcauuuguccacuguccugcauccaggccuaccaggugacaugcgugcauucccaugaggcccgcguggugcuguguaguugcugccuucaugccauaacuuuaccuugugcuggcaucagagccucauucccguccuuggcuaggccucccacacaccccuaggagaagcuccuuuuguguguguucuucuuuucagcuguuuuucaccagaagggcauaaacgcucucauuuccuuggggagugggggccccucuccaguaccucuugauucugccccucccagucggugucccucuggcugucgugggaagucggugcggagcccgccugggccgggcugugcagugagccgugcaccagacgugugagccugacuuucucucugacucuuccucuaggauggagauauucuagcauccaacuucucuguugacacacaagucgcguacauccuaagucugggcgucgugaaagaguucaggaagcacggcauagguaagggcagccgggcccgcggcuuggcgcccaccccacccccuugcccuaccccacccccaucccaucugcacccagucucuucccuggccccaacaacucuggcucgugaacaucccucagucucaucuuccauccucguucccgucuugggccagaccuucaucaucccuccccugccagcacacccaccaccuucagccauccucuuuccacaugcccccaggccuuucugcugcagccucgcucagcccccaggauggagcugaggaaacuggcaccucucacuucugcugccgccacacgcacaacucguguauucacugcucacgauucagaguagaaagcgugaacacgcacgaggaagcaacacucaccguuucuccgaugucccaccccacucggccacacggccagugagcggcagagucuuaauuaauuuuaaacccaggcccaucuaguccauguuuuccugggcucacauuuacccuguuuguugucugaaagggagucuccaugcgggcccagcccaugggagggcgcuaccaggccaccucugcagucccucccagcagucuguagcuaccaggcuccaucuggccaugagauuuuagggacuuugacagugguggugaagaaaggcuggucucugauacggugggccgagacaucuccgagagacucaugcaaagcccccauccuagcccagucauccuuccuuccuaacugcucugccugcauuaccuuuaccucuucuccccaagguucccucuuacuugaaaguuuaaaggaucacauaucaaccaccgcccaggaccacugcaaagccauuuaccugcauguccucaccaccaacaacacagcaauaaacuucuaugaaaacagagacuucaagcagcaccacuaucuccccuauuacuacuccauucgagggguccucaaagauggcuucaccuauguccucuacaucaacggcggccacccucccuggacgauuuuauauccuuaacuucugggggagagggacuguggcuuccuguccauaagguggcagagccagugagcaaguuggagcuguggucccccucagaugauguucagguggccaagcuuauggaugcuucucucccuuaccugaucguguuguggguaaaccugacacacauuuggguaaaucgaguugcacauauuaccauguugcccaggcuggucucgaacuccuaagcucaaaugauccgccugccgcagccucccaaauuacugggauuauaggcaugagcccugcacccagcuggagagccuccugcuccacuugcacuggggaucagcagugcacaaaacggacaggauccccuguccucccagagccugugcuagcagaggggaaacaagugcggagagaagagauuuuuacuuuuuuugaauacuuggguucaaaccuuccuuauaggaugcaugacccaaagguaugcccuucccugcuucuuccuccuuaacuuucacuggccccugacaggucagagggaagccaggaaacuuuauaauagucagaauguggcccaaaaaaaugcugugcguguguguguguguuuucaaauucaugagucuaggauuuauucauuacauagaauaauaagcaggaaagagaggggugaccccacacuccacaggccgucuagcuuaugugaagacaggcauccagggggucagcacuguugacccccuccuugucauauggacagggcucugucccucuugcugccacaaagguugagaaucuagggagaaccagaagcaccugcccuucugccaggccccuuccccaccccccgugcaucccugggugugguguccacaugccugcugccucacucagaaggcccuucuguccccagaccccacccucuguuguuuugcacagcagaggccacuucgucucaugagccuuuccagcucugcagaggcuuagcgggcucucagccuccgaagccuggcuugccaucugcacacagucccacaggccacugcgcgggccccugaugacugugcccuggcgagcguggucagggcaagucggaaucuuccuuaacagagccccacggacuacauccagcaccugggcucugcacuagccagccugagccccugcuccauuccgcacagagucuaccgccaggcccacagccugcucugcagcuuccugccauggucgggcaucucuuccaagaguggcaucgaguacagccggaccaugugaugucggcugggcagccgccaccaggccccacccuucggccgcccgcagagcccgccuuccuguccaucugaccccuucuguuuucugcaaggagcugccagccaucuaacugggcucgucggccugccccagcugcaggcccggugcuacacgggcucgggaacagaacaucgugggcaugcgcagagcaugcccauccguggcagguacgccacagcagacacaaagguaugggagcuuggugccuccagccacaaaaguggaaggcccuggaugggcacagagaacggcagagccggaaggggccguggggacugcagaguccaccaccuuaugcaccagcacagcccagagguuuggugacuugugccaagcuaacacagcaggcuccauggcaacugggcugugcacccgacuuuggauccaucagugccuuuauuuguguggggaccgagaggcgccuaguggcugcaggcagacaccauggccuggagaagggcucaugcuccuggagcacccaggcccagcuguguggcccauaggcaggguguggggugggcagagugucuccgccgggccuucacccugcccugcucuucucuuucccacaggcucuucagcuccccucccugcuucuggaaaccucugccugcugcccuggcccugccccccugcgcaugcaccguccccagggcugacccaguguggcugcauucacugggaggggccugcccucacugggccucucccacuccgcugccuguucuugcagcuccuuccuggaaagcuggaggggacuuucuccugcaagggaggaacgcaaguauuauggacacacuugaccguaaaggcacaggagccucggaacaagggggcgcaauaaagggaauggcccguccccuuccagaaccagcccaaagaagccuggggggugaggaguggcccccacuccuccaugaggggcugaugaggggugggcagccugggggaggcuuuccucgcaagcacagagcucugaggcucagcccccuggcacaggcggucacgcaucaggacgguuccuacuccucagcaccuuccgugcaguuaccagugcccugggaggucacacugcccgucggaccuuggcaugcuccauucagcugaccugcugaggacaggcaucgccgagacuccuuggguccuccccgcccucccucaugcugccacaagcugcugcuccaaggccuggccacaugcagacaggaggaagcugagcucgacauuaggccucaaggcugccaucugucuuguagggccuggccuugugggcagggggcaguccugugccuugugggcccucagccucugagggcagagaugcugucagugccgcaggugcaucacauacuucuagcauccucuccacccugcauuccaaaugcugcuugcugccugcccugcccuccgaugcaggggugggguggggggcggagucccgcccagcauagcugcagugucacaaagccauggcagaggguccuagcggcgccacccugccccagccugaggaggagggagagggaggaacaacccugggcagacggggccucagggaccuguguccuuccgccuccagagcugcccagccacgggcucucagggugcuggggcagccccagguccccucuugaacucagcuggggccaggggcccucagaaugaaggcaggcaccaggcaggagcagcaucccccuccuugacggugcuggcaggagggccgcgccaugcugacugcuugaaccucugcugaccugacagugcuggcgggagggccgcaccaugcugacugccugaaucucugcugaggcugccugccugccgggcccagcucagcgcccucuccacugcgaaucaguggcgaucaugugauuucuauuucugccccacaggguaagggacgagucuucuggaaggcucugccauggacauuuguccucgggcucagaggccccacccugccccacaccugccccugaucacugcaguguccagcccaguguugaacagauuguagcguucugucucauuacgagcaaauaaauagacuuucauuggaguucgucacauccuguuucccgcacccgccuggcugcaccucgggccucacccuguagcugaaguuggccucgagcuacuugucacuggcaaggcccaaggauggcuuccagauaaaggggacagugguuuugugugauuaacccugucagagaaugaggaccuuuggccaggcacgguggcucacgccuguaauucuagcacuuugggaggccgaagugggcggaucacgaggucagaucgagaccagccuggccaacauggugaaaccucaucucuacuaaaauacaaaaauuagccgggcgugguggugugcacguguagccccagcuacucgggagccugaggcaggagagcuugaacccaggaggcggagguuacagugagcugagauggcgccauugcacuccagccuggugacagagcgagacuccagaaaaagaaugugaaacuggggaagagguucuagaguugagaagcacauuagguccuuuuuucacuggaagguccccagcagcugcccugucugggcaucucccuggcuguaggccuugagcuggggcccaguccaggcaggcggcuccaagggugauuuggugcacccugcuguggagccugaggugcgugcccacccagcacagaccuggugcuuccgucagccucucauggaaacuucuggucacccucaagggaugauauuguuccucuuagagaugaggagaacuggcucgggggcugggaguuaccaaggagccacaguuugugaguguugggcccaggccugggccacucugaagccugcguggcugcucuguuacaccauuccugugccuuugaccucauccaguggccgggagacaugcaacuugccgaggguccucccaggagagggucugaagcaucugcaagauggaguagggguggacgcuggugcccugggaggccaggcagcugggcgcgcuggacccauguccaaagccauggggugagugaaaccagauuaacccgcugagcuugcccacgggagcgucugcuggggagacacagucuugguuacuccagcaaggacaguugcaccuuugcugaugagucagcuugcgguuaagaggguaacucuuuggggcccuuggucaaucgugugaccaguuaguaacuugcccagguggggcugcggcuccucaggcccugcuucagugaggccaggcaggacugccacugcuccaggccucucaccauagccccaccggaccgcagagcugggacacaaacgcucgugcuccacuggggggcagaaagggagugugggacccagggagagguaggacacacacaggaugcaccuggacauagcacggaggccagcccugaacggagcuggcucugccccaggccugcucagggguggagcccgaggcagccuugggucuccccgcucccugcacacaccacccaaggaucuccuauaggguagggguccuucauacuuucaggacggagacagacuccuggucuuccauuccuagcccaccggcguucagggacucacgggguaaggggcgugcccagggauggucaguguauuuucuuuuuuuuuuuuuuuuuugagauggaaucucauucuguuugcacuccagccuggguaacagagugagaucuuggcucacugccagcuuggccucccggguucacgccauucuccugucucagccucccgaguagcugguacaacaggcgccugccaccaugcccggcuauuuuuuuguauuuuuaguagagacgggguuucaccauguuagccaggauggucucgaucuccugaccgcgugauccgcccgccucggccucccaaagugcugggauuacaggcaugagccaccgcguccggcugaggucaauguguauuuucaugagcguccgcuugcucaggccaagugcugcuuucuccacaucgacucccaccccagcgugccaugauuguggcuuuuuugccucucagucuguuggagugcuucucaaaaaggcuuugggagguuuugcgggagggacugucuagaggccaauuuagggccaguuuucuuuggggccagcauguggcugcagcagauguccucucggguaagauccuggcuacagcugucuguggcugaguuacagacugucuuuuuuuuuuuuuuuuuuuuuuuuuuuuuuuuugaaacggaaccugcucucucccccaaacuggcguccaguggcgugaucucggcucacugcaagcuccgccucccggguucacaccauucucccgccucagccucuggaguagcugggacuacaggggcccgccaccaugccuggcuaauuuuuuuuguauuuuuaguagagaugggguuucaccguguuagccaggauggucucgaucuccugaccucgugaucugcccaccucggccucccaaagugcugggauuacaggcaugagccaccgugccugccggaguaacagacugucuuaaagcuucacagccuaagcaggggccauucuguuugcuuccaauuccagcugggacaggagucagcagggacuccaugugguauuagccaggcaggcuggcggggcuggaggaccugugugaaagauggcccuacccacagggcugcccacagugagcucagcaguggccaugggcuuggcuccuuccuuccauggcuuccucaggcuaggcugguuuugcaccauaccacagucccaggguagacuccuuacggggccacugaccuccugggaagcugccaggcuuccuuacugcccagaagugacaccccgccacuucugccacauucuacugguaaagcaggaucuggagccugucccaauucaaggggagggggcuacacaggggccagaacacgaagacacguggcucauccgggguagcagaagggccacugaccauagccugggacccccccccccacccacccaaaaucuggagccuggggcaaccugugcuccucucugagccuccacucuuuguucagaagugaguggaguccaggugcgguggcugaugccuguaaucccaguacuucaggaggccaaggugggaggaucucuuaagcucagggguucaagaccagccugggaaacauagugagacccucaucucuuaaaaaaauagaaaaucggccaggcgcgguggcucacacugguaaucccaacacuuugggaggccgaggagggcagaucacgaggucaggagaucgagaccauucugccuaacacggugaaaccccaucucuauuaaaaauacaaaaaauuagccgggcgugguggcgggcgccuguagucccagcuacucaggaggcugaggcaggacaauggugaacccaggaggcggagguugcagugagccgagaucaugccacugcacuccugccugggcgacagagcaagacuccgucucaaaaaaaaaaaaaaaaaaaaaaaaaaaaaaaaaaagcugggcauggugguggcccacgccuguagucucugcuacucaggaggcugagaugguagggucacuuggcucaggagcucaaggcugcagugagcuaugauuguuaaacauagggcccagcguggagccucaccuauaaucccagcacuuuaggagguggaggcgggagcauugcuugaggcugggaguuggagaccaggggcaacauagcaagacccuuucucuaccaaaaaaaaguuuguaauuagcuggacaugguggcaacugccuuugguuccagcuacucaggaggcugaggcaggaagaucacuugaggccaggaguucaaggcugcagugaguuaagaucaugcuacugcacuccaggcugggagacagugagacacugucucaaaaaaaagaaaaggggaaaaaaaguggauuaggccccuaacggucuccaagcuccaaggacuuuguauugcuggccucugugcggccucaguuaugcccagcguccgcagcugguggcuggugcaggcguccuuccauguuuacucagcagccucccuaaugucagucuuuaaguggucucuuggauccaccuggccucugcgucucuggggaaugaguguugugggagagagagaaggcagcugccccuccgccaccccaugugacucaucaguggaccucaggcccgcugcaucccacccacaccugccccaucacagcugcucuugggugcagcauguaaacaccugcucucucagagcucccccuccuggggaccgcuacagccuugggugucccccaccccgggccaugccugcauacuuagaacaacccauaaaaccacccaaggacugaagucuccaggaucugcugucccagggacacaagaacuguccaggguggguacaggagaagggaaggagccuggcuguccugggcacgucacaugcgaccuggcaggagcccaaagcagggguggcgcugagcccuagccugacccgggcugcaccggcuggagugaccagacgggaaggucacugaggcaaacccaggugcucccgucuucuucccauaggauggagaccugguggaauagaacaaguguguuaguccgucuugacacugcuuccugagacuggguuauuuauaaacaaaagagguuuaauugauucagcguuccaggugucugggaggccucaggaaacuuacaaucaccauggaaggcaaaggggaagcaggcaccuucuuggcaaggcggcaggacagagagagagagaggcggugguggggaggaaggguggaacugccaaacacauuuuauuauuuuuuucuuuuuuugagacaagagucucacucuaucacccaggcuggagugcaguggcacaaucucggcucacugcaagcucugccucccggguucaugccauucuccugccucagccuccugaguagcugggacuacaggcagcugccaccaugcccggcuaauuuuuguauuuuuaguacagacaguguuucaccguguuagccaggauggucuugaucuccugaccuugugauccgcccgccucagccucccaaaguguuggcauuacaggcgugagccacugcaccuggcccaccgccaaacacuuuuaaaccaucagaucuugugauaacucacuaucaugagagcagcauggcggaaccccccaccccccaccccaugauccaaucaccucccaugagaacccucccucaacacauggggauuacaauuggagaugaaauuuggguggggacacagccuaacuguaucagcaggcuucucauccacaguaacagugcucccgagggacaccggacaaugucuggagacacuugcugucacagcuuagaggagggugcuacagauaccaagugggugguggccagagaugcugcuuaacauccuacaugcacaggacagccuccaucccaaagaaagaucccaucccaaacaucaacagagucgaguggagacaccccggcacagaggaagcccacaccugggugcgcagagucugguccggcugggaggagaagggcugugcucauccugcccagagggaccugggagcuggggucccgcggagcagugaccucaccugguagggggcagguggggccgagguccacaucccugccucugcugcuguccucccuggugcccucccugaccccgcccugccuuccuucauccgcugcgcccuccacccacaaugccauggccugcauuuaggauccuccugaggcaggaggaucacuugagcucaggaguuugagaccagccugggcaacagcaggacccccuccccccaacucuuaaaacaacagaaaauuaggccgggcacggcggcucacgccuguaaucccagcacuuugggaggcugaggucaggagauggagaucaucuuggcuaacacggugaaaccccgucucuacuaaaaaaauacaaauaaauuagccgggcgcgguggcgggcgccuauagucccagcuacucgggaggcugaggcaggagaauggcgugaaccugggaguuggagcuugaagugagccgagauugcaccacugcacuccagccugggccacagagcaagacuccgucucaaaaaaaaaaaaaaaaaaaagacagucuguaacucagccacagacagccguagccaggaucucaccccugagaaggacaucugcugcagccacaugcuggccccaaagaaaacuggcucuaaauuggccucuagacaguucuagacugcaucucaaaaaaaaaaagaaaagaaaauuagccaggcaugguggcugaaaaggugggcuguugagccccuacccacccuauggagccaagcucagcagugucucauccaggaagcucucacagacaaguaugguguucccacaggcccuugcccuagcucacgccucucaugcccuggcaacuaagagugggggcgcggcagacccaucccuggagagacacaggacuguuuuucucaccaaacuggccugaugacagacaggcagauggacaagaacgugcaggccuuggcuuuuauugagaucagagcugugggcuccccggccucucagggaggcgguggcgggggggccugauucugcacucagcccggccucccagguacaaguggcugacuggagucuaagcaggcugcaagggcacggccaugcuucuauugcuucugccccucccucggaaccuccuccuccucccucuccccaucacauucucccgaggcccaggccugggcgcugggccgcugccugggccaccccauguggcagggccacugccgggggccgagccccuccugcucaggcugccuccucggccauccugccccuccuguacccaguccuggcacucgggaucccuauggccucuccagggccccagagcggguucucuugcacaagggacacauggccucuucccaggucccccaggaccucuugggccugagccuagaaggacuaggcugggggagggcacccuugucuggguccaugcuggaacuggaagcugaggaaagaggagagaaaggagucacuugagggacccaaggggaggcugggggggaggcuggcagcccacccugggguuuccagaauccgauauucuugaaaacagaagggaggagggcaaugcuuccuccuuaacagaauccccaggggagggaggagguugagggaacagaaugguucaagcuggaaggacccucaucuaaccugaacccucauuuuacaagugagaaaacugaggcccagcaagggagacagauuccaaggccccucaccgaguguggagcuggggcagucacccagcccucccucccagauccucccuuuuucucgcaccgcuuugucccugguggauucuccagaccccgcuuagcugugcgugaugcagagauggggacagauucaucaagaucuuggccuucuggggcauggugccacuguggaggcuugggaguggagaagggcccgccugaggccccagcccaaccauccccuagggucuucccccgugcccaguccugccuugacagagcucaccacugcuucccaggcugucccugggcaaucgggcuuccagaagggcugaacagaggcuguuacgugggcccagaguccccuguggcagguccagggcccaggcugugcccucaggcuguggcaggcagcccccagccauaagccggcccagccaguggcucucacacuggccaguggguggcggguggcucuccagguagaggcccaggccccggagguggcgcagccggaaguucuugggcuugcuucccugggcacuggggcacugcggcugcggggaccccaggccccccucguagauguuggggggugcgucaggguggccggggcguccuugggccuggcucacugcaucugcagaggagacagcgggagggugguggccagccccccacagcagccaugaggggagggugcagucacauaccucugagaccagcucacaugaugggcuacacccccagccaaccuggccucaguuuaccugugugucaaauagucucaguccacugccuccccugcccaugcccaagacacgacuccucuucccacucccaaccaacagggaggccugggaagccucgggccuugguacuaagagugcuuucaggaccucaaguccuuucuacuacccuguucugcccgcuacccuaggaagaguauucugguccccacagagaaauugcacaguggguuugagagaaaguggccagcccaggggcucauggccuggcccaguggccauuccccucucccaagcauacaugucccugaggccaccccucggcuuugggcccagguggggacagaagccuaucucucuuccugccacuccuccccacagcccggcaccuucucuuaugugcagcucagaaaaugcacagaccaaggcuuccauggagggccagugugguggggaggagcaaccaggacuugggugcagcagggcccugcucuccccugccuaggggguacauuggcaggucuccccuggcaacugguucuuaugacaucacggggaagacucccagccuuccuggaccccuaguuugggagaggacagugcccaaggcaagggcagggugaaagaaaggcaugggaaggggccagaacccugggggaagucccuggucccucuggcuggggucaggccacauaaaacagacagcucuggcaaacuggagaguccuucucucaggugaucucuuggggccagcuuccucaucuggggugggaaaugaggguucaggaguacagaccuaggaagaccuaggucgguacuuugaaaaugcugaaaag

SEQ ID NO: 18002 - RNA, 4078 nt, Homo sapiens
uucagauauacgagaacgccaugauugcugcuggacuuguugacgacccuagggccauggugggccgcuugaaugagcugcuugucaaggcccuggagcgacacugacagccagggggccagaaggacugacaccacagaugacagccccaccuccuugagcuuuauuuaccuaaauuuaaagguauuucuuaacccgaguguguguugggcuuuuuuucuggguccuguggcaggauggguccucucuuccugcaguucaacugguguggggaggggcugcucacuucagcaucaccuccacuggauaguggucacugauggcuugggccugcaggcaagugggcacagggucugggcugagccuaccugagcuccugugucccauccucauguggcugugcaagggaggacacauaccaguuggucacucaggccauaggcagccuggaaguuaaagggaagagccgagucgggaacaacggcgccucggagcagcaucccugcaaccacgauccugauggguguugggaagagaaaguagguuccccuuucacacaugggccuggcucagcacccgcaggaacuaaacuaagagcccugggaccugccagugcaggucugugggugcccaaaacugcacacccuggucugugccccucaauguggaaaccacaugacagccuaggugucugccucuccucuuauccccagaugugcuuuuccgaaaaaaccuaaaaaucguggcucuuguuauucuguucccuguaguggaucaacugaagcucaguugggugaguguucaaaggcuuugaggcuucugaagcccgaccuaugagucacggcugcccuuggaggugcccucagucugcccuaagcgcgaggcccugcucaccugucauaggcacagugcguggguguagcuguggugucagcgcugucggggaucagccacuggaagguggggcuuguccacaggcggauggaugaccacugggagggucucacauagcugcagcccgcauugaagucgcccaucaacaugacguccuaccaggaaacgcugccuguggcccugggacaugcggaggccgcuggugcccacugccccugggagggccucaccuccaagccccauuucucuuggacauccagguagacgucauagagagcgucgaucucggcuacugcgucccccggggccgcaugcaggggaacaauggcaaacucccugaccucuguggagacagccacgucgugugaggcacacucccugggggcagguucagucaccaugucagcuggaacuauguaucaugacaguccccccgggggguggauauuuuccaaaugacuugaauggaaaacccaagccccagggacugggagggcagugugugacacaggcauuccagguucccuaggaggggguggaggccauaagcgccaagccgagccccacccuggcccaggcagcacccaccugugaaccgggagaagaaccugacaauggcuggcucucgguugaaggugucguucccgcagggcucgcagccaucaucguaguaguagcuguccaccgcagacaccuggucaggccugcgggaaggccgggcaggaggaggugaccccaggcuggaagcugccccacuccugcuucccaggaggcaggcgucgcgucccaggcgacaggagggcgggggagccaggcaccugcucaacccauugguccgggacccaggcgacaggagggcgggggagccaggcaccugcucaacccauugguccgggacccaggcgacaggagggcgggggagccaggcaccugcucaacccauugguccgggacccaggcgacaggagggcgggggagccaggcaccugcucaacccauugguccgggaccuugggguguuuucacuccacccuggacccugcucugaagccucagguucuugccauaggacaaacuaauaggacaaacuacuucccugcucuguuggggcccucccaggugagggaggggcuuccuggcuuucuagaccacccaccuguacacgaacagguagcgcuccuuauagcuguuccgucccaguggcucacugaccacguagugauaggugucuggugcaucccuggauugaagaaacaaaaggucccaguggcgggggccauaggggaccccucuggcugccgauagcgaggcugugcccagguccccacccuuggggcccaagugaagugaggcugugccguggacgagaugucaccuuccuaugacccugccacugucacccacugauugagguuguccagcagcuuccccacggcagucagguggcugucucugaccuccuggaccagggcgaugucauagcggcucaggaucugggggcagggccacaguggugcugagcagggcuggugccacccagggacccuacagcgccacaaagggagccacagcugaugcucguggcauugcucgguuuaaccgcagccucauguuucugccugggcuccugcugccagccagggacagcacagcagggaugaggaccuugguccacagccaagagccuguuccaccgugcugggagcaguggugcucaguaccccacacccgacacccuguggcuccauagggcuggcccugcccaccagcccuagacuccagagcuccucugcuuuuggggggaggcugcccuggccucaccugcacaauguagcugacgaggguggcauuggacaucuuggucuccccaaaugucuggauguugaaggcugcgaucuucagggacacggcccccugcaguagggccgccagugccagcagcgcccccagcagcuucaugccccucauccugggagagcacagggcacagagacauaacagaagugagacgucaucccugccacagcacuccagccuucuggagcccagcuggcaggggcugguggagcucaaggucagggggacgcaggcgggggaaacccuuuccuacaacguccagaaagccaaacagcuggcaccacguagaggaccccgagucacuccuccauccaccagaaaacccgcccgggagggacgcuggagccuccgccucacucgcugcuggaggaugagacucuaagccucccucccugcuccaaaccggccagucacccagaggcacuccaccuggugcucaccugagaugauggugauguccucagagaugacgagaaugcugucaagaaucuggaauauccuuugaugacaauuuucuccuuuugcugcuuaaagaaaaaaaaguagucuaugaagaaaggucucugaagaagcacuucaaggcccuggcagugcugcugggcuccggauccugcacaggcagugcgugucugggaguuuuaaaaguucaggcagcugugaccuucccuggggcaaaugugagccgucaccugagagugcagaaaacaauggcucuguguggcuuuccgcauagguggguugcuagcacguguuucuuucuguaagcacagguuucuugcugcuguaaaaacugcaccugauaaucacguuugcacuuaguuuuaaaaugucugauaacaaggccaaagguuccuaucccgugucccuugcacgugugguggcccccaucuuccaggauagggcagggaugggccagguaugugcgggaggguggggcugggcuccagucucccugucucuugucugggggccccaaggucacuuuggacaaagaggccaaagccacauccaaaguugcaaauggagcccccugguggcugacagccaugacugcucuguggcccaggacacgccugccuuccugauucaucgccaucaggugcaggcaacucugcaggaggcuggggagcucggaacaagcaguggugggggccugcagcaccagcgccguggggccaggacagguggggccugcaaagcccaccccaauugccagccaagcaguggggagccuucuugagguagacaauaggcuguguguuuaggcccaggggaucccgagugaccaggucacaagggcagggcagcagcuaaaggccaggccuca

SEQ ID NO: 18003 - RNA, 1140 nt, Homo sapiens
cggagacggcaugaguaaaacucacgcaauucgucguaagucucagggucagcaggaggaaaccacgcacuacaugcugggagcggcgcgacggaggaccgcguuguaugcugggacuuguagucucgcccuuagccagaccccucggaccacuuaaguucggcuacauucaaccacguccuuacaccgauaacguacacccauugguugucuagcacagaauagcgagguucugcacggcgagucuaccuaacaacacucuucagagcaaaccccguuucggcgauggcuacccggaaggcgcguuggcugcggcuacgcguacggugcgccugcgcgugcgcgacgcaugcgccucuacgcgcgcccgccguucccgcgaggcccaccuagagccgggcggcgcaggcgcagaguccccgggccaagauggcugcgcggugcuccacacgcugguugcuggugguuguggggaccccgcggcugccggcuauaucggguagaggggcccggccgcccagggagggcguggugggggcauggcugagccgcaagcugagcguccccgccuuugcgucuucccugaccucuugcggcccccgagcgcugcugacauugagaccuggugucagccuuacaggugagggcagguuccaacuuccgaguggcgguuucagggccuagaaaagagugagucuccucgcugugacuacggcugcagggguagugggguggagggugucuuccgacgcggaugcacaauugccggagacacagacaggcaggaggcggggaggccccaguggcugcucagccgucaaggaagggagagaagcguggagcccccggcggcggugaugaaacgccccguagaucgugaaccuucaccucucugucaacauuucuggaggccgcugcucccucguccucuuccuuucccaucucuccaccuucuagcccguagcggaagggaagagcuaacugccauucggagaggccuagguacuuuguuacaacaacccugcaagaugccugccgucaucaccauuuuaaagaaugagaaacugagauucaacggaggaaucgaccagcccaaggucauggaguuagacuagaagaguugucucaaacccaaagcag

SEQ ID NO: 18004 - RNA, 1140 nt, Homo sapiens
cugcuuuggguuugagacaacucuucuagucuaacuccaugaccuugggcuggucgauuccuccguugaaucucaguuucucauucuuuaaaauggugaugacggcaggcaucuugcaggguuguuguaacaaaguaccuaggccucuccgaauggcaguuagcucuucccuuccgcuacgggcuagaagguggagagaugggaaaggaagaggacgagggagcagcggccuccagaaauguugacagagaggugaagguucacgaucuacggggcguuucaucaccgccgccgggggcuccacgcuucucucccuuccuugacggcugagcagccacuggggccuccccgccuccugccugucugugucuccggcaauugugcauccgcgucggaagacacccuccaccccacuaccccugcagccguagucacagcgaggagacucacucuuuucuaggcccugaaaccgccacucggaaguuggaaccugcccucaccuguaaggcugacaccaggucucaaugucagcagcgcucgggggccgcaagaggucagggaagacgcaaaggcggggacgcucagcuugcggcucagccaugcccccaccacgcccucccugggcggccgggccccucuacccgauauagccggcagccgcgggguccccacaaccaccagcaaccagcguguggagcaccgcgcagccaucuuggcccggggacucugcgccugcgccgcccggcucuaggugggccucgcgggaacggcgggcgcgcguagaggcgcaugcgucgcgcacgcgcaggcgcaccguacgcguagccgcagccaacgcgccuuccggguagccaucgccgaaacgggguuugcucugaagaguguuguuagguagacucgccgugcagaaccucgcuauucugugcuagacaaccaauggguguacguuaucgguguaaggacgugguugaauguagccgaacuuaagugguccgaggggucuggcuaagggcgagacuacaagucccagcauacaacgcgguccuccgucgcgccgcucccagcauguagugcgugguuuccuccugcugacccugagacuuacgacgaauugcgugaguuuuacucaugccgucuccg

SEQ ID NO: 18005 - RNA, 1589 nt, Homo sapiens
uuuuaaacaaaaucugauuguuuauauuugccucuuggcugauccaugaggaggcuggugcggcgcccgugggauauucugggauggccaucccuuccagggccaggugccacuugccuguuucaagccuuucugguuccugugcucaccaccgaugcguuugguggaaaaagagccaacugugaggucacacggucuugcugcggcaauucagggauuggccuuggcacgcagagcagagggcucccccaggccccccucccaacaaugcuccuggccucauuucuuccccuucugacaguuugccugucucucccuucaauuuccucccuuucaauccuccucccucuuuccuuucucgccccuaacgcugucucguuuugcucucuccuucuguacuauugacgguucuaucccaucucggagacuaaaacaaugucccugugcaggggugaagccugacccgccgccauaguccccaguguccacuggaucccugggguggugcuggggaguugaggggcugguggggagcugccaggagggagcuggaggggggcuccccuuucacuucccuuuggcugccuagggggggacuuugggcuccagucucucccccggccccgguggccaucggagucuggggacacugcaugccuacucuguuccuauuguccucaaggucccuggcccagcucacugcgacccacgccccccacccuggcugcucuuuucuuucuccaaagacuguguccaaaugaggccaagccccucuugaccugggugacaccuauccaagcugccuugggggugcugucugguguagcccuggcccccaccccgaccccuauaccacagaugaguauuuugggcaauuucugcccagaacaaaaucuuccacauuucugaccguggaugaggggacuggcggagugccuucuguguggggaggugggacuugcuggucccuccuccagccaccacccgaggcucagcccgugggcaggagagaaggcacccagggucacagagagagaggccccaacuugccggcccccaccaggaggcugaaccugcuggguccugugacuuccacccccucccacugcagugaggcguggcccccgcucugcugagcugggaggggagggcuccugggggacaccaggccaggccaucuugacacgugacacccagggcaucccccggucccgcacagcugggccccccucucccuagugccccucacugccuguccccacugggccccuccagagcaccaucccagccccuuucuuggguguacaagccagggcuggagugaguuucugcagcccagcaggugaggagcgaggccugggggcaucuccucugcauccucacgggccaccugggggcuugggaagguggggacuccggccccacagcaggcccgugaggagcagucccggaagaaggcagugcccaagggaggguguggggaggcuggccuuggccugggucccaggugggagcugcaggcagaaucuccccuaacccacacuagugcagagggguggcgccugcaggccuuggaagcugggaggggg

SEQ ID NO: 18006 - RNA, 1589 nt, Homo sapiens
cccccucccagcuuccaaggccugcaggcgccaccccucugcacuaguguggguuaggggagauucugccugcagcucccaccugggacccaggccaaggccagccuccccacacccucccuugggcacugccuucuuccgggacugcuccucacgggccugcuguggggccggaguccccaccuucccaagcccccagguggcccgugaggaugcagaggagaugcccccaggccucgcuccucaccugcugggcugcagaaacucacuccagcccuggcuuguacacccaagaaaggggcugggauggugcucuggaggggcccaguggggacaggcagugaggggcacuagggagaggggggcccagcugugcgggaccgggggaugcccugggugucacgugucaagauggccuggccuggugucccccaggagcccuccccucccagcucagcagagcgggggccacgccucacugcagugggaggggguggaagucacaggacccagcagguucagccuccuggugggggccggcaaguuggggccucucucucugugacccugggugccuucucuccugcccacgggcugagccucgggugguggcuggaggagggaccagcaagucccaccuccccacacagaaggcacuccgccaguccccucauccacggucagaaauguggaagauuuuguucugggcagaaauugcccaaaauacucaucugugguauaggggucggggugggggccagggcuacaccagacagcacccccaaggcagcuuggauaggugucacccaggucaagaggggcuuggccucauuuggacacagucuuuggagaaagaaaagagcagccaggguggggggcgugggucgcagugagcugggccagggaccuugaggacaauaggaacagaguaggcaugcaguguccccagacuccgauggccaccggggccgggggagagacuggagcccaaagucccccccuaggcagccaaagggaagugaaaggggagccccccuccagcucccuccuggcagcuccccaccagccccucaacuccccagcaccaccccagggauccaguggacacuggggacuauggcggcgggucaggcuucaccccugcacagggacauuguuuuagucuccgagaugggauagaaccgucaauaguacagaaggagagagcaaaacgagacagcguuaggggcgagaaaggaaagagggaggaggauugaaagggaggaaauugaagggagagacaggcaaacugucagaaggggaagaaaugaggccaggagcauuguugggaggggggccugggggagcccucugcucugcgugccaaggccaaucccugaauugccgcagcaagaccgugugaccucacaguuggcucuuuuuccaccaaacgcaucgguggugagcacaggaaccagaaaggcuugaaacaggcaaguggcaccuggcccuggaagggauggccaucccagaauaucccacgggcgccgcaccagccuccucauggaucagccaagaggcaaauauaaacaaucagauuuuguuuaaaa

SEQ ID NO: 18007 - RNA, 915 nt, Homo sapiens
caggugguguggagccggaagcaggaagcagccugugcuccccaggaccugccugguugggggaauuggaggcuucuaggagguaggugggggccugggggcugggcugccagggggagagagaggggagaugacaguggcuggggagaagguugucaggguaaggaccacagggcugggcaaggagagaagcugggccuggggccgagggagaaguggagugggaggggguggggaagcuggcgcugggccaggagcgggcaguggcugggcugugggaagccuggaugugguccccgcugagcugagcccaggauccugaugcagccucugggggaccggggcagguggcacggugcacgccaagauggcuguguccacagaggagcuggaggccacgguucaggaaguccuggggagacugaagagccaccaguuuuuccaguccacaugggacacuguugccuucauuguuuuccucaccuucauggguaaguguggcuguggccucuggguccucccagcccccugcccugggcuccagguuggggccacaccuggacgccuguccuguccccaggcaccgugcugcuccugcugcugcuggucgucgcccacugcugcugcugcagcucccccgggccccgcagggaaagccccaggaaggugagccccuggaaggugagcccugccggccucugggaccugcacggaacuguacuggggguggaggcggaaggugaggggaguggcgggaagggugcucaucccccuagggaacaacgagcgaaccugcuuggucccgcugugcuucucgugcaggaaagacccaagggaguggauaacuuggcccuggaacccugacccugugucuccugcccgguggcaguaacaaagccuucugucugcccagag

SEQ ID NO: 18008 - RNA, 915 nt, Homo sapiens
cucugggcagacagaaggcuuuguuacugccaccgggcaggagacacagggucaggguuccagggccaaguuauccacucccuugggucuuuccugcacgagaagcacagcgggaccaagcagguucgcucguuguucccuagggggaugagcacccuucccgccacuccccucaccuuccgccuccacccccaguacaguuccgugcaggucccagaggccggcagggcucaccuuccaggggcucaccuuccuggggcuuucccugcggggcccgggggagcugcagcagcagcagugggcgacgaccagcagcagcaggagcagcacggugccuggggacaggacaggcguccagguguggccccaaccuggagcccagggcagggggcugggaggacccagaggccacagccacacuuacccaugaaggugaggaaaacaaugaaggcaacagugucccauguggacuggaaaaacugguggcucuucagucuccccaggacuuccugaaccguggccuccagcuccucuguggacacagccaucuuggcgugcaccgugccaccugccccggucccccagaggcugcaucaggauccugggcucagcucagcggggaccacauccaggcuucccacagcccagccacugcccgcuccuggcccagcgccagcuuccccacccccucccacuccacuucucccucggccccaggcccagcuucucuccuugcccagcccugugguccuuacccugacaaccuucuccccagccacugucaucuccccucucucucccccuggcagcccagcccccaggcccccaccuaccuccuagaagccuccaauucccccaaccaggcagguccuggggagcacaggcugcuuccugcuuccggcuccacaccaccug

SEQ ID NO: 18009 - RNA, 44166 nt, Homo sapiens
cagccggcccccgucacguggucgggcccacuccaaugggcggcgccggggcgacuugcuguucccggcggcccgugcgucggcggugguugggugguaagauggcggcugugagucugcggcucggcgacuugguguggugaguccgagcggccgggccaaccgagacgcgccggggagcuacccgccugggcgcgggguucgcugccggcccuggagcugccuuuuuaugcgcuccaggucgcggagagaggggaagagaaggugccggcgcuugcgagcggcgccaggcggaaggggcaguccagucccgggggaccgaggccgaggguggccacgucgggcaccggcuuugauccccgaggccggccggguggggucugcacucggggcccagauacuggcggcccccgugaagggagccgccggugccgcgaggcuuccccggacgaccgguccccggggucuuguuggggcuucccagaaagcagaagcgccggggaccggaccugcgagaucuggccggugccauucggucaaagcccagguugcgaugcagccgaccugugcggccggcucagccgggguugucuaaaccggacugcuggcguugccccgcgaagaaacggcggggggacuucuccuuuacaaccgauggcuuggcagugaccagugcacgcuugggugccucccgcggucugcuucugugucccagacaaccgcccgaaccaagacuuugucgccgccucccucgagcugcguagcuuguuucuccacccagaggaaggcuuccauuagcauuugucaaagccaggcaggucuccuguugaauuaaaccagacuuagggagggaaagucuguguuuacagaggaagcuguccucccacccccgucauuaagaagcucuagacaagugacuuuugacaguuguguuguucuguauuccuugucaacagaagaauggauaugcguugugcacauaaguauacaauuuugcauuuuacuucugaggguguugggcccagcuaugaaagcuuuuguuucggcauuugaggaugccagcagagauuuaggaaaauaaauugcguauugaguggguugaaggagauggacuggcuuuugcagggcaaguguugacucuuuguguuuucucuagggggaaacucggccgauauccuccuuggccaggaaaggugagugucuugcuacuaaaggaagagaucugaaguuggguuugaagagguggagaauguaagaugcauuccucucaguuucuaguauugaguuaaauugggcucauucagauggcacuuagaauuuuuuuuccccuaguaucgguuauuuuuuaaaaggcaaugcaguauacaccagaucauuaaaucuucucuaaacccuuauuucuggauuuagaggagguuuaugaaguuucuuuuuuaaccccggaaauaauucuagucugaauuuagcuuuaugcuuaaauguaacaaaaggagaagaaaauauaaauuauccaggaagaaagucuaaauguagguuagugaaaagccaaaguauuuuugucccaacuaaguuuaaaucuucuuuccauguuaccauaugugcuacuccagugccucuuugcagaaguuggcauuccagauuuugcaugaggugauccaucauugcuuuccaaauguuguguuuuuauauucuugcuuggagcccgggaggugucuuuagauggucucuuugcaauaugguguuuucugugccucgguuguccuuuguuuucacuauguccugugucaacccuuccugcacaggaaguauuucaaagagugucgucugcauuuuuucaguaauaauggggucacauuggagcagggguggggugguggggggcaggggaugcuguugaucuuaguuuuaacugcuuguaaaacagggccacugcaguaaaagggauauugugucuacugagcacugugcuacauguuaaauauugggaacuucuagaauaucuacacauuuccauacaccucaauagaaaaaugggagauuuagacaaguacuaggccuuggguucuguuuuguauauaaauaaauuuauuuguaaguaaguccuuuuaauuuacuuuuuucuuagcaacguagaacuguagagcaauguggagccacuagaaagugggcugcuguguugccagccaaccuuuuuccccccuuuuauccuccagauuguuaauccaccaaaggacuugaagaaaccucgcggaaagaaaugcuucuuugugaaauuuuuuggaacagaagaucagugaguaguacucaccaggagucucccuucgccuuucuuucuguguuaccuggagucugagcugcuuugaaaauauucuaaggauccuuaguucagucuucuuauaauguguaauacuggcaucucauucugccuucauaccuaaauaaaggugcaauuucuugcagaaauugcccuagacaacuguccuaggucuauaacuaagucaggcaagaacuagguucauuuaccuucuaacuauaacaaucacauugaaacaguuucucacauguuucuuuacccaacuccaaaggcaguuccuuuuuguuuguuuuugagacagagacuuagucugucacccagccuggagugcagaggcagucucaguucaccgcaaccucugccucacugacucaagcgguucucucaccucagccucccgaguagcugggaccacaggugugcaccaccaugcccagcuaauuuuuuguagaggggguuuuaccauguugcccaggauguucuugaacuccuggacucaagcaauccaccugccuuggccucccaaagugcuggauuauaggcgugagccacugcgcccagcuggcaauuauuuuuauaaaagccauguucaguucucuuuuaaugccauauaucauuaugguucaugcuugggguauacaguggaaacuuuuauuuauguuaauaaaaguaauuguucaaucauguucucauguguaaaacuaagugauuugcuuugacauuguuauaguaagucuuuuuaccagaucuguccuaaguuggggaaaccaggaccauuaaucugagacucugaccauauaacauguuacagugacgggaagaacgugaagaaccuguauuaacuugaguugcuagugauuuguuuagcuuuuuaucacuaugucaaguggcuuaccugggucuagcuagaugguuugauuuuuuuuuuuuuuuuuuuuugagauggaguuucacucugucacccaggcuggagugcaguggcaugaucucagcucacugcaaccuccaccucucggguacaagugauucuggugccugagccucccgaguagcugggacuacaggcgcacaccaccacacccggcuaauuguuuuauauuuuuuaguagagacgggguuucaccauguuggccaggcuggucucaaacuccugaccucaagucaucugccccucccccccccaacccccucagccucccaaagugcugggauuacaggcaagagccaccaugcccagccgguuugauuucuuuaaguaguuguauuucuauuuauuauucuuauaggaaaauacagccuuagauuugaaaaaaaugucuguggcuucucugguaaaucuaauucugacgguuaaaguauuucuacuuagaaagcgauauauuauaaacaguauucuucacucauccaggaguuuauaugucagaugcucuuccugguuucauguuuacagauagacccagccccauuucucuaucacaagccagcuuagcagccugugguggcaguauuucaaggagaucgcuggccuggagcuguggagccagagcuucuggaagagggaauguucuuagaacuccauggauuuaaaaagaagauuuggccgggcauggugccucaggccugcaaucccaguacuuugggaggccaagguggguggaucacuggaggucaugaguucgagaccauccuggccaacauggcaaaaccccgucucuacaaaaaauacaaaaauuagccaggaguguuggcgucuaccuguaaucccagcuacuugggaggcugaggcucgagaauugccugaacccaggaggcagagauuguucgagacccugcacuccagcaugggugacagacugagacuaugucucagaaaagaaaaagaaaaacaggaaagauuguccucaugcauaacaucaguguuauguguccacuuucugaauugcuugacacugagggaauuuauaagaaagcaaguauuauaguucccaccuuccagaugcucagucaagugacaaguuguaaacauuucagauaagaugaugugcacaaugauggucgggcaugguggcucaugccuguaaccccagcacuuugggaggccggggcaggcagauugcuuaacgccaggaauuugagaacagccuggccaacauggugaaacccugucucuacuaaaaauacaaaaauuagucgggugugguggugcacaccuauaaucccagcuacucaggaagcugaggcaguagaauugguugaaccugggaugcggagguugcagugagcugagaucgcgccacugcacuccagucugggugacagagcgagacucugucucaaaaaauaaauaaagauuaugugcagaaugaaugauggcagauaauuguuaauucuaggcugggcacaguggcucaugccuguaaucccagcacuuugggaggccaagacaggaggauugcuugagcccaggagccggagaccagccuggacaacauagcaagaccuugucucuacuuaaaaaaauaaauuuuuuuuuucaauagccaggcaugguggcacacaaguguagucccagguaugcagaaggcuaaggcaggaggauugcuugagcccaggaggucaaaacugcagugagccaugaucacaauauugcacuccagucugggugacagagcuagacccugucuuaaaaagaaaaagaauucuagaagagggagagcucaguggagagccaugagaaccaagaagacugacugaagagaugggauuuguuuuucuguuuguuuuuuuuuguuguuguuuuuuuuuuuuugaaacggagucucgcucugucgcccaggcuggagugcaguggcgcgaucuuggcucacuacaagcuccaccucccggguucaugccauucuccugccucagccucccgaguagcugggacuacaggcgcacaccaccaugcccagcuaauuuuuguuguauuuuucaguagaggcaggguuucaccauguuagccaagauggucuugaucuccugaccucgugaucugcccgccucggccucccaaagugcugggauuacaggcgugagccaucgcacucagccagagaugggauuugaauccagcucuggaagauacauagaaucuggauggauggggacuauaggggcauuucagacaguggggauaccaugaacaauuggcauuaagcuggguguuauggaaaggaagaggcucccugccugagguaacuugugcuuaggaauaacagaggcaauaugguuggcccaaacuucauuagcuaaaugaauaauuacacaagucugaaacaaaaaugggaacucagucucauaaggagccugaaagccauuguuuccuuauguuuuuuguuguuguuguuguuguuguuguucuuguuugguuucuugauuuuuuuuugagaaaggguuggagugcaguaucacggacauggcuuacugcauccuugacuucccaggcucagguaauccucccaccucagcaguccgaguagcugggaccacaguugugugccaccaugcccugcuaaauuuuuuacuuuuuuuuuuuuuuuuuuuuuuuuuuuuuguagagacaaguucucgccauguuucccaggcuggucgcaaacuccugggcucaagugauccucccaccucggccucccgaaguacuggcauuaugggcaugagccacagcgccgagccccgauuuuuuuuuuaaugcuaaaagacuagauuaauaaacugugauccuuguuuauaacaagugcuagaaauaggacacagaaaauuggaguugaguuaauuucagagcuuaaccaggcaaacaggugaagccaguggugaugugcuugcucaagacaaaaauagccuggauggugguggugaugauauaauuucuaacugacgaagguucuuuggaggguuguaaacaagugggauacaaagcaacugcuaaaugcaauauuuuuaacuuuuuaaacuccuuugcuagaguucuacauuuuaaacuauaaaaaugaagucacugugguacuaauguguuaucuuuuuguggguaggcaguuaacuuagagaaaggaaauaaaggguaaagauguacaguacuucucuaaagaaggaacacuuccuuagugaucagugcuggggcagauuuuauuuuguguuuuucuaugaagguaagaucuccagauuggcugguggcagcagauuacuuuggggaaagagcucuggauugguuaccagccuaaugugcauucagguaccgguuccaccuugcucccugauuugggcaagcuauuucaccuuucugagccucuguguccucuacauaaggggaugauacccccuaccucauaguuaggaaggaaaaguaguaucucuuguguagaguguggcuugccauacagcagguauuagcacacauugguccaggaugccuuuaaguauggaaaacugagagagauggagacucucccuaugggagagagagagaguguguguguguguguuuguuugaaaagaaaggaauaugagaguuggaaguuccuaaaggaugucagccagguuugcucuuuuuaccaaaaaggcuuugaguacaaaaccaugcaucauuccaccuuuauguaaaacuguaugcgccucaucaggaauacucuauggacuucagaucaugcuuucaaagggaucucuuagaauuggccaagauccagaaaagggaacugagucagacaaaagagcaggacucuucaauguggaaaagcaaagacugaaggaaucacgggaucaggagguaggaaacagcgaauggccuagaggaguuuggcgaugggcacugcaaguggauugugguaugacuguguuaggaccagggugaggagcacugcauaaaaggggcguuuaagaggugguguaaacagguauugcaaggggauuuuuuagggaugagaacuaacuugugaagacaaagccauaaguggcuccuguagaagcuggacugcaccucgccuuuaacacuugacaucagggagggggcaugugguccaggcacauccugggugggggcaccauugguuacuggacccuggcccagguggauagggucugacccaguggaguguccuccguuccugagaaauacaggauuuggucaaagauguucaguuucaaaauugacacacuacuuaggcaaaaaaaaguguaguuauacuuuuuuaauauuugcaaggucuuuuauuaaagagcagaaagaacggcuccuuaugacaagauaaucagugauuacaaucuuuuagaaaccugauuuuucucucuccacaucucugccaaaauaucuaacaaauuguguugacaucccacuguuaggagagggccagaccuuccuaaucagguguccuggugagaggaggacuucuuuauacggauucggcucccugagcgagauggccaagacaaaacugcccacguaauuuuuguauuuucauggaaauacgaaggggauauaauuucagcaaaacccugccagcuucacuuggugacuacaaccaaagauuaugugucaagugcacgagggucccucucugacaggucugauuaguggugacccccccaucagaguagagacagagcucacgguuuaaaaguuucaucggggccaggcgugauggcucacacccguaaucccaacacuucaagaggcagaggcagaagcaucacucaagccuaagaguucaaggccagccuggguaacauggcaagacccaucucuacaaaaaauuuaaaaauaaaaaauuuaaagcuaccaugccggcuuguucucaccuuuauacucuaugcuuguguguguguuugugugugugugugugcuuuuucucugucugucucccucccccugccaucuucuccccgcccuuucuccuuuucucuuucucuuagcuucacggcuucagcccaggucaccugucuauccgaaggcugaaacacaggugagaggguucaugcguaguagcauguaccuguagucucagcuacuugggagacugaagcagaaggaucgcuugagccugggaggucaaggcuacagugaacugugauugaggcacuguauuccagccugggugacagagcaggacccugucuuuuaaaaaagaagaguuuuggccaggcacgguggcucacaucuguaaucccagaacuuucaaagggcaagucaggcggaucacgaggucaggagaucaagaccaugcuggcuaacauggugaaaccccgucucuccuaaaaauacaaaaaaauuagcugggcgugguggcgggcaccuguagucccagcuacucggguggcugaggcaggagaauggcgugaaccccagaggcagagcuugccguaagucgagaucgcgccacugcacuccagccugggcaacagagugagacucugucucaaaaaaaaaaaaagaaaaguuucaucaguggcuguggaugaugauggaauggagggaguguucauuuaaauuacaggugcuuagaagccaccagaaaccaaccgguucaacagauuguggacaaacaguggagaagcugcaagugccuaccugcgaguuuccauagcagucuuccccuccaguccucacagcagcccuuucaggaagugcacagggucaucuuucugguucuuauuuuuucacagaugaggaaacugagagaccagugguccuuuuccaccaagccacaucuaagguggaccggucucgcuggaugugaggugucugagucaguacugaaaguagcugcucuagaagaauaugugguuaauaauuagaagcauagcagcuuggaagcaucccuuuuucguuucaccuggcaccugauuuguguguguuuuuuucuggugccuuuauuucugaagaacuuggccuguaacaccucaguaaucuucagccccuuuggauggauuuuuuuuaaaaaggcacccauagaaauuguuuacuaaguauucaccaaauccaaauggagaagcaaacccacaccuucuggccccaucuuuguucucaccuguauuuuuauucuuaucuuuauuuauuuauuuauuuauuuauuuauuuauuuauuuauuuuuugagauggagucucgcucugucgccaggcuggaaugcaguggcacgaucuuggcucacugcaaccuccgccuccuggguucaagcgauuauccugccucagccuccggaguagcugggauuacaggcgcaugccaccgcaccuagcuaauuuuguauuuuuaguagagacaggguuucaccguguuggccaggguggucucaaucucuugaccucggccucccaaagugcuaggauuauaggcgugagcuaccgugccggcuuguucucaccuuuauacucuaugcuugugugugugugcuuuuucucugucugucucccucccccugccaucuucuccccguccuuucuccuuuucucuuucucuuagcuucacggcuucaccccgggucaccugucuaugugaaggcugaaacacaugugacagcguucaagauuagucauaggcugacaucuuuaauauacaguaucuacauguaugauuuucuuuuuuuuuuuuuaaagaccaagucuugcucugucgcccaugcuggagugcaguagcacgaucugcacucacuacaaccuccaccucccggguucaagcaguuccugccgcagccuccuaaguagcugggauuacagacgugugcuaccacaacuggcuaauuuuuguguuuucugguagagaugggguuucgccauguuggccaggcuggugucgaauuccuggccucaauccaccugccucggucucccaaggugcugggauucaggcaugagccaccgcaccgggcccuacauguaugauuuucauuuaagaggaaagcaaaucagaagugugcaaguuuuugaaaauaccagauuuuaauucauuuugauuggaguaaucugagagugccuuaguggcgguucuguauucauagaugaagagacuuuuuauaggaagagugucaggucaccaggguaaauuggcuguguuacaggugcaguuaugccagcagccaggcagcagcaacccaccagagcaaaccugcaaaccaggaagucauggaggaaacccucugggcagucggcauagccuguguucuagggcagaggccuuuaguauugauuuguuuuguuuuuuuuuuuuuuuuccaauauaauauguguucaccauucaaaaacaaaaacuugucaacauugaaacaguugcauucauccccaucccacagccacccaguuagaccaguuucugaugaugugucccuccagagauaucagugcguggucaguccauuuuccuugucuuugcacgagugguagcacauaacaugcauugcuuuuuaucuugcucaucuccacguagccagauaucuuacgagacauccgcuuuccuucucuguaaugaccuugccuguuuucagcuauuuacuaucacaaugugucauucauucuacuguacauaaaaagcaaagucuccuacuuuaaauacagcuugaauaagcuugauuuuucugacuucccagccacaauugggcugaaagauauagcuccaucuaagucuugggaggaugauaggaaaaucaaaaguuacagcuucuaucaaggaaagaaacagucacuuaaaaaaccaacaguagcaacaacaaaaacacuaaagccuuacgcacuggagcauuguagcaccuuuuaacucacuggugagcaguacauccuccugaacaucugggaaggaaucauuuacccagugauuauuuauugaggaccaguggugugccaggcccggcugaugugccuccgugaauuagacaguggugcauuguugaggcgccaacugaaaagcauauucucauuaaaaagacagagguaggccaguugcaguggcucauaccuguaaucccagcacuuuggguggcugaagugggcagauuacuugaguucaggaguucgagaccaaccugggcaacauggugaaccccaucucuauaaaaaauaaauuuaaaaaagaugaaagaaguguaaccuuuagagaaaaaauuguauucagauagccaaagugauuuaaguuugguuugcuuucaagagguaauccccauagagcucugguaagcuggguuuuuuuguuguuacuguuuuugagguggagucucacucuguugcccaggcuggagugcaguggcacaauacuggcucacugcaaccuccgccuccuggguucaaguguuucuccugucucagccuuccgaguagcugggauuacagcugcgugccacuacacccagcuaauuuuuauauuuucaguagagacgagauuucaccauguuggccaggcuggucucaaacuccuaaccucaggugaucugccugccucggccucccaaagugcuaggauuacaggugugagccaccgugcccagccaagcugguuuuuuauggcuguuuuuugauguaacaggaugcuucuccagcaauaaguugauuccuuaaauagauuaacauuucuuggauuuaccauccuauucauacugucaguucauuuagccauuuuaauguuucgaagaugguuguaaagaggaaaauuuuaguaucucaaaugcuuuaaagugaguggaauuuugacuguacaguuccuucuagcagaaaucaguaaaccuuguaagaugcuucaacaaaaaaugggguugauuccuuggcacuucacagacauccucaccuuucuguucccucagaaucggguuccugugaggcuggguagugggaggcagggauggagguagcaggauggcgugggugggauuagcaagucucggagucuguugucccaucucaagggguuccauaaaaaucaccuuuuugguccuauauugggaacuugugugguucucagcuucugaccagaagcuccuaggaagaacuggcuggucacgacuccuuaagcuucauccuugauacugguugugucaucucagacccacggguuaguaugguagcuucacuggcuuuuggggcugggucugacuuugcaucugauugcucuggccugucauuagcaucccuguaaggagagggaacggagucaguucagggauauucuugccagaaaaucuggggucgaaaucuccuuccacuuuuccucccagcagauuggacucauuggcgcucucauguugaauuucaaacuuuaagaugaguuggucacuggaaaggaguuugcuggcucacaccuguaaucccagcacuuugggaggccaaggcagguggaucacuggaggccagaaguucaagaccagccuggccaacacagggaaaccccgucucuacuagaaacauaaaaauuagcugggugugguggugcauaccuguagucccagcaacucgggagauagaggcagaauugcuugaaccugggagguggaggcggaggucgcaguuagcuaagaucgugccacugcacuucauccuaggugacaaaaugagacucugucucaaaaaggaaaaaaaaaaggccaggugugguggcucacgccuguaaucccagcacuugggaggcugaggcaggagaaucacuugaaccuaggaggcgagguugccgugagccaacaucgccccauugcacuccagccugggcaacaagagugaaacuccgucucaaaaaaaaaaaaaaaaaaaaaaggaauuugccuaacuccucuaguuggagcugugccagggagaccagcuucuguaucuccauucaucaucucacuuagccaugguggcaugccugauagugguucgcugccugacaucugcaggccgaugaucccaggucuguguuuuugcacagaccccauuaucacaacuaccagcagcacacucaaaguccagguagcugguggaggguuaguaacauuauuuuuaugugcaaagguuaacacuugcuguuagugaauauucucuagcuuucuaugaagaaaacaaccugaagcuugugagauagcuggguuucuguauccuuaaccugaccuacuuuuucugaagguuaugcugugaaaccuguaucacaggcuaaaacauguaaacuaacugauaccuuguaaagccuauaaaauuauuuugugcuuggauucuauaagcugcaugccauucagggaagccauagaaagccagcugcagcagauuuguucagguuagugugacagaucagaaaccccagaauugacagcugacuacuuucacuuucauguguuacacauugaugguugaaauuaaaaauuacauaucggagguguauguucuucuaccuuuaaucucaagcaucuuguuucuauuuuuuuuuuuuuuugagacaucauaaaacagcaugccaucuuguuuuuaaaugccuccuuuuguaacugcugcccuuauuccaaaccauguguuccguguuuugugugguuuaguagccaugguuaccaucauuuaugaacaaauauaggcucaguggcugugaauauccauaggaaccacaaauuuuagaagauguugcauuucuucagcucuguaacaucccugacucucuguggaucaacagaucauaaaucugguucccauuguugacaggcagcaggcauuuuccugcauaguaaugcugcuaucaucuaucacauuuccagguacccugauucccagggaucuguguguggccauuugugcugccuggugagaaugggaaagggucuccagauuucuuucugcccugagcaaguggcagcguauaugugguugggcauuggaggcugauagacgauuguggaaauaaauaaucugcaacacagugcuuucacuggaggaacuugauuugugguugcugcagugguggugaugguuguucugcuugacuuguuucaagaaaauauacuuuagacauaagacucugagaugguugauagcauguuuugaaagaaauggcaaggccuauugcaaaguccaguuaaaccaaauggauauuuacaccgugccauagugagguuguugauacuuuagggcauaugcuauaugguucacacccuuuuuguguuuguuuucugcuagugccuggaucaaaguggaacagcugaagccauaucaugcucauaaagaggaaaugauaaaaauuaacaaggguaaacgauuccagcaagcgguagaugcugucgaagaguuccucaggagagccaaagggaaagaccaggugagagacacaauguucacuuucuaccaaugccagacuggugauuuuugcauagcaacuaacagauuaaaugucacccaaacgcaaaccuuuguucuucugaaaugcuacuggagaaagcuacuucaguucuaaggugucagcguuuugcuuaucaguuugaaacuccaugcagcuaaccuuucuggaguagguuguugcuuuuaggaaaauugcuuggacccaggagaaauaucucagcauuugagucuagcacaggccauuucuuccuuucauagcacacagauuaggagcauagccucugaaauacauauacugccuagauuuaaauccuuucuucuaguuuugggacauagggaaagugacuuuugauauauauauuuuuuaaaucugcuucucccaaugucugggacgacagcagaaucuauuucuagggucauugugaggagaccacacagagugccuguagcagcacauggcaccuguaaaugaugguggcgauggcggcagcagcuguggugguaguuaucauuauuauuauuaaacuuucagacgucaucccacaauucuucugaugacaagaaucgacguaauuccagugaggagagaaguaggccaaacucaggugaugagaagcgcaaacuuagccugucugaagggaaggugaagaagaacaugggagaaggaaagaagagggugucuucaggcucuucagagagaggcuccaaauccccucugaaaagagcccaagagcaaaguccccggaagcggggucggcccccaaaggaugagaagguuuguuuucucucugcagcuuccgggauuagugauguccuuuuaguacaagguagaguuaagcucuacaguaugcuuauguaguaugcuuaucuauacucugcucauggagugggagcagaauucugugcucaagaauccugcagggcaggugcgguggcucaugcuuuaucccagcaacucaggaggcugagucaggaagauggcuugagccuuggagcucaaaguugcauugagccgauugcaccacugcauucuagccugggugauggagugagaccccgaaucuuauuuaaaaaauuaaaaaauaaagaaucccauagaccaggugagagacacggccuggaugcagguguaaaguaggagcgcgaggcaggagagcaguccacuugagccggugcacaagggcuggcccugggaggggcuuagcaagaaagaaggguaggcauuccaaagauggagggcacagcccgugugaggcucggugcugguggagauacucucgaacagggagaggauagugaggaaagccgagaaaaaggaagcuugucccuggaucguggagggccugaaggucuacugaagcagcgugguacuaaagcgucuuggagucagugggggcccgggaaggugacugagccaguggcagugugugccucccgugugugcaccaguagucaccgagugcagaggggaaagucucagagccaauuaggagguaagucuaggcgugcauucauaaggggguaauugcaaauguugcaagcaaagaggugagaggcacuucagaggaagaguucuuaagauuccauaauugguuauauagaggaugaaugagaaaaaggaaaagaggauuuccaucuucauuccugggaaaguggucaucacuuucuuaaaaguagaggacuggggauguagagguggcuuguggagaaagaguaccaguucuguuuggaaugucaagaacuugaggcaaggccuagacagccugggagcuuggugugaccucaggacuagaaauguagauuugggaggugaauuuguaaaaggguaguugaguccgggcaguggaauggguuuguuucaggaagagagggagaagagggaagcgcggaggccugcauugccacaagaaugccgugcuuggggcaggaaggagcaggaggagcuagcaagaugagauaaagcagugagagugccucucucgccuucuugcugacaagauuuggggccggucuuacaaggccacagagaagaauuucaaagugaaggggacugugucaggaacgcgguaggauugucaacagcaggauaaagagaacagaagccagauggcuggcagcaacaguugggugacgaggccaugauggaacauuagaccuuggaucaaggcucaaaaauucagacaccagcgagcccaggcagguaauggaagcaacuguagcugacuggaccuaagaagcaguggcacgggugccaggcaccccagcugaccugccuuggugcucagagcagcagggcuggccauggucagggagucuggggaggucaugcucuguccacaggguucuagccagcuucugccaaauugucuguuuuuucucaagagaagcugggaaggccaguuguggugucucauaccugcaaucauagcacuuugggaggcugaggcaggaagaucacaugagcccaggaguucaagaccaggcugagaagcauaguaagagccuuucccuuaaaaaaaaaaaaaaaaaaaagacaaaguuggccaggugcaguggcuuaugccuguaaucccagcauuuucggaggcugaggugagcagauugcuugagcuuaggaguugaagacuagcucuacaaaaacuaaaaaauuggccaggcaugguagcucacaccuguaauccuagcacuuugggaggccagugcaggaggauccccugagcccaggaguucuagaccagccugggcaacauagggaaaccccaucucuauuaaaauuuuuuuugcugggugcaguggcucacaccuguaaucccagcacuuugggaggccgaggcaggugguucaccucaggucgggaguucgagaccagccugaccaacauggagaaaccccgucucuacuaaaaauacaaaaauuacccgagugugguggcacgcuccuguaauuccaacuacucgggaggaugaggcaggagaaucacgugaacccaggaggcagagguugcagugagccgagauugcgccacugcacuccagccugggcgacagagugagacuccgucucaaagaaaaaaaaaaauuuaauauaaaugaauuaaaaauuagcugggguugguggugugugccuguaguccccccuacucagaaagcugagaugagaagaucacuugaacccaggagguggagguuacagugagccaagauuaugccacugcacuuuagucugggugacacagcgagacccugucucaaaaaaaacaacaaaaaaagaaacaaaaaguacuaguugggcauagugguacacaccuguagucccaccuacuugggaagcuggggugggaggaucacuugagcccaggaggucaaggcuguagugaccuacaauuccaccacugcacuccagccugggcaacagugugagacccuaucuccaaaaaaagagagaagcuggaaauacagguuuuuaugugaaauaucccaauuuuaaaugugcuuaguucaaaaauaugucuuggggccauagaaacaucucugugggcugccagugugaggccucuggugagagacagcccuucucacuguuagaugaccucaggcugagggaguggugagagcaaggguggcagugcugucccugcauaccgucagcccaagguuuggaaaagcugccagcugcagugcagagagaacuuuauagggaacaugaucuaaauugacccacaaaaaauguaaugugacuucugaguuuauuuccuggaauccaaaaggaaucugggcugucagauuuuaugcuauuucccaaauugauauugucugguaugugaagccaugcaucucaccggugccugugccacccuggaaagaaauaccuucucguuggauaaagggaaguacaaaggagagguuaugacgagggccuggaguuugaaucacguauauaggaccuuagcaaagcaccuuugccccaguuuccuugucucaucguuaggaauuacaacaguacgugccuccuagguucacuguguuaguuaaaugagugacauggacacagcacuuagaacagugccuguguacaaggcauuugaucaguucuuuagguuuguuucgcagacacuggccguuuguacagugagaaccccagaggccacugcccaggcuuacaggaacucgucucacgagcucccaauaaacugcagacagcccuugggucugaauuauuaaucuggggaguaguguagcauacguuggagauacugcagguucgauuccagaucauugcaggucacacaaacgucuugguuucccauugcauguuaaaguuagguuuauacuguagucuauuaagugguacaauagcaauaugucuuuuuaaaauguacauaccuuugccgggcgcgguggcucacgccuguaaucccagcgcuuugggaggccgaggcgggcggaucaugaggucaggagauggagaccauccuggcuaacacggugaaaccccgucucuacuaaaaauacgaaaaauuagccgggcaugguggugggcgccuauagucccagcuacucaggaggcugagguaggagaauggcgugaacccgggaggcggagcuugaagugagccgagaucacgccacugcaccccagccugggugacagagcgagacuccaucucaaaaaaauauauauauauacaugccuuaaguuaaaaauacuucauugcuuaaaaaaaaaaaugcugacagagacacaaagugaacacaugcuguugggaaaaugucccccauagauuugauugauacuggguugccacaaaccuucaauucguuuuuugguuuuuugguuuuuugguuuguuuuuuuugagacggagucucgugcugucgcccaggcugcggugcaguggcgcaaucucggcucacugcaagcuccgccuccuggguuaaugccauucuccugccucagccucuggagcagcugggacuacaggugcccgccaccacgcccggcuaauuuuuuguguuuuuaguagagacgggguuucaucauguuagccaggauggugucgaucuccugaccucaugauccaccugccucggccucccaaagugcugggaugacaggcgugagccaccgugccuggcccguuuuuuuuguuuguuuguuuguuuguuuuuuuaagugcaacaccuacaaagcacaauaaaacaacgcauaauaaaacgaggugugucugugguccaggagcucuagcugcuauugacccuucgagguguccuuccugccuguucuuugugcuucaccuggcccauagugaaaggacguaugagcaggagaggacagagcuggcaugugguacaggacagauagccguuucaguucagcaccuucagacagguagggaaucggugccugggcuuuggaauuuugguguguuuuaaaugcgauacaucccguagucucagaggaggguguuuguguguguguugcuauaguaauugucauuuggcuggcgagcuccucucagaaacacugagcagucacauaggcugauaacugggcaaagcccagcugagugccauuccgggacauaaucuccugccccgugaggauuaauggaaaaagcugaccuugauggcggaggcaggcagggaaaggcuggguuugcgucuggaccugcauguaagagcugcaccccagcagcgcccaccuacccucuuucuggggaugaacucugggcacagcccacccagaucaaaguagcgcuguuaguucugugacucucccaaaaucccauacucacacgaggagcagaaguuuaggaguuggggcccuuccuuagugccaaacugagaguuacaagcugccuccuccuuguuuccauugggucauuguggccuuaggugaguccuagggcugcaccacccaagacagcugugcugccccagccacaauuggccauuuaaauugaaauuaaaugcacauuaaaaugcagcuucuccaucacccuauugugugagaugcuccacagugacgcuugacuggcgccugcucuaucacacagugcagauggaguacacgcccaucauugcagaauauucuuuugggcagcucugggcugggccuuuucuuuucccccaaaaaccucugcauucaacaaauguuuauugaguaauucuccuauaggccaaaugccuggagagaaagcagcauaaaagucagacgaggcuccuucaguaagaauugaaccuggacuguauggcagcauggguuguagaguaggccagacuggcagaguucuugcuuuucuaggaugugcuucuaauaugacagacccuggagccaaauucugucagucugcuaggcacaguggcucacucccauaaucccagcacuuuggaaggccgagguaggaggaccacuugaggccagaaguuagagaccagucuggccaacauagcaagacccuauaaaaacaaaaaauuagaaauuacagaaaacaaauaauugcaaauaaauaauacaucuacaaaaaauaaaaauaaaaaauuagcugggcguaguggcacacaccuguagucccagcuacccaggaggcugaggugggaagaucacuugagcucaagugguugaggcugcagugagccauaauugagucacugcacuccagccugggugacagcuagacuaugccuccaaauaaauaaauaaguugugucuaccacaccagugacugacucggugaccuuaagcaagguuacuuaagcucugugugccuuaguuuucuauucuguaaaagaagauuauaauagggcugggugcaguggcucacgccuguaaucccagcacuuugggaggccgaggcgggcggaucacgaggucaggagaucgagaccauccuggcuaacauggugaaaccccgucucuacuaaaaauacaaaaaauuagcugggcaugguggccgcgcgccuguggucccagcuacucaggaggcugaggcaggagaaucgcuggaacccaggagacagagguugcagugagccaagauugugccacugcacugcagccugggcuacagagcaagacuccgucucaaaaaaaaaaaaagaagaugauaauaauucuguuucaugaaggggcaagaauuacaugagaauguauguauaaaauaggacuuauugugaugucuagcacauaguaagcccuaugaaggcauuuguucucauuauaauccacaucagcaucauguucuaugggcaaacauaaaaagaggucaggugaagccacucugauaaggugacauuucagcagagucccaaagcgagccugagccaaggagauaacugucagaagaacguuccaaguagcacaagggugccagggcaggcacaugcuugguguguuuggugcgggggggaaagccagcagggugcuaacgagcuagagagcagugacgggggaagaaauaggacuugagguuggagauuggcgugggaugggugggagacggcagaacuugcaagacccucccuguagaccaugcucaugaagcccguagcuuuacuaugugagacuggaaggcaguuuaaggcaaagaagcaucauaaucugauuggcccuuuugguagcugacucuggcugcuguguagagacuagacugugaguggaagcagggagauuuauuuuugcaauuguccagguggccugagcuuagguauuaguagcagggauggugagaagaagggguugggcagaucgccaacuguaaagccccauucauugucaguggauuagagaagagaggggucaagaagggcucuaaagauaucggccuaguagaauggagcaggcguuuucuaagacugagaaaaccucaggaguaguuuaggcagggggugucaagagggccacuguggcuggaagggagugacuggggaaagggagugcaagguaacaucagagcagucgagagggaccagaccaguguuaaaacuggaaagaggacccuuugcccaggaagaaggugagccgggccaucgaugaagaggagcuucucaucucaccauguccuccuguguccgucucaggagaacucaggcucuugggcucuggccacccuggaguuuaauucugccuuugucaugauagcuguaaaaugugggcagaucucaucagccccaugugguuuuauucguuucuuugaaauauggcggauuccuucugaagccacuacuguuucuuuuuuuucuuuuuuuuuuuuuuuuugagauggagucuugcucugucuccaggcuggagugcgguggugcaaucucggcucacugcaacuuccaccuccccgguucaagcgauucuucugccucaaccucuggaguagcugggaguacaggugcagcuaauuuuuguauuuuuuaguagagacgggguuucaccguguuggccaggcuggucucgaucucuugaccucaugaucugccugccucggccucccaaagugcugggauuacagacaugagccaccacgcccagccaccacaacuguuucuuaauguuugguauucaccauaaggcauuuacucugaaacuuugcagacaguacugcagaucguacuugggcuuucuaauuaccuccaucuuugugaaauuuagacauaaguacacauuuuauuauuuccagaauugagaagaaagacucacuuuguguuaaugggaagaacuggcuuguuucucccgagggacggucaucagaacagugguuggggauuggcuugaacuuucccuuagacuguggagcuugcaagggguuuuguugggguuugaaugugauuuuaaaaugcccugccccucccucuauaggaucucaccaucccggagucuaguaccgugaaggggaugauggccggaccgauggccgcguuuaaauggcagccaaccgcaagcgagguaaggagcucuccugcaggcaggacaagcuguggcuuagggcgagguuccugugugauccuuuuuuuuuuuuuuuuugucccuuucuugugugugaggcuuaauuuauuauuacaaaacaguacagaagucuaugaaauaaaaaauuaaaaauuucccucuagggugagcacugugaggcucgaggugacggauuucaguccuuugggaugcccacuuagcauucauuuacaugauuauagaccuaugucuaguuuuuuuuauuuugggcaggguucuuuuucacaaaagugggaugauuccacaaguuuuuuuccccuaauauuuuauaaacacccucuuauuguccauaaauacaacuuuuauguuuaguuuuauuauccuuggugcggcuacaccuguugcugggcauaauuauggaaagcccaugaagguccacugucguggcuacucuguuucuguuaauaugcucaguaagaugagaucgccaagggcuugguaccagacacaaguaggccaaaacccugaaauuccagaauagaugugacuuaguuugcuggguuaucugcugugccugaugaguaccgaauuuauaaagcacagguaugcuuguuaauauuuucccacaggcucauuggaauaauuuguguaccaaccuagcagaaucaucuauucuuuuacacuuuaaagccaguuuuccucuagcuggaauggggcuuguuuuuauaaaaaggcuuaggccaaaaugggaaaagaguuuccagacaauugugaaaaagagaccagaauccagagguguugcagccagaggagaguccaguuaccagggagaaggaagugaccuuugguggcagauaacugguuuuauuucacuguuuucugguuucagccuguuaaagaugcagauccucauuuccaucauuuccugcuaagccaaacagagaaggugaguugccuuugaggcucuuggcccuuggucaggggcuggccaaggagugcuccuccacuggguccuggccuggccaucugaaaaguuaggcucugccgguguauugcccagagcaacuagcccagaagcccccauaugggcccgcuaaugagccaagcauuguuaagauuaaaaguaaauccaggccgggcgcgguggcucacaccugucaucccaguacuuugggaggcugaggcagguggaucaugagguuagggauucaagaccagucugaccaacauggugaaaccucaucucuacuaaaaauagaaaaauuagcugggcaugguggcgcgugccuguaaucccagcuacucaggaggcugaggcaggagaauugcuugaacccgggaggcagagguugcagugagccaagauugcgucgcugcacuccagacugggcaacagcguaagacucugucucaaaaaagauaaauaaacccaaaggccgggcaugguggcucaugccuauaaucccagcacuuugggaggccaaggcggguggaucaccugaggucaggaguucaagaccagccuggccaacauggugaaaccccaucucuacugaaaauacaaaaauuagcugggcaugguggugcauuccuguaaucccagcuacuugggagucugaggcaguagaaucgcuugaacccaggagguaaagguugcagcaagccgagauggugccacugcacuccagccugggcgacagagcgagacucuaucucagaagagcauuuaaaacucagccagcuguguaguugagacugucacagugaccuuuagaguuuagggcagaaaccaaacaucguaagcugucagcaccccaugaaauugcauggcagacacaucuucaagcucacuccaagagguagucuccaaguccugcggaugcagagggagguccucccaaggucugcaagguuaugggguggccugagccgugcuaggaucucaugagaguuuguggcuuuggaguuggauagauguggguuccaagcuuaugacucuuauucucaacaccauggucagcaaaaagaccugguagaauugcauggggacuugaaugagguaauguguaugaacuuucuaguguaaaauuuggaguucacuaaaguauaaaacaaauaguugauguuaacuucccacuuugggucuaaccuuugaggggauuauuaugaagacugguuaagccugcaguagcacaaguagucucuuuccuccuccuucauuagccagcugucuguuaccaggcaaucacgaagaaguugaaaauaugugaagagguauguaggcuccaugccuccccauuuuaauuuucaccuggggccuuaaacugcaggcagacugacuugaugaugugugcuuccuguccguaggaaacuggcuccaccuccauccaggcagcugacagcacagccgugaauggcagcaucacacccacagacaaaaaguaggaccuuugaugaaaaggccuccaguggcucugguucugcugaggguggggagaaggugaccccagggggguucuuuaaggguugugucccagccauugcuggcauugaauggaaaagguggggggauguuguaacucuuaucgauaaagacaggagucaaaagcuguguaaaucuguggucgggucucccuugggcauaagcugagggauuuuuuuggcuccagaacucaagagcaaggagcacuuggcucagugguucucagacuuuccugugccugacagucaccuggaagguggcuucucagucaauauguccggguggggcccaagaauuuguauuuuuaaccaguucccagguauacugcugcugcuggucagagcuacgcugugagaaccacuggcugaguagaaucaugaugaggccccaaaauuggccaugguggggcaggugggggaagggagaugaaagugcuuggggauccucacugagcacuugcuggcuguccugcacccugcccgguguggguggggcgauccuggacaugcucccagacccaacuugcgcccagccuugccucugugccugcucuguaggcaugucuccuccgcagagucuuguuggcaaaaagauaccuuuucuaggaaaacacguucucuggagcaaguuagcuaaagucaguuuccaguuuguaccuuucacauggucuuccccagacuaaaaacagugcaucuuuuacaugauauuuuuguacuguuuaaaucacuaaugcuaccaguuauuuuuggugaacuugucucuguagaguggaggagauaagggcauauuaggugcaaacaaaggggaggaggauuguguuaaaaaaauaaaaauaaaaaaaugaucaggauagggugaggacagaguccugauguuuuuacccaacacauuuauuggcccauuagucaaacuuuuaauaaaagaguaugaagccagcaucaaaaccaaccaguuuuguuguugcccaacccaccuuaauccacauuuccauuuugucugagacacagugugaaggacucucaguugccauauuaaaaauccagaaccuugaccugggcaugguggcucauggcuguuaucccagcacuuugggaggccaaggugggcggauuaccugaggucaggaguucaagaccagccuggccaacauggugaaacccugucucuacaaaaauuagccaggcaugauggugggugccuuuaaucccagcuacuugggaggcugaggugggagaaucgcuugaacccgggagguggagguugcagugagccaagaucgcaccacugcacuccagccugggcaacagaacgagacugugucucaaaaaaauccagaagcuuuaucccaggucuacuggacuuccuagaacaccaagaaaggaaagggaauucgccugucaugauuuagaaucaugggggaauauuguacuacccaaauaaugagugacaaaaagguaccuccuuguuuuuaagccacaacuugaagcaguuagcaaggaggucuauuuuggugagaaaguugguggguuccauuuucaacaugugauucaaauuacuuaauacaggcugggacagggagaaugugagcagcugauauuccagcugagauuagggguccauuuguagagaugguuccagaagaccaaaacuauggaaagaaugacagggucaaaguggaggagcugccggggacauccagcagucagagaauuucugaauugaaaacauggccaagcgcaguagcucauccuuguaauccccacacuuugggagaccaaagcagaaggaucccuugaggccaggaguucaugaccagccuaggaaauacagcaagaccccgucucuacaaaaaaauuuuaaaacuuagccagacaugguggcaugcaccuauaguccuagcugcucagguggacugagguggaaggaucacuugagcccaggaguuugaggcugcggugagcuaugaucaccccccugcacuccagccugggagacagcauaaugcugucacuaaaaaaagaaaaaaggcugggugcaguggcucacgcccauaauccuaacacuuugggaggcugaggugagaggauugccugauaccaaaaguucgagaccagccuagccaacauagcaagacccccccaucucucuuuuuaaauaaauaaauaaauaaaaauuaaaaacuauaaaaacaagaacaugauaugaucagaaaugaggaaaggcauucuuuugcaccauugucacuugcaaagagaggugaagaaguacaagaaucaagaaaagacacuuuggcaagcuaaaagucauccguaaaagcauguugaaauagcagcaguggcauccagcccccagcucucaggguugcaggaaggagcaggcggaguaugugaauguguguggaggagacuggccaaugagugcuucugucacaaggauugggaaggaccuguggaaggaagggcugggggaacagugagagguuugggggaaggcaggcauggggagaaggauuuguggacugggaaagauuggguuccaagcucaggugaaggacuuagcuuuggagaggagaggcaaggcccauucuguugauaacgggaagacgggaaagguaggguguggguagagaauugaaguugggaaagagaggugaaaauugccguccugguucaugcagucaaggaaguugccuggcucuaaacacagugcuucagugacuugugguggauucuguugggcuuuaaaguaguauccagagccgggugcagugguucacaccugcaaccccagcacuuugggaggcugaggugggcggaucccuuaagcccaggaguccaagaccagccuggguaacauggcaaaagcccaucuccacaaaaaauuaggugugcugacagaugccuguagucucagcuacccaggaggcugagggggaaggauuacuugagcccaggaggucgaggcugcagugagccaugauugcaccacuacacugcagccugggcaacagaacaagacacuaucucaaaaaauaaguaaagugugaggccgggcaugguggcucacgccuguaauccgagcacuuugggaggccgaggugggcagaucacgaggucaggaguuugagaccagccuggccaacauggugaaacccugucucuacuaaaaauacaaaaauuagcugggcaugguggcgugcgccuguaaucccagcuacucagaaagcugaggcaggagaaucgcuugaacccaggaugcagagguugcagugagcugagcucgcgccauugcacuccagccuggaacagagcaagacugucucaaaaaaaaaaaaaagggcagcaaggggacuuugcccugggagacuggcccugaaccauacacaucauacuuuuuucugugacagucagggguuucaaaaugccuguuuacauccugggacagcuuuagaccauggcauaagagaagacccaugugcaugacgccccuggcucugcagguagauuggccacugcuguuucuggcagucugaauuccccuaccccaagcuguauaagggagcgagccuugugcugcauggaaucaucaucaccgugacccucccuuuccacccugaacucaucagucucucucuguuucaggauaggauuuuugggccuuggucucaugggaaguggaaucgucuccaacuugcuaaaaaugggucacacagugacugucuggaaccgcacugcagagaaaguaagcauucagggguggugccuguuggaucgguggagucugggguaacccuaagaguggacaucucccccuguugucucagcguucugcgugcaauagaauagaagccaagcuuuuaguccaggcagguagagauguagaugccuaaacuuaggauguuauuauaaaaccuaaacauuugccuggcgcgguggcucacuccuguaaucccagcacuuugggaggcugaggcgggcggaucaugaggucaggagaucgagaccauccuggcuaacacggugaaaccccgucucuacuuaaaauacaaaaaauuagccgggcgugguggcgggcaccuguagucccagcugcuccagaggcugaggcaggagaauggcaugaacccgggaggcagagcuugcagugagccgagaucgcgccacugcacuccagccugggcgacagagcaagacuccgucucaaaaaaaaaaaauagaaaauacaaaaauuagcuggguaugguggcguucaccuguagucucaguuacucaggaggcugaggcaggagaauaacuugaaugugggaggcagagguugcagugagcugagaucgugucacugcacuccagccuggcaacagaacaagacuccgucucaaaaaaaaaaaaaaauggcacaaucucggcucacugcaaccuccaccucccagguucaagugauucuccugccucagacucccaaguagcugggauuacaggcgcgcgccaccacaccuggcuaauuuuuuguauuuuuaguagagaagggguuucaccauguuagccaggcuggucucgaacuucugaccucaggugauccacccgccuuggccucccaaaauacugggauuacgggugugagccacugugccuggcccacaaguaauuuuuuaaaagaaaaccagaagaaaauaaauacuaacauagaucuuuguaaaucuagaacuaauaaaaaucacacaagaagaucaguugauuuuuuuugauaauacuccccaacaacaaaaaaauaaaauucaaaggaauaccaacuagaaguacuuguagcaaauacguaagaaggguaauauguugcuuuuauuaaacauaguuugauaauuaagacaaaaaaauuaguagggugcuaauuaauaauuuuagaucuaagaauaggcucacaccuauaauccuagcaccuugggaggcugagggaagaggauugcuugaguccaggaauuugagaccagccuggacaacaugagacuccaucucuacaaaaaauaaaauauuagcugagugagguggcaccugccuacuauagucccagcuacuugggaggcugaggccagaagaucucuugggcccaggagguagaggcugcagugagcugugaucauaccacugcauucccaccuaggcagcagcaagacccugucucagaaaagaaaaaggacaaaaaaauggcucacaaaagaggaaacaaaggcauaaaaaauauucgguaaucaggaguaauuaaaauauaucaaacaaggccgggugcgguggcucaugccuauaaucccagcacuuuggaaggcagagacugggggauaacgaggucaggagaucgagaccucggugaaaccccgucucuacuaaaaauacgaaaaauuagccgggcacaguggcgggcgccuguagucccagcuacucgggaggcugaggcaggagaauggcgugaaccugggaggcagagcuugcagugagcugagaucgugccacugcacuccauccugggcgacagcgagacucugucucaaaaaaaaaaaaugaaacaguugccuuuuuugacugguuaaaugaucagguaggaagaauuuuacauguauuuaugggcacuuauuuguaguuuuuaaauuacauacuugguacuggcauaauaggagagcuugcuggugaucuuuaugaagugacauagucucauugggaagucaucugucuacauuuguugagagccuuaaaacuuuuagaaccuguuuuauucuauuuguggagaccugaauuuaaaacauagagaaguuuuguacguaaagauguuuggugaugugauuuuacaauugaaagugggcuaagugucaaacuacaggucagccauuagguaaaucacaguauaucucucagugaaguuuuccauagucaaccacuauaaaccauaauuaugccagaauuaugaaagacaacaauauagauaaaugugaaucauaaacaacauuaaaagucugauagaaaauaguaggcccauccagccugggcaacauggugaaacccugucucuacagaaaaaaaaaaaaaucacacauggggcaugcaccuauagucccagcuauucaggaggcugaggcaggaggaucacuugaguccaggagguugaggcugcagugagccaugauugcaccacugugcuccagccugggugacagagcaaaaccuugucucaaaaaaaaaaagccaaaaugguaguguuuuuaggcacuuccagaagucuuauuaaccugacaacaguguugagaaacaacccaaaaacgaauggccaccagguggaaggcuuccagcgacauccccacauucccagcagaguguugauagcucagggccacagccaggacagcacagcgggggcuggggagaggugcuacuguucauaccccauucuugaaacagcauaccuucagcagacacuugugaagcaguucaucauccuaggcacucgucaugcaaaaacugaagauggccaguaaaaggccccgugcacuuccccaaaaguugggcuccuaucuccaugacccaggcucccggccucagccuccugccuugguaggccgccaggaggccuggucagcaauucucuggccuggcuggcauguuuguugugcacugccugcagcucacguuaggaucugugacuuuugcagugugauuuguucauccaggagggggcccgucugggaagaacccccgcugaagucgucucaaccugcgacaucacuuucgccugcgugucggaucccaaggcggccaaggacguaaggacccccucccuccccucagcaacuccgggucacagccaggauugcuggcuggccucuuccccuccuccccugcacaccaagugaguguccacauguggggggcugaauuucccaucaggggccaucucccauugugaaggguguuugcauuaauugaauacagacuuccuuuaauucagaucaaagaaugaacacuacuagggcccuugaagucugugcugaaaugugucuugaacaggcuucauguguucuuguugaacuagaagcuuuggaacugaaugugccuuugguccaggugccaagcuucuauguuuagcugucacuguauuuguauauuuuagaaguucaagugugguagucaucuuauuaaacuggugacuagccuaauccaaguaaauccaaagaaguccccaaaguaaaugcugagguuuauucuuuuaaaugggguuuguuuuuuuuuuuuuuuaaauaaaaagaaaugcacacacucacauagauucuuuuuaaagauaaaugggagcaugcgggaaguacuuuucuaucccuugcuuauuucauuguucuucccuuuucagcugauagaaaucaggaaaugagccaaaacagcagcaggauucugaucugaggucuguagggcuccugagcaucugcccgggagccugggcuauugcuucucccuuguguccccacagcuggugcugggccccaguggugugcugcaagggauccgcccugggaagugcuacguggacaugucaacaguggacgcugacaccgucacugagcuggcccagguagcagccuuccuugggcuggcucuccagcaucuuuucuaucagagcccaagacccaggcuuacaagagugggcaguuaaguuacucuagagccaaagccagagagggaagaggagaggcgaguagccuugggacuagccuaucccgugcuccaccuucaaaccgcagcuagucugaacagccaugggcagucgcugcauggcugggaugggcaucaaguccuggagcugccagccuuaugaugagaagcaacccaggccgcccgccuggcauugggguuugagcagcugucugcauuugacacuggcaaagcaucccuccuccccgagcaucuggcccaaauaagggaguggggacuuugggacccacauauguucugaggggagggcagcauccacaggggagguguguguucagccgagccauugacauggucacaucugguucuaguuguuggucucuaagaaauuccaguccgggcgcgguggcucacgccuguaaucccagcacuuugggaggccgaggugggcggaucacgaggucaggagaucgagaccauccuggcuaacacggugaaaccccaucucuacuaaaaauacaaaaaaauuagccggacgcgguggcgggcaccuguagucccagcuacuugggaggcugaggcaggagagcggcaugaacccaggaggcggagcuugcagugagcugugaucgugccacugcacuccagccugggcaacagagcaagacuccgucucaaaaaaaaaaaaaaaaauuagccaggcaugguggcgguugccuguagucccagcuacugaggaggcugaugcaggagaauggcaugaacccgggaggcagaguuugcagugagcugagauugcgccacugcacuccagccugggcaacagagcaagacucugucucaaaaaaacaaaacaaaaaaauuccggccaggcgugguggcucacuccuguaauccaagcacuuugggaggccgaggcgggcggaucacaaggucaggagaucaagacaauccuggcuaauauggugaaaccugucucuacuaaaaauacaaaaaauuagccaggcguggugguggacgccuguagucccaguuacucgggaggcugaggcaggagaauggcaugaacccgcgaggcggagcuugcagugauccgagaucgcuccacugcacuccagccugggcgacagcgagacuccaccucaaaaaaaaaaaaaaaauuccaagucaguuggguuccuguguggagaccccagcgucucaucacugcugugauucggccugugugaccugcacaugguuagcuccugaguuuaggugucagcuaaaggaccuugguauggguggccguccccuccagcucuggaaggugaugagcagccguggccacucagcaacacuccuugaguccugcccagagagcgcugggagaggggaggccuccagaagcugugacuuuucuuuccaggugauuguguccaggggggggcgcuuucuggaagcccccgucucagggaaucagcagcugucuaaugacgggauguuggugaucuuagcggcuggagacaggggcuuauaugaggacugcagcagcugcuuccaggcgauggggaagaccuccuucuuccuagguaacacgccugcaccugucaggccuggagccuggggccacaucuccucuguuucacacugaugacagcgucagucccacacggccuuucugccggggacccuggggaagguuuccuuucaccugcauagucagugcguggaaggaggaagagccagucugucgggggcaggugaagggggccuccccuggagagaggugggucugagcagaggugaggguggacagagaagcccugucuguggcauucuugggcugugaccgugagucuuuacccugggcaggugaagugggcaaugcagccaagaugaugcugaucgugaacaugguccaagggagcuucauggccacuauugccgaggggcugacccuggcccacgugacaggccagucccagcagacacucuuggacauccucaaucagggacaguuggccagcaucuuccuggaccagaagugccaaagugaguuguuuuuggccccucuucuugcauuugguguuugauuagagcaggguacuaggucagggauuuagugagcgugaaagaugccccuccccagucagucccugacccuggccagaggagguucagaaacacagugggcgggauuuggggauauaggcugggagcugcagcccucaggugucuaagggugagugaggagccaagaggccuaggcuauguggaacugagcccugaguauguuuuagguacugacaccugguggaccguaaguaguuuuuaguuucagguccuuggcuuuugucugauacuggcuuuuucuccucagauauccugcaaggaaacuuuaagccugauuucuaccugaaauacauucagaaggaucuccgcuuagccauugcgcugggugaugcggucaaccauccgacucccauggcagcugcagcaaaugagguaggguagauguggcccaagccccaaggcccuucaguuucuuuuucuuucuuuuuuuuuuuuuuuuaacggagucucacucugucacccaggcuagagugcacuggugcgaucucagcucaaugcaaccuccgccuccugguuucaagcaauucuccugccucagccuccugaguaguugggauuauaggugcccaccaccaugccuagcuaauuuuuguauuuuuagcagagaugggguuucuccuuguuguucaggcuggucucgaacuccugaccucaggugauccacccgccucugccucccagagugcugggauuacaggcaugagcuaccacgcccagccauucaguuucuuuuucuuuuucuuuuucuuuuauuuugagacagagucuugcucugucgccucaggcucuugccaccacgcccggcuaauuuuuuuuuuuuuuuuuuuuuuuuuuuuuuuuuuaguagagacaggguuucaccauguuagccaggauggucucgaucuccugaccucgugaucugcccgccucggccucccaaagugcugggauuacaggugugagccacuacaccuggccaaguuucuuuuucuuuuaucguuuccuucccucuacuuaguuuagcuuuucuuuguucuuuuucuuuuuuuugagacagagucucacucugucgcccaggcuggagugcaguggugugaucucagcucacugcagccucugccuccuggguucaauagauuuuugugccucugccucccaaguagccucccaaguagccugggauuacaggcgugccccaacccgcccugcuaauuuuuguauuuuuaguagagaugggguuuugccauguuggcuaggcuguucuccaacuccugaccucaggagagccaccugccucagccucucaaagugcugggauuacaggugugagccacugugucuggccucuuuguucuuuuucaaacccuuuaaaguggaaucuuaaaucauuuauuuuaauccugcuuucuuuauaacaugaguauauaaaucuuuaaauguccacuaauccguguuaauuuguuuucugauuucuucuuugauccaugaauuacuuaaaaguuuaucuaguguuuggguuuuccuagauaucuaaugauuauugauuuuuaacuuacugcucuaugaucaaagaacaugcccugcccuguauuggguuuuuuuuguuuuuuuguuuuuuguuuuuuuguuuuuuuuggagacagaguuuugcucuuucgcccaggcuggagugcagugucgcgaucucggcucaccgcaaccucugccucccaaguucaagcgauucucaugccucagccucuugaguagcugggauuacaggcacacaccaccauacacaacugauuuuuguauuuuuaguagagaugagguuucaccauguuggccaggcugggcuugaacugcugaccucaggugauccguccaccucagccucccaaagugcugggaugacaggcaugaaccaccacaaccagcugccuguaugauuuuuuuuuuuuuuuuuuuugagacggaguuucgcucugucacccaagcuggaguacaguggcacgaucucggcucacugcaagcuucgucucccggguucacuccauucuccugccucacccuccugaguagcugggacugcaggcgccugccaccaugccuggcuaauuuuuuguauuuuuaguaaagacgggguuccacuguguuagccaggauggucucauucuccugaccaagauguugaaaccccuaucucuacuaaaaauacaaaaaauuagcugggcaugguggcaggcaccuuuaaucucagcuacucaggaggcugaggcagagaauugcuugaaccugggaggcgggagguugcagugagccuagaucgcaccacugcacuccagccugggcaacagagugagacuccaucgcaaaaaaaaaaaaaaaaaaacgaaagcugcuacagccuucucaggcuuauuguuuucaugguauguauauuuuuccauccauuuccucucuuauuuaugucuaaauuauggcuuugauagacaguauguaauugggguuuggauuuuuauccauuuugacaguaucugccuuuuaauuagcaugucuauuagcauuuuucaaaugauguuuuaagcacuuaacacgugcacuuuuuuuauauuugagacacagucucacucucuugcccagguaaagugcaguggcacaauuauagcucacugcagccuugacuuccuaggcucaagcaauccucccaccucagccucccgaguagcugggacuauaggcgugcacaacuguauccaacuucacauacacuuucgaaaagcuuuuuaggguagaaguuccgcuuucuuagcucaucuucauagaauuugaaucuaaaaaaaaaacaacugaaaaacauuugucuuuaccauauuauuauaauaaaaaugacacuuugugaaacagcagcuguauuuuuaaaguacuaucagcugauacacuuuuauuuuauguuauuuuauuuuauuuuauuuuauuuuagagaccgaguuucacccuuguugcccaagcuggagugcaaugguguaaucucggcucacugcaaccucugccuccuggguucaagugauucuccugccucagccuccacaguagcugggauuacaggugccugccaguacuccuggcuaacuuuuuguauuuuuaguagagauacgguuucaccauguuggccagguuggucucaaacuccugaccucaggugauccacccaccucagccuaccuaagugcugggauuacaggcgugagccauggcacccagccaguacuguucuuuugacaccuggcuuuucauaguauaauucucuguuccugaauuguauuuuuuuuuuuuuuuuuuuuugagacagagucucacucuguugcccaggcuggagugcagugacaugaucucaguucacugcagcccccaccucuuggguuaaagugauucuccugccucagccucccaaguagcuggaaccgcaggcaugcaccgccacacuuggcuaauuuuuguauuuguaguagagacaggguuuuaccauuuugaccaggcuggacucgaacuccuggccucaaguaauccgccugccuuggccucccaaagugcugggauuacaggcaugagccaccgcaugcagccuuguuccuaaauucugucuucugucucuugucuguuucaacauuucagaguacuuauuucaugacucuuucagauuacauuacuauuucaaguccccccuguucauucuaccaguggauucucucuggauaguagaauucguuguguauuuuauaagucuuuuuugaugaaagcucauuucugacuauaguuauuucccaaggguuucauguggcuugggcugggaaagcuucucuuugaagugacuuccaaguugccuccacccugacuacaggauucauuggcuuggaagcagaguuuuuagguuaauuucucaaugcagcucgcugcuuucaggucguuuggaugguaugagcuuagacucuauacuguuaggaguucagagguuagguucugaagguuaacuggugcauugaccuuuaguaguuguauugauaugugguucaauuuggggcugccauuuuaucauuugauuucuguucguugucuuugucuuuuguuuguuccuccuuucuuacuuucuuuuuagaauuccaguuucagcugggcacgguggcugacaccuauaaucucaacacuuugggaggcugaggcgggcagaucaccugaggucaggaguucgagaucagccuggccaauauagugaagcccagucucuacuaaaaauaccaaaaauuagccgggcauaguggcgggcacuauuaaugccagcuacuccggaggcugggacaggagaaucacuugaacccaggaggcggagguugcagugagccgagaucgugccauugcacuccagccugggcgacagaccaagacuccgucucaaaaaaaaaaaaaaaaaaaaaaggggccaggcgcaguggcucacgccuguaaucccagcacuuugggaggccgaggcggguggaucacgaggucaggagaucaagaccauccuggcuaacagggugaaacccugucucuacuaaaaauacaaaaaauuagccaggcgugguggcgggcgccuguagucccagcuacucgggaggcugaagcaggagaauggcgugaacccgggaggcagagcagagcuggcagugagccgagaucacaccacugcacuccagucugggcgacagagcaagacuccaucucaaaaaaaaaaaaaagaaaaaagaauuccaguuucauuuaucuauuuucuuuuuuacuuugccucugcauucuuuuuuuagugguuacucuacagauugcgguauaaauccuuaagauagaguuaaucuugccaggcacaguggcuuauacuugugauccuuguaauccuagcacuuugggaggucgaggcagggucgaggcagggucgaggcuuaagcaagcccaggaguuugagaccagccugggcaacauagcaagacccccaucuguacaaaaaaaaauaaaaaacuagcugggcgugguggcgagcacccuauuccuagcuacuugggaggcugaggcaggugaggcaggaggauugcuugagcccaggaguucgaggcugcaaugagccaugauccuaccacugcacuccagccugggcaacagagcaagacccugucucaagaaaaaaaaaaaagacaguuaaucuuguaccauuucccauuaaauguaaaaacuuugcaaccacacagaagcauuucuuucccccuuccucucccucauccuuuaaggcaggguuucucaaccucggcacugcugccauucugugugggggggcuauccaagcacugcaggauguuggguagcccacccaccagacgccagugacauagcuccuccucaggugacagaaaaugucuccagauauuaccagauguccccugggggcagaagcaccacaggugugagaacucucacucugagguauagguguccuggguguuucaucugcccuuguuuuauuuuuuauucauuuauuuauuuauuugagacaguuuugcucuuuuuuuguuuuugagacagagucucgcucugucacccagacuggagugcaguggugugaucucagcucacugcaaccuccgccucccagguucaagcuauucuccugccucaaccuccugaguagcugggauuacaggcaccugccaccaugcccggcuaauuuuuuguauuuuuuuuuuuuaaagaagggguuucacgacggucaccaggcuggucuugaucuccugaccucgugauucacccaccuuggccuccuaaagugcugggauuacaggcaugagccacugcgccuggcccuaauuuuuguauuuuuaguagagaugagguuucaccuuuuuggccuggcuggucucgaacuccugacuucaggugauccacccaccucggccuuacaggcaugagccgcagugcccggccaaugcugaauguuuuauaucccauaguguauuucauucucacaagaucccccggguacuguuccuucucccagagcaagaagcacaguggcugagguccagagaaacggaggugcuucaugcaaggucaacacaggauuccuaaccggacagccugggcuccagcacugccugcuggccacauccaccacugccuccaggaaucaggucuaggucuugaaggcagcucuggggccagagacugagccaucucuuuuuuuuccagguguacaaaagagccaaggcgcuggaccagucugacaacgauauguccgccguguaccgagccuacauacacuaagcugucgacaccccgcccucaccccuccaauccccccucugacccccucuuccucacauggggucgggggccugggaguucauucuggaccagcccaccuaucuccauuuccuuuuauacagacuuugagacuugccaucagcacagcacacagcagcacccuuccccugaggccgguggggaggggacaagugucagcaggauuggcgugugggaaagcucuugagcugggcacuggccccccggacgagguggcuguguguucacacacacacacacacacacacacacacacacacacaggcucucgccccaggauagaagcugcccagaaacugcugccuggcuuuuuuucuuccgagcuugucuuaucucaaaccccuuccagucaaggaacuagaaucagcaacgagaguuggaagccuucccacagcuucccccagagcgaagaggcuguagucauguccccaucccccacuggauucccuacaaggagaggccuugggcccagaugagccaguacagacuccagacagaggggcccuuggggcccuccaaccucaggugaugagcugagaaagauguucacgucuaagcguccagugugcacccagcgcuccauagacgccuuugugaacugaaaagagacuggcagagucccgagaagauggggcccuggcuuuccagggagugcagcaagcagccggccugcaggugagcauggaggcccggcccucaccgccucgaagccaugccccagaugccacugccacagcgggcgcucgcuccucccuaggcuguuuuaguauuuggauuugcauuccaucccuugggagggaguccucagggccacuagugaugagccaagaggaguggggguugggggcgcuccuuucuguuuccguuaggccacagacucuucaccuggcucugaagagccacucuuaccucgguccccucccaguggucccaccuucuccacccugcccugccaaguccccugcaugcccaccgcucuccauccucccuccucucccucuuccucccguggagacaguauuucuuucugucugucccuuuggcccagacccagccugaccaacgaugagcauuucuuaggcucagcucuugauacggaaacgagugucuucacuccagccagcaucauggucuucggugcuucccgggcccggggucugucgggagggaagagaacugggccugaccuaccugaacugacuggcccuccgaggugggucugggacauccuagaggcccuacauuuguccuuggauaggggaccggggggggcuuggaauguugcaaaaaaaaaaguuacccaagggaugucaguuuuuuaucccucugcauggguuggauuuuccaaaaucauaauuugcagaaggaaggccagcauuuacgaugcaauauguaauuauauauaggguggccacacuagggcgggguccuuccccccucacagcuuuggccccuuucagagauuagaaacuggguuagaggauugcagaagacgaguggggggagggcagggaagaugccugucggguuuuuagcacaguucauuucacugggauuuugaagcauuucugucugaacacaaagccuguucuaguccuggcggaacacacugggggugggggcgggggaagaugcgguaaugaaaccgguuagucaauuuugucuuaauauuguugacaauucuguaaaguuccuuuuuaugaauauuucuguuuaagcuauuucaccuuucuuuugaaauccuucccuuuuaaggagaaaaugugacacuugugaaaaagcuuguaagaaagccccucccuuuuuucuuuaaaccuuuaaaugacaaaucuagguaauuaagguugugaauuuuuauuuuugcuuuguuuuuaaugaacauuugucuuucagaauaggauugugugauaauguuuaaauggcaaaaacaaaacaugauuuugugcaauuaacaaagcuacugcaagaaaaauaaaacacuucuugguaacacagc

SEQ ID NO: 18010 - RNA, 34924 nt, Homo sapiens
cgcgagcgccgcggucuccgcgcgccggagcgcagagacucccggcuccuucccccucccuucggcucgugacaacgaagcgcccgcggucugaggcggcggcggcggcgacggugcgaccggcugagcgcgagagggagccggccucgcggcucgccccgcccccgggucuuggacuccgcgccccuccccucucggcgcuuccguuacgcccguugguccggcgcgggccccggggccauucccgagcccgaggcgcuggucggccccgucgcagcgccagugagcuacccugacggagcucggcgcggccuggaacucagccuccgccgggucugggcucccgcgcccggcaacucugcuuggccgcaggccgggaggccccgguguccgcgcccguccgcucccgccgcccguguucuuuggagcgcuccucccgacggccgcuuucggaggcgccgucugagcgcggggucccgcgccgcaaguucuccuggggcgaccggaggcugcucccccgacccccugguguccccggaguggcugcgcggacgucgaguuggcauuucuucgcuuccuccugggccggcgcgcggcgcggcacaccaggcuccccugggcucggggacccggccaugggccgaggcgcgggccgcccgcccgcugggagccacggcuuagcagccgaccgcuagcugcgccgccgcccggggaccggcaugaggaccgccgcggggggacgucugcggcccgcgucggcgcuggggacaaaggugcgugucguugucggguccgggcucucucguuagccuugcccuaguuuugcacuuuugaaaaaguugugacaacaggaagacagaugccgggcguaguuuggacacuuuaaaacugaaccaugaacugggaaguguuaacugcaguugagcgcagcgucggcccaaacuucagcagaccagguagaaucacaauuuugcaaaagaucccagucccgaucacagacuccacaguguuaaggauugacuuagacuuggugucgggcucuuguugagucacugccagcuggcaaagguggcgagucgacacgcauuuccccaaggcauuguggugguuagagauuucgguugcaagucgguguuuagcguacugggucgucccgcagccugauuuuucuugggagaucaguuucccugaaguaccaagaauuagcugcacggacugucauuuacugcguguguauuuuuaagacaaagugaucuuuaaagcguauuuaagauuccagggaauaauuugauaaaaauuuaacauaaguuccuguuuaaaaauucugaauuugugaggaauugaaugagauuuuaauaacuuaaauaaaaacaugaaucuuggccgggcagggugguauaagccuguaaucccagcauuuugggaugccgaggcggguggaccaccugagaucaggaguucgagaccagccuggccaacacggucaaacccaguacucuacuaaaaauacaaaauuagccgggcgugguggcgcaugccuguagucccagcuacuugggaggcugaggcaggagaaucgcuuaacccgggaagcggagguugccgugagccgagauuaugucacugcacuccagcuaggcgacagagcgagcgagacucguccccccgccaaaaagaaaaaagaaaaaaaaaucucaaaugaacauugcaccaaaaccuagaggcauuccccuuaacaucagaaacaugguacauuucuaccacuauuagauaauaagaauauauugccuaaaaccugaaaguucuagccagugcaguaagacaggaaacaaaaauaagaaaugcaauuuuuggaaaagggaagacagaauucucauuuccguggaugauaggucugccuauuuugaaaacaaaaacaaaaaccaaaaaacccauuaaaauaagaauucaggaaggguacucauuauaaguuggaaugcacaauuuaguuuuucuguuucaucaauaaccaguuugaaaauacaauguuuagaaggagauauauauauauauaguaagaaaaaauuaaaaauugcugaggauaaccaagggacaaggaaggcuaguauuuucucaguaacaccaacugagguuuuuaaagggggaucuuuguuuuuuucuuuuuuuuguuugagacggaguuucacucuugucgcccaggcuggagugcaguggcaggaucacggcucacugcagccuggaccuucccagucuaaagccauccucccaccucagccuccuuaguagccaagacuacaggggugugccaccauaccuggcuaauuuaaaaaaaauuuuuuugugcagaugaagucucaucauguuguccaggcuggucuuaaacuccuaggcuccagcgaucauccugccuuagccucccaaagugcuggguccgggaaguugaggcugcagugagcucucauggugccacugcacuccagccugggcaacaggagugaggcaacugucucacaaaaaaaaaaaaaaaaaccacaaaaaaagcuaaaaucuuuccaaggacuuaggcaacucucguaagucuaauagauaaauguaaguuuuuuuuaagcauucaaacauguuugaacuuaauuauauuuucuuaagcauuuugaauuaugauuguaagucuaacguaccauuguuaaauauauuggauucucuuaaauguuucaaauggcuuaguaacagcagaacauuauaaugauuauaaaacaaccccaaaucuaagugguaauagaguacagauuugacucacuuuauccuguaguccuauuuuuuaccuucuugggccuggagagucacuuaagcaacugaaaggagcaguuuugccaucuaggauugaagcugcagucucucagacuuggacugagauaagguuauguguuuacugccuggacagggggaguaggaccugguugccaauucaaggaugaccuuccugcaucccauugguuaacuugcugauucccuucuuauagugagacuguuccgguucuaucagugggggaaucuguaagccuucagcugggauuuauuuccacaacccagcgcaucacaaauauccugagggccuuggagauuucuuuuagggaaaucuccuuuaacaucuuaguacguguugggagauggucuuuugcagcgccagccuguuacacugcuaaucguuuugccgccugauuagaauuauuuuaacucuucauuuguagauauuuuguucccuuaugugauguuauaaguugauuuugugaucauaauucgacaaaugaauauuggauauauacaaauacgucuacauguauguggauauauacgauauaugcuaauuuuccugaauuaacucacauuugugauugauuuacaaccaaaauacagugaguuuuuuugaaaccugccaaaauaauacauaggcuggaauggcaaaguauuauuuauaaagaaggauaauaaacaugagcuuuaacuuugcaacauuaaaguaugaaacuuuacaaaacagugcaauacugauuaaagaaucucuaaauaccguauuaauaugacacauggacuucagaaacaggccuuagauaucugugauguugcuuugcaauauaugccaaaucagcagaggaaggaaggauuguuuagugauugaugcuggaagaaaccaaguuacagccucuccucauacuuuauagcauagcaaauucaucugggguuaaugaaguaaaugugaaaaaauaucuauaaaugaccauauaggcugggcucaguggcucacaccuguaaucccagcaggaguucaaaaccagucugggcaacauggcaaaacaacgucccuacaaaaaauacaaaaauuagcacgccuguaguuccaacuacuagggaggcugagguaggaggaucgcuuuagcuugggagguugaggccucagugagcugagauugagucacuuuauuccagccugggcaacagagugagaccuugucucaaaaaacaaaaaaccuauauacacaaguucuucuauaagaucugguuggagacgaacauucuaggcauaaaagaaaugggaggagucucaaaggaaaagagccuaguuuuaacugcauacaaaguuauaauuuccuuggaaggagggucgcuugagguugugagcuuaagaccagccugggcaacauagugggucagcaucucuacaaaaaauagaaaaaauuagccaggcauggugggauauaccuguagucucagcuccucgagagguugaaguggugagagguuugcuugagccugggagguugaggcugaaguggcugugauugggccacugcucucuagccuggauauaacagcgagacccuagcucaaaaaaaaaagaaaaaaguuaacauuucuuucaucauaccucacucuaagcaacacuaaacagcaaauaacaaaacaagaagaaguacuuauaagagauaugacagauuuuguauaucuauaauguauaauaauuuauguauaauaucaagagcgcuuacaagucaauaagaaagucacaauuuauucaaccauucccugauugauugucauuugauugucauuuugguugcuuccaucauuuuucuuguauaaacaaggcugcaaugaauaucuuuauuuauugguaugguagaaaguucacacuagaauaugaacucuuuuaaaaagcaggacacaaaauuguauacgaaguaagcagaaaacauguauggcauguauuagcauauucauauucugugaacauuuggaauucuguauucaaaaucuauuuugaccauucccaagugauuuugaaggucuuuggcaugucauaauuuguuauuuugucaaggccaguguuugggugugagaguggugcacagggcaggaguguguaacuuuguuaggaagugagccuagccacacccuccugagucacugguucuuuacuauccugggguaggcaauaucuuuuguucagcugauaaaagcuuugucauugugaagauuggcucccaaugauaggaaacugcuggugaugaaaauaaaggggucuuaaagauuauucucagccagaaaaaauaaguguuagacaaauuaaauggaaaauaauuaauauuuuaguagucuuuacaauuuggaggucuaaggcucugucagcauggguucuuuaaggucaaggaucuaggauacacaugcacaggaaaaaagacuggaaguaugcuaagcagugacuaucucugaaugauugugaaaaaauuuuaggaugaauaagcagaaaaaaacaauaaaugacaaaauauaacaauggaguuuucuugacaaugaaauucucuuaaacuuaaaucucuuuaauuaggcagguaaacuauuuuaucaucuucguuugaccuggcccuucuuuucaauguuaacagaagccaugcagugacacccgcuaagacuuguugguagccaugucggagccccacaggguccaguucaccucucucccagguucccugaauccugcguuuuugaagaagucccggaaggaggaggcuggggcaggagaacagcaucaggacugugagccggcugcagcagcuguucggauuacacucacccucuuugaaccagaucacaaacgcugcccagaguucuucuacccagagcuggugaagaauauccgagggaagguaaaaggccuucagccuggagauaagguacaccccuuuguucccagaggcgcugcagguuuaacgcacaggggucagugcaugcauguggggcuuccguagcggggaagcaagacuuaacugagguuuuggcugccccaagauccugucacucacucaaggcaagcacaagauuugcuucucuuaccucugugcgcaaagggagaggccaauuugaauuaugacuaauuaacauaaauuuuaaaaacaauacauuuuucucugccaagguuauaaacguuauguguaaaugaaaccagucccugacaguuccaguguuagaauuucaugcuggacauuuuccucuuccaacagaaucuugcugucuaccuaguauaggggcagacaaaaaaacacguagacugccuuuuuuuuuuucuuucuuuuuuuuuuuuucgagaccgagucucgcccugucguccaggcuggaaugcaauggggcgaucucggcucacuguaaccuccgccucccgaguucaagugauucuccugccucaaccucccgaguaccugggacugacuacaggugcacgccaccacacccagcuaauuucuguguuuuuaguagagauggcguuucacuguguuggccaggcuggucucaaacuccuggccucaagugaucugccugccuuggcuucccaaagugcugggauuacaaacaugagccacugcaccuagccacaacuugauggauuuucaugaacucaguacccccauguaaccugcacguaggucacaaaauauauuuaucaggaccccagaaacccuccuucugcccugccagaagacuaccucaauacuuaugggcaaccacugcccugauuucuaacagcuuagaucugcuuagauuugugggguuuuuuuguuuuugaggcagagucuuacucugucgcccaggcuggagugcaguggcaccaucuugucucagugcaaccucugccucccggguucacgccauucuccugccucagccucccgaguagcugggagugcaggcguccgccaccacgcccggcaaauuuuuuguauuuuuaguagagacagcguuucaauguguuagucaggguggucucgaucuccugaccuugugauccacccaccuuggccucucaaagugcugggauuacaggcaugagccacagcaccuggccucucuuuuuuguuguuguuguuguuuuuugagaccaagucucacucugucacccaggcuggagugcggugaugcaaucuuggcucacugcaacuuccgccucccagguucaaauguuucuccugccucagccucccgaguagcuaggauuacgggugccagccaccacgccuggcuaauuuuuuuuuuuuuuuuuuguauuuuuaguagagaugggguuuuaccauuuuaaccauguaggccaugcuggucuccaacuccugaccucaagugauccacccaccuccgccucccaaaguguuaggauuauaggcgugagucaccgcaccuggccguguuuuuguauuuuauguagauggaauuguaugguauuugaguaccgccuaggugaaaagcuguuuuuuuuuuugagacagagucucgcucugucgcccaggcuggcaugcaguggugcaaucuuggcucacugcaagcuccgccuccucgguucaugccguuuuccugucucagccucucgaguagcugggacuacaggcgcccgccaccacgucugguuaauuuuuuguauuuuuaguagagacaggguuccaccguguuagccaggauggucucgaucuccugaccucgugauccgcccgucucugccucccaaagugcugggauuacaggcgugagccaccgugccuggcccgugaaaagcauuuuuaagcaccugugucugccuuugcacugugcuaggcucugaggaaaagguaagugggccccacacucgcagcauuguggucucuagcaugucucuuagugaaauggggaugaggcugguaauugguucacaguugucugaguguggaacgagaaugaaaucauguugugaauuuucuagcaguaugccucagugccaagugaucagucggucuuauucacaggugugcuguucggaggguauuuuugguuagaaggauuaaucuuuuuuuccugagauuaaaaaaauguguuuucuuggccuggcauaguggcucacaccuguaaucccagcacuuugggagucugagacaugaggaucacuugaccacaggaguucaagacuagccugggcaacauagugaaacuccaucugugcaaaauaauacagaaauuagcugggcaugauggugcaugccugaaguuccagcuacucagaaagcugaggugggaggauugcuugagccugggaggucaagguugcagugagccgugaucacaccaccgcacugggugaaagcaagacccugugucaaaaaaaaaaaaaaaaaaaaaaggcuggaaggccuggcgcagugacucaugccuguaauccccacacuuuggguggccgaggcaggcggaucacuugaugucaggaguuugauaccagccugaucaacauggcaaaaacccaucucuacuaaaaauacaaaaauuagccgggugugguagugcaugcauguaaucccagcuacucgguaggcugaggcaggauaauugcuugaacccaggaggcagagauugcagugagcugagaucaugccacuguacuccagccugggugauggcgacuccaucucccccuaccaaaaaacaccaaaccaaaaaagaaaaaguguuuccuugauugagaucugauugccugauugccagaauggaggccugugagucuguaccaagggucagccuguugcaugagcaccacugggcagaaugacagaaaguaauuucaaaucccuuuauaauuccuguuucaggaaaaugguaucuucuuccuuuagaggaagagacaggagcaggaguugguuaauguguuuauucauggguucaaaccaaaucagcaggucaacugaaauuagaacuccagugcucugaugucaccuuuuuggggacuacagaugcccuucaccauugcagaaaaaugcauggaggauacacagagaauuuugauccaauucagaggauucaguccuggacuucggguucagaacuccuaaaucgucgugggucuacucugcaguguuaaaaauacaauaaaaucaggcacauuugugcagcaguucuuuuaguguauaguccuuaauaguaugaaggcauugugcuagacucagaggacuauagaaaguuagagaaaacacuguaccagccucaaaacaaacauccuauagauguuuugagagaaugguaccaccgcagguaacagaaauuacaauauggucauuguuuaagucugguacgacacaggcccuggaggucuuagaaagaagagagcuuauuuccugauuaguguugggacagagcuggaccuuccgucauacagucaggaaaugguaguuauuggaagacugcuguuggcaaggcguucaguaguauacauagaauccagugcugcucaagguuggugggauuucuuacaguuacauaaccacucaaguuauaugcgaucauuguagaaaaauuagaagauccagauaagcauguuugaaagacuccccauuugagguaugaucguuagauguaugcucuauaauaucccauuguauguguacaccacaaaucauuuaacugauccuuugcaggugguauuucaguaggcagagaugggagggugagauaagaaaguuuguuugaaacaggcauacagucuuuaguguuuucugucuaccuugaagucuuaaacauacuucguacaggagucuuauuaaaauuaggauuccuggcuccuggcugggugugguggcucucgccuguaaucccagcacuuugggaggcugagaugggcagaucauuugagcccaggagcuugagaccagccugggcaacaugaugaaacccuaucuauacaaaaaacuuaaaaaaaaaaaauuuagcuaggcauaguguuguaugccuauagucccagcuauucaggaggcugaggcaggaggaucacccgagccuggggagguugaggcuacagugagucaugauugugccacugcacugcagccugagugacagagugagacucuuaucucaaaaaaaaaaaaaaaaaauuuuuuuuuuuggauuccuugcucacaaagcuuaaggcuuaucuguggaaaauuugcuugaugagaaaagaauaagcuuauaaaauggaaauaagccuuggaagccugaguuuaacuuugguagcaccgagagaagugcaaauucagaccuuucuaaacaguauggcagaacggcucucaagaacuugcaccacauucagugggauuuucacguuuuugagcccuugacuauuuuggaagucaauggacucuuucuuagaauguuuuuaaaugccugaagaaaauuuuaagaguuacaaaggaaguccacuuuauugaacgugguuguguagcgacugggcaucuccuucuaaaggcccuuugcugucuuugaguccugcagccccucaugcugugguggaugauuguaggcauucaaucaaguuuuauuaaccuacauuaagggaaauuuuacuuucuuaauuaagauaaacauugaugagaugguagcauguuuucuaccuugcccuuuucuggaaaacauuguuuuuauagagguauugaguaaucagugaaguuucuaugaauaagaacaugggaauauuuucugacuuauuuuuuguggaacgaucucuuuacagaagaaagaucugucagauccuuucaaugacgaagaaaaggaaaggcauaaaguagaggcccuugcccgaaaauuugaagaaaaauacguaagauuucucucuugaauaacaaaacaaccucauugggugggagacguuuccacacuguauuccuuuaguggaucaucauguaauaaacacugaucuggaaguaagccuuaagcauggagagaagagaagcaguuauuaaaccuaacgcauuaagguacagaaaaggggcauggcagagcuagugugaagagcuaacuggacaaauaaccgagaagggccuguggucgccuuagaagaaauauuuugguacaaagcauaagaagccauuuaguucauuuuucuguccuaggacauuuuauacagguacaaauauguucuauguuaaaagguuuucaggaaaggagguuuugggguuuguguguaugugagagagugacuguuuuaguuagugcauuaccucuuugagucauagcugaugaaguucaaggccacaguuaauucuguguguuuauucaaaaagcauguaaucuauugcuuucacauuuuaggguggaaagaaacguagaaaagaccgaauacaggacuugaucgauaugggguaugguuaugaugaauccgacuccuucaucgauaacucugaggcgguaaguaguuacugaaaaugccgugucagacccacuguaccuguagcuccuccugauacugaccaggaagcuggggguggggucagagcagucgugcccucuucccagcaugaggcaguagcagcacugaugagagacgaaaugacauucuuuauccgggucuuaguucccucuucagaaagugaugaccagaucuguccaaaacaccuuguagcucagacauucauguuugaccagaggauguuuuagcaugcucuuggaaguggcagaggagcacagucacaucucucucgagacccacuuugcaccuucggacugcagaagcagaacuuggagcugacaguuuguuucccaucuucaguaugaugagcuuguuccugcuucuuugacuacgaaguauggaggauuuuacauuaacucgggaacccugcaguuuagacaagcaucagagucugaagaugacuucauuaaagaaaagaagaaaaaaucuccaaagguuagaaugugcuugcuuuuggauuucagaaaugcuuuuugacgugacccuaucagaucaguaggugacuugccagaauacguggcgcuuggccggcucaggaggaugguggaaaggcagagccgugccagguugauggcucgccucuuacacgugugcccuaaugaggacacgugcccgugggggcucuguucagcacuuggucauuauguccaugucacaugacaucccagcaggcucagcaggggucguuucuggagguggccucagggugggaaggcuguggaaugagggaauguguaccacucuugcugacccucuucuguggacauguagaggacuucaguuucagggcugccaucccacugaaaaccagucagccuuaggaucaguguguuuaaaaaccugucuaccacugccuauguguuuaagaugagagguagggcccacuuguaacuuucaaacuacaaagguuucaggcuccagaauggucacuguugucucagcccuggguguuuccaggagacaccgucggugggaaugcuguggguuugugguccagggacugaucugagagcuuuuguucaugaaggaaaugagacaggucucaggaugugccccgggcggagcaaggccagugccguguagugcacuugcucccugaguuagggagccguguaacugugccuugucuuuaauucucagaagcggaaguugaaggaagguggugagaagauaaagaagaagaaaaaagaugacacuuaugacaaggagaagaaaucgaaaaaguccaaguuuuccaaagccgggugagaggcagcagcuucuuugcuaggauaaagccugaacuguuagggcaggacgacugggagcugacucaccuccuccccacagcuucggaagaggcagcagggccuggccuuccuguccucccgcacgccucccgcagugccauucugggcauagacgcucaccucucagugugucagauaguuccacugucaguguuggcagcuauuguugucacugugugacugcugauguuucucguccucuggggugcuccucucugccccaguucuccuucugucuccgcuguuuucccuuguugucuauggucaugcuuccuucuccucacuuggucucaccccagcuucucuucaaguugcugcuguucucugcugcuccugcuuucucccucuaaauacuuuucuugcucucccugccccuuuuugcaaccuuuuauuucagccuggcagugguuucuaaaaacccgucggaaauuuagcauaugugacacuguguugcuaaccuguauuaacucucaagcuuuggucucagcaagaacgagcuccauaugccaagaggagggaggaggaaugacaggguggacugugacagguucuccuggagaccaugacccugggagcaggggugaaggccucuggaguucccuuuggagguguccuauagucugagugaccaguuucccucuugcuugcagcuucacagcccucaaugccaguaaggagaagaagaagaagaaauauucuggggcuuuaagcguuaaagagaugcuaaagaaauuucagaaagagaaagaggcucagaaaaaaagggaggaggagcauaagccuguugcggucccaucagcggaagcucagggccugcgggaacuggagggugccucugaccccuugcucucacucuuuggcucuacuucugacaacgacuugcuccaggcggccacugccauggacucgcugacggauuuggacuuggagcaucugcucagugagucuccagaaggaagucccuuccgagauauggaugauggaagugauucccuuggggugggauuggaccaggaauucaggcagcccucuucucuccccgaaggccugccagcaccccuggagaagcgcguuaaggagcuggcucagguaugguggcacagugcggcugggcuuuccuggaagcaguuugggcagauugcuguugguucugcacugcgugaagcuugcccagagaaacucuuagugaguuggcaguuaaggugucagcuuuuuccaaacccuauucucauccugagggagaaaacaguguaagccuugcccgucaggcaucauuuuaggccuuucuugguuucuucauuucuggaaaauuugcuuucuucuggggagauuguucucuuucuguuuucugucaguuuguuuuccacacggcaucuuuuccuucaugugauagacggaugauguuggcagcaggcagcugaggcagagauuaaucuuagaauucuuacgaagguuuugcaaauucacaaaaguuuguaaacauacaaguuacacguagaguagaugcuucguugccacuagguuucagucgcucccuugcguuguguauccaguguuagguagugauuacaggaaugccucaaaugugaugaaugaaaagcagcuuaauuuuaaaugcuguccaugucccauuaaaacccaccaucggcagggugcaguggcucacgccuguaaucccagcacuuugggaggccgaggugggcggaucaccugaggucaggaguucgagaccagccuggccaacauggugaaacccuguuucuacuaaaaauacaaaaaauuagcugggccugguggcgcucgccguaaucccggcuacuugggaggcugaggcagcagaaucgcuugaacccaggaggcggagguuguggugaguggagauugcgccagugcacucuagccugggccacagagcaagauuccauuaaaaaacaaaccaaccaccauuaccaccuuuaggaucuagcagcucuugcuguuuuacuccagugauugggaauuaagcacugagaauugucuguucaaguaacacauuucuaacuguaaacuaggcauggaucauugguuguaauaucauuuaccuuuaaguuaaaauaacauuuuaccuuaagcaucaggacuugugaugcagcucuaguggcagucauaaucuacagcuguagguuuuaaaucagugauucuuacaguauuucagaagcauuguuaccuauaauauccuuuguguuuuagggcaggguaaauugucagcuacugcuaaaaugauuuucucacuuccaaaaaauauuugaacaccauauacaaagcaaauaaaguaucuauucaaagcucuaccucaucuuugucagcuuguguccagcauuggaaauucaaguauuguauuugaauguaaugauuuaagugaauuguaccauguugggguuuggaguaucucuuaguaugacauugagguggaaguagcugaaucugaacuugguguuuuugagccugcuguccuauauuugcucucagaauucauguuaaccaaacauuacuccuuguucuuuuuaauccucugguucguaaucaaauuguuucuuagcuucugaaagucuuguuaaaucauuuaaggucuaugugacgauagauggucguuagagaaaagucaaaaccagauucuuggcuguguccccacucgugccauagguuguguucuagugugaaaacuuacuguuucacuuucuugggaaagauggggacagauuuaguggcaacagaaugacauaaccggaaacaauguugggcuguggugcaagaaagcggagcugaguaaacaccuuguuaggcaagcugccccuccucagugauugccaagugucaguuagcucuugggcauaacaaacacaggguucaggaucccauagucaaggugggccugggucccaguggggagcuggugaccaggagaggcugauguucugguuggaaaauacaguauucaagugugaaguugauauucgagucuucacauugcccuucuccuauaacagcauuaagaaacuuugaaaaaugggguggaagguguauggaaauuauccauccggccaauauaaaaacaauuucuaguuggauauucuuuucuagccucuguguauauguuuuuaugcagcuguaauuauaguugugaauaacuguuuucugccuuuuuacguaauauuauaaagcccucaugacuuuuuaugguugcauuaaaaagguggcuuauuuuaaaaagaugcuuaaugcuacuccgaaggguccucaggugcgcucuucugaccagggcccugcacuuggggcacuuggagucccugcaugugugugcaaaugcucaggaccccugaucccacugagaaucugcugggaaagauagucuucccagggaaggaaugcacugguauacucaaauugcuuaugauuccaaaagccacauguggauauuugauauuuggauccuuaauaagggguccauccuagaucuugaaauggacaucgcauuuuuaaaauuuaaaguaaaccugauguauguaacugggacauuagcaguguuacguguuucucacuuuauuuuuuauaccccuaauuuucccccccuuuucccucuauuauaagauuggguagacuuuacaucuuggcccuaggugacacacaaaucaguuucuaucacugucugcaaaacaccccccaaaauuugccuugucauagcaguucguuucuccugacucugggccaacgcucauggcugcauucagcuggcaaguuggccaggugcuggcagggcuuuucuuuccuggccuuucauccugccuucuucagggcuugguggucucagggcaacaucucaagaggggaaagguggaagcugcagggcccuugagagcuagccuuagaggcuauguguaucacaugacuuccagcacacuuuuggucagagcaaaucacaagagccgcccagauccaaggauuagggagcuagggugcaccucuuugggaggagaauuucuuugugggaggaaucugugauccugguuuguuguuguuguugccuuuuuuuuuuuuuuuuuuuuuuugagacagagucugacuccaucacccaggcuggagugcaguggugcaaucucagcucacugcaacauccaccuccgccuucuggguucaagugauucuugugccucagccucccgaguagcugggauuacaggcgugagccacugcgccuggccuguguuccuguuuuguauucugccacaguacauagcagauucuuaucccauguguauugaucccuuaggggaaaaaacucugggaagcaaaauuagauauaucuucuaacuaaauaugguacuuaaaacuuuaaaaaaugucuuugaaaacuuguguauguuaaagagguccucugagagggaaccuuggugaugccucugccacguucacuacauucucacaucagccuguuuuuuguuacugauuuguauuguacauuuguauaggccccagggaauccagugauuugauggccuuacccugcccucuguuaauaugcauugauggugucuuuugucuugguuguuggcagguacaggugcugacaaagcucagguuugaugcuccuuuggguuauugucuugagguaguuugacagcuacucagccuugggcuggacaaauaacccagaucuauuuugguucucuuuagucaagcauaacauagagacaauacuaagagcaggaaucaaagagaccccaugucacccauucugcucugcccucuauagaauuagaaccccucaucacaagaagugcagggagagauggauccaaagagaauaacguagggggaaaaaaaacgaaaacaacuuguuugaucuuuuuaaaaaaaaucaugcccgauuuucuccuacucagcaaaaacagauacaguauauaagauuuugagcugggugcuaaaaggcuacaggugacuuuucuuagaauaaauaaaacagcucauuaaaaggcuguuggaacucuuauaaaucagcaugauugggauguuuaaccucauuuacuaguuaacuuaggauugauuaauucacacaacuucugggguaagagugucucuuuuuaggggugagggaccccauuuauuuuuggaagacuaucagauauauauccaauugcucuuuuaauuagauuuacuuuaaaaugccgcagucgacucuucaguauaaagccagacccucagagauauugucuaugcaauucaaaagguuuacagaaaaguacuuucuaaaauuacauaauauuauuuaaaauauuuuuaaagauugcguaaagauuacauagaaagcuucugaaauauuguacaaguggcuaucuaaacagaaaauuuggcagggcgcgguggcucaugccuguaaucgcaguacuuugggaggccgaggugggaggaucaccugagcccaggaguuccagaccagccuggguaacagagugagaaaaaaaaaucuaaaaauuagucaggcgugguugcgugcagcuguagucccagcugcuugggaagcugaggcgggaggauuauuugagccugggaggucaaggcuguaugagcugcgaucacgucacugcacuccagaaugggugacagagugagaccaucucaauaaaauaagaugcugggcaugguggcucagccuguaaucccagcauuuuggguggcugaggcgggcggaucacuuggggucagauguuugagaccagccuggccaacauggugaaaccccaucucuacuaaaaauacaaaaaauuagccgaacaugggggugggugccuguaaucccagcuacucaggaggcugaggcaggagaaucacuugaacccgggagguggagguugcagugagcugagaucacgccauugcacuccagccugggcaacagaacaagacuccgucucaaaaacuaaacuaaaauaaaaaaauaaaaaauaauaagauaaaauuugauuggaaguuuaagcuguagaugggucugaaaguguggcaugugaaauacauguuaauuaguuugaauuaauguaagggugcuucucgaucuuaaaacuagcaguguaagcuuaagcaaaaaaaguucaguuuuauuuuuucccagacuaauauaauucuaguaccuuccaagugcuaagguagaauucugaauguuuccaagaguguaagaaauuggcacauggcugggugaaaagucaugcccuuuuuuuccauuauucgucuguggauuucaccccucugggcuuucaccuagccaagggaucuguagaagcuugaguuuugcgcauuuucuucugacuuaguuuugguuguuugguguuaagcuuuucuuccuguggcgugccguuuuacaguaguaucuucauuuguugauucauucacucagucaacauuuaguaaauauuaugugacaggcagccaugggaaauauacugaugaauaagacucaguucuauauuuuauuuuauuauuauuuuuuaagacagggucuugcucugucacccaggcuggagugcaguggcacgaucuugccuuacugcaaccuccacgcccagggcucaagugauccugccaccucagccuccagaguaguugggaccacaggcaugcaccaccaugcccagcuuuuuuuuguauuuuuaguagagacagggucucaucaugugcccaagcuggucugaaacuccugagcucgcguguuccgcccaccuuggccucccaauguguuaggauuacaggugugagccaccgcgccgggccaagguuccauucuugucuuucaugagcucguuacauaaauggacccgauagauacgcagacaauggacuguaguacagagcagaaugaaguaagcuuugugauguguggacggccagauagccggacuuaagggguuaaagagaggcucuuggggggcauauaggaagcagacuggaggcaacaggcuucgccggccuccuggggaagaugcccuaagagaaggcagggagcagagcugaagaugggcgaguugguggauggcugggccagaucguggaggaccccaaaugccaugugaaggaguuuggguuugauaccaggcuuggaaagagcugcugaaggguucugaagaagggaguggcggucuuaagguuggagugcaauuauuagaaguggggaacacaggggaagagcagaagccagugggucugguguaaguugaguuugcaaaccagagggucauccauccacagaagugcaguugacccuugaacaacacaggguuuaacugcguggauccacuuacacgcagauguuuucuaaccaaauguggguugauuugagggaugcuaaaucuguguauagagggcuaacuuuuuguauaggcagguuccucagggcugacugugcaguuggauuuugguauauacggggguccuguaaccaauccccugccuauaccaggcguugacuguaauugggaaauuucucagagauaacuggaaauucugguccagagcuuagaugagaggauuuagggcuuaguuuagauuugaguguacaauugucuguguuauuuugaagcccugagggggaaagaaguuauugggagaaguggguucuagugagaauccugggguccgccuauggaaaggagcugguggaggaggcagauggagcaguuagagugguuggaaggggccccagaggaugcagugagaggaaggugagugggggagaugauggugagggguuagcagugucugcaauuucagagggguugaucccuucauucuagauagucaccuuaucacccuuguuugcugucguuacuguauaucaugucugauuucagaaauuuuauuucacccaaagccuucagaccagcagcucuuggguugagaggaaugguucccagcccuuuuugcacaucaguguucccaggguugcuuugaaagaguacuugggccacuuuugagagugugcauuccugaaucuccuuuccagagacugugauuugaauggccugaguugcuccaagcugcccagggaauuccaauaugcaaccaagugugagaacccugaugcagacuuccacagggucugcuuuuuuguguucccgcugugucguggcugccugccgugguugcuucaggggucucugagcuugccauccaggguguguguuaacuguguucuuuucgaaagcaaacuaagacuguacugaaacuccuauaaucugguguuaauagguaauaugguggguuaauuauucacauggucuggcuaauagagagcucgugguauaccauaaguagauuaggaauugucaaagaguuuuaauguccuuaaguguuagagcuacacauuauuauuauuuuuguagauaaaaaggccuuuaaauccuauagacugguugaaguucuugaauauuuuuguacuguagauacauggaaaucccaacuaaugguguaguugaugguguaugggugcagggguuaguuggccuuauuggccucuggcuaagugcauugugauggcuuugacucugauuuucuuuucugugacuguuuuaagucccaggaagaacuggcagcccacagaugcugcagcagcauuugaaaagagaauauugaucgcaggcgaacuuaaccugggacuaggguggaguuggaaagguggcggugugacuguauugacaggugcucuuuauggagcgaugacuccugugccugugggugagcguaagggacauguggggaaagugcacuaacggcuguuacugucugcugugcaccaggcugccagagcugcugagggggagagcagacagaaguucuucacccaggauauuaauggaauccuauuagagugaguaucgucugucugucugucugucugucuguuucugcuauuacugagcuuggggcaagccagcuaggggacagugggaguacaauugaacugcauaaaggugaccaccaaggagauaaaagaagaauuggauuaacaugguuucauuguuauuuuucuuuuaaaaaucaaaacacaacagggacaccaaguacuugucuccagaagcgauagaccuccuugaucuuaggcagcaggcauuaauaacaugugauaaucauggccuguuagaagaggauuucuuggcagguaugagaugaggagagagagaagguguugccugacugucucugagaauccugaagaaugagagacagccugguggccucgggccugcucugccuuggguguugcuuggcgucccuggcuguuccgcucgcuggcacuccuguuccuagugccacgugcaucaucccuaaugcuguucccacaugccugagccucugagacaccacgcugugugaaucggguuaaaaaacagaugagcaaacauuuguaaauccagacugggaaaagugaauccuuguggccuggccugcaguguugccgcuuuucuccugguugcaguuuguggcaggggaagcuuguugcucaacagcugaggaguuuguguguguaagaacaguugucaaaauguggguguucuaccacauggccucgccuggccgggaccuggauuggccccuugggucaggaagugugagcugcagagagcaccugagcauuggugcggacgauaggauugugucaacaaggaaccugcuugagcgugccaaauguggacagcucaaggcauugaagagaaauauuuuuuugcuuaucuagauggagaaacuggaggggugaggcuuucccugaccucauaaugguugauaaacguggggacugggggaaaaaaaagaaaugcugccgggaagugucuccuuugaaccccaaguaacucaugacuuuccacuuugaaagcuuucauguuuucucuaugaaauuuagugcuucagagcuuguucuccugggcucuguuuuccugguauugugaccuaagagccuuggcccacauuaccuagccauguucaucaggcuugggaguuguuguuguuuguugauugcugaggauguguuuccuugggcauucaguuacauugugugaccaacaagacaggguuugacugccguuggcuccuagcuuuccucuccacguacggugagcugaugaagacaggaguugcagugagcugcagccgguggugacuguguuuuguucuucagcauagaggcgcagacucgggagcugagcagucagguccgcucugggguguaugccuaucuugcgucauuccugcccugcagcaaggaugcccugcucaagcgugcucggaaacuucaccucuaugaacaggugggugacucuagagugaagcccuuuggcuuugggguccuggcggaggggugacugagucuuaagcaaugaugcgucugcugccccacugccuccuugugaucaccccaucaugcguccugagcguaagagcgauguguaaaccugccuugaauugugucccgcucuucgcaggggggccgucugaaggagccucuccagaagcucaaggaagccauuggcagggcgaugccagagcagauggccaaguaccaggacgaaugccaggcacacacgcaggcaaagguugccaaguaaguuuguccuggcgcuugcaggugcaacccucccgucuugccucuuccccucccguuucucgguguguacugccguuucccaaggagccucuuggcucuucuuuggccuuuucuccuucucugugaagucccaguagugcagagugaggggagaggcggugggcaggagcaccuuggggccccauguaauucuauucaccccguaggaugcuggaagaggagaaagacaaggagcagagggaccggauuuguucggaugaggaagaagaugaagaaaaagggggcaggaggauaaugggaccucggaagaaguuccaauggaaugaugagaucaggugugcccacacugggacuuggccucuuuggaggguugguggggcagugucugagcacguccccuauugcugacaaagguuaggcucauuuacuuucaucagggcugcugaaagcacaugauuggaaccuuggagcagcaucugaaguaguuuggaguuucugauuucugccuccuucucagggagcuacugugccagguggugaagaucaaacuggagagccaggaccuggagaggaacaacaaagcccaggcuugggaggacugugugaagggcuuucuggaugcggaagucaagccccucuggcccaaaggcuggaugcaggccaggugagggccgugugcugagaugggcaucugugcagucaagacacguuugaacgcugcuuuugugccaggccaacaggauccuugcucacagggagucacugucuagcugccucaacucugaucucaccugaguaacugggggacaugcagguagcugggaaagggucuucuggaucuucccuggaggaagggaaguugccuccaggguuuuguuuuugucauuuuuugucccacuucaguugauguuuggccucccaucucaauaugcacuuuccuuuuuuuuuuuuuuuuuuuuuuuuuuuugagauggagucucgcucuguugccugggcuggagugcagugguaugaucucagcucacugcaagcuccaccucccagguucacgccguucuccugccucaaccucccgaguagcugggacuacaggugccugccaccaugcccggcuaauuuuuuguauuuuuaguagaaaugggguuucaccguguuagccaggauggucucaaucuccugaccuugugaucugcccaccuuggccucccuaagugcugggauuacaggcgugagccaccacacccggccacacuuccuguuuuaacauacaggcugcuaugagcauuugagagauggguucaucuugggucuuuccugauguuccugaagaagugucauuugcagguagcagggcugacuccuuauuggaacuaagugccaggcuuccaucucagaggcuaccuuguacgaagucacuuccugcgaaugaaguauuugugucauacaugggacagagaaaguuagcuggagugauuuucuugauuggacucgaaucaucuguugugcggauagaucuuggaaccuuugaaauugcuguccucucuacguaggcuggacucauacgaagaacguuuuuguugaguuucucuggacaaagacaugcugggucacuccacauuuuauuccuggaauggagggacuaggcaauaaggaaagugcugugcccuuuagggaagcaucaccaugagagguuugaggcagagccauacauuuucuugguaaaggccagacucagccuuugggcagccagugugucccauugagauccucucaccaggaauuuggcuccccaauccauugaccuuuuuuuuuguguguguggggggugggugggcauggugggggggcggggacaaagucucacucuguugcccagacuggagugcaauggcacgaucucggcucacugcaaccuccgccuccccgguuugagcgaaucuccugccucagccucccgaguagcugggauuacaggcgugcgccaccacgccuggcuaauuuuaguauuuuuaguagagacgggguuucaccauguuggccaggcuggucucgaacuccugaccucaggugauccaccugccuuggccuccaaaagugcugggauuacaggcgugagccacugcgccuggccaguugacauuuaaugagggauagcuacugaggaccagggacacuagcaaaguucuggaagcagagucccagcuuucuggggcauguacagaugccugguguucugugucuuucagaacucuguuuaaggagagcagacgaggccaugggcaccugacuucaauccugugagugucuugguauuuucacaucucgggacaaguguuguuuuuggucuccucuggauauucucuaaacuuuucugugcucauuccuuugaacagggccaagaagaaaguuauggccccuucuaaaaucaaggugaaggugagucaguuugcucgggucacaugucagcuaugcccaucucccuacaacuaugcucuggaaacagucaagugacuguggaagcucauugaucuuugcucgucuggggacagcugcucaggaugacauucuugaagucauaacaggacagagacccaagccacuuaaccccccucuagccuugguucuacaaacaguacccagcuggcccaguuccugggguucaugugggauuaagugggaucuucuuggcagcccucugaggagucaguagucccugaaggugugaacguguuacacugugaucuuuguauggaagaaauacacucuagccaagugcaguuuagcuuggagccacagcagaaagaaaaggcgacuuuacugagcuaccaggcagaaauggagggcaauauaguggcuggagaauagacacugugaaaauuaccuuagauguugcagaaaccucucaauguaguaaaaauugcuguuuaucaacauuuuucccaguucuuaguguggugcccuuagccaucccuaagcagaccgugagaaugagaugugcaaaucauuuacuccuaaguaucuguugagcucccacaaugucccagacacacuguauuaagcaccagggaugcaggagugaaggauuagaccccauuccuguucccaugaaaagcucacucuucuuugaacccagucugaggagaugggugcugggaaaaaucaagaagggaaaaauagcugcuuuaaggcaauucucaugccaugccuuggucugauugcagcuaggagugcgcugagacagugggaaugccaguaggcagaguaucucuucacgagagucuuaacgcuuuucaaaacagaagaaaguuucuccuggcggcuuguuuguacuuagcaacgaagcaugccgggguaaacccagcccuggccaaccagauacucaccaggggugaugaagucauggcaucuaaagucaaggcgggcacagcuccugcucugucccaccacuugucuuguaauuauacaggaaggcccaguuuuuuugacucgaguucacauguuuguauccucacaacaggccaauguuggcaucuuuggaccuuucuaaacaucaacauuucuguuuuccuuuaggaaucgucuacgaagccugauaaaaagguuucugucccaucaggacagauugguggccccauugcuuugcccucagaucaccaaacaggaggccugaguauuggggccucgagcagggagcucccaucccaggcaucgggcggccuugcuaacccuccuccugucaaccuggaggacucauuggaugaagacuugauccgcaauccagccuccucgguggaagccguguccaaggaauuggcugcauugaauagcagagcagcugggaacucugaauucacacugccugcacccucaaaagcaccugcagaaaaaguuggaggcguuuuauguacagaagaaaaaaggaacuuugcgaagccuaguccuucugcuccaccaccagcuagcucucugcagucaccccucaauuuucuggcagaacaggcucuggcacuggggcaguccucucaggagaaaaaaccagagaguucuggcuacaaagagcuguccugccaggcuccccucaauaagggccugccagaaguacaucaguccaaagcuaagcaccacagcuugccacggacgucucacgggccccaaguggcaguuccugugccuggcccccaggucaaagucuuucaugccggcacucagcagcagaaaaacuucacgcccccaucuccauuugccaauaagcuccaaggcccaaaggcuucucccacacagugucaucguucccuccugcaguuagugaagacagcggccaaaggccagggcuuccaucccucugcaccagccaccucaggaggccugucagccuccagcagcagcucucacaagaccccagccucguccucuucugcccugagccauccagcaaagccacauucagucagcucugcaggcucaucuuacaagaauaaucccuuugccagcucaaucuccaaacaugggguuucuucuggcagcucuuccucgggaggaacaccaguccagaguucuguuucugggagccuggucccuggcauacagccucccuccgugggacaggccaccagccgacccgucccaaguucagcagggaaaaaaaugccuguuucccagaaguugacucugguagccccuccaggcgguccaaacggagauuccaguggugggacccagggaguggcaaaguugcugaccucgccgucccuaaagcccucugcaguuaguagugugacaucgucuaccuccuugucagugaguaucugucauagcagccugcccugccccacucacaggggccuuggggaugagguugcuugccuugccccggguggagagugagaucuaaaaccacaggucagguaggaacagugggcucagacguaggaagggagacugggcucccuguucucagguauucacuuuucuggugacaggaagcccaggauggccuaaagcuucuucugaggagggcagagggaccuaaaggauggccagcaccaagcaccaugccucuucggaggcugucuguguggcacagaaugagcaacagcccuugccuuccgugaccccuugccucuccaucucucuaaagggggcuggaaaugcugucuucuaucaguugagucauguggagguguucauggaccaggaauagcaggaccuucuaagagugauucuguugguuuuugaaggacagaguccaauaauuaaugcaucucgcuuguguguaaucacagcagguucgggaagagggagugagcauuuucuuuucuuuuuuucuuuuuuuuuuuuuugagacgaagucuugcucuuucaccaaggcuggagugcaguggcgcuaucucggcucagcgcaagcuccaccucccggguucacgccauucuccugccucagcuucuugaguagcugggacuacaggcguccgccaccacgcccagcuaauuuuuuguguuuuuaguagagauggaguuucaccauguuagccaggauagucucgaucuccugaccucgugaucugcccgccucggccucccaaagugcugggauugcaggugugagccacugcacccggccucuuuuucuaauauauaaaugaagugguugcaaagacaaaaccauagaaaggucuguuggaggucucaccuccuuuccugcacccaccaccucuguaagguaacuaagcucuuuaguuucugguuuauuuuccucuuuuuaaacaaaagauuaauaaauauaaauaaagguauauauguauguguguguauguauguauauaaauauauauacacauauaaauauccaugaacauuuauggauaucuauauuacauuuuucccuucacaaaggaggcuuuuuuuuuuugagacagagucuggcucugucaccuaggcuggacugcaguagcgcgaucacagcucacugcaaccucuguaggagacauauuuaauauccugcuuuuaaaaaaauuauguucccuggaauccauuccauguugguucauaaagacuguccuggauccugucuuuggggcugcagggucggagggugccucccagggccaucugacauggauguguauguccuccuuuguggacacacaaggaggauccuuuguguugccagguuuggugugagugagccacgaacaggacuggaguucuuaccgcuugcuguguuucuucccuagaaaggagcgagugggacugugcugcuggccggcuccucuuugauggcuucacccuacaaauccagcagcccaaagcugucuggggccaugagcucgaacuccuugggaauuauaaccccugucccuauuccuguccaugugcucuccuucagcgcugacuccucugccaaagcaggggucuccaaggaugccaucgucacaggcccugcccccggguccuuccaccauggccuuggccacaguaagugcuucuuugcugccucuggucacucaggaaccucuagauuguggccagggguccugcuguuguguacucugguuccuguguuugagucuggugugugacuguggggaacaucuccgggaacugugccaagcccccacugccccuuuggguguggugcccagacuggccuggcagguuaucgggggcuuuuggcugcuggagcugcuuuccuguuccugucuucaauguguguguuuuguucuuuucuccccuccuguuuucucucaggucuucuggcuggcuugcacuccagcccgccccaugcagcgccucucccacacgcugcggugcccacccauaucccgcagagucugccagguaaucacccgacggucagugugccacgcgcaccgugugccuuugcccucuccaccccuaggugcuuugccgcugccaagggucuuggugucuuugccuugacgcuguuguuguuuugguuuguccuuugaggcugugcuuugucaguacucagggugacacgcacuucuacucuugggguuuccucugguccccacuuggagcugccgccaggucagccucagccugugugaucacagggaaaguugcggggggcaggguggugcgcuuuugugugcgguggaggaguuccuaacccucggcuuguuuuuuucucuucaguuuaaaaaaaaaaaaaaagggaagguaauggugcaucuucuccaagggcuaauuggguacaacaaggucuuggaaugcaagcugcuccacugucagaugugauugcuuaacagaaggcucucuaaacuuuguuuccauuaaagggaaaauccagguagcagccagaggccacagugcaagacuuugagaggagcagcuuuaaaucuguccaagugugaaaacuccaucagaacagauuugugggagcacagcaggcauguggucggugcuccccuuagcaucuucugaaauagggaacuucuaaaagccucaggcuugaggcugcucugguagcaccugagaacugggcucaggugccccggguugguaccuuugcauugagugcgucugccucacccuaucccgagucugcgauucuuggguacgccuccuggaauucuggcaugggaagucucauggugucucagcuuugaccuagcauuguuccuacuguagacccgcuucagacaugaccagggugcuacuuggauaaggggagagccgcucguauggaagccagccgagguaacccuggcgaacuggugccagguggaaguaaggacccucugugcugcacgucucccaaguuacaucugccucaugaugugcuguggcucccuggcaccauggcgcauuauaguaaacaccagaggccauauggggcaagacuaaaucuguaaaucuccacaauggaaacugugcuucuuugaggggcuaagccuauagcacuagugacuccuccuuuccuugggaggagaaguaaagugcagugacuucucuacagacuagaggcugcagagccaccuuggugagagcaggggucuuuccaaagucaggcugcccugccuuugcuuacucucaggaauguuacucucagaaaagcaaaguaauugaggccggacgcgguggcuaucaccuguaaucccagcacuuugggaggccaaggcaggaggauugccugaguccaggaguucaagaccagccugggcaacauggcaagacccuaucucuacauuuaaagaaaaaaauuagucaggugugguggcaugugccuguagucccagcucuuuaggaagcugaggcagaaggaucacuugagccgaggaggucgaggcugcagcgagccguggucaugcuacugcacuccagccugggcaagagugagacccugucucaaaagauugcuuucugcuauauuuucauuuuuccucuggguaugaaaaggcuaucagaauaggaagaauaagugcuaguguucuauaccacuguagggugacuguaguuaacaguaguauguaguuucaguuaggaggaggauauugaacgucgccagcaaaaggagaugaaaaacguuugagaugauggauaugcuaauaacucuaacgugacacuacacauuuuagauguugaaacaucacuauguaccccauaaaauaugugucauuauuaugagucaguuuuuaaaacuguuuaaggcucucagaggcuggaugugguggcauugagaggcaggaggauugcuugaacccaggaaucagaggguauagugugcugugaucaugcuugugaauagcugcuguacuccagccugggcaacauagugagaccucaucucuaaaaaaauuuuuuuuaaucaguuuaaaaguucgaggaaaaagaaaaucaaucagaaaagcaacuauaccaaaacaggguuauccaagugagcuucucucacuuccuuagauggacuucagcuuauaggaugacacgagaugcgaguaagaagcuauuugcgcauuucagcugcgugacuugugucugcguugcuuuccuuucuuucuucuguggacugagaaugcuagugccuuugaauuugucuuuacaggaccugagggucuuuugaugguaagagaaugaaugaucauugcugccuugaguucugugugaucgucaggccucgccucaggauggcaauuguagccugagaugacguagcccaaguugcacagcagaguugcuguucuggaaacacugugcugagugaccaccgaccuucacagugcuagugugcuugcaggcuguggccaggaguaguguacacgaauaacugcuggcuggugucucauggcuuguuugagcucuagaacacucagcauuuggggacuuuugcuauuuaggugucucccuugaaguuugguuacuacugccuuaaggaaaucagagagcaugaaaaacuugcguucuaauuuuucuuacucuuuuccaggugcuucucagcuucacgggaaagggccugcuguaccacggaaauugugaccgcuucagaggcaaggcuugccacuugggucuggguggaaucagaacgugcaggucucccaggauguacacucacugcgcccuuucugcugcuugguguucuucuggaggagcgugaguucucagcggagcgcuucucggcacuucugaugugccucccauggagggagccgggcccuugcugcucaggaggugcagacugccccgugcucugggccuugcagcucugucgcuagacgguuguuagaggggcagcucuaggcuggggcuugcgcugggccguggugggaggcacaguguuuacaggcucugguggcagagcaguuggcacaccugugggugaaucugccugauccccuggcauuuggucagaguaccucagagcaccccacugcucaggggcuccuucuggcugcaguaagcucccuggauggucacagugccgccccauccccaggcugugugcucaaagcggacaaaacucaggccagagccacagcugggagaccugcacugucccugcgaaauacuaagaacaccuagggugugcucacugugggggccaguuucuccucggaacaugacaaugaagcucuuuuagagaaaagaccuuuguagauucaacaauuaugauaggauuuuuacagacaccuauuuugggcucaguuuucaucauuaccauuaaaugcauuggauagaaggggacuguucuucacacaucauauuauaggaagacauaauuccagugccuuuaugguggagcagaauucgacaacacauguccauucagcccucugaauggaucugagacgaagaccuuuuuaaagauaugucuguauugaagagaaagccaguuuugaguuuuuuacacuugcacaucauuaucugugccguccugacuagaagguugucugggcccccaaauuccaagucccaguauagccagggcucccauuuuguuuuuccagaguucguggagguggacugcagagcccagagcccuucaucucucugagggucaaggauaccaggggucccaagucacagauagacauuccaguuuguauucuuaggaaucauucuuaggcagugcggcagaagcaggccucugugaagugucugccggguagaaauaggccuugaaguccuggggcucuccaggcagugggguuaugugucgacugaagggugaugugcagaagagcuuggagaguggaucagagagacuaggacaguuacugcagagcuccuaagucaccacucaaccaguggcuguuucacaaggauuugagggcacuugccugucuugugaggucugugccacaaggugagucugaacugacugcuccagcuaagugaucaggcacguugagaguauacgguguccucagcacauacaccugugggaaaacggaccgcucuuggcuccugacucccaggguacagcgcccaguaacucauccuucauucagagguuugcuggccuucccgguuucccaaggagcaagaccucuguccgcccuuuggcccggccucugcucugucuccuuuuuuuacauaagaaccaauccguguuucacauugggcuaaguggauuccuuaucccuuuguuauauauauuuuuugcaacuuggauuuccaguuuguuuacagaguagucuuagguaguagcaaaagagccaaagaagagauuuguauugcugagcucaaagccaagcagaggccggcaguggaggcugagcagggacucuccaggcuucucugcccauaaacacccgggucccaggcccuccuuccuuucccuuuggugcucccuccuccccacguaccauugcgcgugcagcuggagcagaauacccucauuuuuaggaaucuagugaugccucuugccucagggaaacguuucuuugauggggaguuugagauuucuuuuccuuguuuaugcuuuauuugugguaaugaaagagcgaaugacugaacagccauggcaaggcagaccuacaggcgaggccgcagcagaggguggggcagagcagccucggggucugggggcugcagggguuucccuggcgcagcgaaagucucugagcacuuaccgggcgugaccguuucuuaggugugagaggggcuguggcuuuugugcagcgacuauguugguguuaggggugguguggagauuguuaaucuuguauaaagcaauucaauaaauuguuucaagguuuccaaaac

SEQ ID NO: 18011 - RNA, 13552 nt, Homo sapiens
cggucacgugacugcugcgggccagccaagauggcggccucaugcuugguccugcuggcgcugugucugcugcugccgcugcugcugcugggaggauggaagcgcuggcgccgggggcgggcggcccggcauguaguagcgguggugcugggcgacgugggccgcagcccccguaugcaguaccacgcgcugucguuggccaugcacggcuucucggugacccuccugggguucugcagugaguggccaagggucugggagggacgaugcucucucagccguugauccucgguucuaaccgccccggggagucgaggcggaagugcuccuuuagucgccgccuuugggcagcucuccgagauuagacgagcgguucugccccagccuuuccugggugggucucuagguauagccggcguuaaucuugccacgugucagaaguguguuaagugaauccauugcguggucucacguaauucuccuaguaaguggaacccaggugcguggaacuccagggcuagugcugguagcuacgucccugugcagcuacccuugucaggcuaugucugagcugacaggauauuucauuccucaucccucaacgcagagcucugcagacagauguuuucauuuguucuucauguccagcuuuuccccacagugugcagggcagcggugucugcucccucauuauucuccacguugguaucuugagaggguagcucaaccccaucucaggaagaagugggaacagcacuaguugccuuuaaucccuguuuagaaucugcuauccuagggugaugggguagagugggacuuccuagggauggcucuguggugggaaaauuccacuauccagacaaucuagauuaguuuaauugagcaccuacuguuugccaggcaucauguuaagugaagguagguaagauucaggcccuaucucugugugccuccuagagcaaucugaacaagaauuggccgcauucucuguucuggcuagugaggagcagagagagguuuugaaauaucuuacuuuccaaaacacuguccgugauucagccugaguugggagauuaucugacuuuagauugcugcuucugguacauuaaagggaucauucucauuuuucagacuccaaaccccaugaugagcucuugcagaacaacagaauucagauugugggguugacagaacuucagagucuugcagguaggaugccgucaacuccagaauccucugaauccaugggcugggggcaggggguguucguuugaaaagccgugcagauugccagacgcuccuuugguagucacagguguuuucugacuugcaguugggccccgaguuuuccaguacggagucaaaguuguacuucaggcuauguacuugcuguggaaguugauguggagggagccaggugccuauaucuuucuccagguguguaucagccucugccucccucugugagagccauguuagcaguuuacuuuccagcacaaauugguacuauauugcauauucauauguguguguguuguguguaugggcguuuaaagacaugaguaggagccuaugguaugugucuauuuauggcaccuauccaugcucucugugucauuacagauagucuuacauuguacugacuguguaucaaguguuuuccauguauuaacucauuuaguccucacaguuacccuaagaaauauugcauguagguaauacaagaaccuguuucuuaagguuguucucauuuagaugagaaaaccuagacugagaaaggcucuguaaguagcccaucgccauacagcuaggaagugguggaaucaggauuugaacguaggucgucagugugguucuauaguauacacacgcacgcauacgcgcgcacacacaaacacacauauauuuuuuugagacagaguuucgcucuugccgcccaggcuggagugcaguggcgugaucucggcucacugcaaccucugccugccggguucaagugauucuccugccucagccuccugaguagcugggauuacaggugcccgccaccacgcccagcuaauuuuuguauuuuuaguagaaaugggguuacgccauguuggccaggcuguucucgaacuccugaccucagguaauccgccccccucggcgucccaaagugcugggauuacaggcgugcgccaccgcgccuggccuaucguuauacuuuuaaucccuucccuugaucacuuuuucuuuaaaaaauuuuucuuucuuuucuagcugaaggaagaauacuuuuuuuuuuaaaucaauuuuuaauauauagaagcaccuuccucuuuuauuuauuuauuuuuauuuuuccugagauggagucucuguugcucaggcuggagugcaguggugcgaucuuggcucacugcaccuucuaccucccguguucaagugauuuuccugccucagccuccugaguagcugggauuacaggcaugugccaccaugccuggcuaauuuuuguaauuuuuuuuaguagagaugggguuucgcuaugcuggccaggauggucuugaacuccugaccucaggugauccaccugccucggccucccagauugcugggauuacaggcaugaaccaucgugacccacaccuuccucuuuuaauaggcagccuugaauuccaauaugugauguacuauacugcauguauuuagucucauguuaauggauacucagauucuuccugauuuuguuuuuacuuuuacaaauaguguggcuccaagcacagcgagcauaugccuuuuguauaaguccaguuucuuucuuaggguaacuucccagcaguggaauuguguagucaaaguugaugcauuuuaaaaauguguauguuacuggauagcuuuagaguaagguugggucaguuuggcccccgcugaguggggguaccucuucucccccaugcuuaccaucaccagcuguuguuagaccuuuuuagaauuugcauuccaacaggugaaaaaugccaucucuuuguucuguuuuuugccuccuugauuauugaugaucuuggacuuuucagguugguucuguuuguuuguuugguuuuuguuuguuuguuuuagaggcagagucuagcucugucgcccaggcuggagugcaguggcacaaucauagcuuaacugcagccucauccuccugggcucaagugauccuaccuccucagccuccugaguagcuggggcugcaggugugucccaccacaccuggcuaauuuuuaaauuuuuuguagagaugaggucucacuguguuuccuaggccggccuugaacuccugggcucaaaugauccuccugccuuggccucccaaaguguugggauuacaggcaucagccaccgcaccuggcccauucuguuucuuuuaugacuuuuuacaucuauuuuggugguggagagggucuuucuucugcuuauuaucaagagcucuguaaagauaacagacucaucaccauguguguugugacuauuuuuacuggguuuauugccuagcauggucuggguuuccuccccuucaagucucuaucuuuccuagaaccccccaggucugccuagcauugcugucugcugguucgugggcugccuuuguggaagcaagcucgucauugacuggcacaacuauggcuacuccaucaugggucuggugcauggccccaaccauccccucguucugcuggccaaguggugagagucuaggaagaggguaaaauaccguccccuaaaccacucaaggaugagugagaagaagggccauagugggccuccggaagucgguuccuugugggcucugcaggagguggggugaggcuggugaaucaggccgaaugcugguuccaaaugauagaaacaggccucagcaaaggaccacauuuuuuggcccaugaaauggaagugucuguggaaaugguugguuucgagcucagcagugucacugggacccagcucacgucugucuccacacucccuucugguggugguucccggaacucuccuagcucuuguccucacguaggcucauuggggagggcagcccuuucugauuggcucauguagguuaccugccuuccucugaucugccuguugaggccagggggcaagugcuccagcagaagagcugggucucaggagcauccauaucucauggacagagggugggugagggcagauccccaaauuaaaacccagggcugcuguugguagcuggagaagugggccacaguugcugcagcugaugugacagggagggaagaagggccagugguagcagugggacguggagcugggaaggucaucugcuguccucugagcccaacuauaacaucucuguuauacucugcacggccagccuucaggugcacauccagccuccgugugcauguccagcugcugcguguacuuccggccuugggccauuggcuggcuguggccuucgcccugauaguuuguucacuggcaguggugacagcagcagcaaacagcuuaguugagcaaauggagcagaauggucaauggugagcaccugcugcaugccaguccuccauccaagcccuuuuuguauuuuacccuguucaaucucuaugcaccucaggaggguguaccuuuuacaagucaggaaacugaggcugagaacgauuaugccucuugccacacagcuaagugugaggaccaaaauaucccaggcaagcccauuuccgagcuuucucugcaucuugagaggaacaggcgaugauacccuggcggugauaaauaacccagaaucgcgcaugccguguuccggcucuacccugcgaucagggcucagucuccguuaggagagaauguguacaaugcucacugaaucccuuugccccacguugagagcaagccgugaccuuacagccuuugcagugguagcacaggguggcugagaucgcuagugaggccuucauuguauuucuuccuuuuuuuuuuuuuuuuuuuuuugagacagucucacucuaugucccagacuggagugcaauggcgccaucucggcucacugcagccuccgccuucuggguucaagcaauucuccugccucagccuccugaguagcugggauuauaggcacccaccaccacgccuggcuaauuuuuguguuuuuaguagagacaggguuucaccacguuggccaggcuggucucgaacuccugaccucaaacgauccaccucccaaagugcugggauuacaggcaugagccaccgcgccuggccuguauuucuuccuuuuacagcaagagagaggauguucacuuuggcagugauacacaguguccuucuauuuauuuuuuuaaauuuguauuuauuuauuuauuuauuugagacggagucuugcuuuguugcccaggcuggagugcaguuuccuuuuaaagugauuguauuuaagccaacaagugacacaacauaaaggaggguauauacagcauaaagaaagaacacuggcacagcuggggcucagggagcucaaacucucccagcucugcggccuuuucucuguugagggaugucgagucacgcuguggugguagcggaggccugucuagggcucugcugacugcugaucucucuuuucagguacgagaaguucuuugggcgccugucccaccugaaccuguguguuaccaaugcuaugcgagaagaccuggcggauaacuggcacaucagguaccauggccugggaugacggcggccugggagaggcgcggggccccugauuggcugcagugagagcugccuugccugcugccguccugcugaggggcaauuugaaauacugagggccugggagguggucuuugguuuggggaagcugggggaggagggggcagaguuucuuucuuagccagccaggggguccaggcaguuuugguccuaggacgucucucugugcauucccaaguaauugcaaggcuucuucuugucaucaucugagacuuggauuccccaagcguccuucuuuuccuggagccucugaguccucuguuccugaggccuuucuucagcccucccaauagccccgucaugauuucauugcagggcugugaccgucuacgacaagcccgcaucuuucuuuaaagagacaccucuggaccugcagcaccggcucuucaugaagcugggcagcaugcacucuccguucagggcccgguaggccucccauccucagcugccuucucuccugcucgccacugcccuggccucuccccuucucacugcagaccugggaacccacucauccagggguuggcaaacuaaggcuacaggccagucugcugcuuuuguaaaucaaguuucacugggacacaacacacucauugccuucugaguugucuacagccgccuuugagcugcaauagcagaaucgcguuuugcaacagagaaccuguggcccgcaaagccugaaguauuuacucucuggcccuuuaagaaauguuuguggaccccugcgcugucuuacucuccugccaguggcuucccaggccuguggcaggaucuguggaccuguguguccccuggggugucucauggggcuaaggaggggaccuuugugcaggucuacgcacccugaggugugcccuggguaagcugggguggugugggagggcgucccugcacccucaucuugaguccaggggaugauaagacaguaagucccguggagaaaaggaaugagucagucuuguuugcuguuguaaccuuagcacccagcaacaauauuagagaaagcaagcccaggccucagauggcagggguggccuggugcugcugauguggcugggcaccccaaccucugggagccugcaggccucgccacggcaggagaugccucuccugggucccgggccugcucuauggccucucacaggcuuuuuuucugcuccuucagcucagaaccugaggacccagucacggagcggucggccuucacggagcgggaugcugggagcgggcuggugacgcgucuccgugagcggccagcccugcuggucagcagcacgagcuggacaggucugcaggaccccuggggcacuugggguuggugugacgggcaccuggccaaccuguguucuccucaccccugccaguccugcaugcucccacccugccacggucucaaugagaacgggagggccugugagcuggaagaggggugucuagaaacaggccccugacauucaauucucuucucauagaggacgaagacuucuccauccugcuggcagcuuuagaaaguagguguguggcugcggugaggagcucugggcuugucgggggccacugagcuguaagcugcuugccuggccugcagcauguuccugucccaggccacuggguggggcagccuggggacagcgggggugguggaagugggccgcccugaauccccaguugggucauugagugaccaggcccucaggcugaaaugcccccuccaggagaguaucucacacaggcugguggccuccccgccagagcagugcucuuucuccaccugaccaggugacucuggcuauuguuuauuuaaaaauuuuuuucugaaugggcaugguggcucaaaccuguaauccuagaacucugggaggccgaggcaggcagaucaucugaggucaggaguucgagaccaaccuggccaacagggcgaaaccugucucuacuaaaaauacaaaaauuagcuagguaugguggugggcgccugucaucccagcuacuugggaggcugaugcacgagaauuacuugaacccaggaggcagagguugcagugagcugagaucgcgccauugcauuccagccugggugacagagugagagucugucagaaaaaaaaaaaaauucuaucagaaauuccauguagaauuguuucuuuuucuaaacacagaguuugaacaacugacucuugauggacacaaccuuccuucucucgucugugugauaacagguacugccugggacccugggugucuguuugguugggggauggcggagggggaggggcacgcagccuuuacccugugcuucccaugaucuugucuccuuaauccucacugcagcucugccauagggucuuauacugcuugacaugggggaaacugaggcucagaggcagggcagggagcccagauuugaaucuguagauaccaagcuuucuacuuuuucaguaguuuccaagcaucuuuuuuuuguuguuguuacgucauuggugucuuuuuuuuuuuuuuuugagacagagucucugucgcccaggcuggagugcaguggugcgaucucggcucacugcaaccuccgccucccacauucaagcaauucucaugccccagccucccgaguggcugggacuacaggugcccaccacaacugccuaauuuuuguauuuuuaguagagacaggguuucaccauguuggccaggcuggucuugaacuccugaccucaggugauccacccgccuuggccucccaauaugcuggaauuacaggcacaaaucacugugcccggccaugucauuggugccuuaaccaagccucuuaauuuuucaaacggaagagccccugucccacaguuacugcugcugagcccuuucaaggugacucagugaggagggagaaaagcggaagcggugugggaagaggccgggucugggccagcugcugguccugcucuccucccuccucuggccucuaggcucccaggagugguuuggaacccgcgccauaugcucugggggcugugccagggcaggaggaguccucguguccccugugcacaacacagacaaaaggcuggguccacccagugggcggucgggugccaggccagugcuuaccccgccauguuugcagcccgaggccagcuggcugcaggugaaaggcuaugcgucaggggucagggugcacacaccccugcaggucucagggcuccuggguugcuucuggaagggcccggauggggccugacuggagcugcugagggguggagcuucugggaaagggaucccuccuaggggggagugucuugggccuggggccacguggcagggacagagauggguccauggcagugucugcucuucucugugaaggcaaagggccucugagggaguauuauagccgccucauccaccagaagcacuuccagcacauccaggucugcacccccuggcuggaggccgaggacuacccccugcuucuaggugagaggccagcaggaggcucagggaggaggcggggggaacagggugggcgggauguacuuuuucugaaaagguggcucuggaggccacugggggacgggaccugggcucuggcugaacucccaggaggaggcuacuuccuggugugccagccccucccugccagguggccccaggggccguuuaccaagggguuugaggaggccacguccuuucagccugccacgcccuccauucaguccucuuccuuccugcaggagggcugggccugggguuggggccacuguugcccaggugugggagggcaguggcuuugggagguacggggacgaugugucaaacagcgucgccucucccagugagaugguucuccuuugccuccgucucuuuccccguugauuucuccaaguggggagucgugccuugguccugaugcgucucuagagcugcaucuuccagcuucgagugagcagagcaguuggaggcugaaggccuuuuccuggcaggacucuccaccuagucuuuguuuuagacagucucgcuccguugccuaggcuggagugcaugaucucaguucaugcaaccucugccuccuggguucaagcgauuuucccaccucagccucccgaguagauuacgggauuacaggagcccaccacaacaccuggcuuauuuuuguauuuuuaguagagacaggguuucaccauguuggccaggcuggucuugaacuccugaccucaagugauccuccugccuuggccuuccuaagugcuuggauuccaggugugacccaucacgccuggccccagcuagucuuuagaaauguuaagcuauuuggcuuuauuuucacagugacagcugguuuguggugggugugcugugguuuauuauuauuaucauuuugagauggaguuucgcucuuguagaccaggcuggagugcaauggugugaucuuggcucacgcaaccuccgccuucccggguucaagcgauucuccugccucagccucccgaguagcugugacuacaggcgccugccacgaugcuuggcuaauuuuguauuuuuuuuaguagagaugggguuucaccaugugggccaggcuggucuugaacuccugaccucaggugaucugcccgccuuggccucccaaaaugcugggauuacaggcaggaggugaaccugggagguggagguugcagugagcugagauugugccacugcacuccagccugggugacagaaugagacucugucucaaaacaaaacaacacaacaacaaaaaaaccaaauugugguuacguauaaaaagugucaacuuacauuuucagaugucccagccaggcuguguggcugcuuggccagcuuaagccacuuguguuuggggcuguugggggccuuaucugauuuucacucuccuugggggaugcugccucacugugcugggaggauuuguguucccagggcagagaccagugcucugacccaccccucuugccuagcagggucggcggaccugggugucugucugcacacguccuccaguggccuggaccugcccaugaaggugguggacauguucgggugcuguuugccugugugugcugugaacuucaagugguaggagcagaacccaaauccuucuggggauagcuuugcagauccaccgcugagggggaagcagugcagagggagcugcccacagugaggcccugccccucggucaguccggcacacacuggaggccaugaggaggagcccugcgguuacuguggcugggcugagccucacugaaguaguugcuuccauuuagagcucauguuauauuuagguugguacaaaaguaaucaugguuuuugccauuaaaaauggcaacuacuuuugcaccaacccaauaugaaaacaaaaagcaccuuaaauaccagaacuccacucggggcuuuugcuccuaggguagaauuggugggaauugccugcaggcuuacaugguuuucuuuguuuuucucucccaccaugucccuuuuggccaagcucacauggucgguuugaaucaguuaaaugagugucaugcuguggccucacugcacccagcguagacggguguuuggaagggcaguguuagaggagauucuagaagcaguagccccagcacaaguugagcccuuggccccugcucaggagccggccccuggaugggauuuagggaugugagccccucgugugagcugagcucagggaaugucgggaucaaaccuggugcccuagaaaagucaucuuuuaugugcugagccaguccccagggcguugccuuuacuuguuccauggccauggaauuaagaaaaacaugcaaaaauaauucuucaguccuugaagagcauccagcacagaagguacaaaccccccuuaaggcucccuccucaaauggguguggccauuuugaugugcacccccccaggccuuuauacccuucagaugccaaaucuaagaaccagcucccggaaaccacacccccuguuccaacccccagccuggcuugagcauggggugugugggggagcccaggugggcaccccaggggucuggugucuucuacaggcagcucucaggcucccuugguucucucugcaguuuacaugagcuggugaaacaugaagaaaauggccuggucuuugaggacucagaggaacuggcagcucagcugcagguagccacgucugccaccacgccaggguggggaggguucuggagacuggcaccgagccaggcucccugaucccugcuucccacagccagggugggaccauguggggucuggcggaaaagcuagggagggagcagaggucacagaggcuggcccacucugcugucccguuucgguacaguaggcucgggaaaguuaagacacacccccaccugcccucuggauuuauggagcugacacuccacaaaugaugcuggagcugggugggccgggcugcgguugaggaagugaucaggaucacguaggugggcgggcaaagggagcuucugggaccagccuugaaagauggguggaauucugcaaagguuacuuguuucuuauugcaaaaaguaauacaucauucuugccaacagaaugauuggcaggauuuucaguaaagguccaggucggaagucguuuagacuggguuccccagucucugucagaaccaugguacucuguuggggugugaaaguagccacagaucaucuguagauuaagggguguggcuuuguuccaauaaaacuuuauuuacaaacacaggcugugggcuggauuuggccugcaggcuguaguuugugauccuugauucagacaguuuagcaaggcugcaaagaacaccgacacccccuuguuacccacagaugggugagacugcguuggccagaggccgagaggagggugcucacaggggaaugggcagcacguagaggccgggaggugcuccagggcaccaagugugggaaagugggacaugcggggaaguuuccagaaacugugaugucaaguuggaggcggagugcugcuggggugugaagggucucgaguccaagugagggaguuagggacuugggagggguuguuguugggucggggaccuggggucagccagguggugaccugggaugggguggggacaggcaaugagguaagcucugcucuuuauuuuuuugcagaugcuuuucucaaacuuuccugauccugcgggcaagcuaaaccaguuccggaagaaccugcgggagucgcagcagcuccgaugggaugagagcugggugcagacugugcucccuuugguuauggacacauaacuccugggccagaggcuaaaaccccaggaccccugcuguccuucccgcagcuucuucuuggagucucagggcaaacccuuucgagcagcaccucccaguggccagaagcugaaaugacagcagugguacugccugguaaaagaauugguucugugacccgggaagcuuugguuggccuugauuucuucucuggaggcuuggaaacgcuuccucucuucuucuguucuucacgccccaugccccugcuagcguauuacuguucugugacuucccugugaccucugcagaacuccucauccugcguuuggucuccagguguccccuuucugccguguuccuaacauuuugauuccugucuugaaaaaagcaccugcugcaccguaagcccagggauguggcagcugcagugggcuuggcuuugugaggaacugaguguguccacguugggggaacaucauacuugauacacacguuuuuauuugcacaaaga

SEQ ID NO: 18012 - RNA, 13511 nt, Homo sapiens
aucuguagauuaagggguguggcuuuguuccaauaaaacuuuauuuacaaacacaggcugugggcuggauuuggccugcaggcuguaguuugugauccuugauucagacaguuuagcaaggcugcaaagaacaccgacacccccuuguuacccacagaugggugagacugcguuggccagaggccgagaggagggugcucacaggggaaugggcagcacguagaggccgggaggugcuccagggcaccaagugugggaaagugggacaugcggggaaguuuccagaaacugugaugucaaguuggaggcggagugcugcuggggugugaagggucucgaguccaagugagggaguuagggacuugggagggguuguuguugggucggggaccuggggucagccagguggugaccugggaugggguggggacaggcaaugagguaagcucugcucuuuauuuuuuugcagaugcuuuucucaaacuuuccugauccugcgggcaagcuaaaccaguuccggaagaaccugcgggagucgcagcagcuccgaugggaugagagcugggugcagacugugcucccuuugguuauggacacauaacuccugggccagaggcuaaaaccccaggaccccugcuguccuucccgcagcuucuucuuggagucucagggcaaacccuuucgagcagcaccucccaguggccagaagcugaaaugacagcagugguacugccugguaaaagaauugguucugugacccgggaagcuuugguuggccuugauuucuucucuggaggcuuggaaacgcuuccucucuucuucuguucuucacgccccaugccccugcuagcguauuacuguucugugacuucccugugaccucugcagaacuccucauccugcguuuggucuccagguguccccuuucugccguguuccuaacauuuugauuccugucuugaaaaaagcaccugcugcaccguaagcccagggauguggcagcugcagugggcuuggcuuugugaggaacugaguguguccacguugggggaacaucauacuugauacacacguuuuuauuugcacaaagaaaaugcuauuuuuggagccagaauuuucaugucugauuuauggugauuuucuuaagaaccagaacugcuggcagaaagggggcacccacacgcuuagauagccgaugucuuauuagagggcaguuugugguuccugauuuggaaauuaacauucuccaaacauuccaguccaaugaaaguuuuauccgcuuucccauauaaaaauucuucccaugagagugacuugauucucacaaucccguuggagucgugugugaguccuacagggugagauucagcauugccaucuccaagugcucuucguagggaaacaguuucugcucaugacgagguuccacuucccaucugaucccggcccggccuggaaacagagcacauguguuugaggauggcgguguuuggggacaggacaugaggguauuguguggggcugcuaggacaggccuggcgggguagggggguguccaagucaguuuacuugguucacagguucccaggcccacccaggugccuagaauuggccuccaggaugggaccagaaagcugguuuugcauagaaauggcuagcagcaggcaccgugccgcuguccacucucugccugugucugccccagcacuuggcacagcgggacagaagcagagaucugaauagucaacccacucuucacaaagcuuagaaagcggccgggcacaguggcucaugccuguaaucccaacacuuugggaggccaaggcgggcggaucacuugaggucaggaguucgagaccagccuggccaacauggugaaaucccaucucuacaaaaauacagaaauuagccaggcaugauggcgagugccuguaaucccagcuacuugggaggcugaggugggagaauugcuugaacccaggagguggagguugcagugagcugagauugugccacugcacuccagccugagugacagggugagacuaagucucaaaaaaaaaaaaaaaaaaccacacgcaccacacacacacccacacacacacacagcuuagaaggggcugcuguucucauaagcacagaugucugaagagccguuagccagaaugauucuuuuuuuuuguuuugagauaugaucuuguucugucacccaggcuggagugcaguggcacagucauugcucacuacagccucgacuccugggcucuagcaauccucccacuuccugaguagcugggaugacaggugcgugccaccaugccaguaauuuuuuuauuuuguagagaugggguccugaacgcauggccucaagugaugcuccugccucagccucuuuuauuauuuguuuuuagacgaaguuuuacucuguuccccaggcuggagugcaguggcacaaucucagcucacugcaacgccucccagguucaagugauucuccugccucagucucccgaguagcuuugacuauaggcgugcaccaccacgccuggcuaauuuuuguguuuuuaguagagaugggguuucaccaugugggccaggcuggucuugaacucgaccucccgugaucugcucaccucagccucccaaagccucagccucuuacaguguugggauuacaggcgugagacacugugacccgggacgauuuucaaucacaguuuuuuguuacgaguggaaaaugcguauuuauaagaaugaaguaguacagacaugaauguguagaaaucucuauaauccugccauccaaggauggcaccuguuaauguguauaucagggauguccaaucuuuuggccucccugugccacacuggaagaagaagaaucgccuugggccacgcauaaaauacacuaacacuagcaauaccugaugagcuaaaagaaaaaaaaucacaaaaaaaccucguacuguuugaagaaaguuuacagauuugcguugggccgcaaguuggacaagacugcuauauguauauucuagguuuuccccuauagguauacuuaugugaaaaugauuauugugauaaauuuuguuuugagaugaagucucgcuauguugcucaagguggccacaaacuccugggcuuaagccauccucccgcgucagccuccugaggaguugggaauauagguacucauaaccaugugugggugauuauuauuaguuuuuaaacaaaaaugggguugggcgcaguagcucacgcccguauuccuaacacuuugggaggcugaggcggcagaucacuugaggucaggaguucaagaccagccuggccaacauggcgaaaccucaacucuacaaacaauacaaaaaauagccaggugugguagcacgugccuguagucccagcuacucaggaggcugagaugggaggauagcuugaaccugggaggugggagguugcagugggccgagauggcaccacugcacuccagccugggcaauacaaagccagacucugucucaaaaaaaaaaaaaaaaaaaaaggugggugggggcuuauacuaugugugcugcuuggcacuguuuuuuucacuuaaaauauauugcagguuuuuuuucacguaaguaucugaagaaagacuuccuuuuuuuuuuuuuauuuuuuauuucuuugcuuuuuugagacagggucuugcucuguugcccaggcuggagugcaguggugagaucagggcucacugcagccuccaucuccugggcucaagccauccucccaccucagccuccugaguagcugggacuacaggcgugugcaaccacaucuggcuagcuucuguauguuuugugaagauggggucccacuauguggcccagguuggucuugaacaccuggggucaaguaguccucuugccuuagccuccuaaagugcugggaugacaggccugagcccugcgcccggccagccuccugugcgagguuguggggggacucugucguggaacccaguacgucuucgugugcuggcuuguuuguuggcucuguaguuaacgggcugccccacguggacaggcacuggguugucugugucucugugugcaggcagaggcugcugcaugugcaucugugcacauggcugccaggaggggcugugcucagggggagcuggggcaaaggcugguggcacuggggggcuuggguguaguguggaggcgugagagccagguggcuggggugcagucugcgggagcucgggggucucuuggccuccguguguccuagugucuuuguuggugagaugggacagugacagcacacccucacaguugcugggggcugacaaaugucaggucugaggacaguugcuggcccacuauggggccaguuccccuucucuacagucacccugcucgucuuccaccgacugggugcucaggacaguggcgugguggauccgccuguacauccugugcuccagcguccugcaggccacagcuguguccagcccugaccccgacugccccucccgccaccuccauuuuauagaugaggaaaccgaggcccaagggcuuagggaacccugcucugaagcacacaguagggcugcugggcucagacccucccucccugugcugagcugcccuccuccugccgcaagccccccacgccccaagcccacccugcucacuggccucugccugaguuccccccauggugugggaguguggggcaaccuagcuuuuccccggcacccaguucuuucacuuccacuggcguccugcagggacagcucagggaccaugcaggcccgggugggcguggaggcucaccuagcucgguggugaacagcuggcacgucucuggguugcggacgguaaaggccacguagaccucaggagcccgcuggugcucccggcaggcagccagccuccgcaggaccccgaccagcgacaugauggcuucugggcaauacagcacaucuauggugaaagcuucagguuacugaaagggaccaguggacagguccaggucaugcugacgucagcagcagggcgaggccagagaggcagcggucauaugagacuaguagaugccauuugaccauuugggccauuagauggaaaggcaauuacuugggugaaaaaggagaacccuuaguagagaaagcugcaaaagaccgaagcaaaagaaaaaaaucuccagacucacugguguuccuuaaaaaaccagcucugguucuuggccuaucuagagggcuuugaaugacacaaagccugacccugccaugaacuucauguuucaggcaucugcugauuugucugcuggcuugcaggggugggcuugugucccuggccaccgcuggaccuguggguuucagggcugggaccuaggaccacaggcagagcucuguuccaccagagaggggacugagugugcuggcaggggugagggguuuucgguggcccagccaaacaccaccuucucucaagggcccugucuucgucccagaagugguuguuuuccuccuguggucucugaaggacacagggcauggcucugggacagagccaugugguaacgacuggaacgggaguaugccugucuccaaaaagagggcuguggguugaaggucaccuuaagaggcaccccuguccugugaugucacccuggaggcccagaguaacucuucuggaagccccaucauguccaugcccgacagcguccauuguucccuuuucccagagccaagagcuggguagagcugcaaggacaccaccugcacagggugcccggggcugggcauuaccugcugcaaugacaacaucuggcuggaaggcagagagcugauggaccgucgcgacgucccaguccagcugggccacugucacccuggggcugucuaacuuggcagugaugucugccucuaaugagaggccauugagaaggacauucccucggagcugcucaaggacccggcugugacagucgcugaagauguaugcccgggggcggcacaucuugcagauggccaggccugugaggccagcaccacugccaagcucuaggacaguccuggcgggaggaaaggggaccgugucugcgacugcaccaggguaagccugccucggugcccugcccugcgccccgaggucaccuguuagugaagacugccggguucucgauggcccauucugcaagguagagggcggcgucccaugugaccaggccugugguaccguaggagaugauggccgugcucucggagagugugaccgagccucccgagggcugcaccaagagaaggcgagagagucaguccagcgaucagaaggcaaguggcuuagaagacaaguagccccaccacauggcugaauaaaccaugacaggaccaaucgccacucagcaaugagaagcagcuaacuguuggcaugccaacagcuuucacgggccucaagggugucacgcggugugaaagacacucaucucaggccacacaggauuccauucaucgaaccuuccugagacaacggaauucuggcgauggaacacaugucagugguggccaggggacagguguggcuaugaagggguggcugccuugugaugauucaauaugcuguuuuuccuuugugguuuucuguaucuauguuuuaucuuauuuuuuuuugagcucugucacccaggcuggagucaguggcacgaucuuggcucacugcaaccucugccuccuggguucaagcaauucuccugccucagccgcccagguagcugcgaauacaggcgugugccaccauguccggcuacuuuuuguacuuuuuuuugagacagagauuugcucucguugcccaggcuggagugcaauagcaugaucuuggcucacuacaaccuccaccuccuggguugaagagauucuccugccucagccucccuaguagcugggauuacaggugcccacuaccacaccccgcuaauuuuuguauuuuuaguaaagauggaguuucaccauguuggccaggcuggucucaaacuccugaccucaggugauccccccgccucagccucccaaaaugcugggauuacaggcaugagccaccacgcccggccugauuuuuguauuuuuaguagagacaggguuucaccauauuggccagguuggucucgaacuccugaccucagaugcaaccacuucggccucccaaagcgcugggauuacaggcgugagccaccacgcccagcccugucaaguauucuuugaggacugggcaccagguccuugugaagcagguagugugugucaccuauuggauaagugcccaacaacuccacgagacaugcuguuguuguugaagugccugauuuacagacagggaaacugaggcuaaagaagguugacggaccucaugucuaagacuguagaaugggugagucaggauuugaacccacacccacguuuucacuuugucugugcaggaaggguaucugggcugugagggggaggagggugcccuucucauaccagcaaauagcuccgguggcccuggguggacuccuuggccaucagggucuccgccagcgcuucauacagcucguccaaaggcucuguguggacagccucgugcugggggcagacagagugagagcuuguuugcuuucguucuaaucuguaaaaauggccagaugauuuucaccaaguuuggaggggagauuugcgauggaaugguauaauaccggccagcugccauauaaaauauucacuucguugggcuugguggugugugccgaauagucccagcuacucuagaggcugacaugggaggacugcuugagcccaggaguucgaggacagccugggcaacagagaccuugucucuaaaaaaaaaaauucacuugguagggaaaccuggaugggagggccuugaaccagagguguugggaggguaggguuagguguagucuagggcaggagacaaggauuccgugagaguugccaggugaccaugauagagagccguguuuggaucaaacacagagaggaggaaaacaaaaggugcuuuuaagugagcccaggcagaagugugagggcggcccaugcugcaggcuguggcugucagcaggccgcuucuccacagcuggccccguccuaugauucacagggcagcagcagaguacacugggugacugcugcccucuccugguggcacagggcagaccugcuggugaccacagaugcaugcuucuggggaggacuagggagaaagcagguauuggagaagcaggggauuguuuauuugcuaaaaguguggcucuuucacucagcaggucugcuacugccuacugaggaggccucucgacauccucaugucaaacccugcauguucgggcgcaucuuuaaaauccauccuaggccaggugcgguggcucaugccuguaaucccagcacuuugggaggccgaggcaggcggaucaccugaggucaggaguucgagaccagccuggccaacauggugaaacucugucucuauuaaaaauaaaaaauuagccaggcaugguggcgugugccuguagucccagcuucuuaggaggcuggcaugacaguugcuugaacccaggaggcagagguuucagggagccgagauugugucacgguaauccagccugggcaacacagugagacucugucucaaaaaaauaaauaaauaaguaaaaaauaaaauucauccuuuaucagucaggaaagagcucauuccagcaggauuaaugcagagaauucaccagaggaacuaguuccgaagguauggcaagagcuaaaucuuccaacaggggccuguggggcaacccagagacggacaagagcaggaaacuccaaacccuucagcgggcaggacagagggugcgggugaggguuccagugcugugggcugggccagccugguaggaaugagaauccauaugcuaggagcuggggccccagaggagcagcugccguggaaaccccaggaggcagagugagggagagaugcuggccuccccuucuucccgcccugcacugucucccaugggucacauguggcugcagccaguugccuggggaggccccugccaugcugggguuugcaaagcaggcccagggccugggaaggacgggggcuccagcacgcagguggcuaugcuguccggcuacugggcggacacugcccauaacugaccuuuuugaugaguucugagagaaagcaccgggcauauuugacggacggcgggugcuucacacacacaggaugcuucacagucuacggcaaaggacagaacguugguugcucgagagcccgucuuaagucuccuaugagcuucaagccaacacagcagagggcaaacuccaggcuacccgaucccucagcaaagauguagauggacacagcguuuuggccccaugcaucugaaguuugucuuaagauauaagcuguuuccuaaaaaugcuuccacugcaguggcacaggcuauggcagcauuucuaacgcccauucugagcaggaacacagggcaugugggcccaaaccgccucccucccaggggagccagugugaaccaggguuugcaguaaggacagucgccaacggucuggcucuauggaagaggcgggaaggcccacucggcaacugcucucuuggagugugugucccuggggacaggauggaggggacgggacgcuccgggugacacuccagcuaaagcccagagaagccaaaugcaggaugagcaaguucuaggcagugggaacagcuggugcaagcucugagguggccacagccuggcacuuggaaaggagggcagagggacuggugcagcaggaguggggacggcgggaaaacaggagccuggagggagagggaggagacgguccacagugccugcuggcugggagggaugcagauucugcccaagggcagcaaaguaccccacgcaauacacaggcucuucaggcuggugcugguuuuucauuuauucugacacagagucucgcccuguugcccaggcuggagugcaguggcccgaucuuggcucacugcagccucugccuccuggguucaagcgauucuccugccucagccuccugaguagcugggacuauaggcauguaccaccacgcccagcuaauuuuuguauuuuuaguagagauggguuuuugccauguuggcuaggcuggucuggaacuccugaccuuaggugaucuguccaccucagccucccaaaguccugggauuacaggugugagccagugcacccagccuugugcuggguuuuaaagcagcucucccuacauuucaugcuucaccaccuacgagagugaggcucagggugaaacucagagcagggugcgagauaacuucagguaucuccaugcucgaagcccugguauugccccgaaaguuuucccugcuguggcuguaucuuuuccacauggauaaucuugguucaccucuagcacaggaauucuucaccggggcuccuaggaugggcuggguggguggggguggaggauaucugccuccugaguuuguauggaaaauguauucuucuggugcacuucuuucugcgagggagucuauugcuuggucuuuucagaagggcucauggcccuucgaacgugaagacccaggaugcagggugaucugcacuuggcccucaaggccaaggucaggcuguggcugggccggguggugauccugccucucaccugcaggcagaugcacuugaguccaaaccccacccugggcaaagcaagggcccauuuaggucuagaggagacaggagugggcaggacaggccucaugaaagcaaaaaagaaagucucugaacaucaaccaaaugcuagaagcuguuuugcaccugucaucucuguuuuugcuguggaugguuuaaaaaacauucccuagauuccccccucucauugcagguuuuuguauauucugaagucuuugucuaagucuuaaauagaaaacgaaagcgcuggagcugucagaggugcugacacccaccugcagugcugacucaaugguuuuguuuuuugaacagggguguuuuuaaaggguacaagcacaccugcaguucuucucucaggucuucuggagagauucaggaggcagggucaugagucccagggacucugggauucuuaccuugugcaaaauaucccgcagcagcucagaaucugaugagucucuuaacuuugcuucuaagcucuguguggaggggaaagagagaaaucucaagggcgcauucacaggaacauuaaacacgcaauagaauguguuggcaaagcgcugugugaucccucccuggggacguggagccaguuggaaguggaagccacagcggcugaaagccugacauucagaugucgcagggugcaccuggaugagucacaggaagaaggcugacuuuuggccacauuaguccuggcuacuuagcggccacccgggucaugggccagcucccugguugcacugcucagccaggaauuaccagggcagccauggcaccaagguuugaugggcuugccaucuaaguggagaugcagaaugugcccauaccagccugaguuacauuauccucuuacaggggccucaagcccagcagcgagccuuggcucccgaguuaggcagacugucucggcugguaugugacacagggcaaggcacuucauugcuucagagcucccuccaugccauaaaaggcccuacaagaccugguccuaaucccucucucuggccuguucucccucaccccuggcccacccugcucacuccacuccagccacacuggcugccuugguguuguuccucaaccacagcuggcuuguuuccaccacagggccuuugcauauccuguuccccaagcccuucccauggcuggcugcuucaccacucaggccccaguucaaaugccaccucuuuggggaaggcuucccugauucccugacuuuggugacucuucuucccaguucccgcauucacuauuucccuguuuuauuggcuuuaaagccacugucaucuggucuuuucuuguuuauuuauuuguuuauucucuggcucucccaugcaagcagagccucaucugucauggguacugcugauccauggugccuggcucacagaaggcauuuauuaaacauuuugagacugaauaaaaacacuagcuaacaccaacauguauuuaccaugagccaggcacugauccacaggcuuuuguacucaacccugacaacaacccuaagagguagguaucauuauaucccccauuuuauuaauaagaaaacagcacagagagaugcagucacuugcccaaggucacacagggccaggggcugggccaggauucgaagcagacaggcugucuccugggucugaacucucaacuacugcacccuaaucaaacaaucccucuggucaaaugugagugguaauaauaguacccaccucguggguguugagggugagcccaaguuagcauucagcgugggcaugugaacaauuacagucaauacugaauggagaccuaugaugcuuuuaugaagguuucuauuuuggguuaaaaaugcacgaauuucucuugaccagaaaugaucucugagugcaaauauuuuaugucaauggaauaacgcaaaugauuaagcaacaccccauaaaauggggcagacccagggaggaauauauauccaaacucacucaucccagugagcucaccgcacaugaauuacaaaugaggccgggugcauuaagccccucugcuggcagaagggaggcugcugccugccaugggccugugcugagaauggcagguccccagggcgaggagaggccacccccuucucugucucuuccaucacaggcgugacagccucagagcaugagccgauucugugcagugcucaacauacagaugagaauacugaggcacgagggacagccugugacccggucaccgcgcucaggaggacgugguuaccugcgguccugacggcgcugacuuuuuagaaugggcgagggcagcugugucccagugaccagaacgauuacugccuuuaaaaagucgugaaaaugaucgugaacuguaccccacaccgagcgcgcgucugccccccaaggcuguggagacgcccccagcuucccccgccagcucgcggggcaggaggggugcgagcgacucuggccaggccccagggacggggaccgggucgcgcggcccugaccggcgggagcccaggaacucacguggcgggagcgccaggggcuucagcacggagacccgucccgucugccccuggacucccgcgagccccgcgggccucuccgcucgccccgccgcccaccugccaggggaaggagcgcagugugcgugccgccaggaagcggcgcucgaaacucugcagcaagaguucgguccccgcguucuccucgggcgccaugacgugggcggggccgcagcguugccggcagaccgggcggaagcccggccug

SEQ ID NO: 18013 - RNA, 13511 nt, Homo sapiens
caggccgggcuuccgcccggucugccggcaacgcugcggccccgcccacgucauggcgcccgaggagaacgcggggaccgaacucuugcugcagaguuucgagcgccgcuuccuggcggcacgcacacugcgcuccuuccccuggcaggugggcggcggggcgagcggagaggcccgcggggcucgcgggaguccaggggcagacgggacgggucuccgugcugaagccccuggcgcucccgccacgugaguuccugggcucccgccggucagggccgcgcgacccgguccccgucccuggggccuggccagagucgcucgcaccccuccugccccgcgagcuggcgggggaagcugggggcgucuccacagccuuggggggcagacgcgcgcucggugugggguacaguucacgaucauuuucacgacuuuuuaaaggcaguaaucguucuggucacugggacacagcugcccucgcccauucuaaaaagucagcgccgucaggaccgcagguaaccacguccuccugagcgcggugaccgggucacaggcugucccucgugccucaguauucucaucuguauguugagcacugcacagaaucggcucaugcucugaggcugucacgccugugauggaagagacagagaaggggguggccucuccucgcccuggggaccugccauucucagcacaggcccauggcaggcagcagccucccuucugccagcagaggggcuuaaugcacccggccucauuuguaauucaugugcggugagcucacugggaugagugaguuuggauauauauuccucccugggucugccccauuuuaugggguguugcuuaaucauuugcguuauuccauugacauaaaauauuugcacucagagaucauuucuggucaagagaaauucgugcauuuuuaacccaaaauagaaaccuucauaaaagcaucauaggucuccauucaguauugacuguaauuguucacaugcccacgcugaaugcuaacuugggcucacccucaacacccacgagguggguacuauuauuaccacucacauuugaccagagggauuguuugauuagggugcaguaguugagaguucagacccaggagacagccugucugcuucgaauccuggcccagccccuggcccugugugaccuugggcaagugacugcaucucucugugcuguuuucuuauuaauaaaaugggggauauaaugauaccuaccucuuaggguuguugucaggguugaguacaaaagccuguggaucagugccuggcucaugguaaauacauguugguguuagcuaguguuuuuauucagucucaaaauguuuaauaaaugccuucugugagccaggcaccauggaucagcaguacccaugacagaugaggcucugcuugcaugggagagccagagaauaaacaaauaaauaaacaagaaaagaccagaugacaguggcuuuaaagccaauaaaacagggaaauagugaaugcgggaacugggaagaagagucaccaaagucagggaaucagggaagccuuccccaaagagguggcauuugaacuggggccugaguggugaagcagccagccaugggaagggcuuggggaacaggauaugcaaaggcccugugguggaaacaagccagcugugguugaggaacaacaccaaggcagccaguguggcuggaguggagugagcagggugggccaggggugagggagaacaggccagagagagggauuaggaccaggucuuguagggccuuuuauggcauggagggagcucugaagcaaugaagugccuugcccugugucacauaccagccgagacagucugccuaacucgggagccaaggcucgcugcugggcuugaggccccuguaagaggauaauguaacucaggcugguaugggcacauucugcaucuccacuuagauggcaagcccaucaaaccuuggugccauggcugcccugguaauuccuggcugagcagugcaaccagggagcuggcccaugacccggguggccgcuaaguagccaggacuaauguggccaaaagucagccuucuuccugugacucauccaggugcacccugcgacaucugaaugucaggcuuucagccgcuguggcuuccacuuccaacuggcuccacguccccagggagggaucacacagcgcuuugccaacacauucuauugcguguuuaauguuccugugaaugcgcccuugagauuucucucuuuccccuccacacagagcuuagaagcaaaguuaagagacucaucagauucugagcugcugcgggauauuuugcacaagguaagaaucccagagucccugggacucaugacccugccuccugaaucucuccagaagaccugagagaagaacugcaggugugcuuguacccuuuaaaaacaccccuguucaaaaaacaaaaccauugagucagcacugcaggugggugucagcaccucugacagcuccagcgcuuucguuuucuauuuaagacuuagacaaagacuucagaauauacaaaaaccugcaaugagaggggggaaucuagggaauguuuuuuaaaccauccacagcaaaaacagagaugacaggugcaaaacagcuucuagcauuugguugauguucagagacuuucuuuuuugcuuucaugaggccuguccugcccacuccugucuccucuagaccuaaaugggcccuugcuuugcccagggugggguuuggacucaagugcaucugccugcaggugagaggcaggaucaccacccggcccagccacagccugaccuuggccuugagggccaagugcagaucacccugcauccugggucuucacguucgaagggccaugagcccuucugaaaagaccaagcaauagacucccucgcagaaagaagugcaccagaagaauacauuuuccauacaaacucaggaggcagauauccuccacccccacccacccagcccauccuaggagccccggugaagaauuccugugcuagaggugaaccaagauuauccauguggaaaagauacagccacagcagggaaaacuuucggggcaauaccagggcuucgagcauggagauaccugaaguuaucucgcacccugcucugaguuucacccugagccucacucucguagguggugaagcaugaaauguagggagagcugcuuuaaaacccagcacaaggcugggugcacuggcucacaccuguaaucccaggacuuugggaggcugagguggacagaucaccuaaggucaggaguuccagaccagccuagccaacauggcaaaaacccaucucuacuaaaaauacaaaaauuagcugggcguggugguacaugccuauagucccagcuacucaggaggcugaggcaggagaaucgcuugaacccaggaggcagaggcugcagugagccaagaucgggccacugcacuccagccugggcaacagggcgagacucugugucagaauaaaugaaaaaccagcaccagccugaagagccuguguauugcgugggguacuuugcugcccuugggcagaaucugcaucccucccagccagcaggcacuguggaccgucuccucccucucccuccaggcuccuguuuucccgccguccccacuccugcugcaccagucccucugcccuccuuuccaagugccaggcuguggccaccucagagcuugcaccagcuguucccacugccuagaacuugcucauccugcauuuggcuucucugggcuuuagcuggagugucacccggagcgucccguccccuccauccuguccccagggacacacacuccaagagagcaguugccgagugggccuucccgccucuuccauagagccagaccguuggcgacuguccuuacugcaaacccugguucacacuggcuccccugggagggaggcgguuugggcccacaugcccuguguuccugcucagaaugggcguuagaaaugcugccauagccugugccacugcaguggaagcauuuuuaggaaacagcuuauaucuuaagacaaacuucagaugcauggggccaaaacgcuguguccaucuacaucuuugcugagggaucggguagccuggaguuugcccucugcuguguuggcuugaagcucauaggagacuuaagacgggcucucgagcaaccaacguucuguccuuugccguagacugugaagcauccugugugugugaagcacccgccguccgucaaauaugcccggugcuuucucucagaacucaucaaaaaggucaguuaugggcaguguccgcccaguagccggacagcauagccaccugcgugcuggagcccccguccuucccaggcccugggccugcuuugcaaaccccagcauggcaggggccuccccaggcaacuggcugcagccacaugugacccaugggagacagugcagggcgggaagaaggggaggccagcaucucucccucacucugccuccugggguuuccacggcagcugcuccucuggggccccagcuccuagcauauggauucucauuccuaccaggcuggcccagcccacagcacuggaacccucacccgcacccucuguccugcccgcugaaggguuuggaguuuccugcucuuguccgucucuggguugccccacaggccccuguuggaagauuuagcucuugccauaccuucggaacuaguuccucuggugaauucucugcauuaauccugcuggaaugagcucuuuccugacugauaaaggaugaauuuuauuuuuuacuuauuuauuuauuuuuuugagacagagucucacuguguugcccaggcuggauuaccgugacacaaucucggcucccugaaaccucugccuccuggguucaagcaacugucaugccagccuccuaagaagcugggacuacaggcacacgccaccaugccuggcuaauuuuuuauuuuuaauagagacagaguuucaccauguuggccaggcuggucucgaacuccugaccucaggugauccgccugccucggccucccaaagugcugggauuacaggcaugagccaccgcaccuggccuaggauggauuuuaaagaugcgcccgaacaugcaggguuugacaugaggaugucgagaggccuccucaguaggcaguagcagaccugcugagugaaagagccacacuuuuagcaaauaaacaauccccugcuucuccaauaccugcuuucucccuaguccuccccagaagcaugcaucuguggucaccagcaggucugcccugugccaccaggagagggcagcagucacccaguguacucugcugcugcccugugaaucauaggacggggccagcuguggagaagcggccugcugacagccacagccugcagcaugggccgcccucacacuucugccugggcucacuuaaaagcaccuuuuguuuuccuccucucuguguuugauccaaacacggcucucuaucauggucaccuggcaacucucacggaauccuugucuccugcccuagacuacaccuaacccuacccucccaacaccucugguucaaggcccucccauccagguuucccuaccaagugaauuuuuuuuuuuagagacaaggucucuguugcccaggcuguccucgaacuccugggcucaagcaguccucccaugucagccucuagaguagcugggacuauucggcacacaccaccaagcccaacgaagugaauauuuuauauggcagcuggccgguauuauaccauuccaucgcaaaucuccccuccaaacuuggugaaaaucaucuggccauuuuuacagauuagaacgaaagcaaacaagcucucacucugucugcccccagcacgaggcuguccacacagagccuuuggacgagcuguaugaagcgcuggcggagacccugauggccaaggaguccacccagggccaccggagcuauuugcugguaugagaagggcacccuccucccccucacagcccagauacccuuccugcacagacaaagugaaaacguggguguggguucaaauccugacucacccauucuacagucuuagacaugagguccgucaaccuucuuuagccucaguuucccugucuguaaaucaggcacuucaacaacaacagcaugucucguggaguuguugggcacuuauccaauaggugacacacacuaccugcuucacaaggaccuggugcccaguccucaaagaauacuugacagggcugggcgugguggcucacgccuguaaucccagcgcuuugggaggccgaagugguugcaucugaggucaggaguucgagaccaaccuggccaauauggugaaacccugucucuacuaaaaauacaaaaaucaggccgggcgugguggcucaugccuguaaucccagcauuuugggaggcugaggcggggggaucaccugaggucaggaguuugagaccagccuggccaacauggugaaacuccaucuuuacuaaaaauacaaaaauuagcggggugugguagugggcaccuguaaucccagcuacuagggaggcugaggcaggagaaucucuucaacccaggagguggagguuguagugagccaagaucaugcuauugcacuccagccugggcaacgagagcaaaucucugucucaaaaaaaaguacaaaaaguagccggacaugguggcacacgccuguauucgcagcuaccugggcggcugaggcaggagaauugcuugaacccaggaggcagagguugcagugagccaagaucgugccacugacuccagccugggugacagagcucaaaaaaaaauaagauaaaacauagauacagaaaaccacaaaggaaaaacagcauauugaaucaucacaaggcagccaccccuucauagccacaccuguccccuggccaccacugacauguguuccaucgccagaauuccguugucucaggaagguucgaugaauggaauccuguguggccugagaugagugucuuucacaccgcgugacacccuugaggcccgugaaagcuguuggcaugccaacaguuagcugcuucucauugcugaguggcgauugguccugucaugguuuauucagccaugugguggggcuacuugucuucuaagccacuugccuucugaucgcuggacugacucucucgccuucucuuggugcagcccucgggaggcucggucacacucuccgagagcacggccaucaucuccuacgguaccacaggccuggucacaugggacgccgcccucuaccuugcagaaugggccaucgagaacccggcagucuucacuaacaggugaccucggggcgcagggcagggcaccgaggcaggcuuacccuggugcagucgcagacacgguccccuuuccucccgccaggacuguccuagagcuuggcaguggugcuggccucacaggccuggccaucugcaagaugugccgcccccgggcauacaucuucagcgacugucacagccggguccuugagcagcuccgagggaauguccuucucaauggccucucauuagaggcagacaucacugccaaguuagacagccccagggugacaguggcccagcuggacugggacgucgcgacgguccaucagcucucugccuuccagccagauguugucauugcagcagguaaugcccagccccgggcacccugugcaggugguguccuugcagcucuacccagcucuuggcucugggaaaagggaacaauggacgcugucgggcauggacaugauggggcuuccagaagaguuacucugggccuccagggugacaucacaggacaggggugccucuuaaggugaccuucaacccacagcccucuuuuuggagacaggcauacucccguuccagucguuaccacauggcucugucccagagccaugcccuguguccuucagagaccacaggaggaaaacaaccacuucugggacgaagacagggcccuugagagaaggugguguuuggcugggccaccgaaaaccccucaccccugccagcacacucaguccccucucugguggaacagagcucugccugugguccuaggucccagcccugaaacccacagguccagcgguggccagggacacaagcccaccccugcaagccagcagacaaaucagcagaugccugaaacaugaaguucauggcagggucaggcuuugugucauucaaagcccucuagauaggccaagaaccagagcugguuuuuuaaggaacaccagugagucuggagauuuuuuucuuuugcuucggucuuuugcagcuuucucuacuaaggguucuccuuuuucacccaaguaauugccuuuccaucuaauggcccaaauggucaaauggcaucuacuagucucauaugaccgcugccucucuggccucgcccugcugcugacgucagcaugaccuggaccuguccacuggucccuuucaguaaccugaagcuuucaccauagaugugcuguauugcccagaagccaucaugucgcuggucgggguccugcggaggcuggcugccugccgggagcaccagcgggcuccugaggucuacguggccuuuaccguccgcaacccagagacgugccagcuguucaccaccgagcuaggugagccuccacgcccacccgggccugcauggucccugagcugucccugcaggacgccaguggaagugaaagaacugggugccggggaaaagcuagguugccccacacucccacaccauggggggaacucaggcagaggccagugagcagggugggcuuggggcguggggggcuugcggcaggaggagggcagcucagcacagggagggagggucugagcccagcagcccuacugugugcuucagagcaggguucccuaagcccuugggccucgguuuccucaucuauaaaauggagguggcgggaggggcagucggggucagggcuggacacagcuguggccugcaggacgcuggagcacaggauguacaggcggauccaccacgccacuguccugagcacccagucgguggaagacgagcagggugacuguagagaaggggaacuggccccauagugggccagcaacuguccucagaccugacauuugucagcccccagcaacugugagggugugcugucacugucccaucucaccaacaaagacacuaggacacacggaggccaagagacccccgagcucccgcagacugcaccccagccaccuggcucucacgccuccacacuacacccaagccccccagugccaccagccuuugccccagcucccccugagcacagccccuccuggcagccaugugcacagaugcacaugcagcagccucugccugcacacagagacacagacaacccagugccuguccacguggggcagcccguuaacuacagagccaacaaacaagccagcacacgaagacguacuggguuccacgacagaguccccccacaaccucgcacaggaggcuggccgggcgcagggcucaggccugucaucccagcacuuuaggaggcuaaggcaagaggacuacuugaccccagguguucaagaccaaccugggccacauagugggaccccaucuucacaaaacauacagaagcuagccagaugugguugcacacgccuguagucccagcuacucaggaggcugaggugggaggauggcuugagcccaggagauggaggcugcagugagcccugaucucaccacugcacuccagccugggcaacagagcaagacccugucucaaaaaagcaaagaaauaaaaaauaaaaaaaaaaaaaggaagucuuucuucagauacuuacgugaaaaaaaaccugcaauauauuuuaagugaaaaaaacagugccaagcagcacacauaguauaagcccccacccaccuuuuuuuuuuuuuuuuuuuuugagacagagucuggcuuuguauugcccaggcuggagugcaguggugccaucucggcccacugcaaccucccaccucccagguucaagcuauccucccaucucagccuccugaguagcugggacuacaggcacgugcuaccacaccuggcuauuuuuuguauuguuuguagaguugagguuucgccauguuggccaggcuggucuugaacuccugaccucaagugaucugccgccucagccucccaaaguguuaggaauacgggcgugagcuacugcgcccaaccccauuuuuguuuaaaaacuaauaauaaucacccacacaugguuaugaguaccuauauucccaacuccucaggaggcugacgcgggaggauggcuuaagcccaggaguuuguggccaccuugagcaacauagcgagacuucaucucaaaacaaaauuuaucacaauaaucauuuucacauaaguauaccuauaggggaaaaccuagaauauacauauagcagucuuguccaacuugcggcccaacgcaaaucuguaaacuuucuucaaacaguacgagguuuuuuugugauuuuuuuucuuuuagcucaucagguauugcuaguguuaguguauuuuaugcguggcccaaggcgauucuucuucuuccaguguggcacagggaggccaaaagauuggacaucccugauauacacauuaacaggugccauccuuggauggcaggauuauagagauuucuacacauucaugucuguacuacuucauucuuauaaauacgcauuuuccacucguaacaaaaaacugugauugaaaaucgucccgggucacagugucucacgccuguaaucccaacacuguaagaggcugaggcuuugggaggcugaggugagcagaucacgggaggucgaguucaagaccagccuggcccacauggugaaaccccaucucuacuaaaaacacaaaaauuagccaggcgugguggugcacgccuauagucaaagcuacucgggagacugaggcaggagaaucacuugaaccugggaggcguugcagugagcugagauugugccacugcacuccagccuggggaacagaguaaaacuucgucuaaaaacaaauaauaaaagaggcugaggcaggagcaucacuugaggccaugcguucaggaccccaucucuacaaaauaaaaaaauuacuggcaugguggcacgcaccugucaucccagcuacucaggaagugggaggauugcuagagcccaggagucgaggcuguagugagcaaugacugugccacugcacuccagccugggugacagaacaagaucauaucucaaaacaaaaaaaaagaaucauucuggcuaacggcucuucagacaucugugcuuaugagaacagcagccccuucuaagcuguguguguguguggguguguguguggugcgugugguuuuuuuuuuuuuuuuuugagacuuagucucacccugucacucaggcuggagugcaguggcacaaucucagcucacugcaaccuccaccuccuggguucaagcaauucucccaccucagccucccaaguagcugggauuacaggcacucgccaucaugccuggcuaauuucuguauuuuuguagagaugggauuucaccauguuggccaggcuggucucgaacuccugaccucaagugauccgcccgccuuggccucccaaaguguugggauuacaggcaugagccacugugcccggccgcuuucuaagcuuugugaagaguggguugacuauucagaucucugcuucugucccgcugugccaagugcuggggcagacacaggcagagaguggacagcggcacggugccugcugcuagccauuucuaugcaaaaccagcuuucuggucccauccuggaggccaauucuaggcaccugggugggccugggaaccugugaaccaaguaaacugacuuggacaccccccuaccccgccaggccuguccuagcagccccacacaauacccucauguccuguccccaaacaccgccauccucaaacacaugugcucuguuuccaggccgggccgggaucagaugggaaguggaaccucgucaugagcagaaacuguuucccuacgaagagcacuuggagauggcaaugcugaaucucacccuguaggacucacacacgacuccaacgggauugugagaaucaagucacucucaugggaagaauuuuuauaugggaaagcggauaaaacuuucauuggacuggaauguuuggagaauguuaauuuccaaaucaggaaccacaaacugcccucuaauaagacaucggcuaucuaagcgugugggugcccccuuucugccagcaguucugguucuuaagaaaaucaccauaaaucagacaugaaaauucuggcuccaaaaauagcauuuucuuugugcaaauaaaaacguguguaucaaguaugauguucccccaacguggacacacucaguuccucacaaagccaagcccacugcagcugccacaucccugggcuuacggugcagcaggugcuuuuuucaagacaggaaucaaaauguuaggaacacggcagaaaggggacaccuggagaccaaacgcaggaugaggaguucugcagaggucacagggaagucacagaacaguaauacgcuagcaggggcauggggcgugaagaacagaagaagagaggaagcguuuccaagccuccagagaagaaaucaaggccaaccaaagcuucccgggucacagaaccaauucuuuuaccaggcaguaccacugcugucauuucagcuucuggccacugggaggugcugcucgaaaggguuugcccugagacuccaagaagaagcugcgggaaggacagcagggguccugggguuuuagccucuggcccaggaguuauguguccauaaccaaagggagcacagucugcacccagcucucaucccaucggagcugcugcgacucccgcagguucuuccggaacugguuuagcuugcccgcaggaucaggaaaguuugagaaaagcaucugcaaaaaaauaaagagcagagcuuaccucauugccuguccccaccccaucccaggucaccaccuggcugaccccagguccccgacccaacaacaaccccucccaagucccuaacucccucacuuggacucgagacccuucacaccccagcagcacuccgccuccaacuugacaucacaguuucuggaaacuuccccgcaugucccacuuucccacacuuggugcccuggagcaccucccggccucuacgugcugcccauuccccugugagcacccuccucucggccucuggccaacgcagucucacccaucuguggguaacaagggggugucgguguucuuugcagccuugcuaaacugucugaaucaaggaucacaaacuacagccugcaggccaaauccagcccacagccuguguuuguaaauaaaguuuuauuggaacaaagccacaccccuuaaucuacagau

SEQ ID NO: 18014 - RNA, 1362 nt, Homo sapiens
uacuguugggaaauaauuucuuuuagacauuuagagaaaaaaaugugaaaauuauguuuugaagugcauuuuugcuguagaaugcuagaaguccauuguuguuuaaugcuucauuuacagcaugcggauuuacaacacacugaaugagagaagugggguuuaauuuuuucacuaugacuucuuauaaacccgcaaggggucuauuugaugaguaauaguugaguugacuuuuaccuacgaguuaccuucuccacgucuucauugcuucauuuuucccucaaccggaucauguaauagaaaacuuccucaaaaccuguuccuacuugagaaauuucaaaggauggaaacccuucuuugaaggacuuaaaauuacauuuauaucaggaugaaucauguuucgacuuuaaauaucaccuuauuucuggcggucucuuuuguuuccaaguggcaaauguuccuucugaaauuacauaguuuccucuugcucauucuguuucuaaacuucucuggauaaaugugugaaaauaaaugaaauuguuaagcccugagaauaagcuuggaaaauagaaguuauccuaccugggcaaaagcuccaaacauucuaggggggauagagaccccuccucccucuuuuaacaaauccucccuugaacuggggagagaaaggaucgccuuccaggauuuuuuuucccugacguguaacaguucuuaaaauacugccuuguuaauuuguuucuauuuuacaugagcauuauacaaacagugauaaacgaaauguaucauuuuuuccccauaaagccuccucccagauucuccucaguguuuacagaaaugugcuguauccaugagcucagaucaauuguuuauacacauugguguucauuuguucaaggcggcaucugggccucggaugucgggagagacccacugaggcaaagcacuauuaauagaaaggcuuaucucguuuaagggaguaaucauuuuaauauacucaggaaaaagccagcgugcaggcucuuggcccacccuugccuaggcagggucuacaccuuccagaagcaaacacagccgaaaagagcucuuaaagaagugauuacagagucaugauugcucuacaaauugagucuuuuuucugcuugacagugauccuggcaucgucuccccgcuuaauccuuacuagcaauuugccuauaguugcagcuaacaagaggugauuagaggggaguugccagucaccacuuaacacccagcucugggggcaccaugggcacaggcugccgaauugggccuguuuucuuauuaacuccccaccucugaaugcauuagcccagcucuuagcuaaugauaguuuucaagcaacag

SEQ ID NO: 18015 - RNA, 3687 nt, Homo sapiens
acaaagggucacauauuguaugauuccauuuauaugaaauauccagaacaggugaauccagagggacagaaagcagguuagugguugccaagggcuggaaaaagaaggaaauuauugcucaauggguauauuaguucuguuugggauaaugaaaauguucuggaaauagaugguggugacgguuguacaacauuuuuuguuuuguuuguuuuugagauagucuggcugucucccaggcuggagugcauuggugcaaucucggcucacugcaaccucugccucccggguucaagcuucucaaguagcugggaauacaagugcccaccaccaugcccagcuaauuuuuguauuuucaguagagacaggguuuugccauguuggccaggcuggucuugaacuccugacuucaagugauccacacgccucagccucccaaagugcugggauuacaggcaugagacagugugcccagccuguacaacauuguuaauauacuuaaugucccugaauugcacacuuaaaaaugauuaaaaggauaaauuuguuagguguaucuugguaugguuaagaaaaauggaaggcuacacaauaaaaaaaaauauuuuuuuuuugagacggagucucacucugucgcccaggcuggagugcaguggcgugaucucggcucacugcaaacuccgccucccagguucacaccauuguccugccucagccucccgaguagcugggacuacaggcaccugccaccacgcccagcuaauuuuuuuguauuuuuuaguggagacacgguuucacccuguuagcgaggauggccucgaucuccugaccucgugauccgccaccuugaccucccaacgugcugggauuacaggugugagccaccgcccccagcgauaaaacauucuuauugacuuucgaguggcaaaauaauaaagaucaugccuuccuuccucuuuacuguguuacaaauuguauaaugaacauauauuauuaauuauguggggcaauguauauaacuggcuuaaguuuauaaaauaacguaccagcauccggugcauuuggcuuuauuacacugcagggccauccaaagcaagagccucuagaccucuggguggugaacaaaucucaacugggguuucgugccuaccuggacgacaucugcucgucaauguguaguuaacauccugacagacccuucugccgcuggauaugugaggggcacagcacagggcucuggaagucccugcugacugcucgaagccuuucucccugcuaaaaccucugaccaaaugcuuaauaauaucugcuguaggcuguugagucugccacacguuugacauuuauuguuuauucccacacccaucccaugaaacaagcaggacuuuccauuuuacagaugugaaaaccaagauucaaagagacucaauaaccugcuccaggacaaaugacagaacugagacuucugacuccaaaucuuacgcucccccgccacaccucuuugccuuucucuuucacaccaauggacucuaugggugaccuuggcauagguucuucuaagaacuggcucuuaacaaaaacuucuggccauuaucugacugaaugucacaaacaagugcuguaagaacuugcuuagagccuuuuuccuaaaccuguacaccagcucuugccuugugaauuuauucaccacaaaacacauguucccaggggcccaggcaaagucuccaaguacccaguccccuuucuucagccuugcccacacccucagccuuccuguuaauccaggcgacccaggguuacccagagguccaggucccaguuguucacuugagcaucugauguaccccaaacaccugugugaaacgcucucuguccaggaugcguccauagcgcagggugacguagaaggucuguuucccacuguaccgcuggauacgcacaaacaucuccugaggccgguccuugguuucugucaggggaaucacaucugccaugggacaguauguguccugccgccagccccagaaguucagaugggccacccgcagcauggugccagacucauucagauacaggauaccaaccagucuccguaagaaauagcucauccagcacagcauggucagggcaaagcccgauaucccacucaugaggcacacgguguugagagugaggaggcccugggaguacaaguaauagccugguggcaaagcuaccacugucagggcagucugugccaacuucagucgugacaggaacccgaagguucugauggcaucaaaacgguaaaacauccagaauuucucagucucugcguuugguaguuucuccuucgagaugggugaacugcugcccacccaccucuuaggauccuccugcccacugcagcaccacagcccauggagaggccuuucccacacagcuuuuccccgaaaccuacgcacagcucggagaagggcagccugaaagggagacaguagaccauuucucucauggaacucaaccacauuaaucacacggugaacaucugcaaagcaccauacucuaaggcuucugccaauccugcaagguaaccguuauugccagacgagggaaggguaaagccagaugcuaucucaugugggcaucacaacagcuaucuaagauaguuaucacuauuuccacuuuaccacuagggaaacuaagcccagagaggguaagauauuuaccaaagaucacacagucagugagugcagcagaguccuccuuccaccaggcaauuccaaauaaauacaggaaaggaggugcggccgucauuaauucaaaacauauccagggaggacaaacucugggcuggacaauguauccacaagggggugugaacauuuccccaagcaggaaacuaaauaaucagugucuuaguggggaacucgagcaacaaaucugugagauauuuauuccaauaaacuuucuaauucucuguuugauucauaugcuaucuugggugcuggagggaacugcugcuuucucuuagccuagucuggggaaggggaaacagcggagaaggagaaggagcgaggcagggaggccccaacacguagcacaaggguauuacuagguggguagugaagcaguaaaagcucuuauuccaauucuggcuccaacaguaauuugugagcaaauuacuccacaccccugagauucgguuucuucgccuuucaaaauggggacucagaacacagugaaccagaggaugguuucagaguccucaacuuaguaccuaaugcacugugagagcucggcgaguuuuagcuacuacuacugugcgcaugugacccaaggagggcaagagaaagcccgggaaaagcgaacuguaacacacgccagagcuuccucccacggauccucggaguccgaaacccgagcgucgggccugcccgccccagcccugaccccgaccccaaagagcaucacccccucaaggcucgccacccgccuccuuaccauggccccaccaccugcugccggaaguaaaucccaccggcccccggaaccccuaagagcgcaugcucgaauguacaaggcgggcgugaucugcguugcacccugggaguugcgguccaggaaucguggcugccgcuacucccaggcguuaugggaacggaguccccuccucuucccgacgugcccugcgacucagcggccgaaccc

SEQ ID NO: 18016 - RNA, 3660 nt, Homo sapiens
cgaagcauuucccuaaagcuuuuuuguuugguuuuguuuuugacauuugaagaacccuucugauacaccaggguaugaauguaucagggaagcauagagggaaaauucuuuaucaaguuccaagugccuacugcuguggcugacagaaagcaucagguucccuagagagaaaacggggcaaagagauggcaaaaggaauagagguguauuucaggaaggauggcgagguggagagggagcuuuugucacucugucuaucccauucugugcauucuuggaauguuacauuuucugcuuaucgcaaguacuugccauggaucugcaccugaauuugaaaauaucaaaauauaucuaaauugaguguaggcgauauucuaggcauauccuagaaugugauccucaaaacaaccuuaagauauaaauaugauugcucccauuuuacagauaaggaaacugaggcucagguuuuucucaaccucgucagcaacuagaauuagcuaguaaaucccuaacguuagacauauuuucaaagugccuggucuccuccagggaggucagaauagaagucagaaagagaggugugcucuuuugagguuccugggcauauacccuugaguaucagccucugugacagggaagucuguuagggucuuaccccucauugccugaucuguguguauggagaacuucuggggaucucaccucuguucauaguuccuucugagacuugaacacuguuugugucucccuuucauaugcuugcacuuagcauuuaaaaaaauuucuggggaguuauuuucucuacuuagcaugugccuaaucuuaaauaucucuuuccuaaugucucaucuuuuuaucagucaacaucagggcuaauuccauuaaacauauauacauaguacaugcucucauguguguggguaugcacacacacacacacagccaugugacccuccauuaaaguccuccuaaauauugugacccauguucaaagaggugauauuauuugcaaguugacuauuccuccuauuucaugucuauguuugguuaucuuugccaggcagauggaaugaguuucagaggugggacagggaauaggaaauagaguuucugcaugaaugauggagagcuuugguagucagaaugauugaggaccagcuauuaaaauguuguuguuguuuuccuucuuggucuguuccuuuuuuuuuuucuuuuccaaauugucuuagagauaauucccggcucacuuagcauuaggauaaugacgguuauucugucccacugaagaguguugaacuggaacgcuuccaccgggcuuuauagguacccagaauggccuaauguuuaacauauccugcaggcaugccccugagcacacacugccuuuccugcauuccccccucuccauggucuaagccacauuucuuuccuggcauuuauauuuacugagaggugaggggugcauuaggcccauuugauggaugaggacacuagcggggauuugaaggaaugucuuucugggagucuccaugaauucucuggagaguuagcuaacuuaaugcaaguuaagugcuagucuaugagaaaaauuucucagcuguuuucaucuuucaagcuggcaguaaaaagccuuuuaagacagaaagauuauuauuuguuauuuggagauccuguuguugggucuacaagugcgugaccauguucuccuuggaauguugagcuaugcagaaauggagcacuccaaagaacgauuugaccaauagcauuucuucucuggggguuguauuucaaagcaugcaacucuccagggaaccagaacuaaauugcuuaaaaugaagucauuccucagauuaacuuccucagauaaagugucagcggucugcagaaacgaagaagacaaaacugagauuaucacucauaauucucuuacuuacuaugucagugaaacaaugaguuugcauuuuugcaauccuagaacauucuucauuagcccugggucaugaccucuuccaguuaauucucuuucacaccuuuaggaaagauuuaagaugaaccuucaauaggauauuaacauaacucauagccaauaccacagcugccuuucaaauuaaugagguuaauuguucuccagcaaacaugaguuugucuuuggcauuuuaaaugcuucccauugaucugacauuuugcuguuucaaguuuuaaagggcucaaaucaaagacuauugauaacugagcaaagagcgaagauccagaaauacgaaaacauugucuuuuuuuuuccaugaaaaacaaucauagccuuuugaauucaaucgaaguuucuacauuagccaucuaagacuuauuuaauuauuucuguucucagucaagcuaauucaagugaaugaacaguauugacuuuuaaaaucuuuuuuaaauuuuuuuaaaucuuuaguuuauuaaguuuguagaaaagcucuggggccaugaccacuuacguaaauguuucaguuuaaaaacaaaagauucaggccucuaauuugagccaaauccaggugaucuuguuugaaauuuuugaugaauuugaaaagaugaaaguggaacuuuuaacauucauguuccccaaauuuuucacugggaagggaugcuaauugccuacuuaagauauaaguucaagaauaacauuuucauagaaaauucagaaaacugcuugacacagcagugacauaguuagauguggcucagaugccuuccaaaccugaggguccccaaagauuucuuuaccaguuguuuuuaacuaugaaucuuaaucuuguucauuccccugccaaaacaaauuuaaaagcauaaaccugcugaauuaauuggcagaauucaccauaguuuauaucaccccagaauguuuauguguauauguuuauguauaguauauauauuucaagcugaauguucagaaagaauaaggugaguuucuugguagcuugaauaagaauuagaucauaaaaauuauaaauaauggccuucucaaagaggauaaaugauucauuuuucacucacguauuaauaauaugacuuguugcauaauacacaagcuggucauugccugcaagaaaguuauugaauuaagcagcuauccagguuuaugucugaguccauuuuuaacccaacaaggcuaggauugaacuccauaugcagaggguuucuauucacagcuacauucaaacagaauccaaaacccacaucagaacugacuugaugucuuguaugguggagcugaaagcaagcugucugcucuaagcaauggucuucauuugggaauuaauguucacugaucaacugcagcaguuuauaucugucauguuuuaauccacugcaugaggaagugcuaauaaguguauuaaauauuuccaagcauagcuacaaaauuauauguuugcuuaacaccuuucuaugauagaggaaguauauacuaugguugucuucuuguaguaugucuuuuaauuuuguucaauguguuaucaacuguuuuaaggaauggggauugaaauucgugugcaaacugauauguauauaacuccugaggcaacagaagugcccggucauaugguguaaaaauguaaauacaggaaaauuucauuuuucuaauaaagauaauuucugccaauugauaugaaaaugaga

SEQ ID NO: 18017 - RNA, 3809 nt, Homo sapiens
agugacucauaaagggaggaaggggccagcucugggaagugugaucagagggggccuuuacucuuagcuguucugcuucaaguucugcaaggggaauggguuuggauacccaacacuugcguaaggaaaauacgauuuucauacuuuuuucaaaggaggaaaaaaaacuguaacauauugcaagcuaccugcuagcugaccccucuuuugaggaggaccuguuuucccaucuguaaaacggggauguucacagucccuacaucggaaggcugggugugaguucaauguuuuacacaggugaugcgggaccugggagcaguuccugcacagacaaugcuacauagaaauaugagcagcugcuauuauuacugcagcgguuagguccuccgguugccuagugguacccagccucugaaaaaguccugaguggguuugcaaaaccuggcuccaccccuuguugugguccugcuuugccucuuggagcccguuuucccaucuguaaaauggggccagcacagccacugaguggucacuaagggucugugaguauacuaguauuacaaccagauccccaagcauugccaucuuggauuucuguuucuccagacacugcccacagcaggcaacagacaggaaagaacaaggacaggacuuaauuaauccacagcagagaagaaagggcagggguguggcaaaaaaaaaaaaagaaaagaaaagaaaagaaaagaaaagaaaaagcaagauuuuuggagauagagacaagacaucaccuccuucccucccacuucaccuuauuaagggaugaaauugccaaagcucucugagauccuaaaucucuucuggccauccuuaaaguccuggagccuacuuaauccccaagacaggccugggcugcucugacucucugaccaucaaguuaauuuuauguuguacuuucaagucugaaaaguauuauuaagcauuagaacacuauuauaugugucuccaaggcugaagagggccacucuaucuucuaaagaugaaguaugacguguccaccaggcugcuuaacccuaaaucugaaaaugacucaguucaccauguguugaguacaacccucaaguuaccaccauggcccaugugucaggcuggccaaagacacagaaguugccagaaacccagguccuggacacuuucuggugcugugggccagccccacaaacguccuggagccacucuucccuucccuggcuccugaaaacauccaccuccucuaugaugcgcagaaaguugcccuuagaaagguggaggcccagggaggcaaggggaauugcccuagccgccagcagcacccucccgccaccacagaccacacagucuccuucuggcuccaaguuguguguucaccaaaaaguacacaagacagagcagggugagaagaaggaagcuagacccagcccuguaucccccaucucaucucaacugaguaucccuugaugcugguucagaaugugccacuccucuguccaaaaacucacuaagcccccacccccaccccuuccuggaagcuguuguggucauagaaccaaagaaguuuccucucuguuauccauuucaagcagauguuuaguggacagccaaaaaaaggcccaaguguugucuuugacaggaauggccacaggcagauuuacucaguuuucccuucuguagaauggaaauaagagcccgugccucacaggguugugccucucuuuauaggauuaaguaaauuuaaguaugcaaagcacagaauuagggcuggcacgcacaaagugcucaaacgcgagcugcugucuuaccggacacacgccaaaacuagaccaaccguuucucucccuggagaguuguggguggaaccgugagggaugcccagccacagggcaggccccguacaccaccugcagcccagcaggucagccuuaggacccucuccccuggaccuguucagaaccaaguuaaacuuuuggccaaagcacacucgcuagaaaacuuauuuuuuuuuaaaaaaaaaacuuucauaauaaaguuuauuaccuaaacugacuuuaaaaaauauaaaauaggauucugcacagcagaaaaauaaagccagagacccucccccaaccccugguuugugcaaagauacuggguauauguaaacaugaagagguaggaggugcgaguucagguccuggcuccagauacaguuaagcugcuacaacaaccagggggacccagagggagcaccaggagggggaggacccccucaagaggugagaaggggucugcggccucgucuccagccgagggcgggaggcgccucgccccuacacccauccgcucccuccaacccaggccggggaggguacccacaugguuccaggcaaguaauaacaaaauaacacggcaucccaguuaaugcugcgugcacggcgggcgcugccggucaaaucuggaaggggaaggagcucagguagucgcggaggacgggguugagggggaugcgagccagguucucgcggcccacgguggccacgaugcgcuggcggcacagcuccugcagcggccgcacgcggcgcuggcgcagcggggcccccagcaugcggcgcggcgccgccacguagugcuccagcagcucgaagaggcagucgaagcucucgcggcugccauccaggugaaagcggccggccugaaagugcacgcggaugcucgugggucccgaggccaucuucacgcuaagggcgaaaaagcaguuccgcuggcggcugucgcgcaccaggaaggugcccacgggcucggcgcgcagccgcucgugcgccccgugcacgcucaggggcccccaguagaauccgcaggcguccaggagcgcgcuggcgcgcgugaugcgccgguaaucggcgugcgaacggaaugugcggaagugcgugucgccgggggccggggccgggaccgcggggcacggccgcgggcgcgcgggggccgcgggcgaggaggaggaagaggaggaagguucuggccgccgucggggcucugcugcuguggagacugcauugucggcugccaccugguugugugcuaccauccuacagaaggggccagccggaggggugggccauagcguccgggggugcgcugcgggagagacaaagaggugagcuggggcgcugcggggccgggcaggugugcgccggccggacaacuccggagggcggcgcucccggcggacccggcccuagggggcgagcacggagcaccaaguccgcgcggauccguucagccucaguggacacagcuagaaaaugggcucuguacuccgcggagcucuucccggcgggugggggcucgguggaggcggaguccggccuccgggcagcaccgagaggggggcguggagagcagccgguucuggcuccagccguccggccccggcucgccgccccgcgcccgccgccugcuggccaggcugggauccgcgccuggucugggcgauuugggcuagggccggagaaaggcugugcugcgggagccccgcgcgcggggggcggccuggguggggccggcgagggucaggggcaucgcggccgcgaccccauucugcagcccccgaggcucgcccgacuccuggcugcccuggacuccccucccuccucccucccgccuccucgcccagggcccggcucaccuggcggcggggcgcgggacgccgcgggcgggacggcggggggcuccggggcgcuccggggcggcucucgcgcaugcuccggggccaggagccgugcagcugccacggccgcagcucgcucuguucg

SEQ ID NO: 18018 - RNA, 1477 nt, Homo sapiens
uaaagcuaggccugcugggagaggaugaggaggaggcccugccccuccaaacguggccuccuauggacacccagacucacagccuuccuaucacccacacucagcuccauagcaacucucagccccaaagccgcaccugcacccgccauugccaaaccuucagccagaguugcagacagagccaucguggcagccggagccagagcuccagccagagcccggccagccaccgcaacccaacuggagcccacagcucauccggccaccagagccagagucccaacacuaguccaccaccaaagcgccacaaaaagacuaugaacucccaccacucucccaugcggcccaccauccugcacugccgcugccccaagaacagaaagaacuuggaaggcaagcugaaaaagaaaaaaauggccaagaggauccagcagguguacaaaaccaagacgcggagcucagguacccuuuaaggagguggggaagggccaccgagcccacagaugauggagagcagaccuugggggcagugagaggaaggcugcagccaggucacaaaggaaccacaggcaagaaggaagagggagaagagaaacaauggcaguuggcuagcugaauguaugauacauugacggaaagucucuuugaaauuggauggguugauuaggaggauggaaagauggacagauagcagauaagcuagaugaaagcaugaauggaguugagagguuggguggaugacuggguggguaaacaauaaauagguuauagaaaggauaguuggaagaaugcauuggcugaaugauaggaaguuuggauacgauuagcuggauggauggauaaauggaugaaugcacuggcuggcuaguuauuugguugguuagguagaugaucaguuugaagauugugguugguggaugaauugguuagaaauagaguuaaauaguuguagaaguuuugauggguugguuugauugguuaaauauuaucuuaauagaguaauauagaguaauugaauaaacagagagaagaauagauaucuagacuaaugggauagaaugggaaagaaauguugaauaaaugaauggaaugagugaacuaaugaauggguggaugacaaauggaagggauaaauggauggauaccuggauucacauaggucaaaaggacacugacgguagucuaaacucuaucuaugucccauauucaaucacaaaugaguaguuguaagaccuuacaggaggucaaggaggucacugacuucaugaagugcucagcuauuaaagguuccuuucccacucuuaucccuuaggauggaaauccaacuaaugagaccgcacuccuuggcuuguuccugcguguuucacccaaaggagaaaaugcuaggaugaagucaaucuucuugcaggaacauguuacuauggugauuucuacgcaacacuaauuaaagcuuguaccuggaagacuaucccugagu

SEQ ID NO: 18019 - RNA, 14458 nt, Homo sapiens
uaaaaagcaauggguaugucauuaccauacacagaaacacaauacccacaucauacacagaagguaacuaaaacauacacacacagaaacccacacaucauucaguucuagcugcagagugucaacugcccgggauucugagccugaggucugugcucucuccuggacauaagggggcugagccagccuuacagagaugcucaggccacacuagcagcaaaggaggccuugccccuagaauggggagcugcuauggguuucagaggugagugaugcccucucugccuuccaccuaaccucacccugcagaccucaccagugguucacaucucacccuucaggaaaaauccccucuggccacgcaguuuucauuuuguucucaggccuggaucccuuauagagaugccccaggagcagaggcccgcccacccgagcagggagucccagcuguagagucucccuugaggcugaggccucuccaccccgccgagcaacccccuuccuugucccagcccuuauagcggcugggggagugggcagagggccaggcugguacagggcacaccagcuggaccccagcaagccccagggagcuggggugagcucaucccaagcccucaauuauccuccuggcuaaugagcaucugagaaccuccaucccauucuguaaggacgaaccccggggacgugaggccagaugucacuacggagggagguagaggaaaugggcuugggggaggggcgcgauacuuccugccuccucuuuguuggggagagaaagguggggcugcagcaagcaguuagggucgcaguuaagcgcaggauccuguagcccaucucaugggcuccagugcaggcuuggagcccacuaccuugugacuuucagcaagugaacucgcccuugcugcucaaagucugucccugaaucaucagcaccacucgggaacuuuugaaaaaugcaggauuuggggcucagaccuagugggucagaagcuguauauuuuauuuuauuuuauuuauuuugagacagggcucacugucacccaagcuggagugcaacggugugaucacagcucacugcagccucaaccucccaggcucaagcaauccuccuacuucagccuccccaguacccgggaguacaggcgcacaacgccacggccagcuaacuuuucuuuuuuagagauaggagucucacuacauuuccagggcuguucucaaacuccugagcucaagccaucccccugccuuggcauuccccaaagugcugagauuacaggugugagccaccgcacccggccucaucuccauuucucagacgaaaaaacugaggcacagaaacguucggcuguuuuuccaaaaccacccagcaggaaagccuggaaucuggcaaucugacucccagcuucuaugccaugcugaaucucccucaccauuuucccccaagaaucuuuccccucuaagugucccugccuccccugucaucguguugccaguccuggcucugggguucuuagccugccccucccagguccucaccacuaaugaagucucugccaacuugaggcggggaccacaaaggcugcuggaacuggcuuugugggaagaaccuauuuccuuccauucugggcuccuagguguggcugauggggcaggauuugggcagaugugggggcggagcuguucugagaugcccggcuuuggccuguggggcagcuggcugaagcugggcucuccucugccuuucuguccucccuuccugcgcaacucccagcucaccuccugugccuggcuuccugacuaggcugccgcugaacccgcccuggaguucugcaguccgaucauucauucauucaacauccauguauucagcacccacuguguggcaggcacuguucuguagacacagcagugagugcaauacaccuaguccugggagagaagaccaaaaguucaucacacaaugucaaaaauguacaauuucacaauggguaggcugggcaugguggcucaagccuauaaucccagcacuuugggaggccggggcaggaggaucacccaggaguuugagaccagcucaggcaacaacaagagacccuaucucuacaaaaaauuaaaaaauuagccgggcaugguggcaugcaccuguagucucagcuaccugggaggcugagguaggaggaucgcuugagcccagguuacagugaccuaugauugcaccacuguacuccagccugggcgacagagcaagaccuucucucuaaaaaaaagaaaaaaaauugcuucgucaaaucugcccacauucauagauauaggcugagugggacgauggcuugagcccaggaaggaguuggauggaggcuguagugagcugugauugcaccacuguacuccagccugagugacagaccaagaccccgucucaaaaacaaaacaaaaaaccccaagggagcuacucuuggcugggcgaucagggagggcccuccugaggaaggggcacuuaagcugagaucgggaagaugaaguagaagaguuccagcugcagggagccacauaggcaaaggccuggcggugggaaaggcuuggugcacugggcgcagggaagaaagcccagcgaggcugaguggagggagugagggccuggccaccucagccucgugagcccaacccgccaugcucuuccagaggcuucugcuugagaaugggaaagaaguuuccagcaaauaaggcccccguucccaggaggaggucccagcucgcccugcccccuccugucuucucaaguccccugggccacagaagccuugagggacccacccucaccccuucugugggccccagggcugggguguccucucgccgauggccuucuugggguggaugaguggagauuacuccaauaacuggagccucugucuucccagguagacaggccuggccucaaaacccucucuccaucaggagcaggcugugggacuucagcucuuuggagccucagguuccucaucuguaaaaugggaagauucuuucuuccggagucaucuuaauaaaauguguugggcuguuuauacagggcaggcauuuggugggggccaaaccaccggguaauuaugcuaaaaauaacuaugauuauagguggcagaggggugcaaaugccucacagccucaucccgcagaggaaugagagcuucgucagggccgggaccuugucuggcucguggcugcucccacgacgacuggcguggcaggcacguggucaguguuccgccaucgacugacugggcggaugaaugauacauaaaugaauucgcgaacgacugaugcccagcuuccucccgaagcaaggucauucaccucagcggucgcgccucuccccugccccugccccggauuccccgccgcucucagcucucgaggaguaugcagcacucuuccgugcagcgugccucaguuuccuccgcuguaagcaggcgggaccaaggcagccugccggggucaggaugaggcuggcagaggaagggcgccuguaguggggccccguacccacgggcgcccaauccgcgcucgccagggccgagcccgcccgccgcgcgcagcccccgccccaccgccugccggccccgagcacacgugacuccgccccggcccgccccgccccgccgucccagcgcgggcucccauuggccuuucugggaggccccguccccagccggggaggagccgggccccgcccgccgcagcgcggggcuccugcgucccgagugcgcggcggccggaccgggcgggcggagccgggcccgcggggcugcugcggggcgaucgggccgggccgcugccgcgccauggugagccgggcggggcaggccgcgcgcucgggccgggcgggggcgccggggcccgggggcgggaagggggaggccaggacgaggaggggcgcgcgcggcggcggggccgggccggggucugcgggcgggggaggggcggcccggcgggcgcggcucgggggaggguccguuccaggggccgcgcccgcgggcugggguucuuugucagcggcgcugcggcgagauccggacaaaggaggcggcggggggcggaggccgcuuuguggggaucgcggggcgcucgcccccgcccgugcagcccccgcccguccucagcuacgcucccgccuucccccggcauuucgggguucuucaaaauucugggagcuccggggagggcuccggggauagggguccaggugacguccggcgcccgucucgcggguagggaaacugaggccgggccgcagcguucggcgcccgguuccgugggcagcggcugcgcggcgugggcaugccuagcuccccugguccccgucccacaccccgccuccgucgggccgauucgagcuaccuccccagcugccguccccucuccagcugucgcccccugggccgagcccccuccucccuggagccucgcuuugcuccuccguggagugggggagacgccggcgccgccgggcaggguggaacgggagggugcgcggagcgcgccuggcaccgcgccugccacgccgcccgcgcucagcacucgggagccgccggggcgcugucaccccuaaguccccagcacccagcccaggucgcccagcccgccccagcgagggccacacugggguucaccuguccgcggccccucaggcacgcgggagaggagguagggagaauguggcauuuuagagucagggucgaaaugcgggauuuuggaugcagguugccuggguuugaaucccugcgcgucuacuuuugagcugugugaccuugggcaauggacuuaacuucucugagccaccaauuucuguaucugccaagagggaacaguaauagcucaacugcccuguugucuugaggcagaaaggagacaucugcgugagcuguuuaucucagugucuggcacauauaauugccaccaacuuucuccggcaucuacaagcaaaguuguuuggccaaacaggccaacccuggggcagccugugaaaaugaccagcgggugauucacagggugggggcaugagccucuggccuggcccgaggaagaccccgacugaccuuggggcagucccgguucagagcucugcgggcucccgcuuccucuuuugccacuggggaaccuaggggauucuggagcgaguuuccucuucugaggaugggggugucauggguggggguggaggaugagauaacacuggccagagagcugggcacagccccaucagugucagucccacuggcauccggccguucuugguccuggcuucuggagggcuggggccuugugugaugcguccuugugucccacuggcugcuggaggcccagggcagaacggacgucccgccucguccuggcuguguccagcagugcccucuucucccuacaacccuguuuucccagucagaaccuggggcaggaaacguuucugguuugugacccgggguucgcugaagaguuuguuggcacccuuggcagguggcuuuauggggggaggcaguacugaaagccccguagggauggcugguccccuguaagcagggcagcccuccuggcgucugucaaggagccucaggagguggcggcugcaaggcggggguguuuugcugguggugagcccggcaaugcucaugaugugcccgguugaguuaggaggaggcagcgugucccuggggaagggguguuuguggcacugggccugggccaggcucugugcccuucuggcccugggggugggcuuggggaucccucgggcucaguguucucccuuugucccugcuguagcacacaggaagguguggcuggugacaugcaaaccuggugaccucaugucccuuuuguuuucacuuuucuuaccacuucucauccuccccacgaccugguagaugaggucagggacucguauccgcuuugcgcauugagaaacugaggccaagaggagcagcuugcuuggcugggcggaagcaggccgcaaaagugagugcuggucugggaggauggaggggacuccagccugcucuacugcggucugugggccccccgggccuagagcacauggaguggccucuggagugggaucaggcucagacaagccgggguccugggagggagagcaggacaggaggauacccguccccucucugguagcuggggcagggacuguccauuugaauggcucugacggggugggguucacccccggcucugcccccaugcuccuugggucccaguuacggaucucugugggccuuggcaaacccggcaggacagugucaguaacaccugcaagcuugggcugcuggggaggaguggccaagggcggugcaggcccccgcucaccuggcauggcucaggcuugucuugcaguuguuauuccuugggacaugugugggcucugccgggagacagaguguguccugugcugcaguugaccuccuuugggguuguuugaggaugcuggggcaggggguucuggagagccugggccuuggaucuugcuuuuauagugggugggugggauccgagagucaggacccccuuggcagaggauggcaagacugaaggcacauggagcaggaggguguguguuugggggauccagauggccuugggcuucaaaugccaggcagaggggacacuccagccugcccagagauggaaggcccaggcugugcucuggguccuggccccucugcacuuggaagaccccuuggcucugcugggcuccccucugggcucccauccugccuucuggcuuuuugcuucaccucccugcgugcgccucaguuuccucaccugccagauggagaugcuagggugaacaaagguggcugcagccuuucuggaucagaugcuggugggaaugaaugugagcugcugucaugaugguuguugggugggccaggauucccaugugccagccugggcaucuccccaacccaagcuguggcccgucccuguccccugcauccugugggcuuuacuggaucagggcgagggguuacccagcuugcaagacacagcuuugcucagaggggcuagaaaggaagaacagacaggugggguccagccaggcacaggggcuuguggggaccugcugcccuccgcgcuuugaguuucccggggcucugcuuggccacccccuucccucccugccugccagcaagcauggagccagcugcccuuccaugggcucaggccugcccuaauccacuggcacucgccguucuguccccacacuaggccugcagccuucucccaugcagucugccggcuuuuuugagucuguugggacagaacauggggaccugugcucaggguucugggagugcccugagugucagggacccccccaccuaugaucccccugagaacagggucuccucuaacucaucacuguaucugcagggagggaacacucaacagaccauucacugagcaccuacuguguacccgugcagggcagggguacagcugugggcgggacagacggugcccuccuuggacugccuuggaguccagugcggggagugagacagcagccaggggacagccccugagccuagagaagggcagguagcaaggagagcaaaugaaguagggcaaggcuguagugguggggugugggaggaggggcgccuggguccaggguggucugggagggcagccugcaagaggcgccuucugagaaagucccgaauaggaaggugccagccguggggcggucagggcagaggugggagcgugggcucgcagcggaggguguggggacgccuggggaggcagggagcuuggauucucuuuggugcuggggaggauucugaguggggagaacgccaucacauuuuugcaaagaucguuucucaggaaacauuugcugagugaaugaaggaacagauacgcacucgggagggccggaccacaggccaggcgugacuguggcucagucacugggcucugugcucgcggcggggcagaaccccacaucuggcucugcccaugccuccuggccuggguucagggcagcagacgggguuuuggggucaccacuccucuuagagaaucccuuugagcuggggccgccugugccucaguuuccucauuaguccuggggccagugguugaacuggggcccuugaacucaggugccuccuggccugcccaccuggcuuugccccgccuaucccagguccuggugccauuguuugauuuucuacuuccugucccugaaccacccccacccccaaacacacacacuuccccuuccgaauugauacugacuugucuuccuguccagaaaccccaggggagggcaggcaccccagcaggcccugggaaccagaggugcaggggagagggaggugggaggugggaggcacagggcagguugguguucuucuugcagggagagaacacagagguugggacgaguguagacaggcucacccagccauggugggaaggcugucuguggggucagagggguccccuguccagucuggaggcgugagagaacagcuaagugggguuguggaaccggaugguggcaggggagaggccaggguggucuguacaugcaggggacagagcagggccaccguggagcucauggcccgcuggagggagaggugggcgcuaaucagguggccaugcuccagaagccaggguugcaugccaaggccacugcuccggagggaaggagcccggccggguugggaaagcuucccugccagagcugguauuaaccgggucagggugucuuucuccagccgggccaucugcguggugggggcugcccugugcacgauaggugccagcaauauccauggucucccuacuugaugccaggagugccaccugcccccaguugugacaaccagaaguggcuccagacauggccagauguccccaggguggggacacaguggcccccaguugagaaccacugaacaaggguaagccgccagaacguucugggcaggggcaacugccugggccagggccugguaggaggguucguugcgggggucagcguggcuggcgagcagggcauauuggggauguguaguguucgguccugcaggucauugugaggacuuggaaggcguccuggcugcaguggccccugagggugggcagggagauccuuagcgccugcggcagccugucuccuggagucagggggaaggcaguggaauggagggagggcaccuccucugcccagggcccucugcagaagcugccgguuuccccgggccuggucccuggacagacgcugggggcguugacuuagcugccuuuguccuucaggcaaaccuggcuucuggggaaacuccugguuggguaagaaucauuucuccuuaagggugcuguuccucaaggacgcagcagguucgacccuauuuggagggaaaaccuccuuccagugcugucugccugugcugaugucagucuuauccaaagggaacaaaaagccagacgugucguucugagugccgaccgcacgcccaguccuguguagaacgcgucucgggccuguccucauccucacugaccccgggugcagccagcguuugcucuguuuguggcgagcgaggcaggagagggaagaaagugcagggucuugggacuccagagaaccugccagccucagcacugcggggcagcagaggcaaagcccuggccucagcaugcucucacuggcugugccuugggugucaccuagaggguugacagggugccuggagcuggggacucuuagaccuuaugugcauuccauagccacacuguccuccgccacuuggcaggcccacccaugggugaacuccguggcucggccagguggaggugguggucccagcccuccaacuucuggcgucauucuuucaacauguggagcacaggcuuggccuggccugggaggggccucauccccgcucccacccaaaucagcuggugccccgacuccuggcacuugccagggggacccucucugccuucagagccuuagcccucaccgugcccccugccaggaacacuauuccccaucagcaccgccucccugccucccaccugcccacccagguuagcaucuuggcaccugguugcuguguuccugacaauggcacccuguauugugagugaccggcauuugggguacuaaccaguuacagucuggcgccugcauuagaugcuaagcaccaucagggagggagccucugucucacccucccugccuccccgaagcuuucccaagugccugucuccaucucccgggacacucuacccuguugcuuccuugguuggccuccguccaaaccacacaagggacucuaccgcccagcuuccuucucagauggugugccgcguuccaggggucuucccaggcccgaugcagugccuggugacaaaggcuguuguccaguacacccucucacagguguccccaaaggaccugccuguucuguauaugaugucuguuugggagagggacugaugucauugucauuucuuuuucuuuuuuuuuucuuuuuuuuuuuuuuuuuuugaagagacucuugcuccugucgcccaggcuggagggcuagagcgcaguggugagaucucggcucacugcaaccucugccccccagcuucaagcaauucucaugccuuagccucccaaguaacugggauuacacgcaugugccaccaugcccagcuaauuauuguauuuuaguagauacgagguuucacuauguuggccaggcuggucucaaacuccugggcucaagugaucugccggccucagccuuccaaagugcuggaauuacaggcaugagucacugcaccuggccauuuaucugcuuucaaacccccaucucuggccauuaggaggccccaguugcccucagucccugaguggucaugaacacugaguuggggcugggcuucccgaaggcacaccuucagcugaagaaccagaaccaugucuggcccucuggcauccuuugcugcagcugucgcugucgcaguguucccggcucugccgccagcgagggugacucaccugccugguacagcagcacucgggguuucaaaggucaugaacaggagcugggugagcgugggugagcagacgccuucgaacgccggccagcaugcuuuuugucagggugagggugggaugggcaggucugagaacgauuaaaaauagaccccguggaagugcuaaccgcagcucgucaaccugcuuugucuuucaggacucccguguccagccugaguuccagccucacugaguggccacccccaaagugcugccagccgaggaagcccccagcacugaccaugucuauuauggaccacagccccaccacgggcguggucacagucaucgucauccucauugccaucgcggcccugggggccuugauccugggcugcuggugcuaccugcggcugcagcgcaucagccagucagaggacgaggagagcaucgugggggauggggagaccaaggaacccuuccugcuggugcaguauucggccaagggaccgugcguggagagaaaggccaagcugaugacucccaacggcccggaaguccacggcugagccaggaugcaaggcuccugguccuguuugcagccggccaagaggcgcugggaggggcaaaaccauacggaugcgcugcugucugagaggaagggcugacacuugcuggcauggccucugcgggcuucgucaucgcaugcacugaugcccggggaccuggcuguccugggcuuccccucggccuccaggugaggcugcccauugcaggcacugggcaggccugaccuugcuggggcucauggcccuguagcgcuuuuguuacuugaaugucuagcugagccuguuuuugauggagcuacuacuguaaugcgugaacuaacaaaccugugaacuguaaauaggccccuggaagcacgugcuuaagcccuuuugcugauuuuuaaaaauaucaucuagcgcacacgggacugguauucuggcuguacuaaugacaagcugagucaagacccuggagggucauaggcuuguaaaggcccacgccacacucggcaggggucucucauguguguccaucugcguguaugucaaggaagugagaugccaauuuggggucuugaggcugaccaguuggggugcuugggugaucucugcuucauuagucauggguggaagaaaaaccacaccccccgcaccccuccguucuuucugcauagacucacuuguuaaauagcaguucuguugagaguggaguuacugcagggaagcuaccggaccugccugggagccagugaagggcgagucagggcacgcguccuggaggcugccagcguccuuguagcagagcaguuucuugccgcuugggucuucagcacgccaagccccccaccaacccuccaccccgagugaaggcuucgcugaaauugcuuugguccucauagagccugugguggcuacuuuuggucugaaacccacuuggcccaggaaagagaaaagguuguauguuuuguguugguguuuccuauuuucugcacuggaggggaggggacuguugagguucugucuuuuuucuucuuuuccucuucccucuucacaucacuuggcuuccuuuccucucugaugaccguccgccuaugggguucugacuucacuuuccucagcgggucuccaguccccugacccagcucuaaaggcacuuaggacccagggaacauuucucacgugcacauuccccuaagagccaccagacugcuuccugccagccugugcuugcggcagggagccggggcagggcagaggugaacuugaaguucaggacuugacucucccacagguggugagcugguggcucucuggugagcuagugucuccacagccugucuccaaggccuccccuauguacauuucagugagcucacuuugauuuuuaaucccaccacaagcacauacuaauuuuauuuaugauucaaaugugacucgugccugcccaucccuguaauagauggaaggucagccccggcuuaaccacagagcacuggcccuucauggcugagcucagagcucuggccuccugcucagacuaaaggcaccuccucuggccucacccaagccucuucuaaaaaccauguugaaugaauccacguucuggaaccccgaggcgggagaaguagggagcuguucguuuaagcagcauacaccuaaauuggggguuuaaacauuaaguaggagcuugggguggaagagggacagccggcugggccaccugagcagaaggugguaaugaaacaccucagcugggcucuugggagaccuuaggaagcaggagaggcaacaccucuggcuacugaugguguggcaaguucagaagaggugguggugggguaggcgugaugucagcagaagcccugcaggcugggugggcaggacacguggugggggccacugaaaccaggccuaggagggagaacaaguuccaaaggugccgacuggaagaaggggguaaaaguuugcuuuggugagugagaaaaggcuggggcgugugauccauccccucacguuucagaacuuccaggcuuucuaccucgacucucaccacagccagcacauacaccuaggcuguuuuuccuuccuccacaccugagggacgcagcaacagcuaggaucugcauuuucagguuccgagccugaccccuggaacugaccagcgcucgauugucagccuuggccugggguuuugaccuugccagugaaguuucgguuuugaagugauuaaaugucacuuccucaucaguuucacuucuggagguuuucuuauccuacucccuggugccagggacguaccugggaguuugaaucaggcccauuugagcguggcagccguguugggugaagguccggggcucggugaggcacuggggggguuuucgggaggaaaaugaaaaugcuucuagaaugagugaaccacaucauagcucucacuguuuuuucaauagcuacuuuuuuuagcagacaccagagccacacucaaauggcuaaguagguuaugaccucucuggauuauuuuugaaugcccaacuguugcauucaaguuuucugacuaauaagaaauuaagcauucauccuucguaucacugcagaagcaacagugggggcacagggagggaacucuugacacugagccacuaaaauauggacuaauuuuuuggacaaaucuucaaacggacugugcuacuguauuugucucaaagcuaccaaguuugugcaauaaguggaagggaugucauccuucuucaauaaaugcugaaugacauucaagcugauuuucuagaccacugagaaaaucuuuauuuacaauaaauuucaauaaaauuugcauaaauauauucccaau

SEQ ID NO: 18020 - RNA, 926 nt, Homo sapiens
guuuucacgcuuaauucacuuuauuuuucuuguauaaaaacccuauguuguagccacagcuggagccugaguccgcugcacggagacucuggugugggucuugacgagguggucagugaauuccugauagggagacuugguaaauacagucuccuuccagaggucggggguuagguagcuguaggucuuagaaauggcaucaaagguggccuuggugaaguugcccaggguggcagugcagccccgggcugagguguagcagucaucgauaccagccaucaugagcagcuucuuaggcacaggugcggagacgaugccagugccccugggugcagggaugaggcguaccagcacagagccgcagcagccugucaccuugcaagggacaguguggggcuugccgaucuuguucccccaguagccucugcgcacggggacgauggagagcuuggccaggaugauggccccacggauggcgguggccaccuccuuggagcacuuaacacccagaccgacguggccguuguaguccccgauagcaacaaaugccuugaaccuggugcgcuggccggcacgggucugcuucugcacuggcauaaucuucaaaaccucauccuugagagaggcccccaggaagaaaucaaugaucucugauuccuuaauugggcagggagaagagauagaucuccuccagggacuugaucuucauguccuugaccaagcggcccaacuuggugacgggcauccacuccuuauccucggccuugccuccgcgagcuccgcggccuuggccccggccccguccacggccgcgacccuggccccggaugccacugccgaaaccuccgcggaagccaccgcgguuccccaucucagggccaccagggccuccgggcccccccgcugcaccggcgucauccgccauu

SEQ ID NO: 18021 - RNA, 2423 nt, Homo sapiens
acugaaguugguaaaaacuuuuuuuacaacaaaauuagucacuuuuauuuaaaagaaacauuacaaauaagugugcaaaauuaaacaucaugauuaaauacacauaaaaggaacaugcauacuuuacaucaaaauccacauacagaguuaguugauuacaugacaguaacaguaaaggaacugaaggaacuggcaaaaccgagaacucgcugcuaugcagauuuuauauguuugcaaucugaaaucaaaaccauaaaauaggguuucuuuaacgggaauuuaagaaaauuaaauauauaucccaaauagcugacaauguagagcccauaaccuauuuuaguuaccaaauguuaaaaaaaguuaugugccuuuccuuccuaaaauguuaguguguagcuauucuuacaaaugaggggaggggaagacaguggacuugggggcuuggaggccagaccgaggcauuucccucuacaccagcgggaacugcagcgggcacuacagcgggcccucccagauccugcucugccagacgacccugaaguuaaaggauguuuucccccauaacgaauguucaaaguccgugcgucacucugauguucccuacacauaaccgggaaacagauuuaacccagaauguaaccaggagaccccgcguccccgccccgcacacgccugaggucugacagcucggcuucuacgguggccugguguccaucucauucuaauggccccaacagagacggggaugccacgcaagggcacagacgacauuacgggcacagaugaccacauugcagguacggagaagaccacaggcugggcucacacaaggggaaacauucacgcugugcucucucuacagggucaggucguuuuucuucauguucggacgggagaaggaauuccuuucuccuuuucuaaggcaagcugcugguguucuauuuaaaucugcuuauaauguaagaacuuacauuugcacacuuguucacuuccccgcugcagacucaguaagaacaauggaaucuguugcaaaaacaaacuugaacucauccacccucucagcccaguucccagguccguauggagcccccgucagcgugaggaugcgguggagccacugaagcuaacaucacagcugaacucaugggaacagccagcggccacucaagcuggucacagcacugaguaccuacggugccuugaugaugauucucucuuuaauacuggaaaugggaguccuuaggaaagcagacaaccaccuaaggcuucgagaccaaggucccugggcagccccuccagcccguggcccaggaggccccuggggcucuggcaccagccccgagagccugaaggcggcagguggugggugcuguggcgcccccagcaggggagucacaacuugucaucagucaucucuagaaacugcgcguagacaucucggaugcacucccccuugggguugaacaggaguuuguaguagcugcagucugcacaaauugcaaugacggcguuuggcuguguuccaaaggcacaaaugcacggagagccugagggaaccugaaacuuggagaaacuccacuuguaacugaaguauuuuggaaggaaacuggcugaggccaaacuggacuguuuauuccuuuuuagaucuucagcugcaaaaauaugcacugugccauggucgcuggauacacagaugagggacgcauccugauugaaguuaaugcaguaaauauuggcugcuugagauccucuucgcaguuccugaauuaaaugcccugaggaaguaucaaauauuccuauaagggucccuuucucggaugcaguugcaauucuuguucccugcaguuugagugcacugcagcucagaacacccucaugugcaggaauguccacugguggcuucucugugcuggccagguccacaaguugcacauggcccguguggugcccagaaaggccaggagggaguuguuacuauugggacaaaggacacagaggccuuugggguuauagcagguuuucaagaugugcaaccauuggggauugugugugaaugugaacaccuuaauuacggaguccaaaaccaccacaauucuaucucgccgcaguuugacugccuugacuucuguagaaaauucuguuucaauaacagucuucuucuucaggucaucccagaucauuacuuuguugggaggguauuuuggcuuuuuuccaccaccaauuaaagcuaaauaguugcagcgaaauaacauuucaacauggccaacuccuccuuuagaaauucuuguuucucuuuuucauuuaguggaucagcguuauagacucggaauccauuuuccaucccacacgcaaagcaucugugguccuggucgaagccagcguacagcagcccguugcggugaugguuacauggcaggagguuc

SEQ ID NO: 18022 - RNA, 551 nt, Homo sapiens
ggcaggcaacgcgaggaggcggaggucugguggccgcucggcggccccaccugucaccuggugggggggcagcggcaggcccugguuggugcagcucugugcugggccgaagaccgagaguauuuuagcccauaggagggguccacucuggccugcuggacacaggcugggggaaaacggacagcaucuauaacauggggaagaaaaauacacucagcucccgaaaauucuuguacucucuuuucaccaccuuuccugcguucucugccucacagucuccguaccuuauucucucuccaccuucuuucuccucacccccagccagauuuugcccuucauuucaaagccggugcagauugcaaagcugauuucauuuuauguaaucauuucguggaagaaacaauaaaaccgugagauauuccggcuuaaaacugcaguguggcucauaaagcgcuggggcccaggcucugcccaggcagaagggauuguuaacuggaaaauuucaaugacucaccguuuguuugacuagucauauaaagccuucacccaaa

SEQ ID NO: 18023 - RNA, 4541 nt, Homo sapiens
gacauaucuuuuuagggaacacucguuagugcauacaugagaguaccagcucuauuccuucagggacauauuggauaauuguacuuuuauauaaaaaggauugaaaaguggccagggcuguuuuuauuuuuucucucucauuuuucaagguaacauuugcugaccuaaauaagacauucuacaucacuuaagugcuuuggaaauuauagauuuaaugaagaaaagacaagcguuuggggaaaagcuucaaugucaucuucuucaggaaguccuuuuuuggacaccccuuuugcucuguuuauugaaauuuauuguuuuucuggagguucccaggguggacacagccacccagacccuccuguuugaagauuaccugcuccaccaaugagcaggcuacuugacuuucuagccauagcugauuggucaagaaguaaacacgugguccagccugggccaaccagauugucuuuccuuggaggaguccuguugcuaucucggcuggucuccuccauggagaugguauguaucagucauggagaugguaugugucugagucaaggaucgucauuuucugcccugugcucugaagacagauugacgaugaagaaagaggcagaugcacaaaaggaggcaaugaugaaagaaggaaagacaggccuggcuuugaugcagaaaauacuuuguccuacuuccuauuuuuccugggggagggcuagcuacauugucugcacuuugaugacaggcauuacaugaggccccuggaucccuaugucaaauuuccuccauuuaaaaaaauugcuuaaaguagccuugaaagaguguguuaacugucaccagagaaccccagagaauucucuugucuguuagccaauuaacuuccuuuaccuuccagugcacugcuccacuuuucucuggaccuucauuuccucauguauaaaauacgaauaauaauagcuaccucagaggauuguaauaaaauuaaauaagaugauaaaucugggacaguuuuuuucugggauuguuuuuuaaaaacuauuaauauuauauauuaccucuuuucuguuugacugugaauuacuuaacggcaaaaaccaugucacuguuuuuuucuuuuuuagagacaggucuuggucugucaccuaggcuggagugcaguggugcaaucauaucuuacuucagccucaaacuccugggcucaagagagccuccucccuuagccuccugaguagcugggacuacaggaugugccaccacaccuggcuaauuuuuaaaaaaaagaguuuuguagagacaagggucuuaugauauugcccaggcuggucucaaacuccugggcucaagggguccuccuaccuaggccucccaaagugcuaggauuacaggcagaagccaucuugcccagccguuuaaaaaaaaaaauuuggccgggugcgguggcucacaccuguaaucccagcacuuugggaggcugaggcaggaggaucacuugaggucaggaguucaaaaccagccuggccaacauggugaaacccaauguuuucuuucauuuugucuccacaaaaaaauacaaaaauuagccaggcaugguggcgggcaccuguaaucucagcuacucaggaggcugagucacgagaauggcuugaaccccgggggguagaagcugcagugagcggaggucaugccauugcacucuagccugggugacagagcaagacuuugucucaauaauaaauaaauaaauaaauaauuuuuuaaaucuccagcuccuagcaggggauuuggcaccuacuagcgugccugauaaagguuuguucaugaaauaaauaauugauauuugaugaauucuuccuacaaaugaccucauuuaauucuuacagccccuggagagagagauauuauuaacucuaucuuaccaaugaggaaacaagggcucacaaaaacuggguacaguucucaaggcugcacaguaagugguugaagcgggguuuuucuuauuauuauuuuuaauuugagauggauucucacucugucguccaggcuggagugcaauggcaugaucucggcucacugcaaccuccgccucccagguuuaagcgauucuccugcgucagcucccgaguaucugggauuacaagcguaugccaccaagcccggcuaguuuuuguacuuuuuugguagagaugggguuucaccauguuggccaggcuggucucgaacuccugaccucaggugauccgccugccucagacucccaaagugcugggauuacaggcgugagccaccgcgccuggccuaaagcaggucuccaaggcacuucucucugcccucugagccuacacucaugaccaucacauuagacuggacacaggugggcuucaaggcacgguagccacuccaugaaccugggaggaggcauuuacagcacagaaagggcaggugggcugccuggaagcuggaggcugaacacucugcugcccuguaucugucauagcaagaagccuagugagcugggagcugaucugggaacccgcggucugaacuccagcugcccaggcugcagggccgaggcuccacauuccacaugcucagcaugcuagccucccgcuguggcgggaccggugacagaugcacuccgagaaccagcagacaccucugugcucgcccacuuuaauuaggugaaggugucaagacccauuaggaucaccuagaaauacgacgccgggccugugcuccacccacacaugcuccaaaucacugccuucccgcugaagcuacuguuucaguagcaucucuuuauuuguaguuaguucuuaaaaaguuuuuaaaaauccucccaccucagccuccugaauagauaauacaaccacaugguaaaauuuucaaacagcaccggaagauacauuauaaaaaucagcuggacacaguagcuuaagccgguaaucccagcacuuugaaaggccgaggugggaggauccguugagccucggaguucgagacuagcccagagaaacauggagaauccucaucucuauaaaaaauaaaaaauuagcugggcaagguggugcacgccuauagucccaccuacuuaagaggcugaagugggaggauuacuugagccucaaagcuggaggcugcagugagccaugauagugccaucgcacugcagccugccagggugacagagcaagacccuaucucaaaaauaaauacaggaauaaauaaauaaauaaucaaaucucacuuuuaucacugaccugcaacgccaccuccccacaagucaugacuauuuuaacugucccuuguguauccuuccauaagugguuuuuuuuuuuuuuuuuuuuuugagauggagucucgcucuguugcccaggcuggagugcaguggcacgaucucagcucacuacagccucaaauucccaggcucaaguucaagugauccuccugccucagccucccaaguaacugggcccgcaggcacacaccaccaucaugcccagcuaauuauuuuuauuuuuguagagacagggucucuaugaaaauaugaauacucaugucuaggaauacguauaucuaauuuuuuuaaaaaggcacacaauuauuuuaauaagauauuuggaaguggcucaaaagcacaaagaaugcuacauucuuuccaugguguuuauuacaucauuuccguauuguguggauggaugucuaugcuguauguggucauucguuaucacaaacaauaccucagugagcucuuuacauccucaguccuugcuuuaugugcaguauauucacagaaaaacaauuccuugcaguagaauuguuggaucaaagucuaagcuuuuuucuuuuuguuuguuuguuuguuuguuguuuuuuuugagacaggaucuugcucuauugcaugggcuagagugcaguggugugaucauaguucacugcagccuccaacuccugggcucaaggaguccucccaccucagccucccaaauaguugggacuacaggugggugccacuacaccuggcuaaucuuuuauuuuuuuuuguagagaaggggucucgcuguguuccccagcuggauguguauuuuuuuuuuuuuuugagauagagucucgcucugucauccaggcuggagugcaauggcgcgaucucagcucacugcaacuuccucuucccagguucaagcaguuacccugccucagccucccaaguagcuaggauuacaggcgcccaccaccacgcccgccuaauuuuuggauuuuuaguagagacgggguuucacugccaggcugaucuugaacuccugaccucagaugguccacccaccucagccucucaaagugcugggauuacaggcaugagccaccgcgccuggccuggauguguauuuuaaauuugacuagauauuaccauccaguguaaugucaccaauucaugauuuccuaaaaacgugugagucucuaggacagauuccacuucacucuguuuccugauuuuuggguccaauuugucucauggagauuccacaaacguuccccucacuccagcc

SEQ ID NO: 18024 - RNA, 1046 nt, Homo sapiens
ggugaaaugggggcuauaaagacaagaggguggggggggguccccauggcccagggcaccccacgugggggcuacaugauguugcacuggguggccccgcaacaauccuugaucagugccagccccgucuuggccaccgugggcuugcuaggugggggcucugcuuucuucucugcccgggagccugcagcaagaugugggcacagggagagggggagaaaggaacagagagagagaggugaggugagcagagcccugaccaucugcagcccagccccacugcaaccccuggccaggucuuguuccaggccuuguucaggugguauggagagcugaugcacauuucauaugauccucagcugguccucauuuuauaguccucauuuuauaugguccucaaugcucagcuuccaacccuaacuuucagcccuucuccuagucagcuguuaucaucauuguaccugccaagccuagcacagggccugacauccaagaaguauuugguaaauagauaaaugggaaauuuuguucaagucacuucaaucugagggcucauauuuuucaauuuuugaaaaugcucauacauugucuuuucagauaccuccaccucccauucucuguuuuaucuccuagaaugccuaucacauguaaguuggaccuucucacucuauccucucgguuuuauaacuucucuuucauauuucucaucucuuuuucucuuugugcugcauucuguguaacuuucucagggcugucuuccaauguauaaauucucccuucagcugugucucuguauuuaauccauugaguuuuuacuuuauugauaaaaaaaaauuucagaaggccaguuuuuugcaugucuacuuauucuuuuuucauagcaucuuacuauuucauuuuggguuuuauuccuucucuuagcucuuugaucauuuaaaaguacuuaguuuauuuuccuuuuuaaauaguucuauauuuuugguucuugggaggacauucucuuuggugcaucuacugauucuccucauggugauucaguucuucau

SEQ ID NO: 18025 - RNA, 881 nt, Homo sapiens
ccccaaaucuuuuaaaugaagccagugacucccaguucucaacacauggccccagucaagacagaacaccauggaaaaaacccuguaaguauuauggcacucuccgaauccuccugaaggcauuuccucuacagacauaguguuacaggaagugaaaugcaaaugugcaauuuuuuuuaaaggagcuuuuaaacaaaguaauaauaauugguguugagaacaucaguugccuuauucuaagauuucauaaggcugaguuugcacgcuuggacuucaguucugcuagcauguaaagagugguggacuuuaaaaccguaagagguaucauuacaagucaccuggaacagacucaaagaacagguucuuugggcaacagacaaagaagaaucaaguucugugcugucccgugagugugucugaguaccauucacuggaguugcugcuuaggucugggacgugugugugacucuuaacaauugcugucugaaaaugagagagaagacuucggaagcacauuguguucauaauguacuccacaauggccaguccaauugcuaucuauuuuuuuauccagaggcuuaauuaaaugaugugguaaaaugauguuugagcauuaagacaauguaauucuuuauuucuggguggaaagauauaccggauuaaauuuaucuguuuaaaaaaaugacaaaaguuaucaccaaaacccccuuucccaucuugcacuguuuguuuuggauuggguuugggggaaagagauguuuuucuuaguugucuacuuuguuugaacacuuuuguugugguucaagugcuguuuuguguguugggaccaaacaguugucaauaaacuuuacaagcgagcaucuauuuugaguuucccaagu

SEQ ID NO: 18026 - RNA, 3682 nt, Homo sapiens
aaaacgggcucaguucguaaaggagccgggugacuucagaggcgccggcccguccgucugccgcaccugagcacggccccugcccgagccuggcccgccgcgaugcuguagggaccgccguguccucccgccggaccguuauccgcgccgggcgcccgccagacccgcuggcaagaugccgcgcuccuuccuggucaagaagcauuucaacgccuccaaaaagccaaacuacagcgaacuggacacacauacagguaaaaagagaaaaauauaucuagaacuacguaucuagagcuuugcaaauaugaaucuacguauuacccuucaaauaccauuacaaaagagccaaagauucaacuguuuuccuuuuuaacaguguccugaaagggagcuuacauucuuuugaucauuuaggguucguuuuaauucaaaacuuuuaaaauucuugacuaacaaggaacauuucauucaaaucucgcagcuucguuugcuaaagccuguguauacaugcauaaugaguaugugaaagaugagcaacauaaggauugaauuacugcguuuuucaugcacuaagucuccuuuccuuuagaaggcggcuugaugcaggcauaucuuuguacucacggucguaauacaccuaaauagcccauacguaacauggaaaacaacuuuucuguauguuuaaaaauaauguugaggcucuccuuccucaauggggacggcgaaggcacuggcuuggcugcacugucugacuucagagcaccuauagcuccgugcagcugucagccuaugugugcauuaaguacaguaacuccguaggugccaggguggaaaugaaacauuuuaccaguguguaugcccuccuaaaugggucuaucuucuuccuaagaaaaucacguguguguugcuaaauaucuuuccaguguguguauacuugcguguggauuuauuuuuaauuauuuuugccuuaaucuucucucccucccuuuucuuucccagugauuauuuccccguaucucuaugagaguuacuccaugccugucauaccacaaccagagauccucagcucaggagcauacagccccaucacuguguggacuaccgcugcuccauuccacgcccagcuacccaauggccucucuccucuuuccggauacuccucaucuuuggggcgagugagucccccuccuccaucugacaccuccuccaaggaccacaguggcucagaaagccccauuagugaugaagaggaaagacuacaguccaagcuuucagacccccaugccauugaagcugaaaaguuucagugcaauuuaugcaauaagaccuauucaacuuuuucugggcuggccaaacauaagcagcugcacugcgaugcccagucuagaaaaucuuucagcuguaaauacugugacaaggaauaugugagccugggcgcccugaagaugcauauucggacccacacauuaccuuguguuugcaagaucugcggcaaggcguuuuccagacccugguugcuucaaggacacauuagaacucacacggguaagagaaaaaccauaggcaggaauguuacucugagauacaaugaagcccugggcuggcuguuggauuugcaugaaguugugacauagugcuuuuaaugauggacagucauugauagcuacuuccugacuacucaaaaaguuguuagggcacaaagugcuccauuucuugcuaacaaccucugcuccagggacugcaaacagcauguagacuuuggaaaguagauucagaagguuuggucucaaagaucaguuagaaaaucaggaaagaugugcuugaauguguguucugugaaacugcccccaguaaucagcaaauacaaauguugcuaucuuaaucaauugauuugguuaauagaugaaggcuuuuccuacaguuuucuguuaguuacauucuugcucugauauuugucacccgugggugacuuggauaguugaaacuaaauuuacuuugccucucuugcuuuguuuggggauuuuuugcuccuuaauuucuuauucguaucacagaauuauucugcaggguaucauggcacuuagaccaccuuaaucauaguacagaaagagggaaaaggggaaauauugggaaauguugggaggugcucaacauuagcugcaucugcuaaagcagaaagcuuuaagaagugaaaguccaagaacuacguaaauuauuucuguaugauuggcagcaguaauaauauucguguaugauuuuuaaaugcaauauucaaguuuaucuuaaaaauucagguauuuuuaaaagugucuauuaugagggauuuuaaucagguuuugcugcuucucauuauuuaagcaaaaugugauugacuuuuguuaacaugauuuuacuuuauguuuccucuaaaaacacugacugucuuucuuuuuuucucccacuccacccccaggggagaagccuuuuucuugcccucacugcaacagagcauuugcagacaggucaaaucugagggcucaucugcagacccauucugauguaaagaaauaccagugcaaaaacugcuccaaaaccuucuccagaaugucucuccugcacaaacaugaggaaucuggcugcuguguagcacacugagugacgcaaucaauguuuacucgaacagaaugcauuucuucacuccgaagccaaaugacaaauaaaguccaaaggcauuuucuccugugcugaccaaccaaauaauauguauagacacacacacauaugcacacacacacacacacacccacagagagagagcugcaagagcauggaauucauguguuuaaagauaauccuuuccaugugaaguuuaaaauuacuauauauuugcugauggcuagauugagagaauaaaagacaguaaccuuucucuucaaagauaaaaugaaaagcacauugcaucuuuucuuccuaaaaaaaugcaaagauuuacauugcugccaaaucauuucaacugaaaagaacaguauugcuuuguaauagagucuguaauaggauuucccauaggaagagaucugccagacgcgaacucaggugccuuaaaaaguauuccaaguuuacuccauuacaugucgguugucugguugccauuguugaacuaaagccuuuuuuugauuaccuguagugcuuuaaaguauauuuuuaaaagggaggaaaaaaauaacaagaacaaaacacaggagaauguauuaaaaguauuuuuguuuuguuuuguuuuugccaauuaacaguaugugccuugggggaggagggaaagauuagcuuugaacauuccuggcgcaugcuccauugucuuacuauuuuaaaacauuuuaauaauuuuugaaaauuaauuaaagaugggaauaagugcaaaagaggauucuuacaaauucauuaauguacuuaaacuauuucaaaugcauaccacaaaugcaauaauacaauaccccuuccaagugccuuuuuaaauuguauaguugaugagucaauguaaauuuguguuuauuuuuauaugauugaaugaguucuguaugaaacugagauguugucuauagcuaugucuauaaacaaccugaagacuugugaaaucaauguuucuuuuuuaaaaaacaauuuucaaguuuuuuuuacaauaaacaguuuugauuuaaaaucucguuug

SEQ ID NO: 18027 - RNA, 17287 nt, Homo sapiens
uaugauuuaaagguuucagaaauuauuuauuguaguaguacuuacacguaagauuuuagccuauggucauuuuauaaagaugacuguuaggauuuaauucacauuuaaagaaaaugagauucguuauauuaugguguuuuuuaugaccuauaaaauacuuaccccuacaaauuuccauaaauguagugguuaguaaagcuuuuuucuuacugaaaaauaaugccagguaaccaaguauuauuccuuccaucauuuauuuaggaaaaaguuuuauguauuaggguaaagugguagaaguuaaccuagaaucuaauaaucuccaaucacccauuccugaucuaauaguagccaugagaaaaaaucucuagaaagaaucauaccucucaaaaaauaaaaaauaaaacaaaggcugggugcaguggcucacaccuguaaucucagcacuuccggaaguugaggugggcagaucgcuugagccuaggcauaucgcuugcagccugggcaacguggcgaagccgucucuaccaaaaaauacaaaaaguagccgggcauagugacauacaccugagcccaggagguuaagccuacauugagccgugauuguaccaguguacucuagccagggugacagaguaagacccuaucucaaaaaaagaagugccauaaaaaagaaaggcucuagcccuuuaccaaugaggugauaugcccaggcuaugccugucaucaaauccauaagcauacugaugauggccaugagaaaguccagcacacaaaccaugccccagacugcaucugugcauacacagaguaaaagcccugcugcuauacuauaaaauggcaccugaaaauaaucucuacgguauguuugaaaauuggcagguuuuuuuuuuuuuuuuuuuuuugagacagucucacucuauugcugaggcuggagugcaguggcgcgaucuuggcucacugcaaccucugccgccuggguuuaagcgauucuccugccucaaccucccgaguagcugggauuacaggcgcaugccaucaagcccagcuaauuuuuuguuaucuuuacuagagacgggguuucaccaucuuggcuaggcuggucuugaacuccugaccucaugauccacccacauuggccucccaaagugcugggauuacaggugugagccaccgcgcccggccagcauaguauuuuuauuuauaacgugaaaaaaaugaaaacagauacuucacuacaaauauugaacccaaguuagaaaauuuuuaugcagccaaaccaugacuuuaagcucuauuuacacugauggcggccaacugagaugcagaccacacccauguggcgugcagcaagcaggacaugcagggagccuuccuugcucacaaggcuucagagcaagcgcacggucuucccagucacugucaggaaaucaucaucugccagggcacgcagugcuucuucaaacauaucuuuaguaauugccuguggggaagagaaagaaaauaaauauuguacacgucaagucccuccuuuaccuguuagaaacacaauaauuauaauguuaaaguaccacccagaaucuuucucuuuuugguggcuguacacaugccuuaugcucuaaaucaggaguggaguagccagaugguccaugugguagacuuggcaucuguauaguccacguuguaacuaucaacucugcccucucagucacaacacagcgauggaaaguggaccagcacugaaagacugcauaguucuuuucacuaaacaacuaccuuacuuauuuacaaaaggacacccaaauauuucauaccuaaagcaaacuuauaacaacuaugaaaggggcauaacaauuuuuucuuuuuuuuuuuuuuugagauggaguuccgcucuggugcccaggcuggagagcaauggugggaucucagcuuacugcaaccuccgccucccagguucaagcaauucuccugccuaagccuccugaguagcuaggauuucaggugcuuaucaccacauccagcuaauuuuuguauuuuuaauagagacaggguuucaccauauuggucaggcugguuucaaacuccuggcugcaagugaucugcccaccucagcgucccaaaugagauuacaggcgugagcuacugcacccagccaaaaauuuuaauugugauuauuucuugaugauggcuuaugguucaucuuccuuuucuucauucuucucuauauuuauuauuuaauaaauaaaggaaaaaaacccaaaagcaauauuaaggaaaaagagaaagcucuaucaaacaaaaaauacauauaaacacuuacuaugucagauuguccccgaauaucuucaaaaaguugcugguauuuuagagcugguguuuugcccuuagauaaaauaagcuuuuucaaugcuucagcuaauucuucuuuccguuuacgagagguggcacucaucccugauuuaaaaagaaaucaaugaaaacauuuuugcuauuaugaaaugaaaugcuucaaauucucaaaaauauuccuuuaguaguaucaccuagaaagauaaggcgacaggggcugaguacauuugaagggaaugaguuuuuaauuauuuggaaauuucuguaagccacuagcugcugcuuuccuuaacagucuacacaucugugcagcaagcagcugcugcuaagaaacaaacaacuucucuaaaauggguuaacaaaacuucccagacagucaaggagacagaaucuccuuaaaacuauacacaaaacuggaauugaacaaugagaacacacggacacaggaaggggaacaucacacaccagggccuguugugggguggggggaggggggagggauagcauuuggagauacacguaauguuaaaugacgaguuacuggguacagcacaccaacauggcacaugcguacauauguaacuaaacugcacguugugcacauguacccuaaaacuuaaaguauaaaaaaaaaaaacaaaaaaaaacuauacacaaaacuguguguguuaaucaauauuuuuaucaagauaagauuaaagggcaacuuucaucagauucucaaagggguccuaauccaaaaaagguuaagaacuucuguuucaaaugauuuaacuguuagcuuaaaucugacauauaaacuacaugcauauugaaauaauuuucaaaagcuuuucuguucacugaaaauaacgaacccguaguaagaauagauauguccacgaugccaguccggggaucaguugcagacugcuucagagcuucccgauggaggcguuuggccucuuccacaucaauggcuucaacuuuguuagacaaucuuacuuuagcaugggcuucugcuaagcggauuaaugacucuagcugucgaggguaugcagaaaccauuccccggcuacugccaaucuuccucaugucuacauaagccuauuguagguagaaaaacaaaagcaaaagcaaaccuccuuggugacaacuuuaguuuugugggugaauuuugaacacuuaggcuuccauuaaguaaacggaacucagauaugguccugggccccggagcucaucaagugguagagacuacacagacagaccacagaaaucgcaggugaagacaucaacgugcagcgugcaguggugggugaacauauuccaacugggagaugcuugggaagaauucuuggagaggguggcaucuaacguagcucugaagaacagagacgggcauggcguggcagagggaaggaauguggcauguggggagaggagaaggcugugagcacucauagggagaaucaggccugucugggaaaagugcucacauggggcacaauggggcucauaaggauugcugggagaaugcugcaaagguaaguuguaucaauuucacauacagaugacacagucuuauuucuucauuaacaacccccaagacuaugacacacaaaaaaauuacauaaugucuguaacuuucaucuuagaauuuuuaggagcucaguuaggaugcaaagcucaucaaagcaccaggaaccuucuuaauaucacaaugcuugaauaaccuaaaugugccaucaugcacuucagcucauguaccaggaugcugaaaagugaaccuaaaagacagcucauucuguuuuuuacaagcaaaaggaagcuuacagaaacuggaugacuuuuucaguuuccaaauuacuguguaguguugccucuauuugaaaccaggucuuugaucuuaaauucacuaugcuuguaaguacuuaaacauauaaaguguguguacuaccuacauaaaugaacuauuucccccuuuugcaacauuuggaaagaucaauuuugcaauaugggaggaaguaauaaacaguuauaaaaaauaguauauugcuaggcgcgguggcucacgccuguaaucccagcacuuugggaggccgaggcaggcggaucacgaggucaggagaucgagaccauccuaacacagugaaaccccgucucuacuaaaaauacaaaaaauuagccaggcgugguggugggugccuguaaucccagcuacucaggaggcugaggcaggagaauggcgugaauccgggagguggagcuugcagugagccgagaucgcgccacugcaguccagccugggggacacagcgagacuccgucucacaaaaaaaaaaaaaagaaaaguuuauuauucuuaggcccagcaugguggcuugcgccugcaauccuaacacuuugggaggcagaggcuggcgcaucacuugaggucaggauuucaagaccagccuggccaacacggugaaacucugucucuacuaaaaauacaaaaauuagccggagugguugugggcaccuguaaucccagcuaauagggaggcugaagcaggagaaucgcuugaacccagaagcacaggccacaggcugcaguaagccgagaucaagccacugcacuccagccugggcaagagagccaggcucugucucaaaacaaggaagagaacaguauguuauucguaacaaaauaauuaauauuuuaaaggagaugauuggucaguuacauuaaugcugugggcuacaggcacaguaagccuuuuuucagcaggguuaccucgaugagagccuggcuggcuuccucacuuagccgcggcaugauggugcugugcgcguaggcaauguaguccuuuagcaccgccauguccaggagcuccuccucugccugcuccucgcucugguaguacagugcgaccagguggugagccagacgccugucauaggcuucguccugaggguccagcaagaggaagaucaaaucaaaccuaagaaaacaaaguaaaaauacuguuuuuccagcaccuugugaggccgaggcagguggaucaccugagguugguaguuugagaccagccuggccaacacggugaaaccuugucucuacuaaaaaugcaacaauuagccaggagugguggugccugccuguaaucccagcuacuugggaggcugaagcaggagaaucgcuugaaccuggaaggcgaagguugcggugagccaaguucgcgucacugcacuccagccuggccgacagagggagacucugucucaaaaaaacaaacaaaaaaacccaaaacaacaacaaaaaaacuguuuuccuaguugagacaccaauacaccuacaaacgacguacuaaagacugcuugagcaccacagaugugcagucaaugugcacccugugagcgccaucagggagaagcaucuuugccugguguggaaagggccuucguguccauccacucaccccacucacccugugcugucccuaguccuuaggucggcccagggaacggcuggggaccaaucagcugagucaaaggaagucuucccuuagggaaacguuacuauaauuuugacgauggaaaguuuuuuuuuuuuuuuuuuuuuugagacagagucucacucuguagcccaagcuagagugaagugguaugaucucagcucacugcaaucuccacucccccaggcucaagcaauucuugugccuccucagccucccgaguagcugggauuacaggcaugcgccgccacgccgggcuaauuuuuuguauuuuaguagagaugggguuucaucaaguugcccaggguggccucaaacuccugagcucaggcgauccacccaccucagccucccaaagugcuggaauuacaggugugagucacuguaccuggcugacaauggaaagauuugaaugaaaacacauucaacuguuuuuuugggaaaaaaaacuucugucaaaaaaaaagaaaaaaaagcaaguaauuaaaaccuaaaauccauuuaugaaaaauguccaauauuuguaguggggccaagagugaagauuaugugauugcacuuuaauaaaucuaacuuuucagagccucaucuacuguacggaauuguucucuguugacucucagcaguggcuuuaggacuaagaguagugagugacagccauguguaaacggcgugggagguaaacaucccaacugcuuaaaaaacaaaugagaacacacaucauccuugucgugaaaacucuugaccaaccaaauuugaaacaucuugauaagagugaagaguuuccauuagcaguugcugaaaucuuaguagcuccuuuucaaucucacccugaauauucuacaaaugaacaaaauaaaaaucuguuuuaauaccuugauaauaaaguaugaggcagcuggauguuuucaaugguuguuuuuuuaggauuccacugagacucaaugggauuugcugcugccaggacagaggugcgcgcauugagcugacagaugaucccagccuaucagagcaaagagugcaguuagaagccucucccugacgcuggcaauuaacaagcaccgucuucgcccggccaccuacuaaacccauauucccuccacugaguuucuauugccugagccauguugccuuuacugacuucagcaguucaccuggauaagcccuguccucagauucaugccaaggacugaguuuagaugaaugugugcuauaaccacaucuuucucaggaagcaggcaccuugcaagagcuuuaggacaaauucaaggcuaguacagcaauaaagacaaaacgugacacccuguagaagacauguugagauuuagcugaaauaugauguggaaagcacuuaucaaucuccccaaguuagaaccaagguagcacagcacaguuccacagacccugucuuucaaggguccacauauuuuaaacacguccauguucacgguggagaaggcgacucaccuuugcaauggacagagucugcuguuccaugacuucaugcaauaccgaucuuguacuuucauucaucuugucgaacucaucgauacagcagaugccguugucacucaggacaagagcaccugucugcaggaccagcugccuugucucagggucuuucauuacguacgcagugaggccaacugcacuggagcccuucccagacguguacuggccccuggggacgagguuguacacguacugcagcagcugggacuugcugguaccagggucgccacacagcaagauguugaucucagcccgaaauuugccccuuccagugugacuaaaauccuuccuugucccgccaaagagcugaagcaaaauucccuaaauaaucagagacaugucuaaacauucauuuucugcacaguuaacugagauguaguuuaaacuuuagagguacuuuucucucuuauaaagaacuacaauuaagaaaucacaggaagguauaaaaaggcucgugaaagugcuugauaugcuuuaaguuaucacugaccaguucaucagcaccuaucauuacaccagaaugguggccaugcaagucccuauucugacacuguguggccucuucuguuuagaaaccuaaguuuagaccagagaugaggauagacaaugcuaugauucuucucaaccaauggcaagucagguugccagcacuugcucuaacaggccacaacucuguccuuuauggcggauggcucgaguggcggaguggauguuuauacuauuugaucccaaagaauuguaaaucccaaccccuaguuuaaaauccacuguuaccuucuuuauaucuucauguucauaaaugcuuggagccaaggcugaagcaagccucucauaaaugucugguuuccuggaaaguuccuuaagcaauuccacacguuucucugaaaaaaguuucuguucugcuucuucaucaaggccaugcagacguuuugcauccguuuuccgauaaugaaugacaucaauguggguuuuguagacagacuucacauuacucacucuuggauugacucgaauaggcacagcucgauagaugccugagggcacaaccaggagaugcacuuuuaccuucccauaucuuccuccgaguggcucagcaaccagcguaggcaacaggugcacuucagagcgaggcaccacgucgggcuggcccuggaaagggugagcuccaccgucucuuaaaugacccucccaagcccaggacucaggcccacauugcaaagcucccgcuugcuaugagcaagcagggaaauagcagcaggaaacggacaagcucgaaagaaccaagguggcucaugucuguaauccuagcacuuugggaggcugaggcaggcggaucaccugagguugggaguucgagaccacccuaaucaacaaggagaacccugucucuacuaaaaauacaaaaauuagccgggcgugguggcacaugccuguaaucccagcuacucgggaggcugaggcaggagaauggcuugaaccugggaggcggagguugcggugagccaagauggugccauuggacuccagccugggugacgagagcaaaacuccgucucaaaaacaaaacaaaacaaaaugaaacaaaacaaaacaaaacaaaacaaaagagaaagaacccagguuucugcaaaugauagacccgaggacguguucaccugggcccacuagucagcagugcuccagggcaacuguagcuacgugagcaugcccacgggcacagucacccugagggugaaauggagcugcugugcuucuagcucaaugcuggguucgugguuguuuuuaauaagcaguauuuuuacuucccuaaguugaguguacagaaucugccuagcacuuacuugacugcaacaaaaugcuaaaauccuccagucauuaaaacuagacuagguccccccaaccuacccaccacccccgacaaaagcaugcaaaucaugcauucuucuggaagccaggcuccucacauacagaggucugaucugauguucgucuuuucuggauuucaaaccagaaggcuuuaacuccaggcugauuccugcagcuuuuggagaaagccuggccuuuccccguuacagcuaucucaacgcaauggcacagagcacuguccuuguuuauucagugggucaguguaauucuuguuuaacacaacaaaccaguuuacacacauucuuagaauacacacuauucuucacuccaauauaggcuagggauggaagauuauguuuaaaguggcccggaaugauuuaucucacagagcagcauugauacuuauuucacaucuacacagcacuuuccacagccccuuggccccaaacacucucacacauguaucaucacauuaacuccacuuuguaggugaggaaacaaaaauauuggacuaaauacuuuaucaaagguuucaggguagcaggacuggaaaugcgcacgucacucacuaaaaacuacgcauucuuucaaauucuccaugacuucaaguacuuuuacgacggaagauugccagugauaacugcgggacuucacacuggggaagaaacagggugagcacugccucacugaagacaagagccgaugcguggugugccccaggcccuccgcucaggagcagauucaggcacuccgcgaccgucgccaccuugcccaucaaugaagaaccgugcugccaucaacacucccuugcccccaaccaaaauccauugugacucuacagcaucaaaaggaggacugccacacucauauggugcugugcaaagagcacucuuguggcagcaagagaaggagaccuggguccuggguucugauuuaccguggcaucugagcuacugcugucuaugcaucccugaaccucagcuucuacacauggaaacaagucacugacucauuuuucucuguaacaaacaaauguuaacccuuggcuauacauuugggaaauuaaguaaaaauuacuuaaaacuccagcauuggugaguaauacuucucugagcugauggcauaacucaaaacuuuacccauacaagccugucugaggcugcucucucaugaugccaacaguacugacuugagacacacacagcuccaggauacugagguaucaagaggcgagugaccacacgaaccaugagcuccaacauucaaguuugggaagaacugaacaauuucauacugcugggccaugguacucaguuaaaaagguggcagauaaagcagggauauaccccacagucucaaagacaagcagugacaacuggagguagaacuggaccugugaccaaguccaaugacucacuaaagcacagcauugaaagcaagccagacaugcucaagugcuggugcaaaccuacacucuuaccuguaacauucacucuguccccaggcuggaccuugucaacgagaucauugugagcaaacaggauaacuguguguggugucugcccugcaggcaugucuuccggagacuccugaagcuugaucugaaggucagcaaacagagaacaugugggccacaaagagagggcagggggacaaaaucugcaugucuuuguacugcuuuugccauauaaggcugcagugcauauccccacauaaaugauuguccauguuucucauuauuuccuuagaaauuacuucuucuaaagaaguugcugcaacagacagcaacaaaacaggggaaggaauguagggagcugcggugggggaagcugagaugcuuuucauaaagcagggucgaggaaggccuuuccaaaccagguacccucugagaggccuaaggaugcugggcuuuucucuaagccacuuugggggccugcaugauucugagaauaggaggccaugugcuccugcggagcagggugccugccuuucugucuccagcucuccaucccaugcaacauuaaagaaaccaugcacacgcagucacagaaaaacucaaauccuguccucccacaucuuuacagucacaaucacgguaaauaagcaauuuucuaccuuccccucacuuuuuucugucauuuuaauaacuucaucuuaaaauuucaugaauauagagaaaaaagaccaaacuucuuagacaguaaaauuugugaaaaaauuucagaaaaauuccucaauccuuuaccaauggaaaaagcagaaugacauuuaaccaaguauucucaucucaaacguuugaagcauuuuaggccaugaaaauacagugucucuaacaacagacagugccacuggcaacagcacagggacagugcccugaagcaggggcuuugcgugcucugcauauuuagcccauaggccacuaacgaaacccacaagaccagagagggauggaugccauucgggaagugaggcucaggguccgagggacaaguuauaguuggccuuuugaggauacagacaggcaaagcauagccuggggggccaggguggcugcgcaccaucugcuugucagagaagagggagcgguuguggaugagugccaugcugugggugguguggcagcgcccgcacacacugggcucugcaaugcggccgcgguccaucuccacccgggucgugugggcacacacuuggcacuggaagaaggccuccugcaucucgggaaucagcugggauguccugaucaccaugccgcugauggugaugagcuggucaaugucugugaggggagaagagaggucagcacaccugaccugagguguggagguccaggaauagcugggaucacagacaggagcuaggugcccaagacucugccuagggcgaccuuucuguguccagucaucugcaggcuaugucuucaggagacucucaagcccagcgaaccucuggcccuucuuccucagggccccuguccagcaggcaucccucguucccuucuugucugccuacccugcucccugccuccugccucacucaccuggccuccuguaugacacccugcugugucaggaaaaaagccagacagccuggacugaguccugacccuagccuuucuguguacauuuuguguccccuauagaauggggugguaucagcaccuaucccagagccaaggacugaacgugccaauguacuucaagccuaguaagagcaccugguagagaaaaaguccucuauacuuuaaagucauuauuauccacacaggagaaccccuuagaugcucugaucuuucacucuugcucguuuccucuauuauuugaaccuuuccugacagacaacuuuuucccuuugaaggucccacugcccgcaacuaauuuccccugcugguuucagacaagcuacccuguucuggccuguauuuagccacugcuagccgugaagaucacccuauccugccacugauucaugagaccucuacaauuuuguuguuguugagauggggucuuaaccuguugcccagacuggaguacaguggugcaaucacugcucacugaagccucaaccugccaggcucaaguaagcccgucaccucagccucccagagugcuaggauuacaugugugagccacugugccuugcuaauuucuucuuaaaaagagauggagucucuuaugucacucaagcuggucucaaacuccuggccucaagugauccucaaaucuuuaaaaucuaauuuuuuuuuuuuuuugagacagggucucauucugucacccaggcuggagugcaauggcacagccucugcucagugcaaccuccgccucccggguucaagcguuucuccugccucagccucccgagaguagccgggacuacaggcgugugccaccaugcccugguaauuuuucuauuuuuaguaaaggaguuuugccauguuggccaggcuggucucaaacuccugaccucaggugauccgccugccucggccuccugaagugcugggauuauaggcgugagccacugugcccggccaauagucacaucucuuauaucagaaacuucaauuaaauuuaaaaaguauaggggguucauaaguauauaggauaacugaaucuauauuauugucaauuuauaauccgucaccuugacuaccaccgccaauuacuucuuucauaauuucucaaugaaaacaaggcuauuuucauguaaggcauuuuccuucaacaaaaguaauccuaugaaaaauacauuaccuucuggauucagguuucucauauucuuagucuucaaugcguugaauggucuuacuugaaucugauguucuaagauugagucaggguaacggucaaagaagauuucauugacagccaugucaaaaguuggaauaacuuccuguaaaaacaaauaugaagauguauuuguauucauaucucaguguuaaauauaauaaaggcaugucagauuagcaaaguauaaaaagacaacaugucauguccccaaaguauuacccuacagaaucaugcacgugcuguuuucaaauuuagguaugcugaacuaucuauuucugcauauuuucaauuggguuaaauuucauaauuuauacgaaagugccuucuugauguauacuggcauauucuuugcuuucuauuagaagggaaaaagauuuugaccucacacuuuauuuuccuucuauaaugaagugauaccaaaguaaguuuuuuauuuauuuauuuuuaauuuuugaggcagaguuucacucuuguugcccaggcuggagugcaacagcaugaucuuggcucacugcaaccucugccucugggauucaaguaauucuccugccucagccucccgaguagcugggauuacaggcauuugccaccacgccugacuaauuuuguauuuuuaauagagacgggguuucuccacguuggucaggcuggucuugaacucccaaccucaggugaucugccugccucggccucccaaagugcugggaucacaggcaugagccaccgugccuggcgauaccaaaguaaguuaaaucauauuuauucaaauuucuuaacauaugguucccauuuuacagaugaggaaacagcuuuugguuggcuaaggaacuugaccaagguuaugcagccaguaaucagcaaaaccaagauucaaaaaccaagucugcuugccuccaaagacuacacccagagucaacagagcugauacuucauuaauagaaacugaccugaggcuuagaaguaaaagucuacaguacaauauauucuuucaaagcagcaggaaguauguaauucauuuaaaguauuuccauuuaagauaacuuacuucaugaaacccaagaagcuaucaguuuuaagauucaucauuuuucuacaugaaaaacacugccaaguaaaccauaaccugucauugauaguaauacaagucccacuuucaggaacauuaaaaugugaaaaaaaaauguucaucuuaaaggagaugauacauaguuuuuuuuuguuuguuugagauggaaucucacuguugcccaggcuggagagcaguggugccaucucggcucacugcaccucugccuccgggguucaagugauucuaucgcuucagacucccgaguagcugggacuacaggcaugcaccaccaugucuggcuaauuuuuguauuuuuuaguacagaugggguuucacuuuguugcccaggcuggucucaaacuuccgaccucaagugauccauuugccucggcguccuaaagugcugggauuauaggugugagccaccacaccgggccaaaggagaugauacucaguuucuuaaaguguuugcgcauacuaucuucauuacugaagaauuucuguuaucuggaaacauucuuucuagacuguuacuaaaauucaucaaggucaaagcuaaauucuuaccuguggguaagagaugaguugucuguacaaauuuuugucaaaugauuugauguguucacaguucacauuuaaaaauggcucaccaauaacauuaaucuagaaaauaaaaaugaacaaguuauauuuugcuaauuuaacuauuuuaaaacacguaacuugaauuuaaagaguauuugauuaccuccccaagucguugcauguauagagguucaguaauaucuaugccaacauuuucuucuucuuuagccagagggucaauaaaacgcugaagaaaucucuuuaaguggagagaaaacuguauuaggcauauagcauuugggaacaggcaacuacuaaaaacacacaaaguuaugaguaugucacuaucaggagacagaaauaaauaauauuuuucuuccuuuuucuuuucuaaaauuuaauuuggagauggagucucacuauauuggucaggcugcuaucaaacuccuggccucaagugauccucccaccuuggccucccaaaguacugggauuauaggugugagccaccacagguggcccuucuagucauuauggcuacuuagauauagauuauaaacacggucucccaacauuuucagagcccaaaguaagaauuuuaauacauguagcucaccugaaaguuuucuuugcaugcugccacauuuacaucuguuccccagaucacaaguuuuuggccuagagacugcucacuugccacuauaucuucugcugcugccuacacagaaaaacaugacagaaucaugaaaacagaguuacccacaugauacccgccauaagaugguuucaggagacugcauacucaccccgucagacugcagauccacuugcaggcccuucugugcagagcccaggucaggccucugucucacaggugugccccuaacaccacuucuugggguucccucuacccgagagcugggagugccguaugucaguggugaacuaacaucaaagucaagagggauagcuauaaaaacaaaauuaggaaauucugguggcauaucaaaccugaaauuacagcauguugucuguugaucuauaccaucuaaucgcaacagcaaacugaauauuuauugcaaccugcgguggcugagauucugagcacucuuaaauguucuauuaaaaaaaagcaccagagaagcugcuuccucugcucacuaagcccuaaaacuacuauuuucugcacuccguucagcuccucugguuaagaacaugcucagucacgugcagaggggaugcuuuaggcguuaugccaacuguuauaaagccaguaaaccugagcagauaaagcaucagcuguguaucaagcacagcaaaaccaagaucuucagacacgcaccugaagaaugcauuuggggagggcuggaaaacagcacguccugcgcagcagggcucugcagguccacuccaggcgagguuggcaucggcugcaacucccccguggagguggaauccucgccucuacgucucugagagggagaugaccuggcauccucacuccgagcuugugucacacaaaacagaaaagacagccauuaacuuucagggccggccuuccuggauuugucuuuuccuuggggcauuaugacucaccacugaaccaaaccaaacagaggcaaauggcaaucgaauuaagcagcacccaggccacagccugcugugggugucugugcgcaccaagcggcagcgcccagcccgaggcugagcgcccgggucccgcgcacccacccagcgcugccagcugcggcgagagggcagacggggcggcgccgggggcuguagugggcccggcucgggggacucacgcgucugggcggggguggcccuuccacgccggcugccgcggcggcucggggucgacgccggggacgacauagugcucggaguaccugcgcgacaaggacaagcucgggccgggcccgccucccggcuucccugcccugcuccgcagcgcggacguucccgucggcuccgcgccacgcccuccccgccggcgcgcgguuaccguggaaaggcggccgcuugccgacgacgcucgcggacuccgaguccaccuggcgaguagcgcucccaaaccgcgagacccagaguucccgccggcggcaaggucgucuccgccccuggcggggccucaccaauca

SEQ ID NO: 18028 - RNA, 3745 nt, Homo sapiens
ccauccuguugacuuuauucuuuuucaccaaggaagccaaaacucuugacagagcacacugaauaggcaccacgccugucuuacaaaugggaaaaucaaaguccccccacgaguuggcgucaguagcguucacaucccagacugauccugacauuuauuuuuacaaaacaaaccaucucaaaacuugguggcaucaauauucauucugugcacagaacucuuguuuggacagggcuucauccggauagcuccacugggcauuagcgggugcccccaaggccggugggagucacagaaggcuccuacguccaggccacagcucuggccggacccccucacagcauguguguggaucccacgggccagcuggaagcugggcaccuuuccugaccaggcguggaacaucacuuggugucccuuccaccgcacuguguucaugagaagccagacacugaggccagcucaaacucagggaaaggcagugagacucacaccuuugaagggaagggcaccaaggagccacauucuaccugcuuuggccacguugucuggcuucuccagccucagucucuuuggccaugacaccauaacgaugggaggggugaguuaauagacaccaaacagaacugcuguagcaacugccaaaugccuugcacagaggaggaguguggggugcccaugauauuacucugcaagugacauugccuucuagggcuuuaaucucccagaaagccagagauggaauaucucagugcuucugagccuuuauuuucagcccuacccgcaacagcauucugcagcuugaucuauaauggggugcaccacacccucucagccuggucagggaugggggccaaggacucccuguaccugucucaucuggagacgaaacucaccugggacuaaccaaaaagaauuagaagaaaaagcgaagucucauuacaaaaacacagaggauuuuagcccaguauaacucuagaagaaauggaauccuauuaaggaaggaaguuuggggcaaagcaccaggaaaucccucaaccggaaguguugcuagauugaggaaguguccuaaaggaagugggagacagcugugggcacugugugcccagccccggccuucccagcagagucugugugcaucgugucccaaguaaaaacaauucaguuaccagaaugggguaguuccuucacuugcuaaaauaaauggguguguggguguguguguguguggguguguguguguguguguguguguaguggcucuucauuuguuucuccuuccuaccacuguucucagccauuugaggaguggaaggucguggacuggggaaagggccuuccacucuggcucucugguuuuccguguuguugggaacaguacgucccaggcuguuugcuuuaaccagcgugccuuuuaucacugcagagcuacgaagugaagaguguccucggaaaggaagugggguuguuaaauuguuuuguccaguccguaaccgcccacccgaccagcugcauuggauuggaggaaaucgagcuucugagugcaggaggggccucugcagaacacuagcgguugccgcaggaucugugaacuuugcaauguggcugcaaggguggugguggugguggugauuugggguaguuauuuguuaacuauggacacagugaacguaguuuacgaucuugaaaugaaacuuagauuuuucuggggaaauguucagauacaguuuugugaacuguaaaucaaaauaccuuuuucuacaguuuaucuuuuauuuucugcaaauuuaggaacauauuuacucguuuucacauugaaucuuaaguuuaagcucuucauuugguauuuaggcaauauaugagaaaaaaauuuuuuuuguucauuuguaauuuuaacaaguugaacauuuuaccaugauugaacauguuuuuauuacaguauuuaacauucccccaaagaauacccugcaaaguguaaaccuuugucccauacugugauauuacuguucugcuacaauaaaugucaaaccuaagcacuuugcaguucacuacuuuugggaaaauguucuagggaacuguaucacaggugaaacuguuacccauaaaguguagcucucugaacuggugugaucgugucucugcugaauggugguggggauagcuggcuccaccacacacaccuguuuuaauuaggcuggguaaugugcacggagagcaaagaucacagacuaaggagcagucagucggauauuugcuuugcuggcaaagauuuaaaccaagaauuaauuaucuuuggacacuauaaagauuuuguucccuuccuuauagcaauauaaucaugacaggccaugguuaacuacaucagauacacguagcagccgugaccaagacauggugcccuaauaccaaguguucuuggguuaaaggcaggcggcuuuuuaauuaaaucuuaaagcacugcaauuacuggcaagacagcuggucuuaagcaguuuugugacugcccuuuucauccacuacaugacuauuccggccuuucuggagcacuuuugaaaaucuacuugacucuguccacaagacugaggaaagugaaagcaaagucccgggaaagcgggagaugauucagcccgggguucugccccucgccccuccagcagccucuacaguuagggagcucuugaacuguucucagcaggggcccccaaaaagucaacccuuccccaggucugcguucuucgggagaacaccuucugcuggaaagcugcuagcuuaccugagcucagccgugcuccaccuagcuuaggcaaguuaaauaaggccaggagagagccuuuaaugcguuuuaaaagcgacagacccucucuccugaguagcucgggccugcgccccauccccccgccccccccacacacacaccuggcgcccgggcucccuggugcucgcuggcugcggguccggaacgcacccuucccgagccggguccugcgccaccggcgggcgggcgggagucacugcgaauauaggaagcaggggcgauuucaaaugcugcuuuauucuuacaaauacuguaaaaauuaauauaaaaaagugagcaugcucagucuuuuccucuuaucuacaauacaaaggguuugucugaaaagucugguuuuuuuucuuuuuacaaauguaccuuagcugcaucaacaggaguaagauguagaaaaagcuaccauuacaaaaauaauuuaagggaaaauaaacacguuuagcuucucucgcaguuuaguggugguaaguccaggcuguagcuucuuugcgcuccuaugucccaagaaacugcagcgggcacccggcggcucuggcugcgccagggcagggcgcgcuccgcuccgggccgucgggucugagguaugggucguugcugagucucucccgccccggccgcgcguuaccggcagucugcugucccggcggccggcaggaagggcgggcugggcagcugcuugaagaacugccggaggccggccaggucccgcgugagcugcuccacgcgcuggugcagcuucucguucucagccgacagcuccaccaacuucugcugcaucuccugguugcgccgcuuggccuugucgcggcucuugcgcacggcgauguuguugcgcucgcgccgcugccgguacucggggcugccgcgguccgggccccucuugccggcgcucuucucccgggcggggccgggcgcgggggucugccuggggcugcu

SEQ ID NO: 18029 - RNA, 441 nt, Homo sapiens
acuuuuuuuuuuuuuuuuuaacaagcacuggcaaauuuuauuaaagggaaauuuugcaugguuuauuuuucaccagucuguucuggcaugcuucuaauggugucagaaucaccuggaucaaugauagccagugugcauacucuguaguauuuuccucaugcugcgcccaguucaauauuauugccacuguagugauggacaccaguuuugaccaacauugcauaguacuccauuucugauuucuucaaaguuggacaguuguuacagagaaugaccaauuuugcuuugccuugucugaucaucuucagagucugcuuguaccccagcacaugcuucucacuuuuuauaacaaguuagagccuagaauugaucaacuccagcgacuuuuuugucuucuuugcagccaccaucuuucugccuuaggugugggauggcccccaa

SEQ ID NO: 18030 - RNA, 25821 nt, Homo sapiens
gggacgccagaagcggcuggacccggaaauagggguugucgguagccgccccgggaacaaggaccggagcuggauccgcggugcggcugugggugagcggcgggcugcgggacccucgcccggcggcucagaaaggcgggaagcgcacgcauuuuucuggcuuguuuccugaacguuggccggcggaggacccgcgagcucgggagagcgcccgggccgggcucugcauucuuguugccucuucccuggcgggggugauacucucccgcggggcuugcuguggggguucagggagguggagaugggcccgccaugugccugcagggagcaggcgcugugguuaauacuuuucuucuucgaacccucccacagcucuuuagggugagaucugcuguaccagucucacagguagggaaacugaggcucagggaagcugugcagccaccggggcccagaucggugcgguacacacccaggcagcuuccacucgccgcccccuaggcccuggcuggguuuugagggcacccagguucucugaccuguuaucuguaaaugaaguaggguacuuuugugaacaaauuagcuggaauccaggggcaauaauuucucgcagaagugaaagguaagauguuccuagucuugccuuuuuaucuucucaccuuuugaaacaggaccugagaggccagccuaacuugggcuugauggccagccaguccugggauucuuuugccaaggucaccugacacuagugugacuuguucugaaccuccauuuacucacaguuuuaaaaaauuacaacaccugccuuaugggguugcuggcgagauugaauaguguugauagcuauggugugccuacuacaaaggaggagcuuaagaaaugguuguuucccucuuuuccugauucuagaagcauuugguaaaguuacugaggugguaaauccuaggaauuuuaaugcuauucagaccacugcuaggccuacucccaggccacaucugcuuguuucuuuuuuuguuuguuuuguugcaggcagagucucacucugucacccaggcuggagugcaguggcgcgaucucagcucacugcaaccuccgcccccggguucaagugauucuccugccucagccuccugaguagcugggauuacaggcaugcgccaccacgcccagcuaauuuuuguauuuuuaguagagaccaggcuucaccauguuggccaggcuggucuugaacugcugaccucgggugauccaccugccucagccucgcaaaguauuugcucacugucuauuuaccgugagaaugcacaaagcaaaacccguguucuccugcugcuuacuuacuuucuaggagcuguaagacaagagcugaauaaguagauggaagcuguaccaaguguagugaugagugcuacaaggaagcaaagcugggcugcuguuccaucagagugcucacagaggcaggacaggaucaggcuuggggcacggguucuagaacaaccaaguccagccacuggagcucuggucucucugaccccacagucccagucuaggccaauaaaauggcagcaccuauuagcaucccugccuaggaugcuggcaggacugccuggucccugguguguccucauuaugucauacauaauugcugacuacucuguggcauagacaugagaaaaucugaggaaacauuuuaggacaaaauuuccuacuuuggaagagaugggaaacucagacccucacagaacaaugccccucugcugcgaguuuucccuuuuggccucuggcuucccagggugagagaaggggagucccuaaaucucuuuuaaaccucacuucugggccucugauuuugguagaaucaaaacuuccccagaacggagagcagaggccagucauaaucaccuugguuguucauucauucccucagcaggcauuuagugcaugcugggugccagaaauauggcaaugaaccugacaauugugggagagacagacugcugacgccagaugcagucuucaggaggggaggggcaggggucagagcaaguagacuaagggggaaaaguggccuaggccgaagccugcuggcgcacagggaggaaaggugggugcgcagcagagccuugggagaugcagcuggagcugucaugggccagagagcucaucugcagacagugucgucauuccacaaggccucggcucuuucacugugggaugguuguacauuuaaggggaacauccacuuacuuauuuugaggaaaaaagcaaauugucauuuuauuugggacagcuuucuggucaagauuacugauuucacuguaguccugugaucucuuaaguggggaacaagguugacagcccaaggccgaccuuggaccucuuccccugcacagcaugaugagcagcagaagccccuuuagugagggaguuccuuuggcauccuuucugaacaaugcccuuuacaacccuccuuuauuuuucugguuuuauuguaaagucccuugucuuaguucuugucccucagucaccuguguccaggcgcuaaauguaaaaggugcaaaagggaauguggugaggaggcacccccagcccugaccuccaggcccuaacacccacuccaggugauugcuuggacuguuuguuuugcguuccauccagacauaucgccucuucauaaucaagugcacacgugugcacacauaugugugaucacagauggcagugcucucuacacaccguuacaugcccagcuuucuuagcaugauuuauuucagugaucugauccacguuaguauguaccaagcagaugcuuuccuuuguaaugcugccaggugcucuacuguagagaaugccaugcuuuuuuuuuuuuuuuuuuuuuuuggagauggagucucacucugucgcccaggcuggagugcaguggcgcaaucucggcucacugcaagcuccgcuucccggguucacaccauucuccgcuucccggguucacaccauucuccugccucagccucccgaguagcugggacuacaggcgccugccaccaugcccagcuaauuuuuaguauuuuuaguagagacgggguuucaccacguuagucaggauggucuugaucuccugaccucgugaucugcccaccuuggccucccaaagugcugggauuacaggcgugagccaccgcgcccggccagagaaugccaugcuuuuauuuaaccaccucccuguugacagacaccagcuuguuucuaaccuuuuaucaugauugauaaugcugcagagaacuccccagugaugugguucaucacaggcaccaccgugcccagccugaggccacuccagcgcugcccuguccuaccuccuggggacucagaguccacauggacagucuugucagggcccaccacugacuccugugagucuccccaggugacuucacucucuaccugucucacagcccuugcccucccugggucagcaugccaccacccaggccccucuguaauuccuguuugagccucccacccucugggaguugcuucuuugacucccacuuccugcucuugugccucacuuccuggaccccacagagcacacccucuguggacccuccccaacccucaccucccucuucacccaacucagagucagguucuguccuuguaaucucuccccucgaacccugacccacucccucucccuccuacucaccuggacucucccaucuaacuaaauccagugcuuccucugcugugggccugcccgcagcaucaccaccuguccucccucaguggacagccguaccaugccuccuccuccaccaagagaagugcagccuuguggcagcucugcaucgccuggaugcugaccggcugccucucuugccccucacccucccaaggccaucacugcagcaguuccuuccccuccggcacgcagcuucucuuuuccuucucgccagagcagucccaucagcggagaacaugcuggcacagccaccauccugaaacaagaggggacagugcaccagccuucucccaucucccagguuuuguugagcucaccccaugcagcuuucaucugucacucaccacauggccccaucaggauuacccagggcucuguuugccagacccuacagucaggucucagcugccaucucgccuggccugucagugucccccacauggugauaacugcccugaagugcucuuuccuguggcuuucaggaccuuaccccuccugacucacccugcuagcuccucaucucccgacccccagccugggcuccuuccacauugcugccaccuccuccaggccacccaggcuguccaaugggcaggucccguuuaacacaccugaagucccacaucagacugccagucccuuccugucaugccuaagccaaagccauggguuguuccuuuugcuuuuuuguaaagaugaggucucauuguguuaaucaggcucuucucaaacuccuggccucaagugguccucuugccuucgccucccaaagcacuaggauuauaggugugagcccauggcaggugugagcccaugcccagcucugccucaggucauucuugacucaccuuccccucccccucccaugucccgccaucccaggucugccuggauucugacuucccucgcauccuccaccacugcuacccagggcccauucauccucuucuauguggcagccagagaggucccuuuaacacuugaagucagauuaucccacaccuaugcaaacccucugcugccucccagcaccccuagagcagacccacauucuacaccccugcucccucccucagccccaugagccccccugcccagccauauccuccccaaggaccucaccuucccugcuccuucugccuggacucuucucccaggugucacccagcccugcccugucccuccccugcucccauacuacagcaugaguucugggagggcaggaccugguguugcuuugugcuguauucccugcauccuggacuaggccaagcaugcaguagguacucaauaaauaacuggacuauuaaguucauuccaaggaguggaauugcugggaugugcacucggacuuugagagggaucccugaauugcugcacauagagguuguucccauuuaacuuccccaugcccucaucugcugugugugcaacgacuuugagucucucccuaugugauaagcacaagcucauuguaguucugaguuucuucugcgaguguuguuggacaugaugugauaccacaaagguacuuacguggugguuuucccuuuuuuuuuuuuuuuuuuuuuuguuugagauggagucucgcucuguuguacaagcuggagugcaauagcaugaucucggcucacugcaaccuccacuuccugaguucgagcgauucucaugccucagccucccaagcagcugggauuauaggcacccaccaccacacccagcuaauuuuuguauuuuuauuagagaugggguuuugccauguuggccaggcuggucuugaacuccugaccucaagugguccacccaccucagccucccaaagugcugggauacaggcgugagccacugugcccaucuaggugguaguuuuucuuuaugcugagauuauuuuauuuugcuuuuacuuuuuuugagacagggucuugcugucaccuaggcuggagugaaguggcuguucuauccacaggugcagucauggcacacaacagccuugaauuccuggccucaagcaagcgauccucuugccucagccuccugaguggcugacacuauaggcaugugcuaccacaccuggcuugugagauuuauuuuaaaagcacauguuuuuccuaauauuuucugguuucauuguuucuacucaaaccuuugcuagaucuggaaucgguuuuagugggauuuaggaagcaggagucuaacuuuauuuuuuuucacagcagauuucccaguugucucaauacgagucuuuuuuuucuuuuuuaauacggugcuauguuuauaaacaucagugcuacauuuauaaugacugaaaaaacaaaaaggguucaugugguuuucuuuuacuuggcuagcagguauugaaugucaugugucaggcacagaaagcuguugcaaagaccaacagugauucagacacaaagcccaucguguccuauuuugggggugaaguagucgcugaugauggcaugaugugaguggguuggaauggagaccuagcccaagagcugugggcacaggagggcugacuuacccugccagugguguugggagacuugagcugggccugugggccauccagcugcauccuccaggccuggcggagcuuucucucaggcagggaagcgcaggcacagaggcuucaagugcguguuugcuucgaugaugauauuugauuuaauuuggccagagcaugaccugcaaagcaaaagguggaguggaauaggugggagauagaugugacagaguccugaugucugcuuggggcuggaccgacuagccagagggucucaggcccaucauggaucagaaggaccuggggggcccagccugggcaucugcauuuuguaaaguguccuggggcguccaagugcuuugcugagcgggaggugcugcucucggccacgauaguuccucuuuccaggugaguccaccuguagguggaagagccaguccagagaggagggccaggcauccaccuggccugacccaucacuccagauccccaggccccagcaucuuccuagcauggauuuaggaauaaaauugaccugagaucacuggggccacuucaccuucccccaaauggagccacauucccaggaucaucucagccacuucagcugaccugguaguuuuuucuuguuuuuaaucucagaugucuucaaguuucccuaauucccuaauuuuucuucuucuugccucagguuggucuuguuuuuucuuuguuaaagugauuuuccuuguagugguguagguucuauugacagcauugcuauccugagugucuuuucuucucuuuaggagucagcauugguaauagugcugugcugcggaagaguggagucuaaacuuuuucauugccagugccccgaaacuggagugugaaggaccgagacaaaaugaagacugugcucaugguugcugaaaagccguccuuggcacagucaauugccaaaauccucucuagagguaggagagaccagcccugcuuuggucuguaagcacggucguuuauguguuacaggacauuuuuuccuaaugugauuccacccuggcugggguagauuugguucgggucggcaggugguaaugaagcaucucaguaugucacaguggggugcauuugcuuccacuccuggcaaugugccaaagcugggguucccauaaggcacaaggcacaauuuacaaugaaauugaaggacagucauuauccauaugcugggccugguggggcuauuagguacagguaguagaaaccagcccuggaaggaaggagacgcagccaggacuacaccccagucaaggucugaugaggcuaugccccaggcauugucaccccuggauacucccacuguccuguggaccucacgucacuccagaguagccaauggacugagcuauggccacaggcacuacugagacaccagggagcucgagagggaaugucugccacucacccccaacucuggccacuggggugguugguagggugcuguuucccccuaucuuugaauucccuccaaauaggaagaguuuuagaugcuggguacccagaaaugacaggcaccuaccuggccuccccuugguccagcaguugagaggggaagagacccucguucagcugagaaggcaugguccgcaggggacggugccccaaaaguggugcccggugcccagaagcugagaaaguacagcugaguauggucaguggagagggugagaauucgauaauuagaaggucccugguaaccgagaguagaucuggagucuguuuuaguaaacgaugaauaacguuucaaugaagugaggcaaaaauggaauugaagagugaaaacauaaauacagagaaagagcccaccccugccugcuccuggcucccggcagccuggggcucugcaucgagagugcucugugcuagguuguuggcagaugcuguuuucccugagcgccgucccaccucucagugcccaacuacccgcaccagucugcggaaugucgucacucaccacucuggggaaggaggacucuggcccucugggagguggcauccgggcuggggucuccacagggucuucagcucagcugaagcagccagucacuuugugcuuccucauccccagggagccuguccucacacaaagggcugaacggggccugcucaguccacgaguacacugggaccuuugcuggccagccagugcgcuucaagaugacgucugucuguggucacgugaugacccuggauuuccuggguaagccccucuacccuccauccuacugaagggaguucugcauggcacuggccaggguccaguugaagccaggagaugccucuaggcagggaaguuugucccaacuccaugagucauaaggccagcagaucaugaaguagcaaugagagggucccuggugcggugcccagaacccaggcucuggaacucagcccuggguccccaucauagcggcaccccuuagucgcugcauucccugugugccuuccuauguagacaaaguggcagcaccuaucuuaggaagggcuugaccugugcaggcauuuaagagaaggcugcugcuguugccaaguugaccgucaucugucggucauuugguggcugucguugucauuccuauauuguuacuguuaucaauuaccuuggaagcgccaguauuagugaccugcuggguguagguuuggggccaugugguuggcaagagucugauccaggcuuuucccccugcucugccggcucacuggcuggggaugugggcaaugacggccucugaguuuacacuucucauagugaaaugggucucacagcaaugccaucugcuucccaaggcuaaggauucagugugacagugagggcaaagcacucagcacagggcccgacacacagcaaagccucagcccuuguucuugcugcucauugaugacagugaugacaaugauggugacugaguuguguggcugagcauuuggaccccaaguuuuaucuccaacuggcagguggggagccgggauuugaauuuggcucugucugaccccauucucccaggaugcaagaaauggggccuggggaggaucgcuugagcccaggaguucaagacuagucuggacaacauagugagaccccugucucuacaaaaaaaaaaaaaaacaaaauucuuuuuaaaucagcuggcaugguggugcgcaccuguagucuugggaggcugaggugggaagauggacugaggcugggaggucgagacugcaguuagccgugaucguaucacuguacuucauccugggugauagagcgagaccccugucucagaaaaaaaaagaaauggggccuaaaagaaagccagacagcugagcaugcaagaaccgggucucuguagaugaguaggugaaugugcugggcaugaggcucaaaaagaugguccuuuaacaggaacgacugcacacaugugugcccccacagagugcuggguggaaggacaaaguuccagaaacucagguuggaagugucaaugaaggcaccauugugggguccagugcucaggcaaagagacccagcccaggaauggugcucccagccacagggaaagucccggaagugaggccagaguggcagccccccgagagcuugcuuggcuccugugguuggccggggugugguggguccgcucagcagccgagcagaaaggaggcuggaugggaggggguuaccaaaggccugaacccacauccuggcucugccucugaucaucaggaugacccugggcaaauuguucuccaagcuuuccccuccucauuugugggaugaggccaacauccuccugggguuaugauggucucggaggcugagcuccugugacucaaugucacugugacugguuuguaggaaaauacaacaaaugggacaaaguggaccccgcagaacuguucagccaagcucccacggagaagaaagaagcuaaccccaagcugaacauggugaaguuccugcaggugcguggggcuggccugggcaugagcacaccggggcuccccacccuccacagcugccaugucuuugcccacccuugcuugaguccuaaucccccuuggacaggggggccuuugcuagcuuuuucugugagugcccccugcuggcccacgaggcaccugcaggcacccccaacacacaaggcaguugccauugccaacccucaguccuggagagcaggccuucugcuuuuaaaauagcuuguuuggucgggggguuuuucuccuuaauuuuaaaacaaaugcauacagauuauggaaaauuagaaagugcagauaaguagaaagacagaaaaauuaugcauaaucauauuacccaagacgacugcuguuaucauuuaggguuauuucauuuuaacccuucuucugggcaguuuugggguauaagaucauguugcauuuauacuuuuuuuuuugguccaaaaaacaucaauuauaaacucaauucuuuucuguuggcugagccagccucaacacagccagcuccuuacccagcccagguaccaguccuccuaacugagguucagggccugggaccaagcccuguccuggaugggagcacugggggcggguggcacagaccgggucugcagcagguacgugugaaccugugcuguguggcagguggagggcagaggcugcgacuacaucgugcuguggcuggacugcgacaaggagggggagaacaucugcuuugaggugagugugaggcucacuuuguuccucacuuuuggccuuucugacaccagccccaaacugacaccagcagucagucacaucacuccuggggccaaaggagggaguaaacuguaccgguuuaaaaacaccucuccccucccuuuauucugaaacuccacagauacuuuuaacugcauaggcucuauuaaagguggucaguuguuccuccgcuugcugaggccucaacgguaugagugaacauaggaggggccaaauugucuggguggaugcagguuucagaaugggauugucuuggggcagcuugguguucagcaucuugugcccagcgugacuucucagggaccuuggguugaugcugguugauucccgaccucagcacugagcuccuuuugcaggccucgcucugcucaucuccugccucauccaggaugccuccugccuccagccaacccugggagcccugcagagaagcagguggcagcugcucccugugcacaccccaugccccaugcuugccccggccauggugcccucacaguggccaugacugcuggucucacuuggugcccuucagacuguuguucuaugggucgcccccgugcuccuguacccccagcucucacccguggcucaagagcuggucagugagacagagcugaggcaccuggcguugcaguacagcacccucagcaaaugcgaucacacucugucucuucccagauacccucuccuccccugcagggcggcuccucccugggggccuuugcaucugggaauggagaaugggggcagcucauggggcuuucucccuucagaaaugaagccacuuauucccaguaaggaagcugcguggccaggcuccggcggcgacccuagucccacugcacggccuuccuagugagucucggcuccaggaccccugcugugcuuuagcccgagcugcccccaccacaagcuaggaccacccguggccuuccugcucuugcccauuuccuuuccccuucauucuuuuuuccuucccugucuuuucuucagccucuuaaaauuuccacccaccccuccaaacccucccuccuagaaggcagggaaucgugucacaugggauggguuuggggacuaagaggucccucauguacuuggcaguagcauuuccugauuugguggggaugaaagcagaggauuagaagagagggcgggaguaagaagggaguguucgaguauguuucuagaugggaguaaaggaagccauguggugggguguuguggagugcucagggcuucuggaaaggcagggggauagaggagggucuggcaggugcaggaaaggggauagaggagggucuggcaggggcaggagagggagccgagcacacguguucuuuccuggaaggaaccaggcuucacagugggguggggagcuguggcagggaucugggaggugggucacagcuggccacuccccacccccagguucuugaugcuguucugcccgucaugaacaaggcccaugguggcgagaagaccguguuccgggccagguuuagcuccaucacggacacagacaucuguaaugccauggccugccuaggcgagccugaccacaacgaggcgcucucaguggaugcucgccaggagcuggaccugcgaaucggcugugcauucaccaggugcuggccacacccgcagaguccugggcacacccucacucucccucagccagagaccugccucuacuggucccccuccggggccccuaggccuccucgagccaggaugagcaacaggggauuucaccaacccugaagaaggccaggcacaguggcuaacaccuguaaucccugcacuuugggagaccaggauaggaggauugcuugagguuggcaguuugagaccagccugggcagcauaacaagaccccaucucuacaaaaaaaaaaaaaaaaaaaauuauuuuuuugagacagagucuuguucuguugccuaggcuggaaugcagugguacaaucucagcucacugcaaccucugccucccaggcucaagagauccuccuaccugagccuuccacuacaggugcuacaggugugcaccacuaugccuggcuaauuuuuaugcauuuuguagagacaggguuuuacuguauugcccaggcuggucucaaacuccugagcucaagcaaucugcccaccuuggcuucccaaagugcugggauuacacaugugagccacugcgcccaggcuaaacaaaaauuuauuuauuuuuuuguuuguuuguuuuuugagacagagucuuacucugucauccaggcuggagugcaguggcacaaucucagcucacugcaaccucugccuccuggguucaagugauucucaugccucagccucccaacuagcugggauuacaggcuccugccaccacucccggcuaauuuuuauacuuuuaguagagacgggguuucaccauguuggccaggcuggucucgaacuccugaccucaggugauccgcccaccucagcuucccaaaaugcugggauuacagguaugagccacugugccuguccaaacauuuuguuuuaauuagcugggugugguggugugagccuguagucccaguuacuugggaggcugaggugggaggaucacuugagcccaggaguucaaggcugcaaugaucugugaauccccauuaaugcacuccugcugggcaauacagcaagacccugucucuacaaaaacaaaagagaccuaaagaaaauuguuuauuuagcugacagagaucacauaugcccugcuugauaaaguguguuugucugugcucuggggguccugaggagagugugcaguagauggaauagaauagaaggcucccuggccugagacaguagaaaccucugucuccucucucacuggcucugucacccauguacacacaugaauccucccuaaggcuaugcccacucugcucccacuggcuucuaaguggggacaccaccugaugccaccuccuucaugcaccaccccuggccuugggcuggacucacauggguggccauaauagugucuugagugaaucagugaccaaaauaucuuuccacucccuccagguuucagacuaaauauuuccaggggaaauacggugauuuagacagcucucucaucuccuuugggccgugucagacuccaacccugggauucuguguggagagacaugauaaaauccaguccuucaaaccagagaccuacugggugcugcaggccaagguuccuugccuuucucuauucaugcuggggcuuucuggguuuggggcauggauucugagagucuuccaucaucaucagccggcaggccccgggcugagggcagaaguguggacggcuguaccuggaaguggucuguggugccuagggcugagggaccccagccuucaugggggcagugggaagagacugggccuguauaugcugaaucuggauaagugggaaugaguucagcucuggcagugcagggugaggucaccccacaggaaucaguggcuucaguggucagguccaagcacuggacugagaccauuggcuuucaaacuuuuuaaaauuccuagaacccuuucuucaaauaaaagccuccacagaagcucacuguaagacuuaauacagcuaggcacagugacugaugucuguaaucccaacaaccugggaggcugaggcaagaggauugcuugaggccaggaguccaaggcuacagugagcuacgaucgugccacugcacuccagccuagcaacacagugagacacugucuuggagcugcuguggcugacacggggcuugggacccuggcgguggccauaccuaccacuggccaggcacuggggauaggcagggguggugugagaaguaggggcucaggugcuucuuagggacacaucagccucagcuuugggccaccuuccugagacuggcugccugguuuuggggcaagugguggagagggccagaugucagcuugcguaucugcccaccugaacagguacagcugugagccauuacagccagggcuauuuggcucccagacaaggaccagcuucaucuguccugguucuuccuggcguugggcucaccuggagacuuuuucuugugcguucacccuuuauccuuuuuccugcagguuaacacugacaaagacagaucucuccuuuuggacugggaccgaguaagaguguuugaccgggagaucgcacagauguuuuuaaacaugacaaagcuggagaaggaagcccaggugugccugcuccacccacaucuaucacaguugccuugggugaggguggcccuuggaugccucccgcuggaggaacagccugugauccuaguccacgucuuucucccccuuucugaaacacagacaucuuuuuggaaagcugaaugguuacucccucauauacuccuaagauauuucugcccagugcaauagucacaguguacugcaugcccgcuccauaccaggcacuguccacaccugugaccuugucggaccccuuccacucuccccuuuccacgugacccgcuaggcauuaccuccguguggcaggacuccauuucacacagagauucaaacuaacaacuguagagggaccuuggugcacacugaugaacuugcccaaggucacagcuagcaggggaaagucuugagauuccaauugcaaucagcuugcgugcuuuuaugggauuauguuucuuacucagggcuucuaugaauugaaaggacaugcugcuuggcuguuaggaaaacggugaggugaccuggcugcauggguuggggacacaucuguggcuauugaaguaaacaugcuacaggcaugacagcuaccagauccgucgagacacagccuggccuccuuagccgccuucuccuuguccuucucuggccuuccuugagugcccuguugcccgccaugcuaucgucucaggcaucugaaacuucuaaagcugcuccaggcugucagcauugaucacauuccugcagagacacuguugccaccuccaggccucacgcuggggagcccagcuucacauaacaacuggccucuguuagcacccacaucugucugucuggaaugcagaaggcacugcccugaccagccuacgugggauuggcaagggccagggccugggguugaguuguuuggauuguuuuugccauaggcaaaacaaagaguugucucuuccgacaaguguucagcagagguagagaguggcaggaccccaacaaagcacagcucauagaugcacuccacuaaccugcaugguguuuacacaaauuccagaauaguuaccagcacuuaaaaauuacgagauuucauacuaaaauucugccuucuagcuucucuugaaaaaucagaagagguagcaauacuagcaggugcaggcagcagcccuccccacaacaaggagugguacuuccccugggacgggccccacuugccaucccuguagcuuggcugaugcuggcuucuguaggauuuccaucugcagcccuucugacuccuccucaaucuuccagguuuucucuuucccuagaaaauucuccagaaaagaauauucaaucacuugaggccaggaguuugagaccagccuggacaacacagggagacccugucucugaaaaaaauaauuuaaaaaguagacgggcaugguggcacgugccuguaauccuagcacuuugagaagcugaggcgagaggauuacuugaggccaggaguucauuuaagacuagccugggcaacauagcaagacccugucuguacaagaaauugaaaaaaaaaauuggucagacaugauggugugugccugugguuucagcuacacaggaggcugaggcaggaggaucacuugucccaggaguucagggcuacaguaagcucugauggugccacugcacuccagccugggcgacagagcaggacccugucucuuaaaaaaaacaaaauuugguuuuuuguuuguuuguuuguuuguuuugagauggagucuugcucugucacccaggcuggauuacaauggcguggucucagcucacugcaaccuucaccucccagguucaagcaauucugccucagcgucacgaguagcuuggauuacaggcacguuccaccaugcccagcuaauguuuguauuuuuaguagagacgggguuucaccaucuuggucaagcuggucucgaacuccugaccucaggugauccacccgccucagccucccaaaguacugggauuacaggcgugagccaccacacccagccaaaauuuuuuuuuaaaaaagaauuuucauucuuuuuccuuuccugguccugaauaaauauucaaucaagucuuuagacuguugggaagaaugaauuggagaaacagggagaccagaugaaugaaaccagacccuucguccacacaucuugauucccucuaugguggugucuuccuccuuccccaaaucauugacuguccugucuuccagguggaggccacaagcaggaaagaaaaggccaagcagaggccccuggcccugaacacuguggagaugcugcguguggccagcucuucucuggguauguagggacauuucucucaagucaccagaaggcuuccugaggcagguucagccuggagcagcgagugcccaggguugcaggauggugcccaaggcuucaaggggaucugagccucaggaggauuucacuuauccuuagguuguaaaggugguaaaguuggucaccaccugaggggaccuccugauguuagagucccugagcagcuaucccuggugaggggagaggccccagccagaugucaccuucagggaaccagugugaacgucgccccucagccucaucuccucagucuuuucuccuuaguaacgaggaggggguugggcuggaaagcugguggucucuggcagcugucagccccuaggcauuggugccccccacccccgcagggaacuaugggcaguguccucucaguggacacugagugguggcuccagcguccucagagggcagcaaugcugggagugguugcuagcuaagcgccugccucugcuggucagggaguagcaggacgagccccccugaguggccccaaagugcugugaggacagaaacacccaagggcucaaaauggggcugcgugcuaacucugucgucagccaaccccgagguaugguuauggcuccauggacaaugcauggggaguggugcucugaaggccaugugucauccccauggccaugagccccaugaggaugcaccgugggguagagugaguggcguuucccaucaggcccauccuggguguaggauucagccuuacgggugcgggauucagccucauacaagacuguguggcauaggugcccacccggccagcagcuuugcacuccagcugugccugcucagagccaccgucacccuccaggaggggccggccacaaugggggagccugagugcauaggccagggcaggcagcuggccauccccacguaccuggcccucugagaaccuccugucucucgcaggcauggggccgcagcacgccaugcagacggcugagcggcucuacacgcaaggcuacaucagcuacccacggacagagaccacccacuacccugagaacuuugaccugaagggcucucugcggcagcaggccaaccaccccuacugggccgacacggugaguggagccgggccggccucagcaugugugugugucacugaggccuugggaccaggucugguacgucagccaaacccaggcaggcagccgagcccagccacagacucugcucugucuucucucccucaggugaagcgguuguuagcagaagguaucaaccgcccgcggaaaggccaugacgccggcgaccauccccccaucacccccaugaagucugccacagaggccgaauuagguaccgcucucaucccauacccggugugcuuccagggagggaagggcgagcugcgacagugaagguugcaggcccuguuggcaaugugggggcuccuucagccucugccugcccuggcuguggggauggggggccaccuggaagaugagcuccauugcuaugggaccaggacaggagugaagagguagcagcaggugcuguugcagggaggcaagggggcagacgccacaggggacaugaaugaaaccaggguagagaguggcggugugggggagggggcagcacaccuccuaccucccagcuggccuaaggugguaccagugguccgagugccaggagaaggcaaaugaggaagggagagcagugcagguagagacaggagccaccuguggacagucugaguuugaagcaauggugucaugucacgagacaauggaaagacaggccaaugccugaagagcagucccgccagaagcagggacaggagguugugcaggauggugggagccgcagccagaaagaaaccacugaggcauggaggcuuguguucccuuccuccgcauuugcuuuuuuuuuuucuuuuuuugagacagagucuuguucugucacccaggcuggagugcaguggcccgaucucggcucacugcaaccucugccucccagguucaagcaguucacccugccucagccccccgaguagcugggauuacaggcucccaccaccacacccagcuaauuucuuuguauuuuuaguagagacgggguuucaccauguuggccaggcuggucucaaacuccugaccucaagugauccauccaccuuagccucccagagugcuaggauuacaggcaugagccaccacgcccggccuuccugcacauuuucuuuccuccuuccccaggauuugcaguguguccugcacagcggcucuguaagcaggagcuugcugcucgagcgagaguacugggggcuccucacggccagagcccccagcuggcucccaacugacuagcccuggccuguugcagggggugacgcguggcggcucuaugaguacaucaccagacacuucaucgccacggucagccaugacugcaaguaccugcagagcaccaucuccuucagaauugggcccgagcucuucaccugcuccgggaagaccguccucucaccaggucacaccacgggcccagccuuccuccucugugccuucaugggcagacaaacauucuacaucgugucuggggaugggaggcccagggucugaggccccggccacccaggcuggggacccugaguggcggcgcauaucucuccaggcuucacggaggucaugcccuggcagagcgugccccuggaggagagccugcccacuugccagcggggugaugccuucccugugggcgaggugaagaugcuggagaagcagacgaacccacccgacuaccugacggaggccgagcucaucacgcucauggagaagcauggcaucggugggugcgccugcccaggccccagagccggcuccgucuccaguacucaggcuucgagucuacucacaaagcugccccgccagcccugugugcccagcccagcaccccuccaugggcugguaucuggaaacuggugacccaguguguggccagccaggcagguccacagcgggcauccccuccugaggccuccauucaggaccuggccuucccugugaaggcccagaugugcccucgugcacuguggggugugcacacaccgacuaacgcccacaaggcugaagauuggcccagaugccaggugacucauagaaaucauauuggcaguccccugaguccacacagccagccugggcuguccugaaaucaggugacagggaaaugagaucucacaggagcugcuucccugggagagaacagaaaugccugucccaggcacagggcuccccaaagggugaccaggaaguuuccacgcaaaaaugggcagcccagggaguuuaucaaagcaaaaguguagucaccagugcacacuccucacaggagugguggccucacaaguccccaggccuggagcugugagaugucucacauguugggggccagccucacugccggagccuucuccccagguggcacucgcgccgcugggcacugccuguucccuggggcacuaccccuggcugacaggcucuggagaccugugggaugucacagccacuguguccaggcucugcuccagcaguggucauauagguggacucucagggagugucucuucccaggcugggguccuggugaccauggcgaucuuggcaggagagcagagcucugggcuugcuccucucagggguccagggcaccugccaggguccugaaauagcccucagcccacuguggagugugggcucugcucccccguguccucugcccucucgcauugaugggacacuggcuccuggcagcccuaugcuagccagugagccagacccaaucaccaauacaaguuugugacagugaagagggcucugguguuaccuucugaacaggagaguggucaggguggcccugugacugagcccccaggagugugucaaaagggccugaccagagccgccacagaggagcccacaccacgcgucauggcgcccggcagacucggggugguaguggcacacgccacccacagccugccacaccgggugcagagcuggccucgugccaagagccaugggcccucggcaggcuccuuagcccccagaggccaguuucuucccaugugagauucucuccgagcuacuuugggaaggugugugucaccuguccaugcuggugagcaugcagggagccccagccuccuuucugccccucugacuggcacccgccauagucaaaacgccucagccuccgcugcgccccucugccaggaaacuuccucugggugggagaguggaauccuggggacugggagccuccccuggggaucgugacgggccuugcagagagggaggaggugggagacaggaaguggacagaauuguccagguuuaggggagggcagcucugcagugagcuuguaagcaccuccguguucugguggaguggggcucuggcuccgggagcaggugggugccacaggacccaggcaggagaagccauagaagucacauuuuccaggcgcagaauaagcacugugaccuuggagaguuccuuaaccuccgagccuguugucucugccauaaagcaggaguaggcgcccuguacagggagggcugcccuuguguucucaaggcagaacaugaaaugcaugcaguuggugcccagcacagugcagggggagcucagggcacagcccucccuccugugaccgggagcagugagagggccugagcaccaggggccccgugacaggugauacagcacaugguucaguggggcauguccaaggcaggccaggaacccuggggccuuguacauugcaggcacggaugccagcaucccugugcauaucaacaacaucugccagcgcaacuaugucacgguggagagcgggcgccggcucaagcccaccaaccucggcaucguccuggugcacggcuacuauaagauuggugaguuccucaguccugcccccagggcccaccgaggcucccuggcuucucccuggauguuggcucugcugcccgcuccagacaggccccugcccuacagugaucccccagccccacacacacucccucaacacccgcugaaggggugcugccccaggacccccaggaccugcccagagcaggagcucaguguguuugaaggcugaacagaugugugagggaaccaaaaagggaggcgaaguugccucagcccuguucccuggagguuccccaggggccaaggggagagggaggagcacaaaacuggcccaagggcggccuggagcucaugugugaugugguucuagccacaggacaucccuggccacucugccugacauuuccaggugggaaaucaggaaaggucuggggucauaagagccagccugguaccaucugaggcuguggacugguggguagggcagaggccaggaggacgggccagagcgggaggggugaacagggcaguaucccugccugggaagggguggcauggcccugggugcgagugcucagggcaauaucugcccccugcccacuugcagaugcagagcuggugcuccccaccauccgcagugcaguggagaagcagcugaaccugaucgcccagggcaaggccgacuaccgccagguccugggccacacccuggacguguucaagaggaaguuccacuacuuugucgacuccauugcugguagagucugccucuggccugccccucaccagaggggugucucucugucagcaaggccaguaccuggggacccagguccccacgugggaccagcucccagaucugggcuucaggccuccguaggccaggucagugacaccuccuggcuggguugaaagagcaggugcauuaacaccacacauggccaggaacacgugccucugacgcacagggcugcugcccugccgugcugccaggacaguagaaaccaccgccuauagggacccuuucacacucagacccuugaccacguguugcggagccuuuugcuggggacugggagggagaugacuccugcacucugcuugcccgcaggcauggaugaguugauggaggugucuuucucgccccuggcggccacaggcaagccccucucacgcugugggaagugccaccgcuucaugaaguacauccagguaggugcagggaacacuagcucaggcaagcugccucaccccuguaggccucagcuuuaucguugaucagcaggaaucauguucuuuguccugguugucacaaaagaaugauggaacauaaagaggccuugccaaaaaauacccaguguccccacguccccuagaauacacagccauuaggccacgcaaacacacauggugcauuuuucccuaacaccaugccacuugccaucaugggcauuaauguacacacagagauuuuagaacugccuuuucugcacgcguggagcaagagccagagacucaugcuccuugccuggcagugugucacagguucugcaugacagauuacauacuuuguauuaugagaggagugggggugggugccaagucgguggccccagugacccucacgccaccugccuggcauugccgcaggccaagccaagccgccugcacugcucccacugcgaugagaccuacacgcucccccagaacggcaccaucaagcucuacaaggagcuccgcugcccucuggaugacuucgagcugguccuguggucaucaggcucucggggcaagagcuacccgcugugccccuacugcuacaaccacccacccuuccgagacaugaagaaaggugagugcagccacucccuccuguccacagguagcugcagucucuuuucagugccaaccccugccuugcaccaggcuggacucugaggggaccccucacccuggccuuuccugcacucauuggcacugagacgagagacccuggauguagcuggggcacugcuuaggccucagccaguggugccacccucucucugugucagaaucgagcaggcaacccuaguccacccucaggaccugggcacaggugugcagugcucccucuggagcugagugagcaagaggaugcagcagucgggggacccacccggugagcgggcacccccagucagcguccaccaccguccuccauccucauccucguccucauuacuggaggagggagcgcauguccaggcaggcaggacagagcaccgagccagaccaggaaucagcgggagugaggcaucugcccacauucaccgugugcucugcagaaagcucccucaggccucagucugcacccaggcugccccgggagugagaccccaucccugcccuccugcugccgccagaguagcugacagggugguuccauguggcccagugacaugagggucauguggcauuaccaguaacaagcuggcagcaaagcaaaggggggauggagucagcugaaacccacugggauggugccagcgaggggccuugaaaguugaggagguuucagguaagcagaaaacagggguaauggcagccaggagccgaaacaugagcaaggcuguccccaagagcaaggccaagaagaguuccuucugcugggacgagggauccaggagcuugaggcauugggagcaggcagcagagggcaggugggcacagugggcgugccuuuacagggcucccuucucccgccaggcaugggcugcaacgaguguacgcaccccuccugccagcacucgcugagcaugcugggcaucggccagugcguggaaugugagagcggggugcuggugcuggaccccaccucgggccccaaguggaagguggccugcaacaagugcaacgugguagcgcacugcuucgagaacgcccaccgcgugcggguguccgccgacaccugcagugucugugaggccgccuugcuugauguggacuucaacaaggccaaguccccacucccgggcgaugagacgcagcacaugggcugcgucuuuugugaccccgucuuccaggagcugguggagcugaagcaugcggccuccugccaccccaugcaccgcgguggaccagggagaaggcagggucgagggcggggccgggccaggaggcccccugggaagcccaaccccagacggcccaaggacaagaugucagcccuggccgccuacuuuguaugaugacccuguccucccucacccaggcugcagugccaugcagacaccucauggcacuucaaacuauuaaaaugcauuuuaucuuauccag

SEQ ID NO: 18031 - RNA, 3283 nt, Homo sapiens
caggcacacaggggugaauguguguuguccagcuuccagggcccccacugggugagaaggcagauuccaggggucaaaaugcauguuagaggccauagggccacugagggagcgaccccuucugcccagaaaagccagggauggcucagaauuuuagacacuccuccccacugcccuccuucucagccacagauggcuucaguguuucuuucccugaucugccccguggcucucuucugcccugccuaccugcuaaaagacgcuaacccuccugucgguuugcuuucagccugcugcgaccucccuuucuacccacuacgccuccucaacugcucagcucuguucuaugacauugaaagcagugacccaaucucacuucuuaaaacauuuccuucguggcacccagaaggccacuccuggagucauccccacuuugcuagccaugcucuggcccugugggacucagcccccuauccucauucauuccgcagcuccaucuccugcccagaccauguucuugcaggcccucaggccucuugaccuccguggaacacaagucgcuguggaaacagagcccauugcccauccccugccugacucuuccauccccaucaggguaauuaacuguaccacgagccuucuaguugcucagaauagaaacuucaacacugucccugccccuccauuuauacugcccgacucugucugcuccuguuugucaccauggcccugcccagcccaggucuuagacucucuccuuuagacagucguccccuucuugccagcccacccuccacaccagggucagagaggccuaaaagccccaucugaucaugccaugucccucuucaaacagaccaaaggcggccagguguggcggcucacgccauuaucccagggcuuugggaggcugagaugggaggaucacuugagggcaggaguucaagaccagccuggacaacauagcaaaaccccaccuguacaaaaaaauuuacagauuagcuggacauggugaugucuguagcccuaacuacugccuguagcccuaacuacucuggagucugaggugagaggaucucuugagcccagggguuugaggcugcagcgagccaugauugcacagcugugcuccagccugggagacagagcaagacccugucucuaaaaauaaauaaauaaaacacagaccaauggcagugcuucccuguuagcauaaagcuuggccugcccuguucccacagccccucaccccggcagcuccuauggccccauccgcccagggaccuuguggaccacgcacagccacuuccucugcugagugugcccaugggucccacaccccaggaucagcuuccuggagcugcuguacaaaugaccacagacccagcagcuuaaacaacagaagugugcuucauggugcuggaggcugucaucugagaucaggauauugacagaacuggcuccuucuggugguuugugggcaacccuuggcauucccuggcuuguagguucaucccccaggucucugccucauguuccccuggcauucucucugugugugugugucuguguccaaauuccucccccaaccuguuuuuuuuuuuuggagacagcaucuugcucugucgccuaggcuggagugcaguggcacaaucuuggcucacugcaaccuccaccucccagguucaagcaauucuucugccucagccuccugaguagcuggaacuacaggcaugcgccaccacacccggcuaauuuuuguauuuuuaguagagaugagguuuuaccauguuggccaggcuggucucaaacuccugaccucgugaucuaccugccuuggccucccaaaguacugggauuacagaugugagccaccgcacccggcccaaauucccuuuuucauagagacaucagucauuggaguaggggcccagccugcuccagcaugacgucaucuuaacuaauuccaucuguaaugacccuguuuccaaaugagcuccauucugagguacuggggguuagggccucaguguaugaauuuaggggggacacaauucaacccagaacacuccccaccccccaggguccccagcuggcaugggugauuccucugcccuccuguggccaggagccaucaucagcauggaugucaggcaguuuacuugcccaucaacagcccccucccaacuagccgcaggcucaaguaugguccagcuccccaccagaugguugugcgucugccuuugcuguccugugaccuuccugucccagcucccugaggacaggggccgcccugcuggccgugaccccucagcaugugggcugacaguuggggaaggggggcuagguguggucuccugcugggggcugccccucacuucccccuccucaucccuaggaaggccccgccaccacuugcugcugcucuggcccacgaagcaguuucacagcugcuacagacagaccuuuccgaauucaggaaguugcccagggaggaagaagaagaggaggaggacgaugacgaggaggaaaaggccccugugaccugugaguucuguuucuucugagguggccccagggcugcuuagcaggcaacaaagggugacgacauugugggaagcccauugauuggggucccuaagggugcuggggcccucgcucacaacggcagcagaaucaaggagcagagaaggcuugcggccccagugagguggaggguggcggucacagcccuccacaggucauauaguucccagucagcccacgaggcagggguggguggugcagacacccuccuguguccugucugacugaaguuccagaacagcccaggaaauuaaagaugcuuaucccguuucacagaggaucucacaggugaucgaucucuggucaugcagccagguucaagugcccucaguguuguaacucaguuaacaugcgcccgggcaggcgaagucaggguuggccagguggcaugccagcaggucucggggcagcagcgugguccccucaacgcucgggcccccugccucagcugcccccaagucaggauucuguuggguggagacgcucuacgguguccaugagccccaugguuagaugcugguggaagcuugucugucagccugcuccugggacagccauaagcaugguguggccaggggaacccagaaauggagagggcugcagauccauuucacagaggauauaaucauuaaaaagcagggcuuuuauuucaugugacuuucuuucauucuccuaguaauuucauuuuauuauauuu

SEQ ID NO: 18032 - RNA, 3283 nt, Homo sapiens
aaauauaauaaaaugaaauuacuaggagaaugaaagaaagucacaugaaauaaaagcccugcuuuuuaaugauuauauccucugugaaauggaucugcagcccucuccauuucuggguuccccuggccacaccaugcuuauggcugucccaggagcaggcugacagacaagcuuccaccagcaucuaaccauggggcucauggacaccguagagcgucuccacccaacagaauccugacuugggggcagcugaggcagggggcccgagcguugaggggaccacgcugcugccccgagaccugcuggcaugccaccuggccaacccugacuucgccugcccgggcgcauguuaacugaguuacaacacugagggcacuugaaccuggcugcaugaccagagaucgaucaccugugagauccucugugaaacgggauaagcaucuuuaauuuccugggcuguucuggaacuucagucagacaggacacaggagggugucugcaccacccaccccugccucgugggcugacugggaacuauaugaccuguggagggcugugaccgccacccuccaccucacuggggccgcaagccuucucugcuccuugauucugcugccguugugagcgagggccccagcacccuuagggaccccaaucaaugggcuucccacaaugucgucacccuuuguugccugcuaagcagcccuggggccaccucagaagaaacagaacucacaggucacaggggccuuuuccuccucgucaucguccuccuccucuucuucuuccucccugggcaacuuccugaauucggaaaggucugucuguagcagcugugaaacugcuucgugggccagagcagcagcaagugguggcggggccuuccuagggaugaggagggggaagugaggggcagcccccagcaggagaccacaccuagccccccuuccccaacugucagcccacaugcugaggggucacggccagcagggcggccccuguccucagggagcugggacaggaaggucacaggacagcaaaggcagacgcacaaccaucugguggggagcuggaccauacuugagccugcggcuaguugggagggggcuguugaugggcaaguaaacugccugacauccaugcugaugauggcuccuggccacaggagggcagaggaaucacccaugccagcuggggacccugggggguggggaguguucuggguugaauuguguccccccuaaauucauacacugaggcccuaacccccaguaccucagaauggagcucauuuggaaacagggucauuacagauggaauuaguuaagaugacgucaugcuggagcaggcugggccccuacuccaaugacugaugucucuaugaaaaagggaauuugggccgggugcgguggcucacaucuguaaucccaguacuuugggaggccaaggcagguagaucacgaggucaggaguuugagaccagccuggccaacaugguaaaaccucaucucuacuaaaaauacaaaaauuagccgggugugguggcgcaugccuguaguuccagcuacucaggaggcugaggcagaagaauugcuugaaccugggagguggagguugcagugagccaagauugugccacugcacuccagccuaggcgacagagcaagaugcugucuccaaaaaaaaaaaacagguugggggaggaauuuggacacagacacacacacacagagagaaugccaggggaacaugaggcagagaccugggggaugaaccuacaagccagggaaugccaaggguugcccacaaaccaccagaaggagccaguucugucaauauccugaucucagaugacagccuccagcaccaugaagcacacuucuguuguuuaagcugcugggucuguggucauuuguacagcagcuccaggaagcugauccuggggugugggacccaugggcacacucagcagaggaaguggcugugcgugguccacaaggucccugggcggauggggccauaggagcugccggggugaggggcugugggaacagggcaggccaagcuuuaugcuaacagggaagcacugccauuggucuguguuuuauuuauuuauuuuuagagacagggucuugcucugucucccaggcuggagcacagcugugcaaucauggcucgcugcagccucaaaccccugggcucaagagauccucucaccucagacuccagaguaguuagggcuacaggcaguaguuagggcuacagacaucaccauguccagcuaaucuguaaauuuuuuuguacaggugggguuuugcuauguuguccaggcuggucuugaacuccugcccucaagugauccucccaucucagccucccaaagcccugggauaauggcgugagccgccacaccuggccgccuuuggucuguuugaagagggacauggcaugaucagauggggcuuuuaggccucucugacccugguguggagggugggcuggcaagaaggggacgacugucuaaaggagagagucuaagaccugggcugggcagggccauggugacaaacaggagcagacagagucgggcaguauaaauggaggggcagggacaguguugaaguuucuauucugagcaacuagaaggcucgugguacaguuaauuacccugauggggauggaagagucaggcaggggaugggcaaugggcucuguuuccacagcgacuuguguuccacggaggucaagaggccugagggccugcaagaacauggucugggcaggagauggagcugcggaaugaaugaggauagggggcugagucccacagggccagagcauggcuagcaaaguggggaugacuccaggaguggccuucugggugccacgaaggaaauguuuuaagaagugagauugggucacugcuuucaaugucauagaacagagcugagcaguugaggaggcguaguggguagaaagggaggucgcagcaggcugaaagcaaaccgacaggaggguuagcgucuuuuagcagguaggcagggcagaagagagccacggggcagaucagggaaagaaacacugaagccaucuguggcugagaaggagggcaguggggaggagugucuaaaauucugagccaucccuggcuuuucugggcagaaggggucgcucccucaguggcccuauggccucuaacaugcauuuugaccccuggaaucugccuucucacccagugggggcccuggaagcuggacaacacacauucaccccugugugccug

SEQ ID NO: 18033 - RNA, 21970 nt, Homo sapiens
uuuuaaaaaaguaugaagagaccaggacaucaaucucaagccccuucucaguuuagcagauagcuugcucuagaaauacuuuuggguggcuggguuguccugaagguggcagggcuucaguugauacuugaaucccuugaaauaaauugauuuuucagauaaacaauuaaaacauuccugucuuggccauagguuuaugaaccaugguguguucauuuugaucucucuuuccuuccaggacaacccuccauaugauaagggagccuucagaaucgaaaucaacuuuccagcagaguacccauucaaaccaccgaagaucacauuuaaaacaaagaucuaucacccaaacaucgacgaaaaggggcaggucugucugccaguaauuagugccgaaaacuggaagccagcaaccaaaaccgaccaagguaagacaugugccugugucuuccucggagggggucuuugggggugcugcucuggggugggggcuucugguaccagaucagacagaauccagagaaucuuucagguacacgaaaaauguagcugagguccugucagaccuugugggaauggcucaucucagcugaacuuuugaccuguauaggguuugaggaggccuuuccagugcucagcccugggcugccauccacagugggaacacacauggacagacaagcccaguggcuugcugcuggugcagagaggugcaggcacuggucccuggaagggaugaaggacuguggggcugccuacaaggggaagggagagugggauuuaagguggccucaugcaguaguuagugccugaacucagacuugaaggaggaaaggagguuggagagggccuuccaggcuauaggaagggcaugggcuagagccuaguugcucgggugaugugaggggagggacagaggcagauguaagggcaguauucccagaugaaggcacguaguuggcuuuagugggccugggauucccuggaguuggauguggcugugcguggugcacaugucuguguguggcugugugaacauaaacaugcucauucuucugggaagaauauuugagucaguauugugguuguccucccuuuuguccccuagaagugacuaguuuguuauggacugugucugguuuucauuuaauucuagacuuucuuuugaaguccuaaucucauauuuugauggcuuccuuuuaaguaccuaaaccaguauaaagucuguuuagauuagaguggaugaagcuggcacuugagaggcugcaaguggaggguuucuuuuaggggugcugcucuaggguaggggcucauggguccuuccugaugccagaucagacggaguccagagaacuccuaccuuaccaggugcacgcaaaguauggcugaggugccaccagucccugugggaauaacucagcugaacuuuugaccugcacagggauugaggaggucccuuguuuuagugauugaaaaaagccuuggaagguggaguucaaagccuugcgcaagaaaaaucaagccucacuuguuggaaguaaucaccaugaaaggugcccauuagacucccacacugaguagaagaaaggagugggugcuaaacauucagucagggcagaacagucucuagugggcuugguccuuguuuguguacaagcugauguuuauaaaagcuugacacaguucuucucagugccugguuuuuucuuuucuuuucuuuucuuuuuuggaaacggagucucgcucugucaccaggcuggagugcaguggcgcgaucucugcucacugcaaccuccgccucccgaguucgcgccauucuccugccucagccuuccgaguagcugggacuacaggcacccgccaccacgcccggcuaauuuuuuguauuuuuaguagagacgggguuucaccauguuagccaggauggucucgaucuccugaccucgugauccgcccgccucggccucccaaagugcugggauuacaggcguaagccaccgcacccagccgauuuuuucuuuucuuuucuuuuuuuuuuuuuuuuuuuuuuuuuuuugagacggagucacccaggcuggagugcagugaugccaucccagaucacuguaaccuccgccucccggguucaagcaauucuccugccucagccuccugaguagcugggauuacagccaccacgcucggcuaauuuuuguauuuguaguagagacgggguuucaccacguugaccaggcuggucucgaacuccugacauuaggugauccaccugccucagccucccaaagugcugggauuacaggcaugagccaucaugcccggcgagccugguuuuuuucuguacagauuccuagcacugucgaaaaccuauagcugcauuugaucaagaguguucaguaauuccuggaguccuugccgagucaugucuguuaacccaucgugccuggggaguggcaguccuuccaggccagguugcccaggaaagcccugcaccucagguucuggccacaaagaguucugaggcuccucccuuaccuguagacugagaggguggggcuagggccagggaggcucucaggagauggaugcacgugcuuugccaccucucauggggcugcugcauagaaggccguggcaggguuauucacuuuuuaccuuccuauccaggugcacugccaaaaugcucugcuuuuucagacuguggcugcuucucccccacccccaagagccaaauaacuuaggggcagcuuuuaauuuuuuuuuguaaaaaguacuguugacuugggauuuuuaagguaaaaauuuugguacaggagcuauucugugugccaugauggacagaacuggaauugcuauuuugugauuugggacaguugaggauuccuuccuagaacauuauuauguagauuguuuguggcauggccuugauccccauccucacauacaucaagaauguuguuccuugcacuugacggccacauucccauguuuguuaucuauuacugcauuauaaccccuaucaaaacuuuguggcuuaaaguaauaccaguuuauuaguuuuuacucuggagguuggcugggcuuagcuacaugguucuacagcugacuguucauuccuggggucacucaugcagcuguauugaggugggaacucaacuuggcugggaagagcugguaggcauagugcacaugugcggaaaugguauuagcuaaggcacuucgguucucuuuguguucucuuauuuuccacaaggcuacauuggaccccuucauagcaugguggucucaggguuccagggugaaggcauagaacugguacggugucacuucuguggauucuuuuggucaggcaaguccagauuuaaugagagggaaaauagacuucagcucuugaugggaggaguaugcaggaugggagacaugauggcagaggugggacaggcaggcaagguugcugaguccccuugcugccuccucaggcccacuugggccugcuuuucccaaauggcagcuccucuggacaugccauuccuucucccaccugccugauucuucauauguugggugucccuguuuuucuggugcuauuuccugacugcuguucagcugccacuguccugcaaagccugccuuuuuaaaugccucaccauuccuucauuuguuucuuaaauaugggaagugaaagugccaccugaggccgggcacaguggcucacgccuguaaucccagcauuuugggaggcuggggcaggcagauugcuugagccaaggaguuugagaccagccugaggaacauggugaaaccccgucuguaccaaaaaaaaaaaaagaaagaaagaaagggaaaaagccacuugugccacccuccugcuguaaucuuccagcgcucuuccuuugucuccagagcaccugcucaugauuuuugucuccugcccuuguccuuagaaacuucagcguucccaauuauggcuucucucagauccagccuugaaguucuuugaccuccucaauucacaaccuguagcugacuuuagccacccacaaguacagaaaaguaagcauaauggaagaaauaguaauaugaaaagaugcucauaugacccagcaauuccacucuuagcuauaucuacccaagagaaaugaaaacauaugcccaauaaaaacuuguacacagauguucauagcaccauuauucacaauggauaagaagugaaaagagcccaaauguccaucaauuggugagugaauaaacaaaaugugagccaggcgugguggcucacgccuguaaucccagcacuuugggaggcugaggcggguggaucaccugagguccggaguucaagaccagccuggccaacauggugaaacccugucucuacuaaaaauacaaaaaauuagcugggugugguggcgggcgccuguaaucccagcuacaugggaggcugaagcuggagaaucacuugaaccugggaggcagagguugcagugagccaagauugugccauugcacuccagccugggcaacaagagccaaacuccgucucaaaacaaaacaaaacaaacaacaaaaaaugguguaucucuacaaugaaauauuauuuagccauaaaaagcaaugaaguacugucuuaugguacauaaaccuugaaaauaugcuaaaugggccgggcgcgguggcucacgccuguagucccagcacuuugggaggccaaggcgggcagaucacaaggucaggagauugagaccauccuggcuaacauggugaaacccugucuuuacuaaaaauaaaaaaaauuagccgagcuugguggcaggcgccuguagucccagcuacucgggaggcugaggcaggagaauggcgugaaccugggaggcggagauugcagugagccgagaucacgccacugcacuccagccugggcgacagagcaagacuccgucucaaaaaaaaaaaaaaagaaagaaaauaugcuaaaugaaagaaccauccauggaaggccacauauuguaugauuccauuuguaguugagccucauuguucauagagucugcguuugcgaauuugccuacucacuaaaguuuuuuguagccccaaaaucaauacucucggcacucgucuaucacagaugugugcgugugcagagcagcaaaaaauuugaaguaccccaugcacguguuccagcugagguugugugguugaacagugcgaugcccugccuucuuguuucagcucucaacugaagcaagugggcugucuaaugccaaacuucuuggauuuugugcuuuuuguuggugauuuugcuuuggccccaaacguggugcugaagugcugucuaguauuccugagcacagaaggucaugauaugccuuuuggagaaaauacaugugugagauaagcuuuauuugggcaugaguuauagugcugcugagucaauauuaccuauuaaauaaggugucuuuaaacacacauaaaacaaaguuauauauuaaucagcuggcaaaaaugugagcagaggcuuguuugaaccuaaaccucuguuucccuuaggagcaaugauucaguaucauuaauucaauguucauggcaaguuuauagaacauaagcacuacagauaaaauucagcuguauaugggaugcucagacuaggguggauccauugagacaaaguagauuagugauugucagggucuaggaggaggagaauaggaagugacuacugagaguggguuuucuuuuugggggaugaaaauguuccaggcugggcguggugggucacgccuguaaucccagcacuuugggaggccgaggugggcggaucacaaggucaagagauccagaccauccuggccaacguggugaaaccccgucccuacuaaaaauacaaaaaaaauuagcugggcacgguggcgugcaccuguagucccagcuacucaggaagcugaggcaggagaaucacuugaacccgagaggcggagguugcagugagcugagaucacgcuacugcacuccagccugggugacagagugagagcgagacuccaucuccaaaaaaaaaaaaaaaaauuagccaggcguggugacaggcaccuguaaucccagcuacuuggggggcaaaaaaacaaaacaaaacacccccccccuuuuuuuaaagcacauuccauggaaggcuacaacauugcauaucuuuuuggguugaagguacauugacauuuuauucuuugacaaugaagcucccuggauuuuuaugaaaaggaggggaaaucacaaauauuguuuacauccgcuauugcagagaaacugucauuaagaacaaaagggccaggcacgguggcucaugucuguaaucccagcacuuugggaggccgaggcgggcagaucacgaggucaggagaucgagaccauccuggcuaacacggugaaaccccgucucuacuaaaaacaccaaaaauuagccgggcgugguugcgggcaccuguagucccagcugcugccacugcacuccagccugggcaacagagcgaaacucugucuuaaaaaaaaaaaaaaaaaaagaaaaggaacaaaaggaaggaaauauuauaggcuuuauucucugaugagaauauagugagaguaaaagguaaaauuggcuaauuuguuguguggguuuuuuguuuuuuguuuuuuguuggggggacagagucucacuuugucacccaggcuggagugcaguggcauaaucuuggcucauugcaaccuccgccuccuggauucaagcauuucuccucccucagccucccgaguagcugggacuacaggcgcaugccaccacaccuggcuaguuuuuuguauuuuaguagagacaagguuucaccauauugcccaggcuggucuugaacuccugagcucagacagucugcccacuucggcuucccaaagugcuaggguuacaagugugagcugcugcgcccggccuguuguauguuuuuaagccccuacauuuugcagaaaaaaaaaguacuucugaggagcauuugggucauggaagagaccaagaacccagggcuggauguuuuauaaaauauaauuuuaauaugcuguccuauauaugaaaaauguugauagagggccacaguuguaauuuguaaagcagacaaucugucagguguucuuacuagcaaaauaaguucagcucagcugaaguuuauuauaguuuagcuaaggagccagaaaugcacccaggggaacagcgaaagaaugaaauacuuaucagaacuacuaaguaaauuuaaaaauacucagacuugaggccgggcaugguggcucaugccuguaaucccagcacuuugggaggaugagauggguggaucaugaggucaggagaucaagaccauccuggguaacauggugaaaccccaucuuuacuaaaauuacaaagaauuagcaaggcgugguggcggaugccuguagucccagcuacuggggaaguugaggcaggagaaucccuugaacccaggagguggagguuucagugagcugagauugugccacugcacuccagccugggcgacagagugagacgccaucucaauuaaaaaaaaaauucagacuugaucaaauuagugaaacuauaaaaaauaacgaaauagacaaauggcaucuuuugagaaauaggucuuuaaauuuuuauuuugccaggugcaguggcucacgccuguaauccagcacuuugggaggcggaggcagguggaucacgaggucaggagaucgagaccauccuggcuaacacggugaaaccccgucucuacuaaaaaauuacagaaaauuagccgggcaugguggcaggugccuguaaucccacuacccgggaggcugaggcaggagaauggcaugagccugggaggcggagcuugcagugagccgagauugugagcugugauugugccacuaacucagccugggcgacagagcgagacuccaucucaaaaaauauauauauauauuauuuuuuuuuugcgauagggucuugcugugucacucaggcugaguauaguggcacaaucacagcucacuacagccucaauauugugggcucaagcaaucaucccaccucagccucccaaggagcugggacuacaggcaugugccaccacaaccggcuaauuuuauuuuuuauuuuuuguagaggccaggucuugcuauguugcccaggccagucucagacuccuggccucaagugauccuuccuccuuggccucccaaagugcugggaauacaggugugagccaccaaccucugcauuaguuaccaaggugaugauagugagaaguagagagccuaaguauucauaucagagagugaggugaaaacuccugagcgugccccuaacgaaguacucagccuguccuuagcccagugagguuucuaaaaugcuaaugcgguaguaauucuccuguuacagggccauuucuaaucaugggaaaggaaggggagccaccuauuugugcucuuaggcgacuguggcucaauuuccagcccugaagucaagaacagccaggaaaagggagcagucucacaccgaggguggugugcacugaaauacacuguggccagucagccaagggugggcuucguuuauuaaauaaauaaauaaauguuuauuaaauaaaaauauaccuccagggccugcugccucuagagguacagguggcuuguacagggaggugauaccaccuaccccugaagaggcuuagagacugaauuagaggccacccuggccugcagagagcuuuccaggccccuugccccugcuugcuguucacaguccacccuccuugcccauccacccccaacaaacguggaaccugucagcauugcaugcgcaaugcccuccucgccucugccccacugcuucaccucuacccacuguggucacaggagcccucucuuucccauucucaccaggcacaguaaaaagcagagguuaggcagguggguuuuggacaccaggccaggaguacuuugugcuguggcccucacuuaaugugugcuguugaaugauuaugccuuugcauaugacucagccagcaucagcauuuuguuuuauuuauuuacuuuugagacagagucucgcucuguugcccaagcuagagugcaguggcacgaucucggcucacugcaacugccgucucccggguucaagcgauucuccugccucagccuccugaguagcugggacucuaggcaugggccaccaugccuggcuaauuuuuguauuuuuaguagagacgggguuucaccauguugcccaggcuggucuugagcuccugaccucaggugaucugccuggcuagcauuugcauuuuaauccauuucuuguaaugcugaaugaacaauaugagcccuuaauaaaggaauugaccaggugcaguggcuucaugccugucauccuagcacuuuugggaggaugaggcgguaggaucacucaagcccaggaguuugagaccagccugggcaacauagugagaccccaucucuacaaaaaacuaggccaggagcaguggcuaacacccguaaucccaacuacucucaaggccaaggugggaggauuguuugagcccaggagauaagacugcagugagcugugauugcaccacuguacucuagccuagguuaaaaaaaaaaauuagcuggacgugauggcaugugcuuguagucucagcuacucaggaagcugaggcaggaggaucauuuacacccaggaguuugaggguaccgugcaguaaaguaugauugagccacugcacuccagucugagugacagcaagacugucuaaaaaaaauaagaaggaauuuguggcaucagcaguucggagaagaggggcacuguuuuacagugggaaggaacauucugagggugcugguccugacagggucagggggcaacuguggcaaaguaugugaggagguguggguagcagcugcuucugauuccccacuauccuuccacccuggggcacgucugggcuacggcaccuagggggaguacuguggcacccaucagagccaucagcgugacaucugccuguggucuugacaaugugaugcgauggcgguugucagcuucccauuggcuggccccagugacccuuucuagaggguucagaaacuccuaagggucuuccagaguugggucauugcgcauugacaagugcagcgccaucacauacccuucucucuagugcccacucagucaccuuaaccgaaacuucccugagccgagcauggugcugggugcugggcugaugcagggaaguucuacccgguccugcccugaagaaagugacccugugugcaugcaugagagugagcagucaguucaauacuaggccuccuaucuccagaguacacaagaggacuggauuagccgggcaugguggugcacgacuguaguccuggcuacuugggggacugaggcuggaggauugcuugaggucaacccaggagguugaggcugcagugagccaagauggugccacugcacugcagccuaggugacagagugagacccugucccuccuccccaaccccccgccaagaaaaaagggcugggagugacugagggcuaagaccuccccagguguuaggucaggaaggcuuccuggaggcggaagcacaucacugugaacaauuauccacuguaguguuagcuauuuguuguccaucagugucuucuaaucacagaggaaagaugaguuuucuggcagucagaauuuuggauaaauaggaggcagcuuuggcuuaaaagcacauuagcuguaaaucaguuguaaagccagaguuuuguucccggauuagcugccucuugccugugccauuucugagacuguguuaaccccccaugccuuguccuucucuuggcaguaauccagucccucauagcacuggugaaugacccccagccugagcacccgcuucgggcugaccuagcugaagaauacucuaaggaccguaaaaaauucuguaagaaugcugaagaguuuacaaagaaauauggggaaaagcgaccuguggacuaaaaucugccacgauugguuccagcaagugugagcagagaccccgugcagugcauucagacaccccgcaaagcaggacucuguggaaauugacacgugccaccgccuggcguucgcuuguggcaguuacuaacuuucuacaguuuucuuaaucaaaaguggucuagguaaccuguaaagaaaggauuaaaaauuuaagauguucuaguucugcucucuuuguuuuaaaaaucacugcuucaaucuacuucaaaagaaugguguuucuuuucuuguccaauuuuauccaaaaucuucaaguuacauuuaacccauaagguuuaaaaaaaaggaaaaaaaacgguugugguucccuuucuucccuacccuugccacucccacuuucuggcaccgaguuuauuuuucacuuacuuacuuccccagaccccgggcucgccuccacaaaggagaaaagacugcccuggcgguccugguggcuuuucuuagcauguguggcacuguugcccagugugggaguugguuuaaauucuccugacuccaguuuauaacauccuuuuaaaaaauuuaaaaacaaacagccacaccccuccuccaguccuucuccucaguucuugugugaaacuccagcugauguuaccacaguaacaucaguuaauugggcaagcccugaugucaguguguguaacugaccucuggccuggccugcacagagaagcccuauaaucacaggucugugguggccccgaaauggggggccugcuagucaggaggaugcugugcacacugugugugaugaaucucgccagaaaggcuccugaggucccagguuggcacuucucccugcagccauuguagaagaucugcugguccuugcaggcaaagcuacagccagaauguccguuugaaacuccuagcucaucugucaccgagcuucauccgaaugugccacggagcuugcucuccacuuccuccgugcaguggcccugccacagcccucccucggcacacuuugacccuuuguaggauuggaauuagcaggacucggcuauuuaaagcaccagucuggggucgccugggccccugcugacccccuccuccagagcagccagcccagcccgggaacaagacggacuuccucucccuucggacucacagccuuugcagagucaagcuccacuugaagcucacucaguaauauccuuucaauguguuuuauauuguuuugacugccuuuuuuuguagaaauaaaaauugaccuuagaauuuaucgucagauaaacuuguaaagauuugaauauuaaugucuuuucaaggcaaaugggauuguccccgcacuaguagagaauccaugucgcucugacaccccaaggaagccgacgauccaaaugccgugugucaccaaccccgcuucugccacuggcggcuucccuucuuggcucuugggggggacuagauccuguggagaagaugacuuaaacuuugcuuuuuguuuuaauuuuaauucuauaacuugagaucuuuccggggccuacaggcguguaagacagcuuggucuggucugugcagaaguggggagugaugggcagguucggcagccuaacauuguucaggcgcauggccccugcgguguguacacgaacucggcuucuuuuguccuagguacgccaagggcagguuucuggagacucccuugugcccgggauggcaagggcaccgggcuggcguuuccacaucugucuucauuagcagaaaagugaugauggauuuuauuucacucacacuccaguuuguaauaaaaugccaaauucugucagcuauccaaacaagccaccauuuguucuuguugcuucucuggauccagaaauguugccauucuuggaaacugucccauugcuucguauuucugccaacguagcucugccugccugucaaccccucacugcacucugcucaucacgggaggauaccugugugccggcagccccucagggacucucagcccuggcacuggcaccccaggguuggccccgucagcagaggcuuggcuuucgagccagugggugucucuccuuugggccugggcggcuugcuccugccagccaugccuucaggguaggcucugagcaagcuggcgaacagcccuggcugcuccaaaaccaaaaagcuggguccucuggaggaggggcgagcuguggagcagccacccacugcugccccaagcucacucaggaauucacacccgccugguuucuugaagugugcuggguccuucccucugcucccuacuccccaccacggcagagaauaggcuuucuaagaugcugcgaucccguucugcugcccguaauaaaaaugcucucagacacugguuagucguguggguuucuuccuuccugggagcgggcagugccaggggccuaugcucuuggagaugggagggcuggcuggggcccagguccuggggcuucugaucucucuccccauucccagccucuccaaaagagguacauagaaguguuccugccucccuagagggaaggagaugagguauaaucagcaagaaagccggagacuucagacagucggggccugcagagggcgcucuugggcgucucguugaggggacagggacuaaagugugggugcaucacuuacaugcgugggucauccuggagccuccugggaguguuaacaauccauguuuagaagaggcaaaccugcggucccaagaggucacagaauugauaagggugugccuguggguggagcugggccauguccaugaauggugccagccagaaacacucugaguccccaguacagcccacugccagggugcugcggcaguggugcuaacucagcaagggcucagccagacccaggacuuuuuuggcuaggccuucccugccuggaauuugacaccagcugagacuaggccugcacuguucagcuggaucugcaggucuuggggaaggaaacuucuuggggugucauuuuacuagccuuuaacauaccuagcacuuuacccucugagucucaggagagcccuguggcauccuuaucccugcuuuuaaagacaaccaagaccccuggccuguuuuuguucacauucugacugcagagccuguugcauuccaccauuuggcauauuucuucccacagggucccucugagcccagaaacagccaguuaccacccuccccagagccagagaccuuuaagccccucugucaacuuccucuucccuacagccaccagccaccauuuuuggccuuguucacuauuaauuguucagcaugaaauaagcauccauuucaucacuccuguacccgcugcagccugacuucugucaccugcugccccuugcugcuucuccuuucauuuggugccaucuaacccagcccugaaagaagccagagcugcucucagcauuucccacccuguccugccuggcucuuccuucucucucugcuuccuggauauggcaugggggaaccgggcaccaacccagaacagaggggagcugaggguaccauugcucccagugcagugcagugccuagccugguccaugccugguaaguggccauuucccagauuauuggaacguguucuuguucauagagggccccuagggaacccuggaggccucagaggaucagaguagaaaggaccaccgugcagaggcgauaacugaggccuugggaaggaagucacuuccagagagcauuccccacccggugcuggccagguucagaaaccccccuguggcuccacauguugccguggguuucuccuacaucuuccucugugugucacuggaugacacuggaugacugucccuguauguaccagacugggagcuccuugcagaccaggccaugucagcuccagcccuggccuagcacagaguggacccuccagacacgaaugccgagugggcggauaacagugaaccgcuuggcuaagacacuguugcugcccccacagccccuguggcccaccagucaccaccccaacagguccuuaucacuuucaccuccucgugagaugggccucauuauaaucaggugggccugauuauccuaccagucuaugcccccucacuucaguuuuuuuuuuuuuuuuuuuuuuugagucaggcucacucugucacccaggcuagagugcaguggcaugaucacugcucccugcagccucuaccucccaggcugagucgauccuccuaucucugccuccugaguagauggaacuacaggcuugugucacuacacccggcuaauuuuuguauuuuuuauagagacaggguuuuggcauguuacacagucuggucucaaucugcuagccucaagccuuccucccgacucagccucccaaagugcuggaauuacaggcgugagccacuaugcccagccauuauuuuuucuuuuuuaaauaacagaaauaaggucuuaguauguugucuaggcuggucuggaacuccagagcucaagugauccucccacuucagccucccaaagugcugggaugauaggugugagccacugugccuggcuucacuucacucaaaugcucauggucagccggcugcuguggcugaugccuguuaauuccaacacuuuaggaaaggccaaggugaccagaucucuugagcccagcaguuugagaccagcaugggcaacaugccaaaaccccaucucuacaaaaaauacaaaaaugaaccaggcaugccugugcucccagcuccucaggaggccauggugggaugaucaccugagccuggggagguggagaacugcagagacgugauugugccacuguacuccagccugggugacaggaugaaauccugucuuuaaaaagaaaaaaaaagucucacgguccccagggcugcugucgacucugcucaucccuccuucccucccugagugacaguagccacucauauagcaucugugcagacccccaggucucuccugcccacccacaccucuccugagccuaaagcugcacaaccagcugccuccuccucucagaacacuuccauaacagaagccccucaagggagcuacgucuguauccccggcuaacuucaggccaccccucucccagccuuagccagcagccugcaggaguguggccagaucucagcaggcugaggcgaggagguggaggcuaggcagcaggaggagcaacuguacagugauuccagcucacaagcaugggugcaagaaagcaggaaaagugcugcagaugggagaguccaagucuagugaaggucaagauggaagacgaguguggagccagaaaaagggacugaagccacagucaaggggauggggccaugaguggguagaagcaggaaggaggagcgacaucccacacucacccuucagaaagccacacgucucuccaagcugccuaggcuggaugagagcucucuuggccccugauuccauguuuggcccaggcuagggcccagugcacauuaaauaaaugaaugaguaguuucaaagcccugcucugccacuccugccucuaccccuguaaaauggggacaucggugccugccucauagaugcuauuucaugaaaugagacaaggaccacaugguauuccaucugccuuuccauccugcggaguggugcagaaggacucugugcucuagaggacucgcacugccuuccccaucugcuccugcaccucaggagcuuucagcuaagccacaugcggccccaguccacagggcaucccuacauugccagaaguuaggaaccaugguaucccauuucccgggaagacugcuccuccuagaaaaauuuaaauguauucccacaggguugcagggucuccucacgccuaucccguagaauggcuuacaucuaaacagaugacuuuuguuuuugagauggaauuucgcucguuacccaggcuggagugcaggggcgcgaccucggcucaccacaaccuccgccucccggguucaagcgauucuccugccucagccucuccaguagcugggauuacagacaugcaccaccaaugcccagcuaauuuuguauuuuuaguagagaugggguuucuccauguuggucagacuggucucgcacuccugaccucaggugaucugcccgccucggccucccaaagugcugggauuacaggugugagccaccacacucagccuacaggugacuucuuaaaucaauacugagauuauaguauuaugccucuuccaaagcagccuggugaggacaaucucccacucccacccuaaaaaggaauaaagaaaauugcagcaugaacaaaaccagaauggagaaugggccauuuccuggagugguuugagccaagagggagcugcucuuuguccgugcuuguuucucugagggucuccugggcacagcugauaaaccacccaaguuugaaagacacacguuauuuuauuaauauagccaucucuccccacugccccaguggugaagguguuugcauugcaacauggaggggcaccaaaugcucugcgggcccuagcccgcugccacaggcuaggccugccugcagccaagaaggcugcucaaacucuagaugccauuuggaggcaugaggaccugagcccagagguggcaguguccuacccagggaagucaacagaucgugcuccaggucccagcucugggcugggccaggacuaaauccuggcuccccuuucuugguacuaaggggauuagugcuugguugucuguagggggucagaguagggaggguuccaggaaggguuccagagugggcucacaggggaccuccuccccuggccucuuggaguccaggucgucgagggcgcaaagcugcacgccauccugggcaagcugggcccgcagcgugggcgcggugaggacgcgcagcucaugcagccgcucccaagagcaagagaaagcgucggggccuucaccgcagccgccggugggaggcacacugggguagccggggugcgccaucagcucggcugucaggguguggcccgcuaggguaccuuccaggacccgcgccagggccccggacacgcggugagcggacaugugccggccgcaagugcucaggcccacgaaggcgucuguccaccuguggggggcgggacaucagaggugggaccaggccgggccauggccaagggcuagguaggcuagggaagggacggcggggugggaggggguaacugggguggcggcagcggucgacgccagacucgcuuccggguugagaaacggacacagcuagccaggugaacagccagugcggagggacagaggcagcuaugguaggagacggggcggggagccucaccgcaggccguggcgggagaaggggcccacggcggcccgggcgucgcgcuccacggcgcaggcgaaggcacgcgcgggggccuccagccaagugcagccacccacaccgcgcuccagcggcagucgcguaaagcgcaccccauaggccugcagcgccucggcgaacaccuggcacacgccugcgggcggagcgggucagggaggagcacguccuuucaccugggggcaucgaacuuccccuacucccccagccccgccugggaguaacgcccuccaaacugggaucacuaaccacgcaccugggagcacgugcacgugcuggugcccguccgcgugcgugggggcccugcccagcagcucccggaagcagcuuaguugggccucgagcuccucccgcaccuagagggcgagcgagagacaccuugagcgaccgggaguagcugccgaggauacccuccucgugcuuccgugugauggcuccaguguuugaaugcggaagucauccaccgccagcuccuaacggccucacaguacccuccgggcggagcucuggggguccucgcgagcauccuccuguagcugcggcuccgcaccugaggcaaauccacgucuccggccgccaccgccucccggaaucccaucuugccaaggaagaagccuuccgggccgagcagcgaugaggcgccacggcgggccggacccacggggcggcccucggacagguuggcguggaggcccguggggaugcugugccugagggcggagcgcgagcuggagcacuagcggccgcggagccgcgcgccccaagccgaucgccgcccugcuagaggcccuccccucaccugcgggccagcuccgccgcgcucuccguggccgcaccguugaccagcagggacacgcuggucacagccccggccagaaaggccuccacgauacccucaucgcgucgcgggcaguaaccaaagucguccgcggugaccaccaggcgcaugcgagggcgggacauggccgccuggguccaccgcucgcgcucccaggggagugggccggacagcccaggccccgcccccggacgcugcccgggccccgccccgacgcacacgcccaggugcggcugcacuucgccuuuguucucgccaccuagcgguccggcgugccccugcaaggacccggcaacugcucccgcgcuaaccagaccagugauggauucauugcaaugcggaacuuuccuugacugcaaaagugauauuuaauauguaaaauaucaaaaggaagccgggcgcaguggcucacgccuguaaucccaacacuuugggaggccgaggcggguggaucacgaggucaggaguucaaggccagccuggccaacauggggaaaccccgucucuauuaaaaauacaaaaauuagccgggagugguggcacgcgccuguaaucccagcuacucgggaggcugaggcaggagcguggcuugaacccgggaggcggagguuguggugagccgagaucgcaccacugcacucuagccugggcgauagagcgagacuccgucucaaaaaaaaaaaaaaaaaaaaaaaagaaucuccuacccuucccagagauugccauuguaaacuuucuggguuguguccuuccaguguuuucucuaagcaaauaaacacacccaacucccuuucuccccaacccaacuuuuuuguguguuguuuugagaacauaaagaugauuauaucaauguuaucacauucuaguaguuucuuagcagugcgaaugaaaauuuucauauuauuagcuauuuuuauucuuuuucaaauugccuauugaucuuuugcagauuuuucuaagagcaggcauuuucuugauuuguugauuuuuuuuuuuucuugagcucuagacacuaagaaaaugaaagaaagcauauacacuaaggcuucauuugagaaaacauuaucuccaguuuccaucuugagcucucugccaggcuacagcuuuuacauucauaacuucacuguuuucucuuugguccagaaaagcuuuccuuacccaugacuguauaaauagucauuaugguuggcagccacaguuuccauugcaaugugacagucuugauuuuucccauggaaagugugguauuuguguccgggcuaugaaauugguaaugucauuccuguuucacagaugaggaaacugggguucagagagcgaaagugugguccugccaggaguaguggagcuaagacugaaccucacaccucggggccagcacccaggccugcuauguccucucugucccugaccuaguggguagccagagcugagaggacagagcagagcuugagaggaacaauauuucgugaggcaugugaggauugaaagccucauagaguccuucagccaugcucuuggcauaaggacugauguguuuauagugacuggugaauugucagaccucaaccaaccaccguucuccacuggaagcugaucuuggaaaggucagaggucccgagggucugcaggugggaaggaggagacugacauuuauugagcaccuacuuggugccagacacugaaaguauuagagauuaagggugacuugccucuguucuggccccaaagaagcaccaucugauagaaaaauaaguagcaacaugguaugguagagucuggaaugggguuuacugugaauugcguagggcguggcagaauucacaguaaaagguuuuuggaagaagugacaccauggugggguauuacugagcaaaggggaaaaggagggagggagaggagguaagaauauacaaggcuccgcugggcgcgguggcucaggucuguaaucccagcacuuugggaggccaaggcaggcggaucacaagaucagggaaucgagaccauccuagcuaacacggugaaaccccaucucuacuaaaacuacaaaaaaauuagccgggcgugguggcgggccccuguaaucccagcugcucgggaggcugaggcaggagaauggcgugaacacgggaggcggagcuugcagucagccgagauugcgccacugcacuccagccugggcgacugagcgagacucccgucuccaaauaaauaaauuaauuaauuaaagaauacacaaggcuccacuggguuacugggugugcuguagggagauuuuauugaaucccauacucccauauuggaagaacacucaagcccauuuacagugugggacuaaugcugagagguugagucacauuggcaggaaagagcagagccaggaacugaagcuaggucugugacuuagagccggcacucuuuccacugcagaggggagaggucucaaggcagaaccuggggcugugcacaccgcgggaagggcagaggccccuggaaacgaacaggagcaggaggcccagggcugcgcagcaaccaaggaggacacgaggaaggugcuugugccaccgguggaagacguggcuuuggcuuuuaggcuccccucggggcaggagcagaucaaagagccuagccccagcuucgguggugggugggggguccucccggcagcggggagcgugggcaccagcauccucagccug

SEQ ID NO: 18034 - RNA, 1049 nt, Homo sapiens
cauggcggacgguggcggcggcggcagcggcggugcgggcccggccucgacccgggccagcgggggcggcggccccaucaacccggccucguugcccccuggcgacccucagcucaucgcuaucaucguggggcagcucaagagcaggggccuuuuugacagcuuccgccgggacugcaaggcugacguggacaccaagccagcuuaccaaaaccugagccagaaagcggauaauuuugugucgacacaucuggacaagcaggaauggaauccuccagcaaacgacaaccaacugcacgauggucugaggcagagugugguucagucagggaggucagaagcuggaguggacaggauuaguucucaggugguggauccaaaacuaaaccacaucuucaggccacaaauagaacaaauaauucaugaauuccugguggcccagaaagaagcagcugugccagcacucccuccagagccagaaggccaggacccuccagcuccgucucaggacacuuccuaagaauaugccugacagcuuuugaaagcgcuauuuaauuuuuggugaagaaauggauucgguuacauaagagugcaguuucagauugaagauaagccaaguucaucacugagcucaagauuuccaccucgaccaugagcagugaccagauugaaagggaagcaaguucgccagagagaaaguugaccguggcacccuccugcauugcgcugccauuuggccagccuuuccaagggcaugacaccaaacacacacuacagagagggaaacacuaccgcgacccaggauuguccugaaacagacaucuauacuugaacauggagacugcacauggauuuuaggguuugugcucugagauaaacgaaagcuacagcgagagaacauaaccaaucccaaagacaauuucaaagaacaaugacaguaaagguuaacugggaggaauauuugacaguacuuauuugauauugucucucagaguugcaaacuagauuguacacaacauuagugucagauagcuuugaaguugugaccu

SEQ ID NO: 18035 - RNA, 1049 nt, Homo sapiens
aggucacaacuucaaagcuaucugacacuaauguuguguacaaucuaguuugcaacucugagagacaauaucaaauaaguacugucaaauauuccucccaguuaaccuuuacugucauuguucuuugaaauugucuuugggauugguuauguucucucgcuguagcuuucguuuaucucagagcacaaacccuaaaauccaugugcagucuccauguucaaguauagaugucuguuucaggacaauccugggucgcgguaguguuucccucucuguaguguguguuuggugucaugcccuuggaaaggcuggccaaauggcagcgcaaugcaggagggugccacggucaacuuucucucuggcgaacuugcuucccuuucaaucuggucacugcucauggucgagguggaaaucuugagcucagugaugaacuuggcuuaucuucaaucugaaacugcacucuuauguaaccgaauccauuucuucaccaaaaauuaaauagcgcuuucaaaagcugucaggcauauucuuaggaaguguccugagacggagcuggaggguccuggccuucuggcucuggagggagugcuggcacagcugcuucuuucugggccaccaggaauucaugaauuauuuguucuauuuguggccugaagaugugguuuaguuuuggauccaccaccugagaacuaauccuguccacuccagcuucugaccucccugacugaaccacacucugccucagaccaucgugcaguugguugucguuugcuggaggauuccauuccugcuuguccagaugugucgacacaaaauuauccgcuuucuggcucagguuuugguaagcuggcuugguguccacgucagccuugcagucccggcggaagcugucaaaaaggccccugcucuugagcugccccacgaugauagcgaugagcugagggucgccagggggcaacgaggccggguugauggggccgccgcccccgcuggcccgggucgaggccgggcccgcaccgccgcugccgccgccgccaccguccgccaug

SEQ ID NO: 18036 - RNA, 11117 nt, Homo sapiens
ccggcaagcccagaguggaggcugcagaccugggcccagaaccgcaggggaaccuaaggguacaacuuccaagggcuccguuucuccuucauauccccccagagaagcagaaagcacugcaggaugugagcucaacucagaacacagguuccgagugccgcagaaagcaacgccagucacccggugcucccacagccgccccaccugcagcuuccucaccuggggggccccucgcuucaagccccgcaguccugagacgugaugcaggccccagggcaaggcuagggcucguguggggagcaagauggagaggcaaccccccagacuguaccuagguguucuuuaaugacaguucaaggggccaauuaaacagcaaacagcuuggcaaggcccugggguguggugugggcacgagugccuugugccagucuggccccagcacagccccuuucuccagugacuccugguauggucaacagcuucuggcccaggccugggccccgagaaggcuggaguccucugcuggguguacagcugcccugcaggcucugugaagcgucuaugagcccagcccaggccuggcucuaaaagaaguccgaagcuuugcgccgggcagggagcugcagcagguuguccgugauggaggccggguccugugugagaggggugcguguggcagagccaggcgccggugugcuugugggggucugcagcccacuggccggggucuugagguggguggagcgugcuggggaugguguguagcuggcccgcagggcccggucuguguacuugcuggccguccugcucacaaggcgcuguagggcuggcgacauggcugggcucaggccuuugggggugaggcugggguggaggaaugggugagagaggcaggguuaggugggcugagagcugccggcagcagggccucccuuggcucccaggaagagccugggcagagacacagucacucugagcugaggaggaugguacugccagcauggcagcaaaugcgggggaucccugaggucaaacagcagcgcucaggucaaaccugaggucaaacagcagcaccgcccuuggcugugggggcuggggugcacccccaggccucugagaguuggaguccccaccccucuccaaggggaacgaugacucucuccacagggcugaugaaagcucccagcaggaccacacgccuaaagaugccucuuagggacgggucaaagaggacguggaggaaagagaagauggagggggccucucauccuguccaugugcggccaugcucuggauagaggagcugccacaguacccacugcagaaccccgcggaccugcccuggacucugccgcgugggccaugccuccacacggucagggcaggggccgaacaggagcaggccagagccacccucgcacuuccccaccagccaggcggccccucaccuggccagauucuccgucacucuccgcaaggcuuccugcuucuuggcccgguucuuggcagcggccucguuggccaucuucagacccagccgcucccugcggccuggcuccaggaucuacaagguagcagguguguggguagcugcgccaggccugccacacgccaggcagccccucacacagaaagccacuguggugggugccagccucucuuuguugccuacaaaacccccacaacccaucaccucccacuaaaagccccuggaaagccccaaaccccaccugaccugcccaaggcgcagcacuccucaccugucuucguguuccucccaaaaccaugaccucugacaaucucucaggaaaaagcagucuguuuuaguguuucccugauuaucagagugaacaucucugucuuuaucggcgcucuguauuucgggcgcuuccccgugugccuguggccuauuuugcucucaaggggcucauuuuccuuuucugcugcuguuacucagaagacccuugccaagaccuugugucaagucaacugugcuacgcugugcacauguuuuuucacucauuuacauuuguuucauuuauaacauuuucugcuguauuuguuauuuucauuugugauuucuuccuuugcuuuuauguuuagaaagucccuccuaacuuaagauuagacuacaggcugggagugguggcucacaccuggaaccucagcacuuugggaggccaaggugggaggaucacuugagcucaggcauuggagaccagccugagcaaaaugacaagaccucauuucuacacacacacacacaaaauuagcugggcauggugguguaugcuguuagucccagcuacacaggaggcugaggcuggaaggucauuugagcccaggagcucaauguuacaaucagcuaugauugcaccacuguucuccagccugggcaacagagugaaacccuaucuguuaaaaaaaaaaaaaaaaaaaaaaaagaggcgaggcacaguggcucacgccuguaaucccagcacuuugggaggcugagguggguggaucacgaggucaggaguucgaaaccagucuggccaaggaguucgagaccagucuggccaacauggugaaaccccaucucuacuaaaaauacaaaaauaagccgggcgugguggcacgcgccuguagucccaguuacuugggagguugaggcaggagaaucacuugaacccaaaaaucaaacuaaauauucgccacuauuuucuagucccaguuacuugggagguugaggcaggagaaucacuugaacccaaaaaucaaacuaaauauucgccacuauuuucuucugguuguuuuaugguuauuguuuuuacauguaaccuuuucaccuuuccacaauguaugcugcuacacauccugaggacccagcucccuucauuucuaaauacucugcuauucagugcaaucugaguugccaucuuuaucgggccccaaauucugacuuggaucaugguuuguuucagaauuuaucuguuuacuguuggccuggagacucgggaagcaguggcaggcauaccucagaagcaccucagcccuugccuugcgcucucacauuggacagcacggcauccucuucauuaucccucucgcacguuugccuugguuauccuugugucccagacaauuuagaaccaagguaaccagaaccucuccccauguuuugucuggacauggguuaccuguacuaaguauucuggggaaaggcccgcagugguauggggaggccuguuguaucugacccagcccacgaagagccuccccuggucugugccgggccucacacacuccacccugaccacuccuacaacaccaggcuugagccguguaauccagcgugucccaaucguguucuguaaccaggggccuucucuacaagcacacagccucguccuauggcccucaggccugcagagcuccucacgugucugugaccauccugccucauucaugaacagcacccggccuccaggauccagagggcccaagccacucccugccuuggugucucagcccuuacacccccaaaucccucugugacagguccacccacccacaccugccuucagcacccuggcauucagaaaagccagcacucugcccgucagcagcugggggccgaucccagugcucaguccugagccacaggcacucagggcuccagagguguccaccccggucgcacacaguucccccaucaccacaacccaccuuaaaagcugggccggguguccuguccacguagggcguuuccgacccuucaacucucaaggguguguucucaaccuccccccaggucaucaucggggacucguucacaccugcagacaaagagcccaaaaccaccucaggccagaggacuccccaccacccuccccuccagucacagcuuguucacccaaugugcaucccagcuaauacgaaggcaggcagcuagcccucucuccuuccccaggacucuggaacccuggcaccuccauccuccgaaagggaaaugccaagcucccagcaggcccgaggcaggcucaaggcccuacagccaugugcuuagccuacaagccucugggaggucucccccagccacgcaggaggagacacucaggccuuccagggcucccaaaccuccuagaaccccaggcaaaccuguggugccuucacaugcccuggcgugugacacagcaccagcacccaagagcacagaggccagagugcagagggacacccacgcaugccacaagaccaccugaguuucaccuccacugaggugcugggccucccucccugcagugcuagguagacuuagacucauaagcacugugcacacacccccacccacugacaucacaguaaggaccaggacaggacacgucaucccaggaugucucaggccaggucugccugagaguccagcccacccacggccccaagcagccuggacaccuggccucuagggccuuguacagacaggagaccaggucccugaguuacacaagguguggggcaggccagguagaggccaggaguggccagggccgacugagaagcccaccucccccagggagucccagcaguagacccacuugccagugggcacuuuucucaccaggggcaggggaaggaguggcaacaaauccaaauccacccacucgaggggacuccugggggaucagcuccuugccaucggggcccaccuugcccuguuugugcuggaacaagcagagaggcuggcaucagggggaccgcagcccacgcucgacagcuggccggugggcaaacacgugggaacaugcuggaaacacuuccucuccucagggcaaggcuggggcucugggguuggcagccuucuuggagaaagagagggagggccccugccccaaccccccaaaagaccuugagggccugucaaaguggguacccaagcaaggaaagcccccuccucccauccagggaggugccagggccuccacucgagcugcgccuaucccagcaacuccagaggaugcugacgccaggccccugcagggggcaaugcugaugacaggcaaugcugaugacaggcaaugcuuaugcucuagucucuuccugccuuccccacuucaacccugugacugccacagucaccaucagagaguaucuacucgucuugcucccagacucagaaagccucugcucucugccaacccagggccugucccaccccagccacccccuggggcugggcucccucugcggcucucuggcuucccugcccggugugugggcgugcagcugccagccugggcucacucccagcagucccuuuucucuccugccccugccaucaagggagcuggcacagaucuggaccuacagaacgugugugaccaaggcaguguucaauggaagcccacuggggccaaggaaagacucaggauccugccgcacagggccccagaugguuccacucacugagcucugccaagcucaaagagaugggagagaucaugccugcccccaggcagcccuguccaaccuggcccaugcggcccugcugacccgccugcucaccugggcauugagggcggcugccugcuggagcuggcaccugcucagggcuuggcugaaggggucccuaaggaagcgcguguucuuauguaccaccugccggggcuucuuaaacagcugcuccucgucagggacaccuggcagacgaagcaaagguagcagcaggugucagaagggcagcagccuaaggagcaugaggagcucgcuucucggccaagucacucccagaugaacaaaagcauugagcagaacgcaggccccagugccgcuggagagggucucacucacugcugaccucacacagaccuguccacccuuagacagaccaguacccaucagaagcccaaacugcaagggggcacggccauacacaccuggaaggcugcuccaaacacagccagacacacacagcucuacccaacaccuccccauuuggcugcgaggcccgccacuuacccucuggauaguacaugagggaauucuuggccuuguacuuccaggucuccacacuggccuggcugcucucgauggccuggugcucugcugacgggaguucgagauuaucuuucugccucugcaaucacauggggaaaagugauggucagagaugccccugggcauuguacccauggcccuggggcuccccaaccaccacagagggugccuacgccuaugugacaccccagaccccagagacaccuucucaaacucuuccucagccugguagagccaagcguggcgugcccggcuucucuccuuggccaccuccaugaucuccuggaaggaggcauuguccucacucguguagcggcucaggaagacaucuaggcugggcagcggcuccuucuccuccuccucuccagccucuccugcuuagggguugcgggaggaggaacacagcacccuuugcagucaggaaagaggaggacacccaggcccaggaaucauagcccccaacaugcagggcuggaauccucuccccugguccuggcuucugcccaugaaagcccacacugccaaggacuccccacgggggcagaauccacccacccugacugcccagagagcccucaggugguacccuacagauucagggccagcucugcucaugugcuggaugccaagggaauuacguggucugauucagacuggagaaagcaauacagguguuagagcaagagcucgugaucacaggcaggcuccucccccaccaaaguggugccaggccugugggugccaggccuccaaaucccuggggcucucccucacucccuaggauuuccuuaccuuacccacucuucucuuccugguaccuguacuacagguggguggucaucgccuaaucauccugaccugagagcgagccccaauuccagggaucucauaugacuuaguccucuggauggggccucacaggugcuaagccacaaccccaaacaccccccccuccgaccaacccugccaccauggaaagugguacucccacugagguggugcccuggugcugcgugugguggugcaaacuucgguggggccaccuggagagcucugccuucaagucuagugacaguccugaccaccugcuacacgugaggcuaugcacaaggcacaguggcuacaagcucaagacccacgggaugaggacaggggucagaaacucuauucaucucagagagauaagaagugaaacccugaccaucucugagaccugcagaagugacugccuuucugagccucaguuuccucaccuguaaacaugaugaugguuccuaccacuuagguucugaaaaggauuccuauauuuacuggcauguagguguacagguauugaaaaucugcaaacuggcuaggcaugauggcucacacuuguaauccuagcacuucgggaggccaaggugggaggaucacuugagcucagaaguuuaaaaccagccugggcaacauaaugaaaccucaucucuauaggaaaaaaaaaaaaaaggagaagaaaaaaaucuacaaauugcccugugaugcacaagcuacauuucaacagauaaucaagcuucaaggacaacaaggacuguguuaauggccgaaaaagcuggauuguaaagcaaaaaguaucauguuugcauguuugugcaaacacacaacacaucugugcuacuccagcacaguggagucuacaaacugauaagaaagagugucucguuugucuauacaugcacugacauucuacuacugaugaaaagagggccugacaacgcagaagucccauggcgugcagaacacuugcauucaacaggacucggagugcccuuuccuaaaccgacucccccaucaagucacgauguuaccauauagagcugugugucccagcaaacaugcugaagaugacaacucuuucaucuguuccauguguaucugugcaaggcccacaacaccacaugugcuguucccaacacggagcauacagaugaaagcaaaacaaagcuucugcucuugugcaagggaugccaauuagggaaagagaccauaaacagaaaugccuuuaaaacguuaugucuuggccaggcgcgguggcucacaccuguaauaccagcacuuuggggggccgaggcagacagaucaccugaggucaggaguucaagacuagccgggacaacauggcaaaaccucgucucuacuacaaaauacaaaaauuagccaggagugguggcaggcgccuguaaucccagcuauuugggaggcuaaggcagggagaauugcuugaaccugggagguggagguugcagugagccgggaucacaccauuuuacuccagccugggugacagagcgagacucugugucaaaaaauuaaaaauaaaaugaaauuaaauaaaauaaaaugucuugugaugaaaaaccaaagccaggcuggaagccacagagcaccagugguguugugacuucacacuggcaggucaagaaaaguuucucugaacagguaacaccuaugcagagaucuacaggaagaaacacagugagccaugcaguuaucugggaagugaccaacaugaaggaaacaaauggagaggcccugaggcaucuucaggauaguaacaaaaggggccuuccaacauccaugaagcccacagggcagggcuggaacacagcagaaaagccagcaagagcuggugagagucccauuucacagaggcgagccaugugugggagcuggacccagauguucuaccaccuagaccaauguccuuugacuucacaggcugcuauuuacgcaagaccccucaggaacaagauguggccugcagcccucuggaccacccccucagggccucacaggcuaagauucccaggcaauccugaccaugugacuuaaagagggcacccucacucaccauccuccaggccucggccgcggggccugggcuuguugcccaccacuccagugccugcaugcaccucagggguuucaaauguggcuggagucacaucuaggggaagagagggggauaagaauuagagugagccugaagcgacaguucagcaggcuuuccccucuccgccacccacaggguccucauacaggguggcgggggcucccgggacaucuugcccaaggcagagccaaacuugauggcaaucuggcgcauccguuccaagucuccauucuccucggcuuccagguacuccuucugugccuggagcuucuccacaucaggaaagaaaucccuuuggaugaccgucuggaggcccugcaaggagagaucagaaugaaagucagaggccaggcgcgguggcucacaccuguaaucccaacacuuugggaggccaagggagguggaucaugaggucagaaguucaagaccagccuggccaacauggugaaacccagucucuacuagaaauacaaaaauuagccgggcgugguggcaggcaccuguaauuccagcuacgugggaggcugaagcagaagaaucgcuuaaacucgggaggcggagguugcagugagccaagaucacaccccugcacuccagccugggcgacagagcgagaccgucucaaaaaaaaaaaaaaaaaagaaaaaagaaagucggagcugcagucugggugcuccugccucacagguccacugcuguacaugcuaaggaacuugcugaaccuccuucaaauucuacuuccccaaugacuggggcuggauugagggagcuugagggcacuuucuagugggguugagcaucccauaugguagccaugcugcaaccucuaacauuacuaaacacucuucugaaguccgugaaacccuucucucucgcccuugcuaacuggucauucucauucuccauugcuggcuccccacaagccagaccaauguggguguugucacuuucauuccacacaugacuuucuauuuccaaucuaaaccuuucuccuggcggggcaugguagcucacgccuguaaucccagcacuuugagaggccaaggcgggcggaucaccugaggucaggaguucgagaccagccuggccaacauggugaaaccccaccacuacuaaaaauacaaaaauuagccgggcgugguggcgggcaccuguagucacagcuacucggcaggcugaggcaggagaauggcuugaacccaggaggcagagguugguuacaguaagccgagaucgcgccacugcacuccagccuggacgacgagcgagacuccgucucaaaaaauaaaauaaaaauaaaccuuuuuccugaguaacuucagccagucacuaccacaaguugagauucccaagucugcaccuccagccagaccuugcucccgagcugcauaucugggcacccaaccguccguuaaagccauccaucuacauaucccaaaaggugucccgaauuaaacaggucuaaaaccaaacugacuuccgccaauccccguuucagcuccuccuucugugugcgugugguggggcgacgcagguccacucacucgagaugcugucacaacugcggucucuuuccaggaaccccagcauucacacuugcugccaccgcucuuuagaaagcccucuuugccaccauccuuccaguuugucaaacuccuacucacacuuuaacagaaaaucuucuuucccugacccccgucccauacaaagagagccgcucucucuuuucccugacaacacuacuacagccucuuccaccacagacgucuuccucugcccuguuuacuugacucgugggaccguccacacccggcuccuccacuuccacgaggagacggagugucaacacccgagagagggaaccugagaggagcuugaagcagaggaugggcccagaagucgccggcguccgcaccgaggucguaccucgauauacucuuccucguccaggacccgcugcuugcucgucgcagccccagccucucccgccucgcgcuuccucgggggccuggacgcggcgggaagcaacaaggacgacgcugaugcgcccggcgucuccaucgcuaucccaggaaaaagcucgggcccagcaggcgcgucacaggguggagggggcgggacugcaccauuugcgcaggcgccuccaaua

SEQ ID NO: 18037 - RNA, 1248 nt, Homo sapiens
cugucuccucuucaccaacaaagagaaugcugguccgucucagcacucacaacaaacacuaucuuggucgaggaugcaagaguacuauuuuccucacuuuuuauuuccucuguguuuucacagauucccugcacagggucuuagguaaggggcauagaaccaggggccaccucaagaccugggaacauggacugaacacagacaaacgggacaggggcagaggugaugcagggacaguggagaacugaaaggacagucugaaaggggugacgggaggaccacagagaacacugaggaucacggauaaacaugacaaggccaccaugggugacccaugggaaacaugguggcccuguaguuccacuccacccauuccuaccugacaaauaucccugagagcagccucccuucugcucagguugggccggacccugaccccugacccuccccaacauggcccuuauuacacuguugucacauuuguccccucugccaaaucacauccauccaccacccaacgcccacuuaauucuccauugaccaggccugaccugggagccaugaccugggaagcuacacuuagccacaggagugucaucuccugaagugaccucaagggaugcaccaucucaucccucugcccccaaguucugcucaaaucccugccguggccgguggcucacuagcuccaagcagccgaagcuccgucucacaagcgcgguuccuggagcuccuggggcccggggcacauuccaugcgcugggggcuggggcagccgaggcuggcggccauucugcuagucgccccgaggcagcccuaugcaggccccugccgccgcuaccgaugacccugaccagucacccccuccucucggggcccgggagacucgccugggguuguaauggaagaagguaaauaaaaugccagcgaucgugauccgggggcucauccugcgggccggcccaggucacgggagaggcgcugugcccgccagggccaggagggucgccugcgcugaggggcgggggccacggccgcagaccacccgggccccgcucaguacccggccauagggggacacggagaagcuuccuggggaccauuuccgaaagaggaauggacuuccucagccucggggaccggccauccaggcagggagggccgccgagucggaucgcguucccguagcccacaggcugugggggcgaccacgcuugcgcucggaaguuggggcggcgcgcgcugaug

SEQ ID NO: 18038 - RNA, 3836 nt, Homo sapiens
ggggugugggaccuccguugcccagacaagcugccuaggagaauacagccgcuugcauuuguggucuuuccugaccuuguucgcugagcgcagaaacuacaaccgggaaaggugugggugggaaccggcaggugaggcccggcccguggcugcugcgggaggggggcccggcggcguagccccuucucaccggccucccgccucccgccuccagguuugaaacguuagaguuccucugggacugggcuagccccacguguuuucggggagggugugccccuggccuccgggaucccuggggaucccgccgcucucgacagucgcgcagacccgaggcccgcuaucccgcggcgcggcacacagugcaccuugacccacugcucggagcugggccacggcuccgccucccgcagccccgcccccgucccgccgcucgcggucgcccagggacucggccucggccauuggcugcgcuuuggccccgccccuacgccugccucggcgcgccccgcccaggccucaguuucccggcccgcacggggcgggcugggggcggggccuggcucggaccacgcggggcgggaccuggagcugacgcggccgccccgccccugggaccauaaccggccgccgccgccaccgcggaccgagcgcggaguucuggagucucggacccgaagccgccacagggcgccccgccucccgcccgccaugcccgcgccccgcgccccgcgcgcucuggcggccgccgcgcccgcguccgggaaggccaagcugacgcacccggggaaggcgauccuggcaggugggccccuccgggacgcggaccccucucccgccgcgcuucugggugggcccgggacgcugaggccccgccccacuuccggguugggccgugggcuggggagucguggaggcgcgguccugguccccacccggcgcgcugggacucgcccgccucccgucugucacccccugcgccucgccgggacaacggggugagggcaugggggcguggggccccagccuauguuccccgcggcacuggcgcggcggccgcgccgaccgaaguccgggacgggggaggggcccgagcgccagcggccgggcgggagucucaggagcggguucccggucccugcaggcggccuggcggguggcaucgagaucugcaucaccuuccccaccgaguacgugaagacgcagcugcagcuggacgagcgcucgcacccgccgcgguaccggggcaucggugaggagggggaggccgcggcgccgcggggggcggguacccagggcggcggcaccgagggccgugggguccugaccgcccccucccccaggggacugcgugcggcagacgguucgcagccauggcguccugggccuguaccgcggccuuagcucccugcucuacgguuccauccccaaggcggccgucaggugaggcccggccgguggcugcugcgggaggggggcucggccgcggcagccccucucacccgccucccgccuccagguuuggaauguucgaguuccucagcaaccacaugcgggaugcccagggacggcuggacagcacgcgugggcugcugugcggccugggcgcuggcguggccgaggccgugguggucgugugccccauggagaccaucaagguggggaagguccuggcgaggaccccggacacgcagggaguacggagacgggcggccccgcuggcccggugcucccggggcaaccggcaagcuggggagggucuccuggacgccagggaaggccggcggggugaccgcggggcccuggggcaggacgccugccacgaagggccacccguggaggcugagucuaugcuaaaggcagccuuaaagucuuuaaaaaauacuuuuauaaagcagaaaacaaaaugacaccuucacugccaaaacuggaaaagagcagcaaacauaaagggagaggcugcucacagggcugcccugugucccagagcaugguccgugugggcugcccugugucccggggcaugguccgugugggcagcccagggcggccuuggcugcacugcuuccuggggaagaguucccaguucccuccacccuggaugggcccugggccugccagcuagccaggacccacccagguggcagccgagaaccugcgccuuugcuucucucucucaggugaaguucauccacgaccagaccuccccaaaccccaaguacagaggauucuuccacgggguuagggagauugugcgggaacaaggugagccacucgaccuuccugauagggcucagggaccugggccagggugggaagggccugcaccucccauccugccuugggcuuugugcaacacccaccccccacacacaccaauucccaaccggggccugagaggcugcaggguaaccccgugccugccuucccgcagggcugaaggggacguaccagggccucacagccacuguccugaagcagggcucgaaccaggccauccgcuucuucgucaugaccucccugcgcaacugguaccgaggugugucugcaucacagggccccaucucugcacauggccagcuccucuccucuccuuggggccaccccuggguggcgggcacccaccuuuugaagugcugauccaggccccucccggcacccucugacccaccucaccccuccuauauccaggggacaaccccaacaagcccaugaacccucugaucacuggggucuucggagcuauugcaggcgcagccagugucuuuggaaacacuccucuggaugugauuaagacccggaugcaggugguggggccgggaaggggaggggaaggggggaccaggccagagcuagcugcugagccccugccugcugaugucccccauagggccuggaggcgcacaaauaccggaacacgugggacugcggcuugcagauccugaagaaggaggggcucaaggcgugagugggggaggggcagggcuauuguccccaccucaaaccuuucccggccuaccuggccugcccacucuguccccuucaggccucugugccucucacuucaguaucuggggauugcccugugcagggacacugugcugaccugccuuccucuccccgccccuccucccacccagauucuacaagggcacugucccccgccugggccgggucugccuggauguggccauaguguuugucaucuaugaugaaguggugaagcugcucaacaaaguguggaagacggacuaagccuagagaggccgcaaggggaccgccccaggcaccgccagaguguccugcuaccuuugucucacgauuccagugcaguagugccaaaaggccccuucccacgucccucgagcucuguagccuggucugugcauuguggcugucaaauccauguguccccccuguggucugugugugacaccaccacugugucccagugucuggcccagccauggcuggaugugcaucuggccuaugacccugugccuguguuucauguucugugucacgugacccugugccccgccucccggggugcccguguggccuggguccucggcccuguagcccuggcccggucccaguccggugccuuccacccugcccuggccuaccacagcugccuccgggccucggccuggcuucaccgcauuccaggggcugcagcccccugcuucucccgccauuggccuuaacuggcccucgggcccucucuccgccccggacaggguggcacccaccacucucaggaccacccugccaaggcagaauaaaccggauccuguugcagccuccuguccuguguucgucccuguauggac

SEQ ID NO: 18039 - RNA, 2641 nt, Homo sapiens
cccucaguaagaggguggcagguugggccaggccagagccuggaccugggaucaggaagggguugcagggagggauggaggggcugaaaacccugggccccugcggccacccccacccccagugucccccaaccccagccuccagcagccauggaggaggccuggaccagcccugccagggauuuguaggguggcccugccugggccccaucuccucugcucacucagugcagucccagagaccuuucccagucccaggggcagggggcagugggcccacaguggagggcgaggcucccgggcucuuucuguccagccaggagcagagagcgagagacacugaggggccgagacaaggagaccuggaggcagggcuuggguggggcuggccccugcacccagggucgaaccagggggcucccaggcaggggggauccauuggcucagggaccagacccugcccaugcccaccccugucacgggagggaggggcccuggccucgcccaggguagcccugucccagcuucagugcgggcugcugggcucugcagaacaguccuuccugcagcuggagcaggagaaccacagccuggugagcaccccacccaccgccccagccccagccccagccccacccaccgccugguaccccugccccagccccagccccacccaccaccuggcgccccugccccugccccugccccagccccagccccacccaccaccuggcgccccugccccugccccagccccagccgcaggagcggccaugacaggcagcccccucucucugccccccaccccagaaaaggcagaaucaggaacuucgggagcagcugggggcccuccuggggccggggcagcaguuccugccccugugucccgaacacucaagcugcacugcucuggccuggguaaauacagggcccagggaccccaugcagccaacgccccucuagcccgcagucuuagggcugaucugggggcucucccacagccccccgacccggcuggcacgcagcccuuggggaacagggcaccucugcagcugcugcggcgggagcugugccaggggcaagaggcuuucgugcaacagucccaggugggccugggggaggggcuguggggggggaggaagcuucguaacagcacuccaggugggccugagggauucauuagggagggaggucuucgugcaguaggccagugggcccagcggggagguacuggccacccugcugaugcugcccaagcccauccugggccccacccucagaacgagcugcagcagauccgccugugcuuugagaggaagaagauggucaucacagaggugcccgccuggcugagggggaggggugcugggggcccacccaguggguccugcuccucaggcgugaccccaccucccccuaggugugggacaacguggcugagaugcacauggcccugaacaaccaggccaccgggcuccugguagguccccacagggcagcacccagaaggacggggcccggcgggcgagaggccacggagggcggggcgaggggccugcugugcuuaccuccucuggcccccagaaccucaagaaggacauccggggcgugcuggaccagauggaggacauccagcuggagauucucagguaacacgggggcaggggccgggccagcugagcagggucucagaagguguccuggucaggacagggcagacccauccuugaccccccaccuccacagcaccgagccagggggugggugccaggcuggggguggagggugugggguccugacagugaggcccccgcagggagcgggcccagugccgcacucgagccaggaaggagaagcagauggcaagcaugucggugagccccccacgccccacucugggucuggagaccagccccccacccagggcccugcuugggcgagagggagaaaugggcuccaggagggcagguccagggcagggggcaucggaaaaguggcugcaggagccuguccaggaggaaggggccagggcugcggugcggggagcccugucugaggaggguuucccaaagccagggaucccugcccucagccuggacacucggggugggcucugauccagccccuccccgacagaaagggaggccaaagcugggaagcuccaagggccuggcaggccagcucugguaggugacugcacggcagagcccagcccccaggccccccgcgcgccccugccccugaccaccgccgcccgcaggcugcugacccugaggcugcugcugggcgcccugcuggucuggaccgcugccuacguguacguggugaaccccacaccuuucgaggggcuggugccaccccugcugagccgugccaccgucuggaagcuccgggcccugcuggaccccuuccugcgccucaaaguggacggcuuccugcccuucuaggccagaggcccagcggccccagcaaggaggccaggcgaccagcacugccccggaugcccaguggccgugccagcccccugcacauggcaccacugugcaccauccuugccagaagcugcagagaaggguggagguggggucuguccugagggcugggccuguggcuggacauagaaucaugacauaaguggccg

SEQ ID NO: 18040 - RNA, 16199 nt, Homo sapiens
cugaucaacaccaaaaauuuuauuuggggaauuaauuagcagggguacccuuaagaacaauagagaaugguuuuguggcuuucucguccccaaaugggagauguagagccacagcccaggguggacccagggacagggacccugugacggagaagggcuggccggagugccacccugccgcaggccguaccacugcuggaggacacagggcuugggccucaggcccucugagaucccgccggcaucgucucugggugcaggcagccccaguggggcccaggcggagcuggccaagaccacaggaccuugguggcaggcagaggccaauggcucaccaggcugguggcuccaggaaguuaaggcaucuguucaugugucaggggaagggcaggaggagugcagagaccuucaggggcaaccugagaccccccccccacccagcccaacccacggaggccugggcuccccgaggaggaaguggcuuagucuaaagugcuugguuggguagggaggcugggcaaaggucgugccgguccccacagcucugggacugccccccuguggggugcuggacccccugcagcaggugggggacucccugaggucauguggacacagggucucaggcccuggcaggcugggaaucugucaagcuguggcugguggagcagagagcccagcccacccccagcccugccccaggguccacugcagucugaccuccuggguccccagcugggcuguccugggccccagagccgccuacuugucauccugcuagggccccgagaggcuggggaaaagacuggaggcagccaagugcaggcggcacauggccccgcgugggggugccccggcggccuggcuccagggggcccgcaguggugggcgguccuccgggcggccaagguggcacaggugcagcccaggaggcacccaaggcuggccacgccgcccccauccacgggugcaggugccaauccgcccccugcgggccgcggcguccgugagagagaagcagaaagguggaggucagcuucggggcccuacagcccgcacgccucccacgcugggacagccccagcccagaaugucucagcccugaacagcugugcaucccucacacucccucagcccugccccuggcauguggcaggcaggagaguuccagcagguucagcggcccccacagggcccugagccaacagguggccccuaugcacccccauuucaucuccccaagcucucggguuccugagaguccccuguggguagcggcagacccaagucuuucccccaaacacccugucacugccagaacugacacagacccaaggcgagagacccucacacuucccagccacagaccaucggccgcccccucuucccaagccucugacucagcccaagucggcagaaaugccccugaggaacccaccgaccccugcacaccagacagcagccacucccucuucuggggcccggccccugcccuccccuaacucgggauccugcagcaauagcccuggccuugcccaaggaaagaaucaaaauaacucuuuuucuuuuuuuuaauaaaauuauagauauauagauguagauauaaaaacauaaaacagacacaacgcaagcagacgcugucaugugcuuacucucaggucccugacaccaagggaagcacugaccccuccccagugugcuuucccacggcgcgagcaccgcagccaggccggggcugcggacguggcaugccuuggggugggguucuccaguuuggcagggagggccugagggcuggggagggggcucugggugucaccagcccccuguggcagcaucacccccgugccugcucccgccugcccccccgucgccucccacaagagcauaaagcaaagguuaaggcuuugaugaaagggacagcggcggccggagcacugacacaucagacacggcgcggcagcacagcacacagacacgggacacauggagccgggcccccggccacagcuggcuggcuggccgucuguccaccuauccaccaccacccagagcaggccagggcagaagcaucagccuugccaagcuacaagcuuccagcgggguccgugaaaggcaacgcguuaguuaggaguagccuggcgggggacacucgguccgggagcccacaggcugugucagaaggacggugggggcccugggugccucuguccaucucugggaccuguccguaaggggaccauugggggcuggccuggcggugaucuggggugcugggugauggcagugggccaagccuggcugagagagggugccccaaagaggcugacugggcccccucacugccccagccaugggacaggcccagacacagaccagcccaguggcccuugucccagugagccgacuuccccaugggcagaugaguggacgggcaggcagagcgcuuggggcaagcuguggaggcguggcacucucucccgccgauggguccacaccaggcugggguggccucgggucccuggggcagagaaguugguggggagggggggugcgcugugggguccugguccccguggcaccauggcggauguguggcagucaguccucacaccgagaucucguagguggucccacccacgccggacaccuucuuaaccagcgugugccguguagggcuggcagagggcccuggggggccgguggcaggucccagccgggccaggcccggggacugcccauuaagcuuacuugggggagucuucagcugaggguggucccugcaucaaaacaagcacauacacacaugcacacggugaacacacgaacacggggacagaggacggaggaggcagcaagacagagacgacgcggacguggacuagugcagccgaguuguggggccccgugcagucccugcccucugggcuuggaggguucaccuggaaagcaggugagggaugcagagccugccuggggagcagcugugcugucacaggacagacagauguugucagaacugccaccacccucccgagucccugggucccuccuagccagcacuggccacagagagcauggggcagccaggugggcacugaauggagccccugccgugcccugcacugggagcccagccacucugccuggccucauuccugcucucucucaggaaaacgaggggcugcccuccugcccaccagcgcugaccaacagcagcuguaucuuugcuacuuaaaccuucuugaggcgagagcccuuuguccccgggcugcgaucccugccuggcugcaaugcugcccacuucuaggucucgggcuccccacucaucacucccaguggcagccuccuccccaacuccacaaaagcugaacaggucccacccugugggguagaggagacccgcucagggcuggacugcugugcccucagccccuuuguggccaaguggccugggcugggcugggcugggcucucccucuggggcugcaucugccgacgggaaacaacugcgccugugcuugagguuuccaggcccggacagggcgacagaugccgugaggacaccaugcgucuguggcguggguccuggccccagcaggugugcagcucuccuaccuggaccugggccugugagccagcugaccccgccuucucagucaccaaccugccgggugccuggagccagccugcuuucuccaguccucagcuuccccaccuacgagcagggaagccccugcuuccuagaacuauguccuacagggagggccagggcccggccacucaggguggcacauucugcugcuagguaauauccucagccccagccuccuagagaugcagccaagcaggcccagggagagcccuggguggacagggccacugugacccaggaagccagagccacagccuaaaggaggcccaggcugccacaugauacuggccccaaagagaaagccccauggccucccacaugcugggucugugccagcucuagaagaacgagucgucgggcucaggacacaaauucucauacccuguccccagagcgugcccaggacauccucagagcugggccacacgggcuagccaaggccuucaaggcagggugaggcgcauccucccugucccguccccagagaaaaacucaggccccugggaugaccuaugagugcccagccaagaggggcccuggagacggcuggacagcugcccugugccaggaagcccacccgcaccucccggcacccaccucugcacggucagcgagggcgguggcucugggagguccguguggaugaaggcgacagcuuuggggcccgcguaggauggugaguggggagugccgggcggggagggcaggcccuggcgugcaggugaccugugugagccacugcugggccggggccccggggcguugcugcuggccugaucagccugcagggaggaggacgacguccgcggugcacggcucacggagcuggacagcgaggacagugacgucugcagggcaggguugcgggcgccaccgaagccgggcccagccacaaggucgucucuggagccauagcgcagcgcgggaccucgggggcccucggacagcacacuggccugcugcaggcuguaggagcugggagcgucauagacgccugagucgccgaagagugagucggccugggagcgcagcaggcgcucacgcuccucccuguccuugcgcuccuggauggaugccaugaugguccuggacagguugucguagcgcacaggcgagggcucccgggggcgggggcccagcacggggcugaagcugcgggguaggggccguggcgggucgcccguugccccaggaugcagguagggugagugguauccggccacgccaacugcugggugggcagggcaggcguggccaccaggcgagccaggauugagcaggcugucauaggacaggcugccguugcgguugggcagugcauggggggcaaaaaugcuacgguggggcguggggggcccccccucagagcgcaggggcugcagggccacaugauccccgccccgccggcucgaggccuugaggcucagggagcgcaaagcgcccgagaaggcaucagaggcgcugagcgguggggauggcggguaggcugcaugcaggcccccuggcccauagucagggagguccaggcucggcucggacacaaaguccaggcuacggaugcugucgucccccagggucagggaaucagggccuggaaccuguagggagaaggcauucucaccacugcccaccugccaccccgccugcagccgccagucagcacccacgggggccacacauggcaccguggccucaggaacugggccucaaggagccauaagagccacauagugacccauggcccugucccugagcauccacggcugaggggcaggggcucugcaacaggagggaggccacagcuggcuacugcagacaccugggguucugcccuuggagccaugcagccccaggggcccaccacucagggcagccagagggaggaggagccucgucuagccccugugacgggcacauaggcaugggcuugggcuugggcuugggacaagagccucaggaaccacaaagccagaaguggaucagggcaaaugugggcucaaugcacuuggccaaccagacccaaucccccacuggacccaggagucccaggaagaugacauacccagagcccucaucuccaaacagggaugccuccuccugcgaggcacggccccuacaugccugcagacucagacccuuggccaaggaggcucagacucacugcuucacccagugacucucuccaggaaagacaucaguccugaggggagaggucccuggggauggggcuggucuaggugcacagggcccagucacaggccugccucucgggguggcccagaaggaaggauggcacccugggacuguuugguguuccugaucacugcacagaccgccccgcacugcccaccauuccagugaccacagagcacucaugcaacucagggaagagaaaugugcuuucucaagcacgucucaaauucuuccaaagucuucccgugggccuuacagagugacuaaugguggaauuccaggcauccugguacacagugcuccugggggcagccgcccaccuggccuagggcaaugcuggccaagggacagacgccaagccuggauggcccacgccagccccucccaggacacccugcuccccucugugggucccagcucugggugcacacagacaggguccuaccagucacacaaggcccuuggugacccaggcagagcccugaggggcauggccucaggggauguggccucugcuggagagauggggcucuggagguggggccuucacggggugaaggcuguggggcgagcuccuagaggcgggccugggggacgaggccugccagggggcaggcuaggccuccuuaccugcucgccugguccacagaagggcaccuugggacccguggggaaagccggccuaaacuuguacauggcaggugucggggggcugguccucugcaccgacagggcacucucuggggaugcagaccacugucagacugaggucagaggagggucaacccauaucccucccuagucguggcugccccaaccucaccagcacugccugggcgcggggucugcaggucacugcugaacgugccagccucuaucuuggggggcagugguggccccaaguccaguggcuucucauccagccgguccaggcugcccuuggacugggagggagcggggucagugguguguggggcuuggaugaggggcagggcuucacuagggauucagccugggaccuagcccccucccaagaaucugucuacggcucugucugccccauccaccucuucuaggcccccaccaaccugccuguuuccccauccaagggccugacugccagcccaucccuaagcccaggcgcccaccuugcuacggcccaggccagccuucagcccguugucacuaagcuugaccuugagcggugcagcucgguccaggaguucaggccuaaggaaaggcggcuucaaacucaccgcgagcggcagccgggguggcuccaccacguaccugcaccagggcacaggggucaguagccagcccaccugccacaaacacacaagggcagggcuggccauaccuggcaagagccaaacggaccaagagggucuaaggcugcccgccccacacccagcagaggccccccuccacccugcccaggccgggccucaccggggcgccagggggcuacacagcacgugcuccacauucccacagcagccucgggugaaaggguucacacccccgcggaacuucccagucaccuguggaugcaggacccucagccagccuggccucccaagguccaggccagggugggcagggggcugggcaagggagcugggguuccuuagaagcugauacuugcgggaaguggcuuaggugggaucagcccagggcugccccucacauagguuacccagccugaacuugcagggagcugugggauuucugggucacugguggccacaguguccacaggcaggaugugcgcaggggacggggcaggcguagccccacgugggggucucagaguuggagccucgucucaacacagcugcacaagcuaccucaggcaagggugccccagcccccacccuguccccaugcagccccaacucucucggcccuuuggggccacccaucccccauggggucugcaccugcucguugguggugcgcccccgagugaccagcaccacauggaagccagugaggccaaugacagggaugaagaagaggccggccacacacaugacagccaugcuagcccguuaaggccaacggugcaggccaggacaccgcagaccccaucgcagcagcacagagcaggugccuguggacaaaccuccucccaaccuagggacggccaccugcccacuggggaucccugggcaggaaccaagccuucugaggcucaaucucccuggugaacguguccccgguccacaucgccucugcaaugaggcccacaggaaccaaggauacgugaugguggugugcgcggcucccagccccucagcgugguucagcacguagaccaggccgaaggccacgacgcccaccaugugugcacugagugacagcaggaacaggaagaaguagcgauaguuucgacgcccgaugcaguuguugacccaggggcagugguggucaaaguccugggcgggagcagugcaucagggcacauggcaggcagggauguggcacagggcugggggagcgcggggcagcagggcggucaccucuacacaguugucacagacgcugcagugggagcagcgcggcgggcgguagaaguggcacguggcacaccacuucaugcggaccuggauaccucgcacauccacguucuuguacagcggagcccggaagucguccuccuuguccucauccucauccgcuacagaccaggagccaggcagugagcaggaaguugacuuuccuggcaggugaaucccucccccaaguccagcccacccaccaggaaucccuaaggcugucucaaguuagccacucacacucuagugaaagugagaggagcugccgcagcacagggcccuaccucgggggaaaacaccaggguccaugaaaguggccaugcugaaguuggccaggacaaagaggaagaugaugccauuguagacgggaacagcuggggacacagcucgugucaaccacgggcaccugcaguagacagugggggcagagaguggagucugggggugcagagcggaugcaggcgcagagcuauguggugcggcaggcugggccugcaaggucacccucagagcucagaggcaguggggaggcugccacagcccugccaagaaaccucagccacaucgcuccuucgaguaacggccagaggcugugcguaucaguacagcaugugggcuacccgugcccugacccggcaaccucucagggcagccgucucagagaggcccacagaccuaaggucaccccauuccagcgaccuaggcuccaugacuggggcgggguagggggcgggggcgguacacaggcuggaggugggagccccagauggaaaaugcgccacgaugccucauccaggccugucccuggcccaguggggccucucaccaggcagauucugggguguggggagccccaguccuuggucaguaagugcauggggcaugucuccccuacucuucccagucaggcacauccccauccagacagccccuucuuuuuaguuugucaccucccuccccagaugacaaaguagaacacuuagggacucuagaaugcacaacaccccccaccacuucccaucuucccagccaucagcacuuggcuccaaggccacccccucuuccgggaagcuuuccaggacuccaggcugcccucugcagcuucccuauaaggugugcccucacacaccuuccugaaaggcgccuuccucagcccuuaacgggccuggcccgaguccccucugaagagacuugccgguccucgggccacacggccugcagcggguuccuaaauccacccacucagcuuccaagaagccccucuggccucaggcuccuugucucuccccugcgcacccugagacagcugcugugacaagcagcagggacaggaacacagggguuugcgucccucccugcacccaggcccucugcauagucggggggcuaguggggaucccccacagcagcccugaccucuauggccacuagcaguggauggggcccacgcgcugccuaccacuccagcgcacguggccacgcugcugcacccacgcccgccuggccaagagccagccccgccgccccggcaaccaccuccacggcagcagagcuucacuauuuuuaguggaaagcaagaggcuauuuaaagacuccgcuucccacgacagccauccucggcggggcugggagcccaaguuacccuuccucuuguccagggcccagcccguggagguagacaccagggugaggacacagcugcggccacaccucccucugcugggagggcucucccugucccugcccaguggcucagcccccaggcuuccuuccacccuccccagcccugccuggcacacaggcagcacucaaacaugugccuggccuccaaugcaacgccauucagccaggaccacaggccccuaaggcagggucggcccaacaagaugggcacaggcaggugagcagcucccccagggagaggcagggccuguggagcucuccacgagccuucuggggaaggcuggcuacauagucugugcaaaaugaaacugcgggccccuuauuuaaaaauuacagagaauuucaagauguugacagcggagcauuaaaccaaacgcaggcccucaugaugcccguggggcuggccugcucugggaagggaugcggcgagugccauuggucaacccucgggcugcaaggaggcagccucuguccucccagugcugaccucaggauggaagccucggggccccucugcaccugcgcuggcugccagccugccuccuggcccuaacgggggccuuggggguguguucgcccaucaggcaggcggggccugaaccccaugcugacuugagcucccugccagcccaagcaggcgguacugcuguguccucccugagccuggacucccccacaccaggcgggcuggacagcagccuugcagccguggggcuacuuugggaaaucugcagugugaccgggucccuccugcccagugcggguaccugccacaugccugugagggcccauaugggcccuaauccagggguuggggaggcuuguuguggguucucugacugggaccugagcugcugcccacuccuccaguccuccagagugaggcaacuguccucucuguaguccccaaggucagauccugccuaacagggaccagcucacaggccaacccaccagggcccagagcucucagggcucagugggagagaagaugaggagcacacgcaggcaccuacagacacgugugaagacauggacacacacacaaacaugcuccagggcacaugugcauggguaugugugcacacacacaaauauacaggcauguacacacauaaacacacagacaaccuguucuggugcacagaaggcacacaugcacacaugcaaucaugucugcauacaaaacacauauacaugcaugaacacuugcaugcagacaugcacacgugcacacacuggugcacaugcaugaacgcagacacgccugcacaucacucacccaccaagaccuaugugugaacacgcgugaacacaggcaugcauagacacaugccuccucacacugcacccagcccuauccagccucggcucggcugccccucacucugggccucagacacggcccucccacucucugggcuucccuuugccccucuguggauagggcaagugugaggacacacaagcacucucagggugcgcaagaacacgggaggacacacaaggacaugcaaggaugcaugaggacacauggggacaggggaggccauguguggaugcucagggacacucaaagacacgcauucccacaggcagggccuagcaggcaguagucuggguccaggcucggggaggcuccacucccacccagaccugauggugcacaccaggcucgccugccggagggccaggcaaagacaggcucugggccugggcuggagguggagugucuggcccgccaugucccucugagccccuccuggcuggcuccagccaagcuacggguggagggcagguccagggggcccagccccgagguuccaaucccuccuccagggccacaggcagggacaugcaccaccaccauaggccccacccgggcugaggccccaagucccgccugggcuggcagggagauaccgccgagcaagagggguggcuuaggggcagaauguccgccacagcuaaauguggaauggaaaauuuuaacucagacguuuucauuuaaaucagguucuucauuagcacuguuuguguaugaguggcacucgcccguggggcgcucgggaccggcggggcagaagcugcugcgcccuugucaggccaggccuuugggccucgaaguaccugcaccuaccuguccaaucccuauagacaccuggacagauggggaaacugaggcucgggggccaggaauaccccaggccacaugcggugggucccagcaggggggcucacacugaguuuucacucccagguuccccagacucaugaggucccagucagcaguucagucccuccuggcccaccaaggcuagucuggcccagggccuguucugacugcuguccugagcugggccuccaggcaaggagagggcucaggacgaucuagggaccagccacaccaucccagaugccccagacagagauaagccagccuggcucagccccaggcacuggcagccugccaggcagccccagcccucggacauucacagggucccugucauucugcaauguggcucuggagugaagucagggcagggucgggagccuggccuaggggucuucgaacccucugccagcagcugacccagccuagcauuauaccaugguauaaagggcuucugaagcccagggggauacaaaacccccagaaacauaggaaggggccgggagcagugaucacacauguaaucccagcacuuugggaggcuaaggcuggcagaucaccugagcucaggagaauagccugggcaacauagcgagaccccaucucuacuaaaaaaaaacaaaaaaacaaaaaauaaauaaauuagccaggugugagggugcccaccugucaucccagguacucaggaggcugaggugggaugaucacuugcgcccaggaggucgagacugcagugagccgagguagcaccacugcacucuggccugggugacagagugagacccugucucaaacaaacaaacaacaacaaaauccuaggaaggcuuccugaaggaagagggccucugagaaacugcccugcuguaugugccccauccugagagggugcucuucacaacugggcauccuuccaugcccagacccuccuagagagaugugugaauguccugcuggucccaagacccuuggcgaucuggcugagggaggggucccugguucucaggccuccagcuccccacaccacaugacacccagaacuccugcccaccuggugcaugggugaagccaccccaccggcagcaacucauguuuacugagugcagagagggggcuggggccacucacugucugguaacguccgaggagcaaacagugaagucgggaacccuguauaggcacuaagggcagggauucggggcacaagagcaaccugcuccccuuccugugugccuggaccagauacagggcaggagguggggcaacggguagacaaguggccugccccaagaagggggccgccuggaccccugccuacccagaaucagcacagcugcuauggguggcaucaaugggccagccgacccaacagaaccccuucucaggaacugagcagucucggaggaguucagcagaggcggggcgggucggggaagaggccaggaucacugacagccauucagcccagggguguggccucaccugcccugagggggcaagcagggcuucuuagccuugcuagguggccacugcacaucaaacccaggugagcacccaggccaccauccugcuacagggacacauggcaucuucucccaggagcagggccggcagaggucagcauaggccagguguaggguugggugcaggcauggccugcacugccccaggagggaaccccauaccucaagacugcuggugucgccgaaaccagaaccccagaacagaggaggggaaacuggugcucagcagagugggagccacccaagcacuccaugccuagggcugggucagguucacagucagagucacguaaagggcccucugacaucacgcgugagggaaccagcagcugcagccaccacacagccaggcugcagacgcggcgccaggaacagaggagcccuccaaggaggacaggagauggggggugugugggguugauuuuaauuucuuagcauuuuuuuuuucuguauuucacaaguuccccauaaagaacauacuuuuuuuuuuuuuuuuuuugagacagagucuugcucugucacccaggcuggagugcaguggugcgauuucggcucacuccgccuuacggguucaagugauuuuccugcuucagucuccuguguagcugggauuacaggugcccaccaccacgccuggcuaguuuuuguacuuuuaguagagacgggguuucgccauguuggccaggcuggucucaaacuccugaccucaggugaucugcccaccuuggccucccaaagugcugggauuacaggcaugagccaccgcgcccggcccacacauuacuuuuaaagucaugagaaaggacacugaauugcauggacagaguaaggaaccaagccagaccccccgcccaaggacagaggcccuggggaccagcacugggcugggcccaccccuccagaagccuuggugggauguguccccccaggccaggcuccccaggcugccccccacccaccucucucugccccacaccagcagcaacuaagugacaagaacacacuggcuugcccgagccagaaauaagcccguccacacaggccuuuuuuaaacaugcucuuggcagccugcggugcccacccagccccagccugcagguaacucucucgccuccacgggcacccgauucagccuugcgaugcacgugggggccccccaaacucuugcaaaggugacgagcgccaggcagccccuaccugccccucuccaggcucacaugcucagggguggccccaccuuggaacagguggccaucguucgugccaccugggcuaugucucaaccccagauugguggaaggggggugggugguugaagaucugugcaaccgaagccuggagcccccaacccuccuugugccugaaggagcccuggggugaccccacagccacagagggaggcugugcuguccgcaugccucucugguccuaagccagccuguaucuugggugaagaaguugaggcuggaggggcccaguguccugcaggcgcgggcucucacucccagaaacaggaccucaaggguccuggugugcaccauggccagcccacggaggugaugugcuaacaucgggcccuggguguggccuggccugggcccuccagcugugaugaccacugggucuuccugagaaggaggccaagggccaggcccgggucaccaguggcuguggggcaggcacguggcaacgaggccaggccacaccuacgugggaacaacuugacucuggcccggggcgggcagccaggaggagacccgagaggcacccacggccaccugcagagaagacucaugguuguggguggcccacguccccucgggggucccauggggagggaagggcugcagccacacccagggcagcccggccuccuccccugccagggcccagcgcuccccgccagggccugccuggacacucccgaggugcccagcccgcacugguguccccacacaagggacucaccccggugcccgggacgccggcacaccgcuucaacucccccagccccagcggguggagagggacugccaucgccugcagccggcgccccgcccgcccacugcccggggccccgccagcccccgcgaccgcugcccccgugcccgggcugugcgggcccugcccaucgcugcccgcgugcccccagacgcggcgccgacucacgugaacacgaagaagagggugcuggagccgaccagcagcgcggcggccguggccaccgggauguacuuggcggguuugaggcgcgucccggggcugcggggcauccugggcgccgcgccgccgcaucccuccccggggccgggcgggcagggccggccggggucgggccggggucgggcgggcgggcuggacgcggcgcaggacccgcggcggcggcggcggcggcggcggaggaaauccca

SEQ ID NO: 18041 - RNA, 6601 nt, Homo sapiens
ucuucccuccgccccacgacccgaaccucgaccccugaccccagcggcgggaaacgcgccgcgauucaaaaccaguacagcuuuauuggcucaggaggcggacacucucauuguccggcccgccccgcgcuucccgccaaaacgcccgcggcgcaugcccggcccgcccgucagccagaggagcgcgcacucccggcgacacccgcgcgcacuuccgucccggccacgcgcgccucuagagcuggcuaaagugguuggggguuggauccggcgcgugacgaugacguugccagaagccaggaucauagagacgcucggccuccgccgcacgcgcuggcggacuaagaguggcuggcgaagcgagcggccggcgcgggccccuggcgggcgggcgguacagccccaagccugagacccggaccugagcaucgcagguucgagucccgccccgccuggggcgaagccggggguggcggcgaccucgcggcguugcaccggcucugugagcaccuccccucugagcacuucccuugugacaggccacuucccuugugacaggcccaggacgagguggccaggcggcccccauggcgucccuggucuaggcggagaaccgccugggcgaugagugagaaccucgacaacgagguagagugcggggagacgcuggguagagacggggauggggugggaggaggcggggugggucaggaaaccugccagagaauagguggggacgaggcaggugcgauaggggaggaaaggagacgggaauggggucgggaggguagacugggggaggggcagggcugagugcagagugcaccgacggaggucugggugucccauaaggaagcuuggggggccaggcccccagggccuaguccucacccuagcaccccaucuguccccacacagggcccgaagcccauggagagcuguggccaggagagcagcagugcccugagcugcccuaccgucucggugcccccugcagccccggcagcccuggaggagguggagaaagagggcgcuggggcggcuacagggccggggccucagcccgggcucuacagcuacaucagggaugacuuguuuaccucugagaucuuuaaacuggagcugcagaacgugccucgccacgccagcuucagcgacguccggcgcuuccugggccgcuuuggucugcagccccacaaaaccaaacucuuugggcaaccacccugcgccuuugugacauuccgcagcgcugcagagagggacaaggcccugcgcguuuugcauggugcccucuggaaaggccgcccacucagugugcgccuggcccggcccaaggccgaccccauggccaggaggaggcgacaggagggugagagugagccaccaguaacacgaguggccgacguggugaccccucuauggacagugcccuaugcugagcagcuugagcggaagcagcuggagugcgagcaggugcugcagaaacuugccaagugagugugggcgcaagacgccccucuuggccagggcucugcccggccugugcuuccucagccuguccaugcaccaguugggaggcccagcacaggaucuggcggccccuuugggagcuagccagcaagacacccacgucacagugggcacaaugacaucccaaaggaggggucaggagccuggacauuuggggaguggccuggcaugggucgggggcaguagguggaguccaaccaccgaucugcuccucuuacagggaaaucgggagcaccaaccgugccuugcugcccuggcugcucgagcagaggcacaagcacaacaaggccugcugcccgcuggagggggucaggccaucaccccagcaggucagacuagacuucgguggccacaaaccccuauccuggguuuugaaaaacuuugcuuuugcucacccuuccuguugaucucccugcuuuguguuuucuucugguaacaucacauaguugucagcuguuccucuuguuugacugccagccccuguggggaaaucaggguuuccaggcccaagcgcugggcagccaggguaaggugcagcucucucucccugcagacugaguaucguaauaagugugaguuucugguuggcgucgggguggauggggaggauaacaccgugggcugucggcucggcaaguacaagggcgggacgugugcuguggcagccccguuugacaccgugcacauccccgaagccaccaagcagguggugaaggccuuccaggaguucauccggugaggaccugugacggggcucccgggaaguccuaugcggugugggagcagaggguggugauccugccccgggaauucuggagugccugccauuucagccagaugaaggaagguguggccagaggagagagcagggggacugcuugcccaguugugggcacuugggccagcucgugauucccacagguccacuccauacucggcauacgacccagagacguacacaggccacuggaagcagcugacugugcgcaccagccgccgccaccaggccauggccauugccuacuuccacccccaggucucaacgggggcccugcugggggagggugccuagccuaggugggccucagcacagccugaugggaacuuuucaccacuuacuccagaagcugagcccugaggagcuggcagagcugaagaccucccuagcgcagcacuucacagcagggccaggcagggccaguggagugaccugccucuacuucguggaggagggacagcgguaaggagcccgaguggggcggggcaggucccugcagggacugugacacugaaggaccugcaccuucgcccacagaaagacuccuagccaggagggccugccccuggagcauguggcuggggaccggugcauccacgaggaccugcuagggcugaccuuccggaucucuccacacgccuucuuccagguagccaugagucccuggugggcauggggacauguugagggaggccugacgcaccaucaggacgugaugggaacagugggcucaggcggugagauuugggggaguauccaggcaggugagccacaggggagggugaaguaagaaagagguuggucaucacugauuugacucgggauaaccuagagguacacacggcaguggcccuugucacagggaggaugaggaguggcccucagugcauuaccacagggcacugcucugggcucggcaggagggaggccaugguggccucugggcugggaaauacuguuucacuguuugcucacugcugcaggaaggcuguggggaccuggagcggccguuuuuggagacaggccuggcaggaccuccuggagggcuaggugugggggugggagcugcaguugggugauuccaggggccccggugugaguugugggaggcaaagcccccuugcuggggcagggaagguacagccuauuggccugcggggccucaugagcccucaaccaaguggggcaaggaggaggcugugcuuagcacgggcuuggcuuuuaaagccaggggcuggaugagggcaucagcaaggcugguccaagguggggucagggaagacguugggcaccaagguggggagugggcgccggaggucccggcaggauggagggaccaggaaugugggcgucggggcaccaguggcaccacaggagaggagccacugacauccugggcaccgccugcccccaggugaacacacccgcagccgaggugcucuacacagucauccaggacugggcccaauuggaugcggggagcauggugcuggacgugugcuguggcaccggcaccauuggccuggcccuggcccgggugagcccuccugcccugcugagggcacccucuccccaccccaagacccccauugaccccagcucaaagucaccacagcugacuccaucaugccccaggcccagcuccucuuugcugcccacagggccccauguacuccccucccuggguggggcgacaccacgcuuuccuguuucagaagguaaagagggucauuggggucgagcuaugcccagaggcuguggaggacgcccgggugaacgcccaggacaauggugaguggcaaggccguggguggggguggggaugggggcagccgccaccccugcugcaagccucagccacagccagggcuugggggcugcccgacagguagagcaagugagcaagcucuuuggcuagggguuccccagggcuggcccugcugggagggcauguggcccucugacaggccacggugccaucucuucagaguugaguaauguggaguuccacugcgggagggccgaggaccuggugcccacccuggugagcagacuggccucccagcaccucguggccauccuggacccaccccgugcuggcuugcgugaguggcuuuugcuuaaggagguggcacgggaacgaggacacaugggguggcucaccauguuaugcacucucuggcuguggggacccagcugguguuugccuccucagauuccaaggugauccuggccauccggagagcuaagaaccucaggcggcugcuguacgucucaugcaacccccgggcagccaugggcaacuuuguggagugagugucugcaggggccugggugggggcuaggccugcuaccaagcccccagcucccacaggagccccugauuagccuaucggcugaccuuagcgccccccuuuuccccccacagccucugcagagccccaucuaaccgggugaagggcauucccuuccggccggucaaggcuguggcaguggaccuguucccgcagaccccgcacugugagaugcucauccuguuugagaggguggagcaccccaauggcacaggggucuuggggccccacagcccuccagcucaacccacaccaggacccccagauaacacccuacaagaaacugggaccuuccccucauccuaggcccaggacccauuauggggacaggagcugaagggcucccagggccccaggggcggggaaggcauggcuugcuggccaggauauucagagguaggcagccaaagggcacagaacccugugccccaccaggauuggccugcugcuaggggccaggggcccugaccaggaagacagguggguuccuguagccuguugcccauccccagggccuuuguggacuagccaaggcugugagggccagaauaaacaacugcucaacaaaggguguuucugugaugagagccaggggucugaacacagggccugggugccagggaaagggccaaacuaggccuaggcagcucugcaagccucucugcauggcugggggagucagggcagagcuuacuuuaaaaaagaauguucgauuugauacuuaaacuugaggagaggcagagagaggucugggaacugcaccagcugggggcaugggguggagaacacugggcagaguuggccccucuguggccagccuggcccucagcccagcagagagggcaucaaccaaggaaggggccaugcuggggugcugcucagcuguuacaaaggcaggguccagccugcagggaggccccaggaggggaucuggccagucaaggguccacagggugccagccucucacccucagaauaaagacaucagccauucccuucuggacaguuugcuuuauguguucagacaaucaaggcucgccuuccaggcacagcccagugcccuggauggcaucagcacaggcuccccugccccggccuugaagcauggcugugugcacgauucauacccaugcuuggcagacggguggggggggggggggggcgcacagagaccacaagaguauggcagcaccugcugugguggugccugggaacagcaagacacagcgaggcuccccaaccuuuaggggaacacaugugcacgaagcuuugguucacaggcgcaucuggcuggcuaagggcaacagucacagucaaaugacuauucacagcugcagacaggaggcaagacagaagcaagugucuaauuauagcaauuugaguugaggguuucuuuuuuaaaggucaacagaagccaaccuuggucacacagguagugagggaaggauauguugugggcggcccacaggccaacauuguuuuccugacagaaaaaaaaaaaaaagcgccaucaguaccgccuguagggggcauggugggggacagacacggcagaacgcuggacucuugcuucagauggcgcaccacaagcacacggcacucugcacaggugccaguccaccaccagggccagccuuugagcacacccuggugccucagacuccggcaggaacacauuuccaucgcacacccacccauaggggccaccagucgagaagcaagcugggcaccaggcagcugccuuugacauccagagaaaccgcugucacaggcaacagcucuggaucaagaaugggcuacacugaaggcccuugcuuccuguuucaacaaguccacuugcuaaaaugcaugauuccaaaucuaccuucuacucucacugugaaagucuuucaaaaugcuaaaauaucacaaaagcuuuaaaaaucaauggguggacaua

SEQ ID NO: 18042 - RNA, 3799 nt, Homo sapiens
gcuuuuuugggagggcguuugagaaggcagcggaaagcaccagcucccggaugcugcacaaccauuuugaccucucaggugagagucuccugccacucugccacacuuucccaccugacccuuugaggcuauugcaggcccuggaaccaagcaaguuggcauggcuggaggagccuggccagcagcccucuugaccuuccagaucuggcccugggacaggcuacuccugguggcucagggagcucuggugaaccucaggccccugagagggaaaaaguguuuuccagggaaugacuggccuggcuguggccuuacagcggccuuacagccagugcuaaggaucacuuucccagcaagccuaggggacuggccaccagggcccgugugccccgaucucaccugucaggguuggguuguuucuguuucauggggugagggaacagcagggcccgugaugacccaggacaccaacccuugcugcgccagccaccucuccacaggccggggugugugucgugauaggugcuaccugugagauggcugggacaccggccccaccugugugucagaugagcccagaauggauaggccugccugcccacugcuuccccagcaccagcacggaacaugguucacauucggcuguguuggcguucuuauuauuguugacagguuuuaaaguaaaacagacguauugauauuucaccccggguuaguuugcuaaagcugccauaacaaagugccacagacaggguggcuucaaccacgugucuccucccaguccuagaggcgagaaggcccaggucaagguggggcagggcuggcuucuccucaggccucucuccuuggcucacacagaugaccaccuucucacuguguccucacguggucuuuccucugcauaccuccuuggugucuguguccaaaccguuucaucuuccaaggacaccagacagauuggauuagagcccacccuaacaaccacauuugaacuuaauuaccauagucacauucuaagguccuggggguaagggcuucaacauagagaugugggggagaccguucagcucauaacacccucaguacuuccugcaccucugagaaaggauauuuucuugccucaucaccacggauuccucaacaaugauagacacugucaugggagauccagccuuuguugaaguggcgucagccaucucagagcugccuuccuugagccagacccagccauggcuguggcacuguguggcauugguucaccccgcacagcagccccugcuaacucuuuugugccugugaugugggagagguggauggacacccacuggccugcagaauaucuggccuucaguauacagggaggacucgggcugggaacugcuugguuucccugaggguggagagccaggggugagggugcagagugggccaugucuagugcccaccugcgugggcugggucuggggcucucggggcuguggcuggcagcauagauggcucccagggccaggccagccccauccuggggccugguuuugcuuuguggugagggucugggugcucagcugagccugagggcccugugagauaugggcaguuugcaccauguccccuugugcggaagagaacacugaagccgaggaauuggccagagugcggccaaaagugaccugccccacccaaggacuuccacaacccacucuggggacggggguucaugccagcuggggugggcaggcccguguuuguccaggucuguagggcccuucccugugucaccucuauugucuucccgggggggaguucucccugcaggccccaacccugaccucucuagcagugcagacagcaguugugaagaugaaguacagugagacagacacaaccacugagugcagaauaccacaggccgggaggagccgcgcacuuuggaaugcaguggagggcaggcagcggaggggaguucugugcccugucuuguguucccacuccucccuucucacggcuguuuuucuuucauuacuucaguaauugagcugaaagcugaggaucggagcaaguuucuggacgcacuuauuucccuccuguccuagggugaguuacagggguucugcagggguggcugcagcagcccccucagagcccgacccugaugcccugcucuguccucccucaacggaggcuucuacuuggguuucagaccgaagcaggguucuugagauuggagccaacacauuuuucccaagcacaucuguccuuaggcugccagcagggccacaauggggcauuuugaggcagcuaauuucauuaagccccugcgaucccuucagaaagagcugguauucacccucugcugaccacacuugggcugggcaucgcgugugacacaugucacacacagacucccuggugcugcccucgaaggccaccuggagccuccugucccacagccuucgugucaggcgcugggcaagagcccgcagagcagccauccgggcuuuugugugcuuggcucaugagaaagcaaagcuguuggcagccgcuuagcugggaauuccaaagcgcugguucugcuggggccuucaccagcacacagcuguccugagggccccauugggauucacuggcaggucacugucccgggacaccucccacugccccaugugcuaccucuuucuuaaggguucccaggaaauaggccugccuugugucuuuguaaccaucucucagcccagguuccccacagggaaugccacauccagcccugcaucucccagagcccuagccuggaggcugcggcuguggcagaugggcccugccaagacucuguugcaggaggucccucaggccaggccugggguccuccccacucucccauccguccguccauccauccaucuguccaucccuccaggggcaagcaccuguucuccuguuggggcuggaguggggguuucugcugacaacagcauagggggccucagggaccccacaguuccucucaggguggccugggcuacauggggcccauuuugggcgcggggcucugagucagacccucgggguuuuuggcaaguucuguagggucaucagcagugaccuugggccagccaccuaaucaggcuuagccuguuuccucauccaaaaauggggcccacucucuccuuagacgaugagugugagcaucacaggacugcauaggguggggcggaggcagagguggggcucucuggcaguggagugggugcuagaggcaaaccccuccccugcagccugcuugguggugauguuaugcugcuguguguccuuccacugaggcaggggcacagguggccugggcuaggagggcugagcagcagagugccgagggauggagggagagcccccaugggagggugccagggggcuggcugagcagcugggcgggguccgugagguaagaaggugcccgggccagggggcaggagcucugauguaggacagcucagcccagucaaggggugcuaugaggacagcaggggccuccgagucugggguggccucacccccacaagcaguccuggcuacucagcagcacuacccagaggggacgccugggcaguuucuucaauucgguggcacaucaacaucguuugaaacuuguuuuuucuuguuuuguuuucuagaauuugauucuuccagaaugaccuucuuauuuauguaacuggcuuucauuuagauuguaaguuauggacaugauuugagauguagaagccauuuuuuauuaaauaaaaugcuuauuuuaggcuccguccccauu

SEQ ID NO: 18043 - RNA, 29982 nt, Homo sapiens
cugacucgcuuuuacccagaaaagcgacgcugggcggacaucuuuacuuugggaagagaagccuacugccucccacugggaacccucagggaaaguauacuucuaaccauacauuaaacucagucacauacccaauggggcagcauuuacguuugcaauagguuuuuggugugguuugaagaaggauuuguagcuuaguuccgcccgaguccucgauggcugaagcagaggcagucuggguagugcauuguggguaguguagucguaaggacaaugggcccuacuaaauucgucuggaggggaauacugucaacacguaauuuaaaauaacguuuaaaaauaccuauaaaaggggaaauaaaucacgaaagggcauuuuaaugcuucuacugaggguguuuuagagccuagcgucuucgccuggccuuuucucuuuugcagccgacgcuuugucccgggcacccccccuccgggucucggguccggcacuuccggugagccucuggggcguaccggcuuggcgcggcggcagcggcagcggcggcugggagagcggucggcgggguuucuucguugcauugccugagaggagcggagucugccaggugguguccaucaugguaagcgcugacgggcagcgggcgggggcugggccuuggcccggggccugagguagggcccggcggggcagggcggggcgggacggcggcggaggugccgagucacccgggccugaguccggccugcaggcucaucggccgcaccgggcacaagcaggacccuugaccacuaaccgccuguggucgcguccgccgguccugaacguggcucgcauucugucucagccggacuugcccuccuugacgaaagaaaggaagguuuguguccauucacggguuucccaagugcuggacgcgcaacagguuuccauaaacccaaaguuaguugcaagguugcuggggaugggaacagaaucagggcgcuccccagggagaauccguagugggcaucccccgcucuugggggacacccagcucuugccccagcuccgugagcuccgugccuacggguucgugccuucgaaucuguacagcgguguuguguucgguaaugauaacgauggaagcuaauaccugcugguacauuuccuguuacacagcuuuuaacaccuguacucccucaucgcggcuuauuucuuuuaaucccuacaaucccuuuggaagcaaggaugaugaugauuuuaaacaugagaaaacuaacguuuacagagguacuuuauucgagucacagaaguagggacuggagaguugaagccaagucugucuggcugcaaagcacucuacgguauugucuuccugucaccuguuuauuuuaguaaagacaaggaaugauuguuagauuuuaucccaagugugucacugucaaacccuggcuuauuucuauucuugaguucauccacucaagaauaccugauauguuccaggcagugugcuaggucucgggauugaaaaggaaagugagagaugggaucgggagcagcaaagaaggggcagaaggucggguucauggguaaacugcaggcagguuguuaaguauguugccccuuugugcggauuuaccuuuuauauucaaagagaagaaauggcuuacauagguuggcuagugagaagcacucaagggaagcaagccccuacccuguucuggccuuguucacccagaaacgcuauuuccuguguuaugguucuggccaagauuuagcugaacaguuaugcugcuuaaaagaagaaagacaaaagauuggaaauuacuguguuagagugccagggaguaaagaaccaucccagauuuuaggcgggaacaugcuauguuugcauuuugggagauggcuaauucagcuugcuaauuuuggaguugcuaguaaacugcuuugucaguagguggcauuccuucuacuaaauauauauuuggaaucaagucaagaaauuuucucuaauacagauuuuuuuuuaguugugguuaaaaaaaccaaauuuuuaucaucuuaaccguuuuucagucuauaguucaauaguguugaguacauucacgagcaacagauuuucagaacuuuuucaucuugcaaaagugaaacucuacucacauuaaacaauagcucuccauuuucugcuccucacagccccugucaaucucuguuccacuuugucuccaugaauuugccuacucuagguacuuccuagaagcggacucauaaaauauaaguccuuuuaugacugacuuacuucacuuggcaugauauccucaagguucauccaugugacaggauuucuuuccuuuuaaaagcugaauaauauuucauuguauguauauaccauaccacaauuuguuuauucauucaucugucauuggacacuugaguugcuuccaccuuuuagcuauuaugaauaauugugcuaugaauacgggguguacaaaaaucucuucuugauucugccuccaguucuuuugaauauauauccuccugugagauuuuaggugguuucaguuacccgaggucaaccaugguccaaaaauauuaaaauagaaaccacauucacauaacuuuuauuacaguauauuguuguaauuguuuuauuauuaauuguuaaucucuuacugugccuaauuuauaaauuaaacuuuuuuuuuuuuuuuuuuuugagauggagucuugcucuguugcccaggcuggagugcaguggcacgaucucggcucacugcaacuuccaccuccuggguucaagcgauucuucugccucagccuccugaguagcugggauuacaggcguguaccaccacgcccggcuaauuuuuguauuuuuaguagagagaggguuucacuauguuggccaggcuggucucaaacuccugaccucagguaauccaccugccucugccucccaaagugcugggauuauaggcgugagccaccgcacccagccuauaaauuaaacuuuauuguagauauguauaagaaaauuguagauauguauaagaaaaaacauaguauguauagauuucaguauuaucugugguuucaggcguccacuggggauguuggaauguauccccuguggauauggggguggggggugggaggaauacuguacuuugagaaaaccuucaaauugauacauguuugcuaagccucaucuuagucuacaguuuaagaucuaggaucuuaucuuuuuaauggcaucauguuuuagcuuugcuuguugcuguaagaaagcaucauaacauaguguaacguguaccuacuuugugcugugagagcacgcuggagaggcacuagaccugacccucagcagagcaagagaggcuuccuggggaaaggaaaggaugguaauuggaacccaggggaaggggugcaaccacuggguaccuguucuuccugcugccuggaaugucuuucccucuuuuuugccuggcucccucucauagcauucaggucuuugugcagagucccuuccuaaccaccuauuuaaaauagcauucccaggagcccugugucuacuuacccugcugcuugucuucagaacugccagacacacauguguguguguccguugcuuggaguguauaucucucuugcuuugagugucauuuucaccaggacaggggugguaucuauuuuguuaguggacagacaucacuggaguggugcuucccuugugcucauaucagagccuggcagacaguaggcacucaauaaagagauguuucaauuaacaaauauuguuuagauuaaugauaauaggaaaaguguucaaggcagaggaacuagcccaggcaggagucuguggggcugucaguacaagucucugagguaugcaagagguugggccuugauccugaggaugaagaugggagcauagcccugaaaaagguucaggacaggcuuggcauggccuguuuuguauuuaguaagauuacauugaagauuucaguacauuguguucucugacaauguuuaguagcauuaauuacucugacauguuuuggcuuuugacaugaagaaauguaccuuuguuuuaauacuuguuucucuuuccuccuucuaguucucuuucaacauguucgaccacccuauucccagggucuuccaaaaccgcuucuccacacaguaccgcugcuucucuguguccaugcuagcagggccuaaugacaggucagauguggagaaaggagggaagaguaugugcuuguuuuuauuugaauaguaacuuuuccugcccuaagucugcaaugcuguagccuucaacaguacuuacuuugcaugugggagucagaagcuaguguuacugugaaaauggugcugggauuuaucccugacuugcucuguugggguggggugcuaauuaugguuagguuuauggcugauaaccauucaguucccaaaauaaauuacaucaaguaagauucuucaugaaagaucacugggacauucuggcuacccuaaaaacaguuuaaggcuuuuuguuagauauaaagaaacugcaucuugccuuuggucuguccuuuuuauuuuuauuuuuuaauauuucuuaaauguucuuuccacaguaauuaugccacccucggcccuggaccaacucaguaaguaucuucugagugacuuaaggacuuagauaauguacauauggacaccaagagucagcaugggcuccucaguacauccagacaccagugcccuuugucagcaucugguugugaauuguccguggagggcaugcgcugggcugggagaaccugggucacagguaccuagggcgaggccagggcccccugaaccucagcuucaucacugcccugggugcuucagguuccuccucugugaaggggguucccuuucccuuccugaucaccaccuccacccaccccccaacuguucucaguauucugucaggauuaagugaagguacaaguaucaagugcuuuguaccgugccagggcagcugaugccauuggcugggcucacuagauuuuuuuccuaaaggaagaauuggucagcucacaagagggcgcugugagcagguuccucauccccucaccaaacaucuuuccugagcuccagacccccauuucuuuucuuuuauuuauuuauuuauuuauuuuuugagacagaguuuugcucuuagcgcccaggcuggagugcaguggcgcaaucuuggcucacugcaaccucugccucccagguucaagugauccuccugccucagccucccgaguagcugggauuacaggcacccgccaccacgcccggcuaauuuuuuguauuuuuaguagagaugggguuccgccauguugggcaggcuggucuugaacuccugaccucaggugaccugccugccucggccucccaaaguuaugggauuauaggcgugaaccaccaugcccggcccagacccccguuucuaaucuccagugcaccaaugcauccucagcaugucaaaaacugagcuauugucuuccauccagaagccacuccucuugcugggcuccugccucuuaccaggagugagauaggcccacagggguucuaagaguggccacauucuuccucccuuuucucugaccccuuaucccaugagagcaaccuggaaacccaugcccuagccccauacuacacaggcacagaaaaucccuaucauggacaacccaaucaaggaugcagucauugccuuccagacuuaaagaguguuucuggugugaauucuuccugugugaggcaggagacugggguuggccaggaggacagguucaugcuugguuuugggggccucugguggcagcaagcagagaacaggugcuggcuguggugugacucaccucgggcucuuugcccagccugacuccagaguagcaacuugaccucucugaaccucaauguccucuucuuuaauuggggauaucuacagugucugugcaucagaaguacuguagugucugugacaaccuaagcuauccgauuccaaccacaagguggagguagccccugagccagcacuggcuguggcuauacccaguggaggccucagcucaaccaguaggucaacagagcuauggaguucacaguucucacgaagacccugucauuacagaggagagaacaggcucccuaaaaaggucuuccuuucaagucaugcugacccaggagccagacaccaggggugacccuuggcacagguguccagaagagacucaggggcugggucauugagguguagcucagaucaguguuguucaaaucuuuuaagugaugggagaaacucuuucugucuaaaucuuauaggaaguccucuaauucauaaaaugagguucucugcuuuuuuuggagaaagugaggggguacagagggacugggagccccagggcacugggagccucuaagucacaaaaugcaguuugagagucaguggacugagggacauuggagucucuuucacuugcaacaaucucagacccuuggcugagcccaguccaguuuacuguggaccagcuguaugucagcuccauggcugugcagcugagagguggaccgggacagagguccuggccccuuuacugccagugugagagucacccuuggugauaggagggagugcccacccuuacuguaccuccaugcuacucucagagguucucuguagcuuccugcccaagcuuuuaacuugauuugcuuuauuagaauuuuuagggagaucucaaauggaaucugcguuacuuccuaacacuaagugugauuuuuauuggaauauuugucugaacuaacaagcuaaauucugcuuugaugguugaaucccuggacuuaagccagcagccuugguuugaauccuggcaucaccacuugugugcugugaggucuugugugcucaccacuugugugcuguuacuuaaccugugggccuuaguuuccccauagauaaaaggggauaaugauaguaccuaccugacuguucugggaagacugaacaagggccuuacacauggcaaacaccaucacuaccaucaguuccuucucggucuucucccgggggcccagugucuccuggguuuuccugccucuuuuugccagcccuuccuuuaugugccugugcaccucuugggucagcacgucaccaguccagcuuacuugccucuggccuugcuuucagcccacaccucaagguccaucagagagagggggcguccuaugucaugacccugcugagagcucacacugcccgcugggcccaggcccuagguucuaccccguguggugccccuccccuucccaaccacucgcacaccuguccccagccugucuugccuaauuauccaccauuucugaacugccugggcuccucuucccuuccacgccuuugcucaggcugccaccucugccuggauuuccucccaggucugcccgcccagugcccagccuaaagaacucggccucuaggagccuagcccaguagcucugcccccuccugccagcucuucccacagcaccugcagcaucugguugugguuuucuuuguuggaagguuucuaccuucaaacuagaaaccuuugaaggucgggauuuuguccagggcauggugggcacugaaauuauuuaugaauaaaugaaugaacacaucacuuuuuaaaauguugacuucagaaaaucacaagucuaugccagugcuguguuaccaaguugccagguuccuccuugagccgugcacugugcucucacagagggggauucaucugccagaggagugugggguugagggcaggauuguggggaggcuccuucuaugggaaggcgugggccgaacaggugucccuucauaggagcugugccucauagucucucucuuauuuucaggccgacuuaacauuaccuaucccaugcuguucaaacugaccaauaagaauucggaccgcaugacgcauuguggcgugcuggaguuuguggcugaugagggcaucugcuaccucccacacugggugaguggggcugccagggucucuagagagcagccacuuaggcagagacaucuccugcacucgagaguccuggcccuggagcagguggccccgccuacuccuccugcucagcgucuuagccugagccgacccagcgagagagaagggauccagagcagugcacugugccuuaugcgggcuggugggcucuggacgcaccugugggccacugugcugugggaguggccuuuucuuugauaguugcgcagcugaacuguucaucugugauuuccugggugaggcguuuuuaaaaauaauggagcaacaguauuuuuuagguggucuaguaaguaggguguuugagguuuuuaugcuuuuccccuacuuuuaguagucugucacagcauacauguuuucaguuaccucugacguagucucccaaaucucucaacugagcugccaugggagugacgucuuuuuccuuacaagcaggcucucuuuggaaaguugacuugaaggaugucauugcagaucugggcugggauauccagggcgugugagccaccagagccugcccucaaggcuguaccccucagagaagugagcagaacugugccagugcuguagggaggagccugcagcagugagaguuccacacagguagcuguggcccacuuggcuccuucuucuccucacuccucuccccagcucuggcacauuagggaaguucacaaagggaccugcuuguccuucucuuugugcuuggauuacaucaggcauacugagagaccccgcagugagcugugggcuggaaacucucaggagugcuugcuuggcugccaccagggagguggucugaagcacagcccaccucuccugcugaugcccuaucaugguggccgccagacguucagaagggauggccuuaacuaauauuuucugagauuaaauaugaauugaaauucuggccagguacgguggcucacgccucuaaucccagcacuucggaaggccaaagugggcagaucacuugaggucaggaguucgagacuagccuggccaacauggugaaaccccgucucuacuaaaaauacaaagacuagccgggugugguggcacgugccuguaguccuagcuacuugggagaccgaggcaagagaauggcuuaaacccaggaggcuuagguugcagugagccgagaucaugccauugcauuccagccugggcgacagagcgagacuccaucucaaaaaaaaaaaacaacaauaauaugaaucaaaauucugaaggucucuuuccugcuguagcaggugaccuugcccaugcugccaugguaguggcauccucuucagccugggucccaggguccuucccaaggucugggccuggccagugucuccccgacaagagcccugcacucccauugcaccuccuagugccuggccuucccaugcugccuccucaccucagcugacuaggccugcccaaccuggccuguuggggggcuuuuaugccucaaagcccagauuggcucaccugcccuccccaguauuugcugcucagccccuugcuauucuuguguuugucugcaggugcccccaagggccugaggccacauugugcucauccgguagaacaccuggucacugaagccacucuagguagcugaagugucaggcagugacuacuuccccagucccuucuguggcucaccuauaagaggagguggugaugcuggggauacacuguaucucgaagguucuccuuuaacccauagacuugaaguuuggguggccucuuguccaagcuguuggacugcuuuagaccaggaaacuaauugaacccuuucuccccuggaaagccucuuuagguagccuggagcugguuuggggugugaagccaucaggccaccucuuccccugagcuggccuuccagcuccuggcaugggcaggcgggugacagguauaccccaucugcugucuuggagggcaugugagccagugcuuuuucugggcuggcugguggacuccaucccacccaugcucccaagcuucuucagggcgagccagccuggaauagguacuggccuuuuuccuuguagccaaggcuucgucugcugaccuagauccgagcccuggacuagccguuugugacauguggguacucggcugcccguugugcuguaugcucuaaaaugcugcauggggagggccaggcaucagcuccuccugccugcuuagugcucucaggccucuuccagcagcccauuucucaccucaagcccuagucugaccucucugccuguccuccucacaucaccuauggcaguguccugccucuggcugaggaagccaccccccaucccuggccagccuucccucaggcuugcaauugcagcccaguauccuuccccucgcugacaaauuucccacaaaaaucuacccagggacagugcgccuggccugcgacuggcuaacucugagccuuagaauacuuccuguuagaacaucacuccuggggaugccagacccccguuaccaaagccagucaccucugcauccuucugugccugccuguggcauuugguagagugaccacccucuauuucugcccuuacuagccugacaagcagcugucagcgugagugcaugggguccucugcaagccuauccauagggcccaccacucaggcuucacucauggccuaggcacggcuucccaggcacagccucggccucagcaugccucucccuccucaugagcucccucucauuugugacacagcccucagcccccuuuucccuuggcuguuaaagucaccuucucacugccacucccgaugaaacauucuugaagggaugugauaccugggauuugcuucagggcaucuaauguggcuugggacugggugugagguagugcugaucgauggacugagccacgacgugagcacuguccaacugucagggcucggugcgugggagcucucuucuacggcucuuucuacugauguauaugucugacaccccuuuuaagacgguuucaaauaagacaagcaaaauuucauugcaagagacauagagcuucugaccugagucuggacucccugcacacccaguacucaugggcauuguuuaucucuuuccgucucacuucucagccgucgucuaccuggcuggguuguuuaauagagacauguggaggcuuugucagauuuuuauaaccuccuuagcagagaccucuggggucugucaccaucuugcagccucagcuguggugggccauuccauugccaggucagccuugccuugugcugcuuuuguccuaccucaggugcagcccuacuugacgcagggccuuauaauuugcuugugggacagcuuggaaguacagugagugacuauuccaggaaaaugcucugccccugggaagccuggagcuagugaguaauccgggcagcccugcagagaugcguucacacugugagcuauacagcuucaguagcaccccuuuauuggccuucuuccuuccacaucacuugauuuuucccuccuuccugacauaguaucacgaauuacuuaucuuggcucagguuccucuuccaaggacccaaguaagacgggccugcccaguguauagggagcagugguuguggaggcugcuucaucucuaggagucucauguagccucuucuuccuuucagaugaugcagaacuuacucuuggaagaaggcggccugguccagguggagagcgucaaccuucaaguggccaccuacuccaaauuccaaccucagagcccugacuuccuggacaucaccaaccccaaagccguguaucuuuuucaaauaagcggaguucuucuagacaaaggagagugugcuggcgguuguuaaacaucauguacuguauugaaucugugccugcuuuggggaucacacauuugugauucaaguugugauuugagaauaaugggguucagcuagcacaucugcguggcccuggccaagugcacugggugcugucugggccaccucugucacuuuccagacacuucauggagaccacaaugaagcccuucuuucaguuggucugugucaccuggcacaaagccaggaugcacaguauguccaguggaaggagggagcagcuuaucugccuucagcuccagccccuucuguggcucccuaguaccuccgcccagcugugcacuggcccgucaaccucacugcaugccagccugagagcugauucacuccaggccaauagguagcaaugacugcaguuucuaugucaccaagcagaaagcaaagguaucagguucuaguggauucuuuuuguucaccucugaacuuaagccagguguauguguugacagcaucaggaaguaggcagugcagguacgggacggugcugugugcaccaaucaagaucucuagcuccauggcccugauuuuuccuguuacgaucauggcauaagaguggccacuccauucuacuucuuuuuuuuuauuuuuuuuuaaugcauacuugaaaaaaaaaacaaacagucaaacaacacagacagauaggaaguuaagaaaagcugccuccuuucccaguagcgcucucuccgcauguuuucuuaggagcaaggcacugcugggugugcucuggaugcauaugggccauguauauucuuugcugccuauguucuggacacgauggccuuguugagccuccugucccacaggcagggggauguccuaugggaagagcuaguuaacuuguccuucagagcucugaccuagacaugcuuguuuggcugucagugaccaggaaugggccaugcccauuuucucaggguuuuuacauguguugcaaugcagacuuuuuuuugagacggagucucacucugcugcucagguuggagugcaguggcacggucucagcucacugcaaacucugccucccagauucaagugauucuccugccucagccuccugaguagcugggauuacaggugugcaccaccacacccggcuaauuuuuguauuuuuaguagagacggaguuucaccauguugccuaagcuggucucgaacuccugaccucaggugcuccaccugccucagccucccaaagugcugggauuacgugcaugagccaccgcgcccugccccaaugcagacuuaucagguugaucucagaugcuguuuugucagcacaauuaacuuguuaguguguggagaaagggcgucacuuccaucaguugagagccugguguuuucuggucuggcugaggucuggaugaaagcagucuuggcaccgagcagagaaagugggaagcuggugcugcagcaggugccagaguacgcagaggccauauggggagcccgcccugccugcagaggccucguguucucagccugagggcucuggcucugcuccuccagcugcugcaguggaagucagagaagaugcccuggcagggucacuagaggaguggagggaagggcacuucguaccguggcacuucauauuugggagcaaagaaagcauccaccacauaaggcgcuuuucacaaaguugcucugguucuggaaagcuguuugaccaagcgaggugaaccuagauagccucacccuuucacccucaaguuggacucacaguggcaggcucuggagccacauuucaugugaccuuuuuauguaaaguccuucagcaaauugaugaggaagacauggcaaaauauuccacaugaauagacauuuccuugugugggcauuuggguucuacaguuuuacuguuauaaaaaguauuugcugguuucuuuauuuuaauuucuauuaacuaaaguuaucagcucaaaagauagaaacaacagaaguauaaaugaaagcaucuuugauuuugaggaacuuuugagaggaccuaucugacucauuaaaucuuuuuuguucuuuaguacucccacaggauuuuuuaaaaucccaugguauaauuuguauacaauaaaaugcacacaguucagccaguuugaaaauguauacacccauguaaucagaacauuuccauguccccaaaagguccuuuccugucaguccccaccugauccccuggcccagaaaccucucagcuaccucccauccucauagaucugucuuucucaggguuccauguggauggaaucucacugcccuuuugugguugguuauuuccccuucccccagcuuggcauuuguuaccccagcuuggcauuucauccauauuauugcauauuaggaguuccauccuucuuuauugccaaguaguacuuuauuguauuaaaagcuucguguuucaaguaccaucaugguacagucucuaccuaccaguaaucaucuaacauggaaacuuguuucagauuaagguauccaucuugccauguugccuugacagaaugugucugcagauuagaaaacgcacuuaggaacuuugccugucugaccaccggggaugugauugccaucaacuauaaugaaaaggugagcccaguucaugcaggucauuccugacaagagccaccugcaguguccauucuaauguuugaauggggcuucuuuuuaagcagcguaugccuggaucuuaucaccuaauuacugccuacuguuugguuauuaaguuuucccggguucauauuuagagcccuaauucauuugguaacucuguuuugaggauagauugcauuuacaggggaacauugauagacuuauuagucauaccucuguguaccuugguggcaaggcugcugguucugucuugguuugaaagguccccacugcaccucuaaucugagcuaagcccuuugcagggcuguggagacacaauaacaacccugcuggguccuuguccuugggauaccugccccacagaagcugacaggcccuucaguggggccaagugcuguguggcaucugagaagcaaagccuggcucugccuuagggcaacaccuccuaggcucaccucuccuccugggagcccacauccuccuccaccuccuguuuucuucagcuuccguuuucacuuagcagcuucucuaggcuugaccuuucugacacaagucucucaggucugaaugccucuguuuucaucccugauuuuaugcuguuuaggugucuggaucuagacaauuuaacuguaaagugaaaugacaggacuuaguccaaaauucaagaaagcauucacuuuccuauuaccuaugggaauaugccugcaggaggauguaauaguuggcaauccugccaucaggcugucccaccacaggcauggagcacaguaauaugggugccccuguucacugugacuguugacaauugacccucccacagagcuguugccagggcuagccuuaguguucgggagugaccacagccuggcuuggcugggcuuucccugaagcuagcacuuagcuccuucacagcacucucuggucccuucggggacugggccgucacagcugugucacagcugccugugguuuagccaguuacucccuuggugucagugcagggauccagcuuauucucuggcaguuuccucauauuugaggcaucugaccuuauuuuucaguuccuuggguuucgaaucacacuuucuuuuuuccuuuuaauaaacuaagaaauaaucuuguucccuuuagcuuuguggagaacauuuuagguaucguuuaccuuaacugaauacucuaagcuuuuauaauuaauuacaggcaguuuaauguuauuguuuuuaauguuaagguaguaauacuacauauaacuccuaaacugaugauaaaggauaguacugauacuuugcacucuaagggaggguacauuauauaagaguguauguaaaauugaaacacagguuugaacuuccacuuuuagaaguagggaaaacuagauccucuaaugggcccuucugauuaauguacuguugugcuuauagagaauuuuaaacacucuaagcuggguugcccugagggcagauggccauaucagugcucuagugggagaucugagucagagaucaggauugaacgggaacccuuaaaagcaguaaaauauacacagagguggguguugucauugucucaggagaaauaaacagauccucucuggaaaaagcacuccaguuuaguuacgucuuugggauugcugucaauugaacaagcaaagaacacauaauuaaacuacaccaaagcagagacaauaaaaauuagaucccuaaggaaaucagcauuagaauuucuagauacaaauguaaaauaauuagauauaaaauguucaaagauauuuuuuaaaauggaauuauaauagcgagcaacaaaaggcuaucaaaaauaaccagaaagauuugaaaaacaauguuaaacaacagcuauaaaagaguuaaugaaagaugaaucugaagaaauaacagaauuucacacagaggagcaaggggauggaacauaugagagcuugagauguugaagacacugagaaagucaaacaugcccauugcaaucccaguaggaaagaauggaggaauugcaauaaucugaagagaugguaacugaaauugauuuagaauugguggucagcccaucaugacaggaaauuuauaauguauaacaaacagaauaagcuacagguagaaaauaccaaauacagagagguaagcagggagaaaacacaguaccuucagaagaacagcaaguagcaggucuuugaauagcaacaguuacagccaguaucaaguaacuaucaucaaaaccuuccuuaaagaauaagggcaaagugaaaauauuuucagaugaaccaaaucugagagagguuauuuaccaauggaauuuuaaaagcauguacuuuaggaauaagcauuauccuagaaggaaagcaagaaggaauagggaauaaauaaauuggcaaauaugaauccaggguaaauguugccauauaaagcaguaauaauguuuaauguaugaagcuuaaaaaaugacaucuaaaauguuggaaaagaguaagucuuuagacuuacucucuuuuuuuuugagagagucucucuuugucucacccuggcuggagugcaguggcgcgaucuuggcucacugcagcuaccaccuccuggguucgagcaauucuccugucucaucucagccaccugaguagcugggacuacaggcaugugccaccacuugcggcuacuuuuguauuuuuaguagagacgagguuucaccauguuggccaggcuggucucgaacuccugaccucaggugagccaucagccucagccucccaaagugcugggauuauagaugugagccaccgcgccuggccuagacuuacucucuugagagaguuguuuagaauuaaaguguucucuguuuacaauucaauaaaguuaauaaaaaagauagcugaagcugggugugguagcucacaccuguaaucccagcaauuugggaggcugagguggguggaucacuuaaguccaggaguuugagaccagacugggcaacauggcaaaaccccaucucgacaaaaaauacaaaaauuagcugggcaugguggcaugcaccuguagucccagcuaccugggaggcugaagugggaggaucacuugaguccgggaggcagaaguugcagugaacagugaccgugccacugcacucuagccuaggugauaaagcaagaccuugccucaaacaaaaaaaaagcaaacccugaaaagucuacaugcauauugaauguuuaaaaacaaauaaaaugaauuagauaaagcaaauaucuugaaagauaaaacugugaaaaauuuuauacuaagaaaugagccaacuuauuugacauugauaaauuauuuccuagagaaaaguguaauugaaguuugacuaaagaaaaaaaaaaacaaacagccuaaauaauuguauagccagucaaguaauucaaucagaaaaaucuuaauccaggaaacacaggcccagaugguuauauaugcaaguucuuccucacacucaagcaauaaauugcucuuagauauucuaaaaauagagaaagaacauaucccccaacucauucucugaggucggcauaaccuugaucaccaaaaccacacaaggauaggagaaagguaaacuacagaucauugucacuugauacagauacauagauuguagauaaaauauugacaaaagaaucuggucauauauaaggaagauucuauacggcagcugaguguaauaaagcuccaguaguuaagacaccauauggcauugguucuggaguagacaaguaggccaguggaagaaagcuuuauauacaaagaaucuugguccaccacugaggcagcauugaugucaccaggcaaaggagauacugggguugcggaaucugggauauugacuauuccuaagaugaaaaaacaaauugaguuccuaacucauaccauagucaaaaauaaauugcagaugaauggguaaauaauaugugguacacacauacaauguaauauuauucaacauuaaaaaggaagggaauucugacacaugcuaccacauggaugaacauucugcucagugaaauaaaccagaugcagacagacaaauacuacauuccgcuuacaugaguacuuagaguagucaaacucaugggagacagaaaguagaaucaccuggacaccgugguucacaccuggcaucccagcacuuugggaggccaagguuggaggauuguuugagcccaggaguuugagaguagccuggguaacauagugugauccugucacuacaaaaaauuaaugaaaaaauuuuaaaauuagcugggcguaguggcaugugccuaguuacagcuauucaggaggcugaggcgggaggaucaguugagucugcagugagccagggucaaggcacugcacuccagccugggggacugagcaagacccugccucaagggaaaaaaaaaaaaaaaaagaauggugguugccagggccucgaggaagcaggaaucaaaagugaauguuuagaaacguauaguaauuuggcauugucauaaccuccacacacauggccacagaaccaguacuugucuuggugagcucugggcgucugguguguguugugucuugcuucugugcaggaggaccacauggcaguccagcagacugcacauuuuuaaaaacuaggucuucccagguaguuugaggagcaccaaccuagaaaauuggucccauaguuuaaaaaaaaaguauuuaauauuaugccaauacauaaaaguaaauggaaaaugucacaggaauauuuauccuuacuaaaugcaauaguacuucuaggguacugucuuccaauucuuuccuuuucaguucugcuugcagcccuguugguuuuaugacccacugauuauuuguggccuuuugaaaacaugaaaacgguagagaagcaugagccaagcccuaggagacauguuugaauguuuauaguagugucauuaacacagcaaaaugauuggaaacaggccggaugcucaguggauaagugguaguauauccacacaaugacagauccuuuuuuuauuccuuaucuauucaauaauuaugacacuuuuaaaaguagauuuggcccugcuuagguuuuuuuuuuaaauggugggacuauccagacuuuuuaaaaugguuguaaaagcaagacauacuggccgggcaugguggcccaugccuguaaucccagcacuuugggaggcugaggcggguggaucacaacgucaggaguucaagaccagccuggccaacauagugaaacaccaucucuacuaaaaacacaaaaauuagcugggugugguggcacgcaccuguagucccaguuacuugggaggcugaggcaagagaaucgcuggaacccgggaggcggagguugcagugagccaagaccauaccauugcacuccagcuugggugccagagcgagccuccaucucgaaaaaaaaaaaaaaaaaaaagcaagacagacuuuagauaaaagcaaagaaccugaaaugaugcaggaaaaaguagauagggccacuuuuaauuucuaugcuucuggaguuuguuuguuugcuuguuuguuuguuuguuuuugacacagagucucgcucuguugcccaggcuggagugcaguggcccgaucucagcuuacugcaagcuccaccuccuggguucacaccauucuccugccucagccucccgaauagcugggacuacaggcaccugccaccacucccagcuaauuuuuuguauuuuuuaguagagacgggucuucaccauguuagcaaggauggucucauuugccugaccucgugaucugcccuccucggccucccaaagugcugggauuacaggcgugagccaccacgcacggcccugcuucuggacauuuuuuaugugccuuuuuuacauaggugaggucaucuuagacacaagcaacaugacugguuuuacaauuauuuuccuguuggcugcguagcauaccauuguauaacuguaaauuuacauaugaagaaauauaauucagcugcauuuugaguauacagacagucccugaccaugguucuaccuagaauuuuucaacuuuauuaugaugcaaacaugauacacauucaguaaaaaccauacuuugaauaccuauacaaccauucuguuuuugaucuucaguacaguauucaauaaauuacaugaguuauucaacauuuuauuauaaaauaagcuuuauaguagaugauuuugcccaacuguaggcuaauguauguguucugagaaugguuaaggcaggcugcacuaugauguuugguagguuaggaauauuaauacauuuuuaacuuauaaguuuaugggacuugguuccaucauaagucaaggagcaucuguacagugguauuagugacguugguaugagcauucuuagaauuuucucauuggguauagcuaguuauuuacuuagaauaaauuucgaaggccgagugcgguggcuuaugucuguaaucccaguucuuuguguggccgaggugggcggaucaccugaggucaggaguucgagaccagccuggccaacauggugaaaccccaucucuacaacaauacaaaaauuagccagguguaguggcacaugccuauagucccagcuacuagggaggcugaggcaggagaagugcuugaacccuggaggcggagguugcagugagccaagaucgcaccacugcacuccagccugggcgauagagcgagauucugucuaaaaauaaauaaauaaaauaaauaguaaaguuccagaagugaacuuuccagguuaaagguuguuagugucuuuugcaguuagcuguauaacuaccuugucuaauuugaaccauaucuggggaacagcaucucuucagcgaugggcacagggcagccugucccuuauggcaguguugucacagcaagaagugcagcuguagguugugucaugggcaugaaugcugugucauucgcaggagccaguagagccacaguaacauggacagcgacagcuccagugcugccaggaaaccauccaacugauuucuguguuugccccacagaucuacgaacugcgugugauggagaccaaacccgacaaggcaguguccaucauugagugugacaugaacgugaguggcucuguccaguuacagugagccugggcccugggaggaugggcaguuggugaccacugcaggccagggugucaggagggcaucaaacagccccugggacucuggguaaagaggaggaagaugcugucagaacaucaugaggagacugugaccuugugaucuaucucagggccaguuggggcaacagaguuugcugccagugcugccaugguuagcucugacccguugaggagugaauauucuuuuuuuuuuugagacuuaguuucacuccuguugcccaggcuggagugcaguggugcgaucuuggcucacuacaaccuccaccucccagguucaagcgauucuccugccucagccucccgaguagcugggauuacaggcaugugccaccaggcccggcuaguuuuguauuuugguagagacaggguuuuaccauguuggccaagcuggucucaaacuccugaccucagguaauccacccgccucggccucccaaagugcugagauuacaggugugggccaccgcgccuggccgaggagugaauaugcuuaagagcuaaggaagcguacugaaccuucugaguaggaaugaagugcugaugcacacagcauccugguuguauuacuagggaauacugcugagcaaaaaaagccaaucccaaaaaguuacuucguuauauaacauccucaaagugacagaacuuucgaaauggaagacagaccagugguugccagggcuuaggacugguggagggggcugggagacagcuggguaugguuauaaaaagacaacaugggcaguccuagugguggugaaacuguucuacaucucaacugugguggauacaugccccacacagugauuacauuguguagaacuaaagauacccaugaacaaaaacauguaaaacuggggaaaucugaauaagagcaguggguugugccaguguugauauccuggcagcaauacuuuacuguaauuuuguaagaugcuaccguugggaaaacugggcaaguguacaaggcaucuuuuguauuauuucuuaaaacugcaugugaaucuacaguugucucaauuaaaaacaaaaaaggaagccaaggguggucaugucucaauauuuuacuuuuaaaauccuggaaacacagguggacuuugaugcuccccugggcuacaaagaacccgaaagacaaguccagcaugaggagucgacaguaaguguuauccucaguguccuuugcuguccugcugcaugcugcuuuugaguuccuggcaguggcucguggguggccucugcuaguguugguguagucauauccucugcgucccuuccagccaugcuuccgggggacauccuagccgggggugggggugagagggaagcuggguguccccgcugaggagcucaccuguuuuucuuuuucccugucaggaaggugaagccgaccacaguggcuaugcuggagagcugggcuuccgcgugaguaccagaccacuugacuuauauugcugugcccucugcuccuugaaauuagagcacucacucaagguguucuccaugaugcucgauggacaucagcagggguuaggccucuggguaccugugcauaugcaaaucugccacucgcucaguuaccaaacccuuuuguauccacucucuccuggaaucuucccaacagccccauaaggcagcccagauuuuuaagaauuucuaaccuaccgaagaguuuaaauaguacaguagacauauacuguucccuuagguucaccaaaaguuaccacauuugcuuucucucucuuguaaaucauguuuccuuuuuucuuugccuguaccauguagguugcaaacaugacccuuagcauaacuacuggcaaggcuccaugggaaacagguggaggugguucaugugugggcacugagguggcaggaggugccaggaagcagcagagagggcagaaugaugggaagcugagcuauggggcagucacaacaguagccuuagcccacccauagagcuugaacuggguggcccugcagaggcagggaucaggucuuuuaacccaacacugacugcuggcugcccuuggccaaguggcugucuucagcucauggccacccccugaggaacugggcagaguucuuagcugccagcaccccagcaguugaggagucagggcuucaguccugaaggggucugcacagcacccccagcucacaucccugcagugaucuccaagcaaaggacauaucguccucacacuugggcuuauuauaugacucaccuacuuccugucuaggcuuucucuggaucuggcaauagacuggauggaaagaagaaagggguagagcccagccccuccccaaucaagccuggagauauuaaaagguaggucuguccuggcucuccuccaggacaggaggaggaucugugccagcccgcuggggucgggcagccucaccccaguucuggagacaaagccugggucaguagucucccaagggacuaaaacccuuagcugcucuccuuggugggguggagcacaacaugccccuccuuccacagugccacccccaguaccacugugguccagccucucuccauaccucuccauacccccaauucagccucuucuugcccccacuggcuuuccuaagaugcgagucugauuagaucugucucuuacucaaaaccuuucuggucccuauuuggugaucugccuauuuuccuguuuugugacuuggaauuauuaaucaggucacauuaucucaguuccccugaaaguucccugaggagcuaccucagaugugcuucuguugcuggguccggggacccacagcagacccuuccucugguggccaugauggcaggggcagggcugaggugugucaguugucuguugugugugugaaaucagaauacuggagugagagucuagccaccucaggggguucugugaagcucaggacagugacagugagggcuucccaauccuucagaugaccccucuccauagacagguacagagccuaaagccccuggcccuauacccaauauugauaccaaaccaagaagucaguuacuuucugcuucccuccugggaggaugccaggaagcaccaaagggcccagguggggugcagcagcaucuuuucugcguuccucuugacugucaaaaaugaauuuuaguccuuuuuuccuggaaauaacauuucucugucucugucucuucuuacagaggaauucccaauuaugaauuuaaacuugguaagauaacuuucaucagaaauucacguccccuugucaaaaagguugaagaggugaguguauuuccuuguauuuccuugguugguaaugaggagauuuauuugcuagugaugacugaaguucuuggcauucugaguaggggugugcauuagucuguuuccaagcugcugguaaagauguacccgagacugggcaauuuacaaaagaaagagguuuaauggacuuacaguucacauggcuggggaggccucacaaucauggcagggggcaagucacaucuuacauggaugguagcaggcagagaaaaagcuggugcagggaaacaccuacuuauaaaaccaucagaucucaugagacuuauucacuaucaugauaacagcacggaaaagacccgcccucaugacucaguuaccucccaccgacucaguuaccucccaccuggucccucccacaacacgugguaauucaagaugagauuuggguggggacgcagccaaaccacaugagggugucugucauguuuucccuuuccuagggucccucugcucccugguguccuguuuuuuucuguagagcugguguaggguguaugaaacagaagacuugcagcaugggggucaggagcucugucuugcucuagagccgacuccaggcucuguuaucacagaacugugugcccugggugggcuucgucuuccaacagagaccuugaacuucaaauauaggcagcaccuucuagcugagcagggugguggcgggacagaggaaggcaagggcugagcauccuguagacaugggcacuuugugggaauauggccaggccuggcagcaacuggaacgcagucaccucuuugugaugaggauuucuacaacaccagcgcuucagacccaucgcucuccugguuccuuuucucaaaggauuggacccuugaggauccaggaucagggcagagggcagauguacugagccacccauucaggaccagcugcuacaugggagccaucccaauuacugaacucuuuucucuagcacuuggggugguuggggacagagaccacugugaaguuugcacaccugguccuacucacaaccacuucugggcucaauguucaaguugaaacagcauugggcauugggaccuuucaggcucagaggagcaaacauaguggccagucagaccucacccuccagcuccuccuucaggcaccauccaggcuucaccagcuacaggcugccuuucucacuaaaagccagugccugacuccgaccuaagaccuuagcaugggacgucccccaggcugacugugaccugacuguugcaaauuuacagaaggcaggggaggccagugggcacagcaggccuguuugaccauaaauauguauuuaagaaguauauguuuaaagaugggauugaagacauauuuagcucuauuccauccugcagccccacuaaggcuguggcuaaaggucaugagguaagaaagacaguggaagaggaggcaacuacaaggcuuuggaagccccagguaccuuaguagaccauagaaagccuagaagcaguucuguguagauuguggaauucucaaaaggcaccucuagaaaugagggacuaaagacagaauucuguuacuaagcaguuagagcugcauuacccucccucccccaucccagaaggcuggaggcucgacuccaguaggucucuagacuacuaucucugaagugaaggccacagucagaaagcuuuccauuccagcaucuaaauaauagaggauuugugggaagaacagccacagaaaccaaaggagcagaaaucaucagggaaauaguuuccccaaagaugggcacaauuuugcagauuugaagggcucacugaguuccagcaaaaugaaugaaaauagccccacuuugaggcaaagaaagauccuaaagcuucuagagagagaacagagguaucaccaugcauuaaggacaucaucagccaagcgccauggcucacaccuguaaucccaacacuuugggaggcugaugcgggaagaucaucugagcccaggaguuugagaccagccugggcaauauagggagacccugucucuacagaaaauuuuaaaaauuagccaagcaugguggcacgcaccuauagucccagcuacuuuaaugcugaguugggagcaucacuugagccugggagguggaggcugcugugagcugagaucacaccacugcacuccagccuggguaacaguaagucccugucucccaaaaaaagggacaucaucuuagcaggacacagaggaaacuagaagauaguggagcaauauacucaaaauucugaggggaaauuuuuuccaaccuaaaauucuguaccaacucuuaugagcuggauugugucccuccaguguuucuguguugaagcccuaacccccaguaacucagauagggccauuuaaagaagcaauuaaguuaaaauaagaccauuagaguuggccauaauucaaucugguguccuuuuaagaagaggaaauuuggacauaggaagggccaugugaggacacagcaagaaggcagccaucugcaagccaaggaaaagggugucagaggaaaccaaaccugcugacaccuugauccugcacuucuagccuccaaaacuaugaagaauaaauuucuguuguuugagccacccuaucuuuggcauuuuauauggcagcccuagcagacuaacauaccaaccagccuaucaaugaaauaugagauuagaaaaaaggaacucacaagaagauaauccucaugcaucuuuucucaggaagcuccuaggagguguuccucacuaaaaugaaggaauaagguagaaauaagaaagucauagaauccaggaaauaaggagcccccacuaacauguacggcaccuagagaaaggccaguccagguacggcagggcgaaggcccaggagacacagguuugucaaaacagaugaacuccaugcaaugcaggcugugauugaauagaggaagaagccaaacacagcuauugacaccaggaugaauggaaggcugugcggcaaaggaagacuaaaugcagcugugacucaaauuuacaugaaugugaccacauaaauacuaaacagugcucuauugcagguauaacaugcuacaguuaguggggagccaggugcagggauguguguugaacauuccagaauccucuucuuccuagggaaaaguugagauaaugccucagacugacuagcaauaaaagcaugugaaaaaaaauaugugcaguuuucaaagguuugggaaaaaacaaucccucuuucugcugauggaaggauagcuuaguggaauguuucugagggcugguuggucucuauauguuaaaagcauuaaaaguguguacacacuuugacccaggaauuugagcucuaaaaaaaaucagaguugugugcaaauacauuaagcugcuuaccacaacaauguccacugguagaaaacuggcccuccuacaucauggaauucuuuuuuacagaauucaguucuguagccuugggaguauacuagacaggaaguuuauuggcaugagauuucagaauuaagugggaaaacaauucuuuaagcauguacagaaaagugaccugaaauguuuuugggugaugaacuuacagacuuuuuuuuuuuuuuuuuuuuuugaggcagggucuugcucuguugcucugccauccaggcuggagcaguggcacaaucauagcucacuauggcccuggcucaaaccauccucccgucucagccucccaaguagcugggaucauaggcacauaccacacugagcuauuuuugguagagaugggaucucacuauguugcccaggcuggucuugaacuccugggcucaagugauccucccaccuaggccuccuaaagugcugggauuacaggugucagcuaucguguccagccugagauauuucuuaugaguaauguggaugguacgugaguccauagaguaaggcauuuauuguaaaccuccagggaguuucugaaaauaguaucuucucuucaaaccuaggaugaagcuggaggcagauucgucgcuuucucuggagaaggacagucauugcguaaaaagggaagaaagcccuaagugaggacuguuggcugauuggaaaauaauaaaagaaucauuugcaacaucuuggcuuuuaguuacuggcacugacagggacgagccucaucagagaauacucuguuacuuaagauuuauuuagaguuaccuaagaauuauuaaguuugacuuggaaguggagcagcaggacuuuguaguuguaugcuugauuuggggaaagacaaagagcugucccugagggccuguagauagcugccuccucaccucuucacgcuuucagcuugaggggagcucccacugccucagcaggagcaauucugcaucccuaauucugucaaaaccuaugaaggugacuaaauugucuaacaugaaguguucuuucuuuuucuucauuuauccuuucuuuuccuacaucaauugcauaggugucagucuuuggccuaaaaaaaggcuuuaaauagacauguguucuauaaguaguggcugucccacuacuguggcugcaauuuaaguauuugacaaagaauguuucuauuuuuauuuuacauauuuuuuucaaaaacaccacucagaagaaccugaucugaaugaguuugcacuuuuauucucauuucauauggacauaacuggcuccuuagugaaccuguucauagugaaacaacuccauggagaagcaaacaugugaauguuagaaugaacaaaugcuaaagagauguuccucuccuucuucccuacuccccaacucccaauuuuaauuuauuaaaucauccaagcuucugcuggccuguauuuuuuaucaguauuuauuuggucuuagaucuucacuuucuauaacgugagaucuuuugacaugcuaaucugauuauuuuaaauuuguucccaugagccacugugccuggccccauugggaauaauucuaagccaagaauuucaaguaaaaacaggcaauaacuaaagccuaaaucua

SEQ ID NO: 18044 - RNA, 2730 nt, Homo sapiens
agggcauggugggcacugaaauuauuuaugaauaaaugaaugaacacaucacuuuuuaaaauguugacuucagaaaaucacaagucuaugccagugcuguguuaccaaguugccagguuccuccuugagccgugcacugugcucucacagagggggauucaucugccagaggagugugggguugagggcaggauuguggggaggcuccuucuaugggaaggcgugggccgaacaggugucccuucauaggagcugugccucauagucucucucuuauuuucaggccgacuuaacauuaccuaucccaugcuguucaaacugaccaauaagaauucggaccgcaugacgcauuguggcgugcuggaguuuguggcugaugagggcaucugcuaccucccacacugggugaguggggcugccagggucucuagagagcagccacuuaggcagagacaucuccugcacucgagaguccuggcccuggagcagguggccccgccuacuccuccugcucagcgucuuagccugagccgacccagcgagagagaagggauccagagcagugcacugugccuuaugcgggcuggugggcucuggacgcaccugugggccacugugcugugggaguggccuuuucuuugauaguugcgcagcugaacuguucaucugugauuuccugggugaggcguuuuuaaaaauaauggagcaacaguauuuuuuagguggucuaguaaguaggguguuugagguuuuuaugcuuuuccccuacuuuuaguagucugucacagcauacauguuuucaguuaccucugacguagucucccaaaucucucaacugagcugccaugggagugacgucuuuuuccuuacaagcaggcucucuuuggaaaguugacuugaaggaugucauugcagaucugggcugggauauccagggcgugugagccaccagagccugcccucaaggcuguaccccucagagaagugagcagaacugugccagugcuguagggaggagccugcagcagugagaguuccacacagguagcuguggcccacuuggcuccuucuucuccucacuccucuccccagcucuggcacauuagggaaguucacaaagggaccugcuuguccuucucuuugugcuuggauuacaucaggcauacugagagaccccgcagugagcugugggcuggaaacucucaggagugcuugcuuggcugccaccagggagguggucugaagcacagcccaccucuccugcugaugcccuaucaugguggccgccagacguucagaagggauggccuuaacuaauauuuucugagauuaaauaugaauugaaauucuggccagguacgguggcucacgccucuaaucccagcacuucggaaggccaaagugggcagaucacuugaggucaggaguucgagacuagccuggccaacauggugaaaccccgucucuacuaaaaauacaaagacuagccgggugugguggcacgugccuguaguccuagcuacuugggagaccgaggcaagagaauggcuuaaacccaggaggcuuagguugcagugagccgagaucaugccauugcauuccagccugggcgacagagcgagacuccaucucaaaaaaaaaaaacaacaauaauaugaaucaaaauucugaaggucucuuuccugcuguagcaggugaccuugcccaugcugccaugguaguggcauccucuucagccugggucccaggguccuucccaaggucugggccuggccagugucuccccgacaagagcccugcacucccauugcaccuccuagugccuggccuucccaugcugccuccucaccucagcugacuaggccugcccaaccuggccuguuggggggcuuuuaugccucaaagcccagauuggcucaccugcccuccccaguauuugcugcucagccccuugcuauucuuguguuugucugcaggugcccccaagggccugaggccacauugugcucauccgguagaacaccuggucacugaagccacucuagguagcugaagugucaggcagugacuacuuccccagucccuucuguggcucaccuauaagaggagguggugaugcuggggauacacuguaucucgaagguucuccuuuaacccauagacuugaaguuuggguggccucuuguccaagcuguuggacugcuuuagaccaggaaacuaauugaacccuuucuccccuggaaagccucuuuagguagccuggagcugguuuggggugugaagccaucaggccaccucuuccccugagcuggccuuccagcuccuggcaugggcaggcgggugacagguauaccccaucugcugucuuggagggcaugugagccagugcuuuuucugggcuggcugguggacuccaucccacccaugcucccaagcuucuucagggcgagccagccuggaauagguacuggccuuuuuccuuguagccaaggcuucgucugcugaccuagauccgagcccuggacuagccguuugugacauguggguacucggcugcccguugugcuguaugcucuaaaaugcugcauggggagggccaggcaucagcuccuccugccugcuuagugcucucaggccucuuccagcagcccauuucucaccucaagcccuagucugaccucucugccuguccuccucacaucaccuauggcaguguccugccucuggcug

SEQ ID NO: 18045 - RNA, 4254 nt, Homo sapiens
uuuugauuaaaccaguauuuauuaacagcaugccugauucuguggaaagcagacuugaacccuggucauuccuacucucaggggcagcauguuaaggauagcagccugcaagucuaucucuuaaacuccacuuguguguacaccuuggugaugucauuguaccugccuucaggggguugguaguuagggaucggugguguguaauguggcccuuccuucucaaaggggaacagguuaggaucccgcuugauggccucagcauggagcuucggggauuccaguugcaguuccuccagagcuuccugcugggcuucuagcauagcccugauggugucccucuccaucuuacgcucuugcugcuuguacaaggaccacuucuucagaagcagagcucuccucucagucuccucaaaggugagcuccaccugaggccgcucucugcaaagaagcuaaggguuaccaaucucacuggcauguaagucugugacugcaacugacacaaguauucccauugccagacacagacaggacuuaggagauaaaacaaguuugggacaaauuaagaaauggaauguugaauguggcugcagcugcaacugaugcuuggaaccaaggucauuugcucucugucaaaagaacagaugaucugaggagacugguagcacuuccucugcccaagcaaauacucccuugggugagagaagacuuuuaacaccugccccuuuauagauggugcacacugcuuacaaaacggcagcaggagcuguuaacccugcacacaguagaaucccaacaaauaccaaccaaagauaucugcaugauaaaacaggaggccaaggguuuucuacuguuaggaugaggcgagggcuucagacuccaggcccaagggaucagaaacagccaagacuccucaugcaugacagcaacaacaugaacuccagagcagugcuuaagcaucuggauuauuagaugucuuagguucuuucccacccagagccauucaagaguaccacccaaggaugcuuucuccugcuuccaaaaggagcaaggacucauuagggccaagucagcucaagccuacugaccaaugacuaucacaggugugaacuacagacacaacuaccugaaguugauauuacuccuuuguccugaggacuucaucccuagagaaggauccuuaccuugcuuuauccaagaacuuuagagggguaauaaaaucuucaauaggaauuagcucuugaguagccuuuuccaguuuucggaucuuccuuuucaagcgcuccuuugcuucuuggucuuuuuuaggaucuaccuucuucuuuuuucgaagagguucugaucuaauagauaaagcaaauauuaaacauuuuccucuuuggucucaugaaccuacugagagacaagaugguaaguaccccauacugaccucuccacugggggaaggagcugugcaugacuaacucaugagcucagcguggugaggagguacuccaccccacaguacuugugagaacuguguaggugccaucaauuacaagaaauaguacaaaagcagccgggugcaguggcucaggccuguaaucccagcacuuugggaggcaaaggcgggcagauugcccaaggucaggaguucgagaccagccuggucaacauggcgaaacccugucucuacuaaaaauacaaaaauuagcugggugugguggugcgcaccuguaaucccagcuucucgggaagcugaggcaggagaaucacuugagccugggaggcggagguugcaguaggacaagaucgcgccacugcacuccagcuuggguaacagagcgagacucugucucaaaaaaaaaaaaaaaaaaaaaaaaguacaaaagcaacaagaggcaucaggguauaaaaucgggaaguguuccucuuuauugcugggauucaggugugccuugggauuacacucaaaagugaaaauaccaaacuguuagauuagaagcuuauuacuauuaaaauugauuuguggacugggugcgguggcucaggccuguaaucccagcacuuugggugcugagguggguggaucaccugagaucaggaguucgagaccagccugaccaacauccaacauggugaaaccccgucucuacuaaaaacacaaaaauuagccgggcgugguagugggcgccuguaaucccagcuacuugggaggcugaggcaggagaauuaguuuaacccaggaggcgaagguugcagugauccgaggucacaccacugcacuccagccugggugacacagugagacuccaucucaaaaaaaaaagaaaaaucaaauccuuuacuaucaagauugacugaaucaaguaucuacaaagagucgagagugccagauggaaauaccuuuaauacuugcaucuuccccacacucuccagggccuccgaaugggcagggaagaggaagggucauggagaaacagaaacuuaagcuguguccuuuaaaacacacaagaaucccuucaaggagaauacuuacuucuugagaaacugcucaaauuuuaaaaauuacaaacaacaaucuaugguuuggaaaauguuggaaaaacagaaaagcaucggccuaaauuuaacugagaaacuuuguaggcuguuaauuuugcaaaccacacauccagcauucuugcuuuguucucuacacauagacugacaccuuuacccccagaggucaggcccucgauugaguuuuaccucaugggaaugaguucccagaaagacaacaaugacgcucgcuggugagucucucuaagcugcgucugccaaguucccagaagccugaaagauacaagaguauguauaaauaucugcuucuccaggcuaggcgcgguugcucacgucuguaaucccagcacuuugggaggccgaggcggguggaucgcgaggucaggaguucaagaccagccuggccaacauggugaaaccccgucucuacuaaaaauacaaaaauuagccgggcgugguguugggcgccuguaauccgagcuacucgggaggccggggcagaacugcuugaacccgggaggcagagguugcagugagccgaaaucgcgccacugcacuccagccugggcgacagagcgagacucugucucaaauaaauaaauaaauaucugauucucucccacuucacaggaaaauaaaaaauugcaaugcucccaaacccggggcacuucuaacuacuugauaugacagcaaggucaacguggaagguuuuucaaaaucuuucguucagaccacagaggacuuaagcaggaccgcugcucgccagggugcucagauuuucaugcauaagagucacgaccagauggcucaucccugagauauucguggacugggaggcgagcagggagcacaggcgaguccuggcggacagucgcgaagaccccgcacgcgcccugggcacuccgcuauccggccagcguccgcacucacccgcuagucgggcgcagggcuagcgagauacuucgcagcacggaggccgucauggcuacccucgccgcuuccgggcgugcgccccuccacaguccggcccgcggugcccccugcugagguccggcagaccaggcgcccagcgcucaggcguuccggcugcgugggcugggacgcgccuguccccgcccccgacgcagccccgccuagggugucagcugcgcacacacgagggccuugcguuucacgcggcucgggguccucccuuccguccccgcccugugcugggagcgcgccucugcagcgggcacagucuagccagucaggcccuagccgguuggucggucugcgcccucgcgcgggccucggcuccgcagugcagccggagcggccgagggggcgucccucugcuccuccgaguccaaauguucaugucuaggcaaacggccccgaucuucuaauaaacgcguccgccccagccucccccaccaggguuggcucgucccccgcauucguucgaguccgaagcccggaucgcauuccggcgccggcgcggagcccggcgcucgcaagaugcccaauagcgcguguugaugaaugacggaagcuaguuaauaagucggacucagacuggcgaggcagagcuggugacgggcgguccacgccaccugggccccgccugccucugcgggcggcccggguugcaacugcaggccccgcucgcuguccgccguccaggcgaaccgcccuuucuggggcgcccgcgcccgggcccgacccgaagccccu

SEQ ID NO: 18046 - RNA, 4254 nt, Homo sapiens
aggggcuucgggucgggcccgggcgcgggcgccccagaaagggcgguucgccuggacggcggacagcgagcggggccugcaguugcaacccgggccgcccgcagaggcaggcggggcccagguggcguggaccgcccgucaccagcucugccucgccagucugaguccgacuuauuaacuagcuuccgucauucaucaacacgcgcuauugggcaucuugcgagcgccgggcuccgcgccggcgccggaaugcgauccgggcuucggacucgaacgaaugcgggggacgagccaacccuggugggggaggcuggggcggacgcguuuauuagaagaucggggccguuugccuagacaugaacauuuggacucggaggagcagagggacgcccccucggccgcuccggcugcacugcggagccgaggcccgcgcgagggcgcagaccgaccaaccggcuagggccugacuggcuagacugugcccgcugcagaggcgcgcucccagcacagggcggggacggaagggaggaccccgagccgcgugaaacgcaaggcccucgugugugcgcagcugacacccuaggcggggcugcgucgggggcggggacaggcgcgucccagcccacgcagccggaacgccugagcgcugggcgccuggucugccggaccucagcagggggcaccgcgggccggacuguggaggggcgcacgcccggaagcggcgaggguagccaugacggccuccgugcugcgaaguaucucgcuagcccugcgcccgacuagcgggugagugcggacgcuggccggauagcggagugcccagggcgcgugcggggucuucgcgacuguccgccaggacucgccugugcucccugcucgccucccaguccacgaauaucucagggaugagccaucuggucgugacucuuaugcaugaaaaucugagcacccuggcgagcagcgguccugcuuaaguccucuguggucugaacgaaagauuuugaaaaaccuuccacguugaccuugcugucauaucaaguaguuagaagugccccggguuugggagcauugcaauuuuuuauuuuccugugaagugggagagaaucagauauuuauuuauuuauuugagacagagucucgcucugucgcccaggcuggagugcaguggcgcgauuucggcucacugcaaccucugccucccggguucaagcaguucugccccggccucccgaguagcucggauuacaggcgcccaacaccacgcccggcuaauuuuuguauuuuuaguagagacgggguuucaccauguuggccaggcuggucuugaacuccugaccucgcgauccacccgccucggccucccaaagugcugggauuacagacgugagcaaccgcgccuagccuggagaagcagauauuuauacauacucuuguaucuuucaggcuucugggaacuuggcagacgcagcuuagagagacucaccagcgagcgucauuguugucuuucugggaacucauucccaugagguaaaacucaaucgagggccugaccucuggggguaaaggugucagucuauguguagagaacaaagcaagaaugcuggaugugugguuugcaaaauuaacagccuacaaaguuucucaguuaaauuuaggccgaugcuuuucuguuuuuccaacauuuuccaaaccauagauuguuguuuguaauuuuuaaaauuugagcaguuucucaagaaguaaguauucuccuugaagggauucuuguguguuuuaaaggacacagcuuaaguuucuguuucuccaugacccuuccucuucccugcccauucggaggcccuggagaguguggggaagaugcaaguauuaaagguauuuccaucuggcacucucgacucuuuguagauacuugauucagucaaucuugauaguaaaggauuugauuuuucuuuuuuuuuugagauggagucucacugugucacccaggcuggagugcaguggugugaccucggaucacugcaaccuucgccuccuggguuaaacuaauucuccugccucagccucccaaguagcugggauuacaggcgcccacuaccacgcccggcuaauuuuuguguuuuuaguagagacgggguuucaccauguuggauguuggucaggcuggucucgaacuccugaucucaggugauccacccaccucagcacccaaagugcugggauuacaggccugagccaccgcacccaguccacaaaucaauuuuaauaguaauaagcuucuaaucuaacaguuugguauuuucacuuuugaguguaaucccaaggcacaccugaaucccagcaauaaagaggaacacuucccgauuuuauacccugaugccucuuguugcuuuuguacuuuuuuuuuuuuuuuuuuuuuuuugagacagagucucgcucuguuacccaagcuggagugcaguggcgcgaucuuguccuacugcaaccuccgccucccaggcucaagugauucuccugccucagcuucccgagaagcugggauuacaggugcgcaccaccacacccagcuaauuuuuguauuuuuaguagagacaggguuucgccauguugaccaggcuggucucgaacuccugaccuugggcaaucugcccgccuuugccucccaaagugcugggauuacaggccugagccacugcacccggcugcuuuuguacuauuucuuguaauugauggcaccuacacaguucucacaaguacugugggguggaguaccuccucaccacgcugagcucaugaguuagucaugcacagcuccuucccccaguggagaggucaguaugggguacuuaccaucuugucucucaguagguucaugagaccaaagaggaaaauguuuaauauuugcuuuaucuauuagaucagaaccucuucgaaaaaagaagaagguagauccuaaaaaagaccaagaagcaaaggagcgcuugaaaaggaagauccgaaaacuggaaaaggcuacucaagagcuaauuccuauugaagauuuuauuaccccucuaaaguucuuggauaaagcaagguaaggauccuucucuagggaugaaguccucaggacaaaggaguaauaucaacuucagguaguugugucuguaguucacaccugugauagucauuggucaguaggcuugagcugacuuggcccuaaugaguccuugcuccuuuuggaagcaggagaaagcauccuugggugguacucuugaauggcucugggugggaaagaaccuaagacaucuaauaauccagaugcuuaagcacugcucuggaguucauguuguugcugucaugcaugaggagucuuggcuguuucugaucccuugggccuggagucugaagcccucgccucauccuaacaguagaaaacccuuggccuccuguuuuaucaugcagauaucuuugguugguauuuguugggauucuacugugugcaggguuaacagcuccugcugccguuuuguaagcagugugcaccaucuauaaaggggcagguguuaaaagucuucucucacccaagggaguauuugcuugggcagaggaagugcuaccagucuccucagaucaucuguucuuuugacagagagcaaaugaccuugguuccaagcaucaguugcagcugcagccacauucaacauuccauuucuuaauuugucccaaacuuguuuuaucuccuaaguccugucugugucuggcaaugggaauacuugugucaguugcagucacagacuuacaugccagugagauugguaacccuuagcuucuuugcagagagcggccucagguggagcucaccuuugaggagacugagaggagagcucugcuucugaagaagugguccuuguacaagcagcaagagcguaagauggagagggacaccaucagggcuaugcuagaagcccagcaggaagcucuggaggaacugcaacuggaauccccgaagcuccaugcugaggccaucaagcgggauccuaaccuguuccccuuugagaaggaagggccacauuacacaccaccgaucccuaacuaccaacccccugaaggcagguacaaugacaucaccaagguguacacacaaguggaguuuaagagauagacuugcaggcugcuauccuuaacaugcugccccugagaguaggaaugaccaggguucaagucugcuuuccacagaaucaggcaugcuguuaauaaauacugguuuaaucaaaa

SEQ ID NO: 18047 - RNA, 666 nt, Homo sapiens
uaggcaaugguaugauuaacuggggccuuaaagaugaugaagauaugacauuuacaagguggacaggcaugauuauugggccaccaaggacaaauuaugaaaagagaauauaggccgggcauggcaguucacaccuauaaucccagaacuuugggaggccaaggagggcagaucacgaggucaggaguuugagacuagucugcccaacauagugaaaccucaucucuacuaaaaauacaaaaaauuagcugggugugguggugugcaccuguaaucccagcuacucgggaagcugaggcaggagaaucacaugaaccuaggaagcagagguugcagugagccgagaucacgccacugcgcucccgugugggccacagcgcgagccucugucucaaaaauaaaaaaaaagaauauauagccugaaaauagaaaguggacccaaauacccagaagcucccccaucaguuagauuuguaacaagaauuaauaugaauggaauaaauaacuccagugggaugguggaugaccgcagcacaccaguguuagcaaaaugacaaaauucauauagcauuaaaguuguacuucaggagcuaagacgucuaaugauguccaaagaaaauaugaagcuuccacagccacuggaaggacaaacauacaacaauuaau

SEQ ID NO: 18048 - RNA, 945 nt, Homo sapiens
uucauuuuuuugugcagaaaguuacuuuugagcauauuuuucaucaccgccagaacaucuuuauuccuaaagcuguagaugaaaggguugagugugggugugaggaucguauagaauauugccaggaacuuauccuggccuggagugugguaugauuuaggucucauauauguaaaaauaaauggcccauaguacaucgugaccacaaucauguggaaggaacaaguggaaaaugacuuuuuccuugccucugaugauuucaucuggaggacaguaagaauaauuuggccauaagaagcagagaucaaggagaaagggaucagcaggaagaucacagcacuuacacaaaccccucguucauagcguguugugucugcacaggacaacuucaacauggcagggacuucacagaagaagugaucaauugcccuagagccacagaagggaaacugcagugcauaagcuguguggacuguggaguugaaaaccccaaugagccaggagccuccagccaugagagcgcuggcauacuccuucauaagaaucggauagcgcagcgggugacagauagccacauagcgaucacaggacauugcagccaggagaaggcacucaccacccaggagggugagggacagaaauaccuggaacccacaaccugcaaaugaaauaguucugcugccugacagaaaguuagugaccauuuugggaacgauguuggaaacaugcaagauauccauuaaggagagauggcugagcagaaaauacauuggaguguggagucgggagucacugcgaaugaggaggaucaugagcguauuuucuguuacacucauaaugaaaaugacaaauaaaacuaagaagaagaccacacuuguuggggaagaagagaacaaucccaaaaguaugaaaucacugcugaaagugugauucugauggcccauc

SEQ ID NO: 18049 - RNA, 10157 nt, Homo sapiens
uccuucccuucguuaauuaguccaucgcauuucaagugcuggauccuuuuuguccccuacugcgugcgguggcagcuuccuugcggaaguggugaccgugagagaagaagauggcggccccuguaguggcgccgccugguguggugguuagucgggcuaacaagcgcagcggcgcggggccgggaggcagcgguggcgggggagccagaggggcggaggaggaaccgccgccgccccuacaagcaguucugguggccgauagcuucgaucgccgcuucuuccccaucuccaaggaccagccucgggugagcgccgcgcacgcgagcagccagagggcaggaaggguggcagggcuggagcaaguucucauuucggcuaacuacaacagcaugcccuugaaggaccugcgucuaugcuguuauccuaaaaccggaugcagagggacugucuaaacccugaugacugcugaccaaguuaguggccggcagauuugggcauucguaaugcuguccaccucggguuugaaaggaaugaagagagcuaaauguagaaacagcgcuugagagaagccuucacgcggggauucagugccccuagaagaggcugcgccgcuuuuaaccuugccgaugacgguugcuuaggugaaaagaaacgaccuuuugccucugaaagggcgguaauaugccuuaaaaagagcgggcuagaucucaggcaguguauuuuuuuuuuccuuccagguucuaaugauagccggugcuaucugucgaaaggacaaaauggguuuagugguugauugccaucagcccccgaguugucuagacaaugggguauuggacucagcugggucguucagcagucaguucagaaagagggaacugcauuggauuuaaggaaaauccucucuaauucccucgaaaaagccuaauggcuguucauuuuugacaagugacgggagauggcuaaccucugacacuuagaaagggaucaaggaaggaaaucuuauggggaagaaggccuuagcaaugcuuaaauuuauggaaauaugauugauuuccaguauuauccuuugccagcagugaacugccauucugucacagcucugugucugauacaaggcacauagauucuguacuuaccauccccaaauugcaaugucucagacucaggcuuagagcauggcaugaacaucaaaggcaggaaccuguuuaucuuugaauuggaaagauacagcaaaauuacacuguuuggaaauacgaauagaggagugaaaauuguugcagugggguacccaaagggauucgagaccucaaguuuuuuuucaucuuguauccuucagguccucuugccccuggccaauguggcauuaauugacuacacucuggaauuccugacugccacagguguacaggaaacauuugucuuuuguugcuggaaagcugcucaaaucaaagaacauuuacuguaaggcccugcaacuuuucuuuccauguuucgccaucuuuuuccaguuuuuucaggaugaauguaacuaaggggaaaugugagaggggaaaaaugugucuacuuagaugucauuguaaguucuaaggguauuuucuacacuuaucaggaggugagcagcugaaacuuuguaucugucugucuuggguuuucugugacaaagauuaaagaauaaacuuggguuuuuucugaaucucauuauaaaguuuggugccaguggacuuugcuuuuauuuaauggcuucaguauggaaguuacaaugauaacaucuuuguuuucccacugaguuucuaaaucuuguuuguucucaccuucaaggauauaaaugagcuccuugucaucuuuguauucccacugccuagcucagucccaagcauauagugagcacuuacauguuuguugaaaucuugaaaacuagggaaucgcauugcuuauggaaguccaggauguaaagacuaggacauuagcauggucuccaucagacaguuccuaaauguuauauggauugcagaaggggaaagcugacgugaagcguguucccaggcuacuuuguguacccuaggcuucagcaggauuuugaguucaaauugauguuuagggacaaggggucaagguauggagaggaaauaaccauguuuccuaacccauaaaacaagacuggugacacaggaugcugaaagcauucauuauaguucauaauacucuuugaaguugaagacgcuggcaagaacccaaaaaagccaucgagaaggacugugagugcugaaagggggugaaaaauggggaaggcucaaaugaucuuuaugcuugauacacucauuccccucacccucccuuccuuuaggaagucaaaguggugccgcccuacaucucucaaugugguucgaauaauuacaucagagcucuaucgaucacugggagauguccuccgugauguugaugccaaggcuuuggugcgcucugacuuucuucugguguauggggaugucaucucaaacaucaauaucaccagagcccuugaggaacacaggucaggaugggaaaaugacaggaacaaggguuaaagaccagcagagcccugagacugcuuuuuugcaguucugucccuccuguccuuuauagguugagacggaagcuagaaaaaaauguuucugugaugacgaugaucuucaaggagucaucccccagccacccaacucguugccacgaagacaaugugguaguggcuguggauaguaccacaaacaggguucuccauuuucagaagacccagggucuccggcguuuugcauuuccucugguguguggauaucugggguccuuugagauggggaagugacaggcuucagugggagaaacaaauuaaaguccuuguaacuucuccccacagagccuguuucagggcaguagugauggaguggagguucgauaugauuuacuggauugucauaucagcaucuguucuccucaggugagcucuuuagggcuggggcugcacacccaaagaguagaacucugugggucuguuauuguccccuuagaaggccaggguauauuucuucucccuguuuauuuucauuauuuuuacuuuuauuuuuugagacagagucucgcucuguugcccaggcuggagugcaguggugugaucccagcucacugcagacucugccuccuagguucaagugauucuccugccucagccuccugaguagcagggauuacaggcacaccaccaugccuggcuaauuuuuguauuuuuaguagagaugggguuucaccauguuggccaggcuggucucgaacuccuggucucaagugaucuaccugucucagccucccaaagugcugggauuacaggcaugagccaccacaccuggccuuauuuucauuuuuauuuauauauauuuuuugagacagggucucgcucuguggcccaggcuggagcacaguggcaccaugacugcucacugcagccucagccucccagguucaagggaaccuccugccucagccuccugaguagauggaaccacaggcaugcacuaccacuaauuuuuguauuuuuuuguagagacgggguuuugccauguuguccggccuggucacgaacuccugagcucaagcaaucugaccaccucagccuuccaaaaugcugggauuacaggcaugagccaccaguuuuuuuuguuguuguuguuguuauuguuguuuugagauggagccucgcucugucgcccaggcuggagugcaguggcaugaucucagcuuacugcagccuccaccuccuggguuccagugauucuccugccucagccucucaaguagcugggacuacagguacgcaccaccacauccggcuauuuuuuguauuuuucaguagagaugggguuucaccauauuggccaggcuggucucuaacuccugaccucaggugauccucccgccuuggccucccaaagugcugcaaucacaggugugagccucugcacccagcauuuuuuuuuuuuuuuuuuuuuuuuuuuugagucggaguuucacucuuguugcccaggcuggaugcaauggugcgaucucagcucacugcaaccuccaccucccagguucaagcaauuccccugccucagccucccaaauagcugggauugcaggcaugugccaccacacccagcuaauuuuuguauuuuuaguagagacgagguuuuaccauguuggucaggcuggucucgaacucccaaccucaggugaucugccugccucggccucccaaagugcuggcauuacgggcaugagccacugcaccuggccuuuuuuuuuuuuuuagaaucuauuguaaagcaaagaucuugucuccaguaucccacugggagucucuuuggaauucugguccauguucagcugucauaggguuugcuaggucucugggggauuaucugugcuccuagagaauaguacuuaauccuggccaagcgugguggcucacgcuuguaaucccagcacuuugggaggccgaggugaguggaucaugaggucaggaguucaagaccagccugaccaacacagugaaaucccaucucuacuaaaaaauaaaaauacaaaaauuagcugggcgugguggcggacgcuuguaaucccagcuacuugggaggcugaggcacaagaaucacuuuaacccaggagguggagguugcagugagccgagaucaugcaacugcacuccagccugggcaacagagcuagacuugucucaaaaaaaaaaaaaaaagaauaguacuuaauucuagcccacuccacuucccuuccacagguggcacaacucuuuacagacaacuuugacuaccaaacucgagaugacuuugugcgaggucucuuagugaaugaggaggugagaaaagucuuccaaugccucuuuaggagagaggagaaggcuaugauuguaucucaugcugguaacuuuugaucuuuuuuguauuuuauugaggcuuaggagggaggaaaagcaggggacaggaggaacaguacacaaagaagaaucuuuguggcagugagaggcagaggggaacuuaaaaggauuagaaaaguuguacuugggggcauucuuccugucuuucuugcuuaggugaccucccuuuccuucucauucagauccuagggaaccagauccacaugcacguaacagcuaaggaauauggugcccgugucuccaaccuacacauguacucagcugucugugcugacgucauccgccgaugggucuacccucucaccccagaggcgaacuucacugacagcaccacccagagcugcacucauucccggcacaacaucuaccgagggccugaggucagccugggccauggcagcauccuagaggaaaaugugcuccugggcucuggcacugucauuggcagcaauugcuuuaucaccaacagugucauuggccccggcugccacauuggugagcacagguggggaaucaagccaacuauccuaggaacaggaaccugggggggccacgucuccagaaacacaagggauggcuacacaagggacagucccugggaauaaggaacuauagagcggcuaccucaggaaaggaggaaacagggauuugaaaacagcgauaccuuaauuuguagccugugggccucucauuggaugacucuucacauuccaggguacccuguagucacauucaggagcaaguagauaauuaacaugcaguaacaacaucuauuuagcacauuacaguuuacaaagggcuuuuauauacauuguuacauuuaaucuucauaauuuacaaauaaacaggcucaacaagauuuucuugcccaaggucauugguaauaauggugggaccugaaucuggguauucugaauguaaguccaguguucuuuugagucuaccauaacugccugguuggccucuugguaucucauuuugguugcaggagugugaugcgucuaauaguacugccccuuuccaagaacaacaguaaggcucagauucuaggggcugagcgugguggcucaugcuuguaauccuagcacacugggaagccauggugggaggaucgcuugagcccaggaguucaagaccagccugggcaacauagcgacaccccuucuccacaaaugauacaaaaauuagcugggcaugauggcgcgugccuguaaucucagcuauucgggaggcugaggcaggaggauuaccugagcccagaggucgagggugcagugagucaugaucauacuacugcacuccagccugggugauggaaugagaccgugucucaaaagaaaaaaaagacuugguuucuaaaauguaccagaagagguggaauuauuugguucugcuuguaggcguggauaugauucuaauaagguuuuuugaguucagaggguccccagaaauccugaagguucucggguucuuaagcucuguguguagucuauaauuguuguaaacuuggugaaguaucuucucaggccugggcuuagggggugaguggguguuucuggugacuugcgggauggggaaugagagcuaggugggagcugugcuggugucagucagcccuguccucuaugaagggcucugcucugcgguuggaacccugaguuacccagaggucuucccauccugagccaggugauaacguggugcuggaccagaccuaccuguggcaggguguucgaguggcggcuggagcacagauccaucagucucugcuuugugacaaugcugaggucaaggaacgagugacacugaaaccacgcucuguccucacuucccaggugagaccugaucuauacugugcacaggcccugaauugcauggcagucacacugagccagaaggggcauuauuuccacccauaauccugucuaaaaaaguugcucucauuaucaggaugcacuuuuccuccacacccuaaugguucuguguuuuuuuuccccuuagguggucgugggcccaaauaucacgcugccugagggcucggugaucucuuugcacccuccagaugcagaggaagaugaagaugauggcgaguucagugaugauucuggggcugaccaagaaaaggacaaagugaagaugaaaggugugagacucaacagguguggggcaucugugugucucgcugccucauagaagaaccaguguuuccuccuggagggauuggugcuuccgccgggcccucucuauagaucauugccuuuuccagguuacaauccagcagaaguaggagcugcuggcaagggcuaccucuggaaagcugcaggcaugaacauggaggaagaggaggaacugcagcagaaucuguggggugagcuaggccugaugccugcccuucuccuccugaaucggaauauuuugaaggauaaugaauacuucagagucacauuacuuauucacuccuuuauucaggcagacagggcagguauauugcucucugucaaugacucuuuuuuucuuuuuccucacccauuauggcuucucaggacucaagaucaacauggaagaagagagugaaagugaaagugagcaaaguauggauucugaggagccggacagccggggaggcuccccucagauggaugacaucaaaggugaguggcaggggagaaaugcgcuggaccaguuuauucucugccuggaucaacuagccagaggcuuacguuccucagaaaggguuugguaucgagucaagacuagaugacuuagagcauucugaaugauguuggcccaugaacuuauccuugcuuugauuucaguguuccagaaugaaguuuuaggaacacuacagcggggcaaagaggagaacauuucuugugacaaucucguccuggaaaucaacucucucaaguaagagcagccccucccuguucuccucggggugaucccgggaagguagaggcuuucucguaaguguuuugucuccaaauaggaaccuauuccuucgacaucccaaauggaaagaccaguaguauuuggagcaaggagagcauuauuaaguucuagccucagcauagacuuucuccuuccuaaacccuccccuuccauauuguuccauccagauuccucuccaaugucuaucaaagucauaguucuaagccugcugaaaggccagugaaggcccuggugucaccccagucuccccacagguaugccuauaacauaagucuaaaggaggugaugcagguacugagccacgugguccuggaguucccccugcaacagauggauuccccgcuugacucaagccgcuacugugcccugcugcuuccugugagcaaagauuggagcugaguacaagggauuggguacaggcaaaggaaaucaggaguagacugucuuguuauauuggguguaugucacuucugguuccuuuuuccuugccucuggaagcugguugggcucuagagcagccuuggcugguucagaggggucagauugaguucaauacugacuggccuuugagacuccaggauuucauaccauccuaggcccacaaagguauauucagaauggaccuggacauucagacucuauggcagcaauuugacccaacacaagaucagccucuggggugggaauagguauuuugaggcagccuauagcaucugauccccuuucaccuucccuaaggaaucucuuuuucccaaacccugucaacaacucccaagucccucugacauaauuccacagaaccuguaucaucucccuuuuguccacccaugucaucaguauggauuugcuuggauguccagguauaggugaaugcuuaggaauauacugcagcucccuucuuucuuccauagcugcuaaaggccuggagcccuguuuuuaggaacuacauaaagcgcgcagccgaccauuuggaagcguuagcagccauugaggacuucuuccuagagcaugaagcucuugguauuuccauggccaaggugaauaugaccucaagccccauucuucugcacuugcuuucaaacgaggguuggugacccccuugggagacauaaaauagaagcuaaugugaauccaguauggaccauccacucccaauaugcuuauugcuagaauaguacagcuuggagccggacuaauaagguagccaucugggggguggucuggaaaugugcaaagcucuccccagcaauaguuccagaaguuagaccugccccaggagcagagcgaacagcucacucuuguccguuuuggaggaggcuacucagugcauagagggaucugagggccugguagaguauccugcuggacuuuccaaggccccugagguccccuuuauuggccuuuugcagguacugauggcuuucuaccagcuggagauccuggcugaggaaacaauucugagcugguucagccaaagagauacaacugacaagggccagcaguugcgcaagaaucaacaggugcgucaggcuguccuccucucgccaagaugguuaucucauucccagguccuggccccuagacucuagggugguugguuucuggggcucugguuguuagagcuguuuaucugccgaggggagcaggagaguuaugugcaccucccccagccgaucucuccucugcuucuuuacagcugcagagguucauccaguggcuaaaagaggcagaagaggagucaucugaagaugacugaagucacacugccugcuccuuugggugugauugagugcccuccuggcuccugggcugggacaagugaggaacuagcugcagagggaugagugaccaccauccaggcugagacugaaaggagcagaggcuggaacuacaguauucuuuccccugcuagcaaccaugugccucccauccugacuguggaguugggauguggaaguggggcuggaacaaagcuucugccuagggaggagcuaagcaggcccggcaguuggaggaaggccagaggaacagcuuugugcuccggcuuucccucagggaacagcagagagcaguuggcucuuucugcugcuuguauauguuaauauuaaaagagagagugguguauuugguuugucuccaucccugacuaaucagccagugaaguaugugaccagaaucacaugauagccuuuccuuaacaccugggggagagggaggacgggugugccagccacuaggugguacu

SEQ ID NO: 18050 - RNA, 10157 nt, Homo sapiens
aguaccaccuaguggcuggcacacccguccucccucucccccagguguuaaggaaaggcuaucaugugauucuggucacauacuucacuggcugauuagucagggauggagacaaaccaaauacaccacucucucuuuuaauauuaacauauacaagcagcagaaagagccaacugcucucugcuguucccugagggaaagccggagcacaaagcuguuccucuggccuuccuccaacugccgggccugcuuagcuccucccuaggcagaagcuuuguuccagccccacuuccacaucccaacuccacagucaggaugggaggcacaugguugcuagcaggggaaagaauacuguaguuccagccucugcuccuuucagucucagccuggaugguggucacucaucccucugcagcuaguuccucacuugucccagcccaggagccaggagggcacucaaucacacccaaaggagcaggcagugugacuucagucaucuucagaugacuccucuucugccucuuuuagccacuggaugaaccucugcagcuguaaagaagcagaggagagaucggcugggggaggugcacauaacucuccugcuccccucggcagauaaacagcucuaacaaccagagccccagaaaccaaccacccuagagucuaggggccaggaccugggaaugagauaaccaucuuggcgagaggaggacagccugacgcaccuguugauucuugcgcaacugcuggcccuugucaguuguaucucuuuggcugaaccagcucagaauuguuuccucagccaggaucuccagcugguagaaagccaucaguaccugcaaaaggccaauaaaggggaccucaggggccuuggaaaguccagcaggauacucuaccaggcccucagaucccucuaugcacugaguagccuccuccaaaacggacaagagugagcuguucgcucugcuccuggggcaggucuaacuucuggaacuauugcuggggagagcuuugcacauuuccagaccaccccccagauggcuaccuuauuaguccggcuccaagcuguacuauucuagcaauaagcauauugggaguggaugguccauacuggauucacauuagcuucuauuuuaugucucccaagggggucaccaacccucguuugaaagcaagugcagaagaauggggcuugaggucauauucaccuuggccauggaaauaccaagagcuucaugcucuaggaagaaguccucaauggcugcuaacgcuuccaaauggucggcugcgcgcuuuauguaguuccuaaaaacagggcuccaggccuuuagcagcuauggaagaaagaagggagcugcaguauauuccuaagcauucaccuauaccuggacauccaagcaaauccauacugaugacauggguggacaaaagggagaugauacagguucuguggaauuaugucagagggacuugggaguuguugacaggguuugggaaaaagagauuccuuagggaaggugaaaggggaucagaugcuauaggcugccucaaaauaccuauucccaccccagaggcugaucuuguguugggucaaauugcugccauagagucugaauguccagguccauucugaauauaccuuugugggccuaggaugguaugaaauccuggagucucaaaggccagucaguauugaacucaaucugaccccucugaaccagccaaggcugcucuagagcccaaccagcuuccagaggcaaggaaaaaggaaccagaagugacauacacccaauauaacaagacagucuacuccugauuuccuuugccuguacccaaucccuuguacucagcuccaaucuuugcucacaggaagcagcagggcacaguagcggcuugagucaagcggggaauccaucuguugcagggggaacuccaggaccacguggcucaguaccugcaucaccuccuuuagacuuauguuauaggcauaccuguggggagacuggggugacaccagggccuucacuggccuuucagcaggcuuagaacuaugacuuugauagacauuggagaggaaucuggauggaacaauauggaaggggaggguuuaggaaggagaaagucuaugcugaggcuagaacuuaauaaugcucuccuugcuccaaauacuacuggucuuuccauuugggaugucgaaggaauagguuccuauuuggagacaaaacacuuacgagaaagccucuaccuucccgggaucaccccgaggagaacagggaggggcugcucuuacuugagagaguugauuuccaggacgagauugucacaagaaauguucuccucuuugccccgcuguaguguuccuaaaacuucauucuggaacacugaaaucaaagcaaggauaaguucaugggccaacaucauucagaaugcucuaagucaucuagucuugacucgauaccaaacccuuucugaggaacguaagccucuggcuaguugauccaggcagagaauaaacugguccagcgcauuucuccccugccacucaccuuugaugucauccaucugaggggagccuccccggcuguccggcuccucagaauccauacuuugcucacuuucacuuucacucucuucuuccauguugaucuugaguccugagaagccauaaugggugaggaaaaagaaaaaaagagucauugacagagagcaauauaccugcccugucugccugaauaaaggagugaauaaguaaugugacucugaaguauucauuauccuucaaaauauuccgauucaggaggagaagggcaggcaucaggccuagcucaccccacagauucugcugcaguuccuccucuuccuccauguucaugccugcagcuuuccagagguagcccuugccagcagcuccuacuucugcuggauuguaaccuggaaaaggcaaugaucuauagagagggcccggcggaagcaccaaucccuccaggaggaaacacugguucuucuaugaggcagcgagacacacagaugccccacaccuguugagucucacaccuuucaucuucacuuuguccuuuucuuggucagccccagaaucaucacugaacucgccaucaucuucaucuuccucugcaucuggagggugcaaagagaucaccgagcccucaggcagcgugauauuugggcccacgaccaccuaaggggaaaaaaaacacagaaccauuaggguguggaggaaaagugcauccugauaaugagagcaacuuuuuuagacaggauuauggguggaaauaaugccccuucuggcucagugugacugccaugcaauucagggccugugcacaguauagaucaggucucaccugggaagugaggacagagcgugguuucagugucacucguuccuugaccucagcauugucacaaagcagagacugauggaucugugcuccagccgccacucgaacacccugccacagguaggucugguccagcaccacguuaucaccuggcucaggaugggaagaccucuggguaacucaggguuccaaccgcagagcagagcccuucauagaggacagggcugacugacaccagcacagcucccaccuagcucucauuccccaucccgcaagucaccagaaacacccacucacccccuaagcccaggccugagaagauacuucaccaaguuuacaacaauuauagacuacacacagagcuuaagaacccgagaaccuucaggauuucuggggacccucugaacucaaaaaaccuuauuagaaucauauccacgccuacaagcagaaccaaauaauuccaccucuucugguacauuuuagaaaccaagucuuuuuuuucuuuugagacacggucucauuccaucacccaggcuggagugcaguaguaugaucaugacucacugcacccucgaccucugggcucagguaauccuccugccucagccucccgaauagcugagauuacaggcacgcgccaucaugcccagcuaauuuuuguaucauuuguggagaaggggugucgcuauguugcccaggcuggucuugaacuccugggcucaagcgauccucccaccauggcuucccagugugcuaggauuacaagcaugagccaccacgcucagccccuagaaucugagccuuacuguuguucuuggaaaggggcaguacuauuagacgcaucacacuccugcaaccaaaaugagauaccaagaggccaaccaggcaguuaugguagacucaaaagaacacuggacuuacauucagaauacccagauucaggucccaccauuauuaccaaugaccuugggcaagaaaaucuuguugagccuguuuauuuguaaauuaugaagauuaaauguaacaauguauauaaaagcccuuuguaaacuguaaugugcuaaauagauguuguuacugcauguuaauuaucuacuugcuccugaaugugacuacaggguacccuggaaugugaagagucauccaaugagaggcccacaggcuacaaauuaagguaucgcuguuuucaaaucccuguuuccuccuuuccugagguagccgcucuauaguuccuuauucccagggacugucccuuguguagccaucccuuguguuucuggagacguggcccccccagguuccuguuccuaggauaguuggcuugauuccccaccugugcucaccaauguggcagccggggccaaugacacuguuggugauaaagcaauugcugccaaugacagugccagagcccaggagcacauuuuccucuaggaugcugccauggcccaggcugaccucaggcccucgguagauguugugccgggaaugagugcagcucuggguggugcugucagugaaguucgccucuggggugagaggguagacccaucggcggaugacgucagcacagacagcugaguacauguguagguuggagacacgggcaccauauuccuuagcuguuacgugcauguggaucugguucccuaggaucugaaugagaaggaaagggaggucaccuaagcaagaaagacaggaagaaugcccccaaguacaacuuuucuaauccuuuuaaguuccccucugccucucacugccacaaagauucuucuuuguguacuguuccuccuguccccugcuuuuccucccuccuaagccucaauaaaauacaaaaaagaucaaaaguuaccagcaugagauacaaucauagccuucuccucucuccuaaagaggcauuggaagacuuuucucaccuccucauucacuaagagaccucgcacaaagucaucucgaguuugguagucaaaguugucuguaaagaguugugccaccuguggaagggaaguggagugggcuagaauuaaguacuauucuuuuuuuuuuuuuuuugagacaagucuagcucuguugcccaggcuggagugcaguugcaugaucucggcucacugcaaccuccaccuccuggguuaaagugauucuugugccucagccucccaaguagcugggauuacaagcguccgccaccacgcccagcuaauuuuuguauuuuuauuuuuuaguagagaugggauuucacuguguuggucaggcuggucuugaacuccugaccucaugauccacucaccucggccucccaaagugcugggauuacaagcgugagccaccacgcuuggccaggauuaaguacuauucucuaggagcacagauaaucccccagagaccuagcaaacccuaugacagcugaacauggaccagaauuccaaagagacucccagugggauacuggagacaagaucuuugcuuuacaauagauucuaaaaaaaaaaaaaaggccaggugcaguggcucaugcccguaaugccagcacuuugggaggccgaggcaggcagaucaccugagguugggaguucgagaccagccugaccaacaugguaaaaccucgucucuacuaaaaauacaaaaauuagcugggugugguggcacaugccugcaaucccagcuauuugggaggcugaggcaggggaauugcuugaaccugggagguggagguugcagugagcugagaucgcaccauugcauccagccugggcaacaagagugaaacuccgacucaaaaaaaaaaaaaaaaaaaaaaaaaaaaugcugggugcagaggcucacaccugugauugcagcacuuugggaggccaaggcgggaggaucaccugaggucaggaguuagagaccagccuggccaauauggugaaaccccaucucuacugaaaaauacaaaaaauagccggaugugguggugcguaccuguagucccagcuacuugagaggcugaggcaggagaaucacuggaacccaggagguggaggcugcaguaagcugagaucaugccacugcacuccagccugggcgacagagcgaggcuccaucucaaaacaacaauaacaacaacaacaacaaaaaaaacugguggcucaugccuguaaucccagcauuuuggaaggcugagguggucagauugcuugagcucaggaguucgugaccaggccggacaacauggcaaaaccccgucucuacaaaaaaauacaaaaauuagugguagugcaugccugugguuccaucuacucaggaggcugaggcaggagguucccuugaaccugggaggcugaggcugcagugagcagucauggugccacugugcuccagccugggccacagagcgagacccugucucaaaaaauauauauaaauaaaaaugaaaauaaggccaggugugguggcucaugccuguaaucccagcacuuugggaggcugagacagguagaucacuugagaccaggaguucgagaccagccuggccaacauggugaaaccccaucucuacuaaaaauacaaaaauuagccaggcaugguggugugccuguaaucccugcuacucaggaggcugaggcaggagaaucacuugaaccuaggaggcagagucugcagugagcugggaucacaccacugcacuccagccugggcaacagagcgagacucugucucaaaaaauaaaaguaaaaauaaugaaaauaaacagggagaagaaauauacccuggccuucuaaggggacaauaacagacccacagaguucuacucuuugggugugcagccccagcccuaaagagcucaccugaggagaacagaugcugauaugacaauccaguaaaucauaucgaaccuccacuccaucacuacugcccugaaacaggcucuguggggagaaguuacaaggacuuuaauuuguuucucccacugaagccugucacuuccccaucucaaaggaccccagauauccacacaccagaggaaaugcaaaacgccggagacccugggucuucugaaaauggagaacccuguuugugguacuauccacagccacuaccacauugucuucguggcaacgaguuggguggcugggggaugacuccuugaagaucaucgucaucacagaaacauuuuuuucuagcuuccgucucaaccuauaaaggacaggagggacagaacugcaaaaaagcagucucagggcucugcuggucuuuaacccuuguuccugucauuuucccauccugaccuguguuccucaagggcucuggugauauugauguuugagaugacauccccauacaccagaagaaagucagagcgcaccaaagccuuggcaucaacaucacggaggacaucucccagugaucgauagagcucugauguaauuauucgaaccacauugagagauguagggcggcaccacuuugacuuccuaaaggaagggagggugaggggaaugaguguaucaagcauaaagaucauuugagccuuccccauuuuucacccccuuucagcacucacaguccuucucgauggcuuuuuuggguucuugccagcgucuucaacuucaaagaguauuaugaacuauaaugaaugcuuucagcauccugugucaccagucuuguuuuauggguuaggaaacaugguuauuuccucuccauaccuugaccccuugucccuaaacaucaauuugaacucaaaauccugcugaagccuaggguacacaaaguagccugggaacacgcuucacgucagcuuuccccuucugcaauccauauaacauuuaggaacugucugauggagaccaugcuaauguccuagucuuuacauccuggacuuccauaagcaaugcgauucccuaguuuucaagauuucaacaaacauguaagugcucacuauaugcuugggacugagcuaggcagugggaauacaaagaugacaaggagcucauuuauauccuugaaggugagaacaaacaagauuuagaaacucagugggaaaacaaagauguuaucauuguaacuuccauacugaagccauuaaauaaaagcaaaguccacuggcaccaaacuuuauaaugagauucagaaaaaacccaaguuuauucuuuaaucuuugucacagaaaacccaagacagacagauacaaaguuucagcugcucaccuccugauaaguguagaaaauacccuuagaacuuacaaugacaucuaaguagacacauuuuuccccucucacauuuccccuuaguuacauucauccugaaaaaacuggaaaaagauggcgaaacauggaaagaaaaguugcagggccuuacaguaaauguucuuugauuugagcagcuuuccagcaacaaaagacaaauguuuccuguacaccuguggcagucaggaauuccagaguguagucaauuaaugccacauuggccaggggcaagaggaccugaaggauacaagaugaaaaaaaacuugaggucucgaaucccuuuggguaccccacugcaacaauuuucacuccucuauucguauuuccaaacaguguaauuuugcuguaucuuuccaauucaaagauaaacagguuccugccuuugauguucaugccaugcucuaagccugagucugagacauugcaauuuggggaugguaaguacagaaucuaugugccuuguaucagacacagagcugugacagaauggcaguucacugcuggcaaaggauaauacuggaaaucaaucauauuuccauaaauuuaagcauugcuaaggccuucuuccccauaagauuuccuuccuugaucccuuucuaagugucagagguuagccaucucccgucacuugucaaaaaugaacagccauuaggcuuuuucgagggaauuagagaggauuuuccuuaaauccaaugcaguucccucuuucugaacugacugcugaacgacccagcugaguccaauaccccauugucuagacaacucgggggcugauggcaaucaaccacuaaacccauuuuguccuuucgacagauagcaccggcuaucauuagaaccuggaaggaaaaaaaaaauacacugccugagaucuagcccgcucuuuuuaaggcauauuaccgcccuuucagaggcaaaaggucguuucuuuucaccuaagcaaccgucaucggcaagguuaaaagcggcgcagccucuucuaggggcacugaauccccgcgugaaggcuucucucaagcgcuguuucuacauuuagcucucuucauuccuuucaaacccgagguggacagcauuacgaaugcccaaaucugccggccacuaacuuggucagcagucaucaggguuuagacagucccucugcauccgguuuuaggauaacagcauagacgcagguccuucaagggcaugcuguuguaguuagccgaaaugagaacuugcuccagcccugccacccuuccugcccucuggcugcucgcgugcgcggcgcucacccgaggcugguccuuggagauggggaagaagcggcgaucgaagcuaucggccaccagaacugcuuguaggggcggcggcgguuccuccuccgccccucuggcucccccgccaccgcugccucccggccccgcgccgcugcgcuuguuagcccgacuaaccaccacaccaggcggcgccacuacaggggccgccaucuucuucucucacggucaccacuuccgcaaggaagcugccaccgcacgcaguaggggacaaaaaggauccagcacuugaaaugcgauggacuaauuaacgaagggaagga

SEQ ID NO: 18051 - RNA, 11164 nt, Homo sapiens
gggccggggcggggcggcggcacugcggugaaagccgaggcagcgggcagacgagcagggggcgggcggacaucuugggauccggagaguggccgggccggcagagcagggggccgaggacaccaggugagccggggaucuggccuuauggcguggaggaggacgcugcgggucgucugccucgccgcgcagcuuuguccugcccugcacugagcuggcggaaagcugcccacacccgggaguggcuucagccuucggacccgggagcuagcugacgguggggcgggggcgcccggggcgcgauugcagggcuggcggggagcggugcccuccaccugacccgccuggcgccucccaugagagggauaccgcuuggaauccucccagagcaggaacgcugcgcagcgcccccucccuaggaucgugccaacccccuaccccuccgcgcaaggacaauuuccccgucucguaggacagugacaccccuuugugccgccgccuugcaccgugacaggucucacgccaugcggcacccccuccucuuaguucaguggcaccccgcggcucuucuuccuuagaccugugacagcccccgcacccccauggcaccaucuuuucccacaauguccuccccaaggcgaaaagccuaccacccucucauuacucugcaccugaaccccaagcaggcucugucuccccagcuuucccuuauucaccacugucaguucccccggccgguuuuuccuucuuaaagccuugaccuuuuccauacuggaaacccuuaccuuuacguucacuccaccagcccaguuugcugcugugggcucaccugaggacgcugccuggcuuucacugaaggucuuuccccuuaacuaaauguuccauucuugcccaaggccccccucugguucucgggugcccuucgcuaccuaccacucgauaccuguggacuuggugcuuugccccaggcucuaccuccauuuugcaucuccucucccagccuguuugggacugagggaugggaugaguccaccaccuugagagaccgcucaccccucuggaagaccuugacagccacaggaaaaggcuuuauuuuccaguuuagaaaaguccucuaaaguacucccugugaaauuaauaccagggcuaauccaggaaaucuaaaaccaaauuaaugccuuuucucaaacagucuaaauuaauuugacccaaauaauuuggauaauucaggcauccugacaucccugcuucuugcuuauaggcacccaggccagaaaugaguuacuucaugggccuggaaucacgauuucagauggaaggauuucuuaauuuuaugagccugcgccacccccaccccccaguccuuauuuuuauugcauuccagagcuuuuugaaaggggggugguaaucagaaauaacuguaauaagcagcuugggugauggaaguguagucugccagcccuaggaccuuccuccugugcccuuugccugcuuauuccacugccuggaagagguuaagccacacucccggguccacauuagggccuaagggcucccuucucuucuccuuauacccuuuccuggaauguuugaauucugugaauuagagugccggaaguucaggcccugcgaccuucucugaaggguaguggagcccaagagacuggaugcucuaaagguuaugccugggggccccaggccugaaccaacuggaguaaugccuaccgccauuccugcagccgcaggcaggcaggcaagccuuagugagucacuggcgggagcccgagagucugcacaggagggggccgaaaaggaucauuccugagcucagugcuggggagagggggcggggguuacugaugcucagccccaggaaagggagggucaaaauggccuuagaauccugggccuaaucucucucuguuucuuucucccaucuaguguggaauaaacaggaacuggagccuggcugaggggaggggcaugucugggagggcugcagggucacuuacuaaaggguugagucaggaaagaagcuccagugaccugcacagcuccacaggggauguuggcagcgauucugaggucuucuuuuacccugcccccgccuguccuaggucuguucucagagcgaugggccgcggagacugaucugccgccaugauuggaggcuuauucaucuauaaucacaagggggaggugcucaucucccgagucuaccgagaugacaucgggugaguccccuggcggagccagcugugccccaccacuccagccccccagccccagcauacaggauuaggucuuuucccaccauuggcuugacuugggccacccugaccccuggcugcacccuggaagcucagcuaguguagccuggcucccauuaggucuggugguauuggcccggcagccagccugccagccccuaggugggaccuguggaauggcauggucccacagcuuuaggaacuccuucccuuccugcauccuguuucucuaguuacagugccuuugcccaggcuggugaauuccuucuuugaggaggaggaggagaaaugucuccagugggugggguuaguggccacgcuggaggcacuaauccaucuaagccuugcucucagaagcccuucccauaucaaacgccuucacuggauucuguugaaagccccuccaggcugcccaauccucuccugcucccuuucucaggagucgucaggcugcugacucagcugucuucaguuccucuggcccauucccuggggaguggcuggaagcgugaggcacucucugggucacugugggagggcagggaagccaugcuacccucucaguagacccagagcagcuccauauccugggccuucacacagagccacagccugccuucucauucugcgcccccuugcacgcccuuguucuuugcgacugaagggaccuauccuagccuccgaggcgcuaaagaguaggcuccucugguuccugcugccuguuuuucuuccucagagagcuugagauaaagucacagaaugggccuguggcagugcucuucauuuggcucccuggcugaugggcuggcuuggcccuugcgggcguuuguccauuggcuggugguguggcaugagcuagagcugcagcuguggcaaggccuggccugucugaaccuggcuggcuacaccccccaccccagacccccuccugccuuggauggacugggcaagccaaggccaggucacacgccgccuugccugucuugucugcuucugccucacggugugugccgcccucccgguguguugugugucuaacccucucucucguugcuaucacucuccucuucuugcuggcgucauuucucucaucccaucucauuggcugccguagcaauagguaagcggccucucaagcugcugcccagguacaggugggugggggccugcccccaucguuuuccugcauccuuuuucauucccucaacuugcucuggaguuggauccugggcaagaauggguagcacaauuccauggccccuugguacuucucccuccuuugugacuucugaagccaugcuggcuuugucuaacaucuggaggagucggcccuccccacuggugggaucacuagcgggaggacugaagaagcagugucucuuucuguccuggaccugggagcuuacagggaagcuagauaaagcugggaaauuagggccagcccugggaguaaggaauaucugucucuaaaccugaugaaccucacuuuauuaagguuacaucagccuuaauaguugacuucccuauuucuuguggccuuuagacacuagcccagcucaggcacucuucccaugccuccacagggagucauaagaagggaaccacuccagugguuuaggcauuggcuuucuuuggagugugugugucagacuucugcagaaaggaggguggggcuguuagcagcugugguugauccuuaugggguaagguucaccugggugcugagcaggcccuaugcacucuuuucccucaggaggaacgcaguggaugccuuucgggucaauguuauccaugcccggcagcaggugcgcagccccgucaccaacauugcucgcaccagcuucuuccacguuaagcgguccaacauuuggcuggcagcagucaccaagcagaaugucaacgcugccauggucuucgaauuccucuauaagaugugugacgugauggcugccuacuuuggcaagaucagcgaggaaaacaucaagaacaauuuugugcucauauaugagcugcuggauggugaggcuggcgggcuggcacggcagcgggcguagggugggaaaaaaccaggcugggccuggccugaagguggguguagguccgaggcucugguacacucugaacuuucuuuccugaguauuuggucucuugggcuaggaucucuaugccccucagaaggccaguucacauccagaccugaaggcuggucugaaguagaacacagaaauaggccagcaggugaucuuccaaggggcuaggaaccugacucagguuugguggcugaaccuccuguauucauccucuuuccuuuguggcuuggaccuuaguucacuaacuguccacccaguuuuccaucucagcagcugcuucagagccugggggagagugagauauuacaagccucuuggggugcacuguuaucucuguuccucuguagagugugaucuaagagaaggugaauacuuccaccuucccaaugucuauuuucuggagaaaacagcucaaagcuucuugacuugccacccacuggccaugugacucuucuauugauuucuuuucuuuuuuuuuuuuuuuugagacagggucuugcucuugucaccuaugcugagugcaguggugcaauugcagcuuacugaagccucgaccuccuaggcucaagcaauccuccagccuuagccuccugaguagcugggaccauaggcacaugccaccaugcuuggcucauuuuuacuacuuuuuguagagcugggucucgcuauguugcccaggcuggucuugaacuccugggcucaagugauucucccaccuuggccucccgaaguguugggauuacaggcaugagccacugcaccuggccuugauuucucuauuugaaaaaaaucaaacauuugaauuguuuuccuguaaagcacaaaucacagaauaaaugcuacaaagcuagaagacuuucuugcggaugaucccacaugggcuuugggagcugugccggucagauguguaggcccaaguaggggcuggaaugaagaagcucuguccaggggcugaugguucccuucuuuuugcagagauucuagacuuuggcuacccacagaauuccgagacaggcgcgcugaaaaccuucaucacgcagcagggcaucaagagucagguacuugaauugugcagacuauagucaggguggaguccaaucucccuucaucucagcuggccccugagccuugucugagcugacucaugagcccucccaugacaggaagugcuggccugagccuccugccaugauugcaggccgauuuugcucugugugguccucccacugcaggagcagccaauucagcaucucuauuaccaggaauacagcucaagcaguuuccuuuugcacugaggggugggggaggaggccuggucuugaggccugguauuccucaggaggagcgagcuugggcccucuccucuaggauccaagccucauagcuuucuccuccuuuucugccucccuugcugcuucaugugggcaccucguuggcccugcggccuccagcaucagguaagcucuucccucagcuuccacccuugcagcuuugcuuuguuucuccaggcccugcccuuuggggcuuauaggggaaaauggauuacagguggggacuagaagggauggggaaugaggguggaguggggauagagacaggaugauuaaagggacagaggagugaggccauugcuguuuguuucugcccucauguagacaaaagaagagcagucacagaucaccagccagguaacugggcagauuggcuggcggcgagaggguaucaaguaucgucggaaugagcucuuccuggaugugcuggagagugugaaccugcucauguccccacaaggugaggucccucucacgacaaaguuggagggggcccagggcaggauccugggccugccugccugacuccgcugcuccccauuuaucuguuccaucaccagggcaggugcugagugcccaugugucgggccggguggugaugaagagcuaccugaguggcaugccugaaugcaaguuugggaugaaugacaagauuguuauugaaaagcagggcaaaggcacagcugaugaaacaagcaagaggugccugaggcaggagagcuggugggagagggugucccuuggagggcucaguggggucuagugaaccacaaguuucuucuggauuucauucccacuguaauugcaaacucuguuccugacgguaagccuggcuguucgcucuugacauuagugcuacgagagaugaggggaucguccucagagagcaagccccuuuguuuggucccuaggaccaaggccuuuucuguacauacugacagccucugcccagugugccugaaacacccaggucccuagcagaaggagccccaagagaugagcuugcaaggcuucccucucaucccaagcucuggggcagaccuccgagucacaaagcugcauucuagcagcuuuucauagucucuggugccagccugggguggaguggucucccagcaugacagcugucauucuccuguaccaaugagaccucuucugccccugcuugcagcgggaagcaaucaauugccauugaugacugcaccuuccaccagugugugcgacucagcaaguuugacucugaacgcagcaucagcuuuaucccgccagauggagaguuugagcuuaugaggugccauuggggugugaggaggcagcuagugcugcuggcagacuggggagaggaagugggucagcucuuugguaaccuugcuucccaucccuuaagguaucgcacaaccaaggacaucauccuucccuuccgggugaucccgcuagugcgagaagugggacgcaccaaacuggaggucaagguggucaucaaguccaacuuuaaacccucacugcuggcucagaagaucgaggugaggacagggggcucaaggaggaggaagaacuugucccuaggaauaaagguagcugaugucacagcuugacagagcucccugacaggugugucacuucuaggugaggaucccaaccccacugaacacaagcggggugcaggugaucugcaugaaggggaaggccaaguacaaggccagcgagaaugccaucguguggaagugagucuuuccuucauuaggccacagcagggcucaagaucccaguauacccucuuguuuucagcuuugauccuucugaaugaggggcaggggagugugccuguuugcuuuucuaggagccucugcuuguacugucagucuuuauaccuccaugugaguauguacacgccugcauuuggguucaugcacgugcuuauuuuuuaagaugcuuuggcauuucccuuuguaauguauacauuacaaagggaauacauugccuuuguaauguaucugugaagcagacaaagcaaacgauagcauguccaagugucuaggcagaaacugcauccuguuguucuaaagaaguagacccaaguuuccauagcaagugguuagcaggguccugaccacuucuccuuguucuggcaccuccugcaagcuccugggcucucuccuugcuugaaaugggcaacugcccuugaaacuccuccaagccccaaugggcugcccauugucccuguguucccaggaucaagcgcauggcaggcaugaaggaaucgcagaucagcgcagagauugagcuucugccuaccaacgacaagaagaaaugggcucgaccccccauuuccaugaacuuugagguauggcagaggaggggccuagagucaugccaggguaugcuggaagaccucuuagagaucauuccgauaaacugcugcaccuuagaggugaggaaacugaggccuagaaagaagaacuggcuuuaauucauagauccauucuuccccuuucaagccucuuaguagaaauuacuauuugugaugaggcaaaucuuuuacuucucucggcuuguccuaacacaguucuuucaaaaaacuuagauuguuuaaaugccagguaagacacaaaguuuacuuacagacaggauaaugggcugacuuugcuuugcgcauguuagacauaauuuucuccaccuuauuuuuaaguucauaauauugagcaggauaaguauguucuaaagcaguucuuugguugcugucuccugcugauuaaaggaacugauucaaggugucacagguagggcuuucuucuuuagucaccucuuagaaggucccacgccgccccagcuucuuucaggaccccagccauacaaacaccuguaguagcgaugaaguagggcagggcaacgggacuucccagaggagagcggcuguaagaggaaggccacauuucuaacuagcucuccuugcccaggugccauucgcgcccucuggccucaaggugcgcuacuugaagguguuugaaccgaagcugaacuacagcgaccaugaugucaucaaaugggugcgcuacauuggccgcaguggcauuuaugaaacucgcugcuagcugccacuaggcagcuagcccaccuccccagccacccuccuccacagguccaggugccgcucccucccccaccacacaucagugucuccucccuccugcuuugcugccuucccuuugcaccagcccgagucuaggucugggccaagcacauuacaagugggaccgguggagcagccccugggcucccugggcaggggaguucugaggcuccugcucucccauccaccugucuguccuggccuaaugccaggcucugaguucugugaccaaagccagguggguucccuuuccuucccaccccuguggccacagcucuggagugggaggguugguugccccucaccucagagcucccccaaaggccaguaauggauccccggccucagucccuacucugcuuugggauagugugagcuucauuuuguacacgugugacuucguccaguuacaaacccaauaaacucuguagaguggaguugcuggcuuaguguugaugugggagcuacauggggagggaacugguguugcucuccgugcaguuuucuguacugaauacucuaaaggcucuuuccuugucuugucccaguuaggccccuccugggccauccaagcccuuauccuuguggguucugggcccagguuuccuggcuccucuuagaaagccucaagggcaugcagccgcagcgggccccaguacccuggggauagauucuuucccuagcuccuuuuuauucccccugguccucggacuccuaggcucaagagaucuuaccugccccagccucuggaguagcugggaucacaagcacgcaccaccacagcacccagcucuuucucuaauucuuaggcagauguuuucuaauuagauuaagcauaaauuaagugugaaguuuacauuuggucuuguagccauccuaagaaauugaccuuuuaauuccaucauuuacccaagcuucccaaaucuugcugacugggugguaggaggaaagauuugcaaggagaauaacauaauggacugggcgcgguggcucacacuguaaucccagcacucugggaggccgagacggguggaucacccgagguccggaauucgagaccagccugaccaacauggggaaaccucgucucuacuaaaauuacaaaauuagccgggcgugguggugcaugccgguaaucccagcuauucgggggcugaggcaggagaaucgcucgaacccaggagguggaggcugcggugagccaagaucacgccacuguacuccagccugggcaacaagagcgaaacuccuucucaaauuaaaaaaaaaaaaaaaaagaauauaaugaaucuccaugucucaucacccagcuucaacuaugaucaaugcguggccaguuccuuaauaucacauccaguuuguguucacuuaaccaggugucuuaucaaauuuuuccagauaagguccauugugguugguuaaugcuccucaaauuuuaaaaauugauguuucccuucaggucuugcaauuuuguggaagaaaccagaguucuguaguuuaccacaucagaauuugccuguuguccccaugaagucacuuaacauauuccucuuuaccuguauuuccuguaaaaugguucaauaucgggauugaugccucaugauggcaauguuuaauccaaagggaugaauggguaauaauguaauuuucggugccacuuuuagagaccaauuggaggaauauucacguuaaauauaaagcaguagcaucauuuuggaggaaauuccuaacuucccgagggaaucggugaaaggaaauagccuuuuauuggcauuuauugagugcagagaagucugcucaggguguagguagggaauaauuuauacaggccacguuguccugguuuucuugcccuuuggcgguggauuuggucgugcccuggggugguggaagaacugaaugggcuuaauucacaaaggucggcugaauuacacagugaaaaggcggucgcggcggggaggcggguggcgcuggccaccaggcugagaagcccguagggucuggggacccgcgaaagcaaagcacugagcagggggcuucugagagucagggaccggggugagucagcaaagcucugggcaggcuccaaaaugggccugacuggguacgcaccagcagcagacgcgccucgagggagcgcauaaaaccuggcaaagccaaagugcuuuaucagccgccugccucuugggaggcucccacccgccagaccacgggugccucgcggccccgauaaaccuugagcucccagccuuugccccaccccucgcucccggaacuccaccucccagaaggcagcgagaaccgcacauguggcuaaucuuucagcggaaaaggugucgcgca

SEQ ID NO: 18052 - RNA, 6548 nt, Homo sapiens
guagguugcacagaguuggacuuagcaagguuuauuuggaagggcagaguccaaccaaccccagguccugaggguagacucagguccugagggaaagggguggacuucagugggcuuucuugcuguguugggugcucuuggggaaaggcugcgggcccagccagagcugcagcaggaugacggcauggcauaugugcagggcagcagagcugcaggauguggaaggguauguguuccaggagagcucgaugagccccagcaccaacaaccuggagaugagaaacagguuccacguuucauccaguugcaaggccugcagaccugcagcuccucaugcccuagacauaaacccccaacaggaacucccuaucccuucccacucccccagguugucccagcugguaccugagcaggugugugagccagcgugcaggcauggcccacaggagguagggcaguguguggaaauaccagacguagaacugguaguggagggagcggcugaagcagaugccaaugaaguuggaggugaagaggguagaaacgaucuguaugcgguggucaaggccaagggcaggagugugugugggggggacuaucccaaaacagaggggcaauaguuuuuaggucacauagcccucuggcucugccauuccuugaugcaugccuuugggcaaguuuauuaaccucucuggaccugcuccucaaccaaauauggaauauggagagaguaauaccuagggccauaaggucuuguggguuugaaccccuaacuuacuggcugugugaccuugguaaguuacuuaaccucaugaagucuuaauuuuuccaucuguaaaaugagaauaguaaauguaaguguaccucccugucucggggucucuugugagcuuucaauauuagaacauauguaaaucucuuaugauaguaccagggagaaguacucauaagaguagcucguauuuagaauuaagaaucaaauauccuucaauaugugaagugcucagcacaguggugcagaauaggacuucuaugauugggguccccuuuccucgcccaggucaccagcugucaagggauaccugaccaggacucugucagcaccuagagagggcaagacuuaccuucccacaauuuaaaggauaugguuggguguaaggggcugggguggaaccuuccuuuuggagggaucccucagcagcgacaagauacuuuccccuguccuggagaaaagccauucagacaguuaucaagccccuuuugugagucaaacucuagacucaccccaugagcuuaacugacacuucccccaagcagccccuaaggcuuaggcccuucacuccuucccccaacucugcccauggcacuacugccuuuucucaccugugccaccugcagagggcaaacagcaggagcagggugaggugggcagucaacagggccagguggaaggcucgaugcaggaagagcgccucugggaggaagcgccaguucacuguccaguggaacagaaacuggcggccaaggucaaaggagcgggacagguagccgcugggguucuccagcaggaagggcagccccagcaccaccugaggauuggugugaugucagcagagcugccaaggcucauucccaaugaccagccuucaugcuacucauugaggggugugggacggggauguaggccucagagguuccccaauucccacuagaaauagcaggaaaaccacguuccccaccccccggcccaggccagugccuggggccaaagaagcucaggaggcaggucauaacaaugcuuuaagguguggauucaccaagucauaacugggcagagcaaggaaggcucucagaagccaggcaggguggcucaugcccaaaauccuagcgcuuugggaggccaaggcaggaggauugcuugagcccaggaguuugagaccagccugggcaacccagcaagagcccaucucaaaacuuaaaauuaaaaaaagcaaaaaggcucucagagaccaucaaauuuaauacccuauuuuacagcuauggaaacuacagccuagcgauaguggcucccuagcucagaaucaacuccaaaacccugucucuuggcuuugagggagucucagggauagagccccucaaucaagacaaguggcuucuccuugauuagaaagaggaagggugagauggggguaccugaaggccagcacagauucccagcuuggggagggccccacggaagccaaacugugugaggagaagaaacaguaacccaggggcgaagagcagcacauucaucuucacagagacugccaggcuggggugagcaggggagaggaaggguggagaucagcuccagggccaugcacacaacacccaaagacauaccccccaccaucaccacagcaaccucccccccgccgccacgccaacaaacuccaagaugggaccuacacucacaacuguuggagggaagagccuggaguaggcaggaggcagauacauagucucuaugccuacuagaugcgaaugagcauauacugaguauuuagaaugugaaggacuaauuccaacaaggaaugcugucugggaggaagacaggauggaaagagggcauguguguauguugggggauggcagggcagaaacuuucuauagauccuggacucgcuuuguggagcccugagugacccaugcugucuuggcuacuccuuuacucccucugcugcaggaaauugggaagagauggaaaugcagaaaacgagaggggaccagaaaggaagagguguugaccugaaaaagcagcaaccccagccccagcgcugggccagcaggagguugauacugaggaagagcagcaccauggccacugggucauugaagagccgcagcacaaagauggaguggacacgguaagaggcgcagcacaugaagaaaaagacgaagggagguaccuaaagggaaaacacaguaagguacaaggucagcucagcaagccugagccauccccaccacccagcccucccaggcuggggcccucuagcccugguagcauggacucaccuugcaggucuggugauagaucaagaagacaagcagcaagguagccagguagagcacagcaaagauguucugggccaugcggaugucagugccucggcugguggcauaguacaaccccauaaagauguacacgaaaccagcuggguaccuggaagaugagagaaaaugugagccugggucaggucacacagacuaguaccuaaccagccccucacauccucccugaacuuccuguccccacucacacaagugguccggugucacccugcaguuggguauagucauagguaccauugaugacgccuucuaccucggccauguaggccuuccagucaaucucugugucuggaagaagacaagaugaucugguuacuucugagucuagaacuugucugccacccuccccaugccuccagaccaucaaaacacagacuuucagccaauucccagggcuuuacuaccucuuaaucuaacucuuuaucugacauucucugggugagcccaggcaucucaaacucaacauuucuauaagugaauuugugaucuuucuucccauuccaaucuacuccuuuuccuggguuccgcaaauggcaccaccgaccucuuagcuaccaggucacgaaccugaguaacaucuuugauacucccuccucucucauuugcaacccuucgucaacaaguucugccuguuccucaccguaaauaucucuaucucauccuucucugcuacuacauacucaaauuugagccuaaaguaaucucuagccccaaugaguauacaauagccugcuaauuaggcuccugacuucuacuuucacccugcuacaauauauuuuccaccucguacaccaaagagcuccuccuaaaauacaaaucauaacaggccucugcuuaaaaccucucaaugauuccccaagacccuuaagauaaagaaaacucuguauuauucccauuuuuugaaggggagccuaagaauuaauuagguuaagugacuggcuuaagauaauugagcuaggaugguggaguugggauugaagcuugcagggucccaaguucuuaauuaucaugcuaucuucuuaacaaagcuuucaaauuccuucaugaucuggccucaguuucugcauucccaucucuuacuacucccuucacuugauuucuacacucuagcucuaaaaaaaucauuucaguuccucaaaggaaccaggcugucuucuuuuuuuuuuuuuuuugacagagucucacucugucacccagacuggagugcagugguacgaucucagcucacugcaaccuccgccucccggguucaagugauucuccugccucagucucccgaguagcugggacuacaggugugugccaccaugcuuggcuaauuuuuuaaguuuuguauuuuuaguagagaugggguuucaccguguuggccaggcugguuuguuuguuuguuuuucuuuugagacagggucucgcucagccacccaggcuggagugcaguggugcgaucucagcucacugcaaccaccaucuccccgguucgagccauuuucccaucucagccucccaaguagcugggauuacaggcacuugccaucaugcccagcuaauuuuucuauuuuaguagagacagggugucaacauauuggccaggcugguguugaacuccugaccucaggugaucugcccgccucgggcucccaaagugcuagaauuacaggcauaagccaccgugcccagccaggcuggucuuuaacuccugcccccaagugauccgcccaccucagccucccaaagugcugggauuacaggcaugagccaccgugcccagucuaacugaauuuuuuuuuuuuuugacacggagcuugcucugucacccaggcuggaguacaguggcgcaaucucggcucacugcaaccuccaccucccggguucaagcaauucuccugucucaaccucccgaguagcugggauuacaggcauaugccaccacgcccagcuaauuuuuguauuuuuaguagagacaggauuucaucauguuggccaggcuggucucaaauuccugaccucaggagauccacccgccuaggccuaccaaagugcugggauuacaggcgugugccgcugcgcccagccuagcuggagauuuuuaauagaggauccucuguccacagcacuccuuccccucaccuuuuucuucuuuccuuaaauagcuaauuccuaccuuccaaggguggcucuaugaagccuuugcugacuccuccaaccugguuuaagugacuuccuaugcccuuuaugguauccuguguuacuacuaccaugauuaugaugcauuauaauugccugcuaacuuacuguccaggcccgaguuagaaaugcauccuuuuucuuuuuuuuuuuuugagacggagucuugcucugucgcccaggcuggagugcaguggcgugaucucggcucacugaaagcucugccucccggguucacgccauucuccugccucagccucccgaguagcugggacuacaggcgcccgccaccaugcccggcuaaauucuuuuuuuuuuuuuuuuuucaguagagacgggguuucaccguguuagccaggauggccucgaucuccugaccucgugauccgcccgccucggccucccaaagugcugggauuacaggcgugagccaccgcgcccggcagaaaugcaucucuuauucaccacuguaccucucucugguaaccagcauaaugcuaggcauauaauaagcacuaaauaaauauuuguugaauuaagagucuuuagcaagaaagccaagugccuuaagccuagaguauaguuucagccuggaaaggaguagccaauaaugccuaauggacucaaguggucacaagaugccaucauugagaagggacguucaaagaucacagaacugaacacauggaaaaagcugagauccaggaggagaccugagguguccaaagccacagagaaaagcagcagcagcagcaguacaacaauuuuggcucaaaucugacuucuaagcugguuugcaggcuguaaguucagugcagaaggccaaucucuaggguauccaccucugccaugcgggcagauuaagauccgguuuucuguagagcaggcuuggcgcucagguaagggauauggauggguucgcaauugacgagugaguggauacagagucugguuuggaguuccaggucugagauccaguuugggucgcggguucaggucucccucccuccccuccccucccccucggcgcacucacaugccacccugugaaugacccagaaggugaugcccaccuccgccaggcagaggcaggcggccaccagcagcguguagcgcggcucccgcagcagcaggcgccgcucuugccaggcgcgcugcagccauugcuugcagagucccucugccugggccgcggaaccggaccggccgcguuuccgcagcccagccgccaucuuaacggugcgccg

SEQ ID NO: 18053 - RNA, 6548 nt, Homo sapiens
cggcgcaccguuaagauggcggcugggcugcggaaacgcggccgguccgguuccgcggcccaggcagagggacucugcaagcaauggcugcagcgcgccuggcaagagcggcgccugcugcugcgggagccgcgcuacacgcugcugguggccgccugccucugccuggcggaggugggcaucaccuucugggucauucacaggguggcaugugagugcgccgagggggaggggaggggagggagggagaccugaacccgcgacccaaacuggaucucagaccuggaacuccaaaccagacucuguauccacucacucgucaauugcgaacccauccauaucccuuaccugagcgccaagccugcucuacagaaaaccggaucuuaaucugcccgcauggcagagguggauacccuagagauuggccuucugcacugaacuuacagccugcaaaccagcuuagaagucagauuugagccaaaauuguuguacugcugcugcugcugcuuuucucuguggcuuuggacaccucaggucuccuccuggaucucagcuuuuuccauguguucaguucugugaucuuugaacgucccuucucaaugauggcaucuugugaccacuugaguccauuaggcauuauuggcuacuccuuuccaggcugaaacuauacucuaggcuuaaggcacuuggcuuucuugcuaaagacucuuaauucaacaaauauuuauuuagugcuuauuauaugccuagcauuaugcugguuaccagagagagguacaguggugaauaagagaugcauuucugccgggcgcgguggcucacgccuguaaucccagcacuuugggaggccgaggcgggcggaucacgaggucaggagaucgaggccauccuggcuaacacggugaaaccccgucucuacugaaaaaaaaaaaaaaaaaagaauuuagccgggcaugguggcgggcgccuguagucccagcuacucgggaggcugaggcaggagaauggcgugaacccgggaggcagagcuuucagugagccgagaucacgccacugcacuccagccugggcgacagagcaagacuccgucucaaaaaaaaaaaaagaaaaaggaugcauuucuaacucgggccuggacaguaaguuagcaggcaauuauaaugcaucauaaucaugguaguaguaacacaggauaccauaaagggcauaggaagucacuuaaaccagguuggaggagucagcaaaggcuucauagagccacccuuggaagguaggaauuagcuauuuaaggaaagaagaaaaaggugaggggaaggagugcuguggacagaggauccucuauuaaaaaucuccagcuaggcugggcgcagcggcacacgccuguaaucccagcacuuugguaggccuaggcggguggaucuccugaggucaggaauuugagaccagccuggccaacaugaugaaauccugucucuacuaaaaauacaaaaauuagcugggcgugguggcauaugccuguaaucccagcuacucgggagguugagacaggagaauugcuugaacccgggagguggagguugcagugagccgagauugcgccacuguacuccagccugggugacagagcaagcuccgugucaaaaaaaaaaaaaauucaguuagacugggcacgguggcucaugccuguaaucccagcacuuugggaggcugaggugggcggaucacuugggggcaggaguuaaagaccagccuggcugggcacgguggcuuaugccuguaauucuagcacuuugggagcccgaggcgggcagaucaccugaggucaggaguucaacaccagccuggccaauauguugacacccugucucuacuaaaauagaaaaauuagcugggcaugauggcaagugccuguaaucccagcuacuugggaggcugagaugggaaaauggcucgaaccggggagauggugguugcagugagcugagaucgcaccacugcacuccagccuggguggcugagcgagacccugucucaaaagaaaaacaaacaaacaaaccagccuggccaacacggugaaaccccaucucuacuaaaaauacaaaacuuaaaaaauuagccaagcaugguggcacacaccuguagucccagcuacucgggagacugaggcaggagaaucacuugaacccgggaggcggagguugcagugagcugagaucguaccacugcacuccagucugggugacagagugagacucugucaaaaaaaaaaaaaaaagaagacagccugguuccuuugaggaacugaaaugauuuuuuuagagcuagaguguagaaaucaagugaagggaguaguaagagaugggaaugcagaaacugaggccagaucaugaaggaauuugaaagcuuuguuaagaagauagcaugauaauuaagaacuugggacccugcaagcuucaaucccaacuccaccauccuagcucaauuaucuuaagccagucacuuaaccuaauuaauucuuaggcuccccuucaaaaaaugggaauaauacagaguuuucuuuaucuuaagggucuuggggaaucauugagagguuuuaagcagaggccuguuaugauuuguauuuuaggaggagcucuuugguguacgagguggaaaauauauuguagcagggugaaaguagaagucaggagccuaauuagcaggcuauuguauacucauuggggcuagagauuacuuuaggcucaaauuugaguauguaguagcagagaaggaugagauagagauauuuacggugaggaacaggcagaacuuguugacgaaggguugcaaaugagagaggagggaguaucaaagauguuacucagguucgugaccugguagcuaagaggucgguggugccauuugcggaacccaggaaaaggaguagauuggaaugggaagaaagaucacaaauucacuuauagaaauguugaguuugagaugccugggcucacccagagaaugucagauaaagaguuagauuaagagguaguaaagcccugggaauuggcugaaagucuguguuuugauggucuggaggcauggggaggguggcagacaaguucuagacucagaaguaaccagaucaucuugucuucuuccagacacagagauugacuggaaggccuacauggccgagguagaaggcgucaucaaugguaccuaugacuauacccaacugcagggugacaccggaccacuugugugaguggggacaggaaguucagggaggaugugaggggcugguuagguacuagucugugugaccugacccaggcucacauuuucucucaucuuccagguacccagcugguuucguguacaucuuuaugggguuguacuaugccaccagccgaggcacugacauccgcauggcccagaacaucuuugcugugcucuaccuggcuaccuugcugcuugucuucuugaucuaucaccagaccugcaaggugaguccaugcuaccagggcuagagggccccagccugggagggcugggugguggggauggcucaggcuugcugagcugaccuuguaccuuacuguguuuucccuuuagguaccucccuucgucuuuuucuucaugugcugcgccucuuaccguguccacuccaucuuugugcugcggcucuucaaugacccaguggccauggugcugcucuuccucaguaucaaccuccugcuggcccagcgcuggggcugggguugcugcuuuuucaggucaacaccucuuccuuucugguccccucucguuuucugcauuuccaucucuucccaauuuccugcagcagagggaguaaaggaguagccaagacagcaugggucacucagggcuccacaaagcgaguccaggaucuauagaaaguuucugcccugccaucccccaacauacacacaugcccucuuuccauccugucuuccucccagacagcauuccuuguuggaauuaguccuucacauucuaaauacucaguauaugcucauucgcaucuaguaggcauagagacuauguaucugccuccugccuacuccaggcucuucccuccaacaguugugaguguaggucccaucuuggaguuuguuggcguggcggcgggggggagguugcuguggugauggugggggguaugucuuuggguguugugugcauggcccuggagcugaucuccacccuuccucuccccugcucaccccagccuggcagucucugugaagaugaaugugcugcucuucgccccuggguuacuguuucuucuccucacacaguuuggcuuccguggggcccuccccaagcugggaaucugugcuggccuucagguacccccaucucacccuuccucuuucuaaucaaggagaagccacuugucuugauugaggggcucuaucccugagacucccucaaagccaagagacaggguuuuggaguugauucugagcuagggagccacuaucgcuaggcuguaguuuccauagcuguaaaauaggguauuaaauuugauggucucugagagccuuuuugcuuuuuuuaauuuuaaguuuugagaugggcucuugcuggguugcccaggcuggucucaaacuccugggcucaagcaauccuccugccuuggccucccaaagcgcuaggauuuugggcaugagccacccugccuggcuucugagagccuuccuugcucugcccaguuaugacuuggugaauccacaccuuaaagcauuguuaugaccugccuccugagcuucuuuggccccaggcacuggccugggccgggggguggggaacgugguuuuccugcuauuucuagugggaauuggggaaccucugaggccuacauccccgucccacaccccucaaugaguagcaugaaggcuggucauugggaaugagccuuggcagcucugcugacaucacaccaauccucagguggugcuggggcugcccuuccugcuggagaaccccagcggcuaccugucccgcuccuuugaccuuggccgccaguuucuguuccacuggacagugaacuggcgcuuccucccagaggcgcucuuccugcaucgagccuuccaccuggcccuguugacugcccaccucacccugcuccugcuguuugcccucugcagguggcacaggugagaaaaggcaguagugccaugggcagaguugggggaaggagugaagggccuaagccuuaggggcugcuugggggaagugucaguuaagcucauggggugagucuagaguuugacucacaaaaggggcuugauaacugucugaauggcuuuucuccaggacaggggaaaguaucuugucgcugcugagggaucccuccaaaaggaagguuccaccccagccccuuacacccaaccauauccuuuaaauugugggaagguaagucuugcccucucuaggugcugacagaguccuggucagguaucccuugacagcuggugaccugggcgaggaaaggggaccccaaucauagaaguccuauucugcaccacugugcugagcacuucacauauugaaggauauuugauucuuaauucuaaauacgagcuacucuuaugaguacuucucccugguacuaucauaagagauuuacauauguucuaauauugaaagcucacaagagaccccgagacagggagguacacuuacauuuacuauucucauuuuacagauggaaaaauuaagacuucaugagguuaaguaacuuaccaaggucacacagccaguaaguuagggguucaaacccacaagaccuuauggcccuagguauuacucucuccauauuccauauuugguugaggagcagguccagagagguuaauaaacuugcccaaaggcaugcaucaaggaauggcagagccagagggcuaugugaccuaaaaacuauugccccucuguuuugggauagucccccccacacacacuccugcccuuggccuugaccaccgcauacagaucguuucuacccucuucaccuccaacuucauuggcaucugcuucagccgcucccuccacuaccaguucuacgucugguauuuccacacacugcccuaccuccugugggccaugccugcacgcuggcucacacaccugcucagguaccagcugggacaaccugggggagugggaagggauagggaguuccuguuggggguuuaugucuagggcaugaggagcugcaggucugcaggccuugcaacuggaugaaacguggaaccuguuucucaucuccagguuguuggugcuggggcucaucgagcucuccuggaacacauacccuuccacauccugcagcucugcugcccugcacauaugccaugccgucauccugcugcagcucuggcugggcccgcagccuuuccccaagagcacccaacacagcaagaaagcccacugaaguccaccccuuucccucaggaccugagucuacccucaggaccugggguugguuggacucugcccuuccaaauaaaccuugcuaaguccaacucugugcaaccuac

SEQ ID NO: 18054 - RNA, 2182 nt, Homo sapiens
uccuuccgccggcuccccugcugagguagggccgguccggcagcaagcccgccgcccgcgccccgccgcagucccgcucccgccccgcgcccaccccgcgcccgccauguccgagauccugcccuacagcgaagacaagaugggccgcuucggcgcagaccccgagggcuccgaccucuccuucagcugccgccugcaggacaccaacuccuucuucgcgggcaaccaggccaagcgaccccccaagcugggccagaucggccgagccaagcgagguacgcggcccgggcccggagucgccgccugacccagaaacccuccgccgggcgccccccggcugccguuccccgccgagugcccgcagcucuugccgcagaccagcgcaccagccgcucuccagcccgggcuggagggggggguccccgcugcagugugugucccccucuucccuucucccgggaacacggugccccggauucgaugcucgccaccucuggaagcagagcccuggcacccgggcgagggggaggggccggucggggcauuuggggcugcacggaagugggagcacgggguaacgggcugauucuuugggaucaaauacugagucgguggacaauacgaagaaccuucgggucgagagggacgucuaacaagagagggcaggaggccggggguccgcuugucuugguuguuugcauggggaggggagcucuguuggugccaggaucggaagagggguuccagcggcgagagggcucagguugaggagagggcuggaccagcuggauacucgguuugagccccauuugagcagggggaucuguugaagugcggguugaagagggggauuccgugagcaagagguuucugaucaacucagagggaggaaggcucagguggcaggagggcucgcacugggagggagaauagcuggagccuuuggaagaggggcguuccgccaucgggaggggagggggucuaggcuuggcggcggguugggucuccagaagaguucggacggggaggacaccgcggcacaggguuccgaggggcgucgcugggccacgggcaguagcugcgcgggaagcuaggacgcggggcucauucucaucgccgccgccccccgaggccgcgcggcugacgcgcuuucucccugcgcaguggugaucgaggaugaccggauagacgacgugcugaaggggaugggggagaagccgccguccggaguguagacgcgccggcucgggcggcgggcuccgggcccagccucgcagcggccaggagcgcgggccggcgaugcggcugccggcgcccccccgccccggcccaggcgcccgcgggcgggggcugcagggccgugccgccgccgccgccaggcacuccggagcuguccgcuucagcaccacggcggccgcgguagcggcggcgcggacccgcccggaacccgccgccgcgcucaugcacuuuaaaaccucgggccgcagccccaccccgcacaccggaacggacacggagacccgcggcccccagcccccggcccgcccccucccgcacggcuccccugccccgccccccuccggccagucuggucugcagaccgggcggccgccggugucggaccgcgcgcggccagggauguuuggcugcguacuugcaugagcuuuccacccacuugagcccaguccuccgggccguuccucgcccccaccccugucuggcgugaccccagccucagccucuuucuaagggacuuccucagcacauuuguauuuuuauauccgacucuuuguuuacuggcucugcucaugguuccugcccuccccucagucucggccacgcucuucugcgccuggcagauaggauggguguugaggcugggaugagacaagcccccgacacgguuaccaaccacauggccagucugcccaggccugaccccaggaggcuuucuggcagaccccuucuccccaagguaucaucaccuuccaagggcccagauccgauuuuaccuuggaccccugcgucuugccccugggaacccaaauggggacugcucugaaccuuuggaugacaucuguggccccggagauguucucaacccaggggugcccuucguaaauguuccuccauccucacuguaccaggagugugugaauaaacacagacccccucugugugu

SEQ ID NO: 18055 - RNA, 9855 nt, Homo sapiens
cgaguuggucugggaaaaagggcggugcgagcgggugcgcgcgcagcgggccggcaguggcggcggagauggaggagggaggccgggacaaggcgccggugcagccccagcagucuccagcggcggcccccggcggcacggacgagaagccgagcggcaaggagcggcgggaugccggggacaaggacaaagaacaggagcuggugaggcgcgaccccgagagucggcgaaggaggcugcggggcugagucacggcggcuccgcaggccucaggcccgacacccaacuaccccaccgcgccagggagagggcgguuggggcgacccucgggacucccggcaccuugccucucugcuccucauucuccguuccgcgcugucaccuccgccguccccaccaacccucaccaccgccgcgugaaguggacucgggcaggucauugucaccuccguuuccuagaguggcauucaaguagagccugauucagaacccaggcugauuucucaccagggcuucccauucccacucgguuuccuuguccaccuggccccuccuaaggaggcaggcuuauucuucaccugccccggguaagugggaggaggacgucuuugggauuccuucucuucaugagcugcuucucccaacccuccagucugaagaggauaaacagcuucaagaugaacuggagaugcucguggaacgacuaggggugagucacgauguuaacaugauucggugcauguuuggaucuuucccacuuguuuuauucuuuuuugaggcaacugcuauguacgguggacuguauuuuagggucaguguuaugaugauguugggaggcaggagaguuacaaaggguauuuguacaguuuugcagcuuucucuugugggagaagcagaguucuuaccucuuaacuugggucauuuguuuuugugccaggcagggugcagggaguugaggaaucacagaugaaugaauaagacacagcauuuccuuggaggaguuguuaaguuaaauaucucuguauuaugacuugaaggggugugacuccuuuuugucugagcccugucgucucuugaucaggagaaggauacaucccuguaucgaccagcgcuggaggaauugcgaaggcagauucguucuucuacaacuuccaugacuucagugcccaagccucucaaauuucugcguccacacuauggcaaacugaaggaaaucuaugagaacauggccccuggggagaauaagguaaaacuguuucaaaccugguggaggccuaguuuaggaauuccuuuuuacccagaucauggggggacucauugugagucacaggaagccugauagaccuaagccgugaucuauuugagcagaguucaucacagucaaaauaucuacagaagagcugaaaggaaggucagcuucucagaagacacuguuucugucauguguauuggacuuugggguuucauuagcauggucuacuuuuaacguauguuuaaccuugauuuuucucuuuucuucuaucccauauacauucauuuaucucuaaaauauguuccacauucagucacuucucugccugcugguacaacccuaauccuggaaauguucaguuuuugcauggguuauugcagcaccucuuaacugauguuguugcuuuugugcuuuguuccuacacagucugucucucauguagcagcuaucgugaucuuucucgguuauaggucuuuucugcuuaagaccuuuuaauaguuuauaauugcaauuaaaguaaaauugagagccuccauuuuuuuccacuuuaucccucauuuaucacccuucagcuguguuaguuuaaaaggaagacaguggcugggugugguggcucacaccuguaacccuagcacuuugggaggccgagggguggaucaccugaggucaggaguuuuagaccauccuggccaacauggugaaaccccgucucuacuaaaaauuaaaaaaaaaaaaauuagcugggugugguggugggcgccuguaaucccagcuacuuaggaagcugaggcaggagaaucacuugaaccccggaggcagagguugcagugaaccgagagcacaccauugcacuccagccugggcagcaagagcgaaacugagucucaaaaaaaaaaaaaaaaggagauagcaacaacaccaaccuugguuuuugugagguuuagcuuacauaacauguuaaauuucuaguacagagauugguauguaguuaguucaguuucggagacaaugaucuugauuccacaaugcaugcucccuuuaugcuggacugcuggguuugacuucaaagaacucuuuucuuuauagcguuuugcugcugacaucaucuccguuuuggccaugaccaugaguggggagcgugagugccucaaguaucggcuagugggcucccaggaggaauuggcaucauggggucaugaguaugucagguaagaucuuucuucuugggaauccgaagggggcucugaggcucugagauaauucagaauuuucuuguggaguacaaucugucuuggagcaucaguguauugaauuucccagacgcuggauuccuugacccacagagaagugcuuccccugaagcugugcucucuuaaucgucugggacuaucuguaggcaucuggcaggagaaguggcuaaggaguggcaggagcuggaugacgcagagaagguccagcgggagccucugcucacucuggugaaggaaaucguccccuauaacauggcccacaaugcagagcaugaggcuugcgaccugcuuauggaaauugagcagguggacaugcuggagaaggacauugaugaaaaugcauaugcaaaggucugccuuuaucucaccaggugagugaacaugguagggaaggguggcaggcaugcccuccucagcaccucucucucaauugcgccuccucuauuuucccagagcauuugcucaagcauagcaucacgcuguaguuaaucuuuugaugugugugaguuucuugaggacagagacuuugugucuucuuaguaguucuaacaucuagcacagugccugguguauauaguagauauuuauuauuuauuuuggguaagugaauucauggggaaaaugagugccugggacuuucugaauucuuuguuacuuuuacuuuuguaguugugugaauuacgugccugagccugagaacucagcccuacugcguugugcccuggguguguuccgaaaguuuagccgcuucccugaagcucugagauuggcauugaugcucaaugacauggaguugguagaagacaucuucaccuccugcaaggauguguauguagggaagaagcuggcaaagagauaagcuuacgaauaggacacuugcauaaagagcugggacuuguaguuucugguuagggcuugagggguuuuccugugcccuuaguggacagugaugagcagauguacgggcucucuccacaggguaguacagaaacagauggcauucaugcuaggccggcaugggguguuccuggagcugagugaagaugucgaggaguaugaggaccugacagagaucauguccaauguacagcucaacagcaacuucuuggccuuagcucgggaggugagacugcccuuuuuucaucaaggccuuuucgucauaauucuaccugccauuucaccucccugacucuaccucugacuagacucuccuugauuagaauugccauucagugggauagcagaagggacagcugggggaguucuagggaagcaauugugacccucugacuucucuucagcuggacaucauggagcccaaggugccugaugacaucuacaaaacccaccuagagaacaacagugaguagcccucucuguguaugggauuugggggauuguagguaugccccuuguauugggagugauggcuuggccaacaugcuuauccuaucgagcucagaauccucaugaaucuuuuucaggucacugcuuggggggguauagguagaggauacuaagggacuagcucagaaccagagaccaguugccaugcuguguuucuuuccuguccuaccugaaaccuucuuuccuuacuuuuccucucccuccuguugcaggguuugggggcaguggcucucagguggacucugcccgcaugaaccuggccuccucuuuugugaauggcuuugugaaugcagcuuuuggccaagacaagcugcuaacagaugauggcaacaaauggcuuuacaagaacaaggaccacgguauaauucuguuccugcuuugucuuuuguuuugcuuugaucacuucuuuuguccucuuggagucauaaguuaucugacaagggauccaccaugcaguucuuuggagagcucuuuauaauaacaggauccucaggauagggccauuuuaagacuaauagauucuucccugguauaggaauguugagugcagcugcaucucuugggaugauucugcugugggauguggaugguggccucacccagauugacaaguaccuguacuccucugaggacuacauuaagguuggucugcauacagccugcucauggggacuuccccguuccauauucuagugccuagcagugccucucuuucacugaugaggucugcccaguuuuuaacucuaguuaauaagggugcugcagugaggcccauguugcauccuuugcggugaggaagauagaguauccugagugaagaaucuguuugcucuuuguagucaggagcucuucuugccuguggcauagugaacucugggguccggaaugagugugacccugcucuggcacugcucucagacuauguucuccacaacagcaacaccaugagacuugguuccaucuuuggguaagguuccucgcuugucuuucugguagugcucagccuguacacucuggagaacaggaacugggcccuuuucacccauauugccaagggcuaccacugugccuauuggguaucuggcucuuggugaauguuuguugaaauggugaaugaaugaccgauucuccuuuuguucuuuucuugcugcaucguuggguauguguuggggaccgccuuuccauggcuuuugcaggcuaggcuuggcuuaugcuggcucaaaucgugaagauguccuaacacugcugcugccugugaugggagauucaaaguccagcauggaggugaguagaggcuauugagcauuuagaguaaguagggaaggugcuuugagucuuacuuucugugauaaauaaugaaaaagaaguaagugugugcaugugugcauacauguacaugccuguugguguguauugaggggcgucaccucagugaaaccccuugaucugggauucuaagccucuggugguuuuaaggcuaaagaguuaacauuuuaggccuggcacgguggcucgugccuauaaucccagcacuuugggaggcugcagugggcggaucacuugagcccaggaguucgagaccaaccugggcaagauugugaaaccccauuucuaccaaaaaauaaacagaaaaauuagccgggugugguggugcucgccuguagugccagcuacuagggaagcugaggugggagaauugcuugaacccagagguggagguugcagugagcugagaucgcgccacugcacuccagucuggguuacagagugagacccugucuuuaaaagaaaaaaaaaauuaacauuuuaguguugaguucugucccuuggaaucucugagaaacuacuuggacuagagugaaguguaacuuaacacagccugggguugaugauucuccuuaguauuguagucauuggucagccuuaaauguucauacuugugcagagucauuaauggauaaauacagcaugguggcuaguggcauagauuuagagucagaaagacuugaguucaaaucuugccaccucugcuuauaagcagugugauccugaacaaguaauucaaucucuuuaggccguauuuuucucauccauaaaaggggauaacagccaggcacucaugccuguaaucccagcacuuugggaggccgagguggguggaucauaaggucaagagaucaagaccauccuggccaagauggugaaacccugucucuauuaaaaauacaaaaauuagcugggcgugguggcgcgcaccuauagucccagcuacuugggaggcugaggcaggagaaucgcucgaacccaggagguggagguugcggugagccaaaaucgcgacacugcacuccagccuagcgauagagcgagacucugucucaaaaaaaaaaaaaaaaaagcagugcaggggauaaccucaggaucugugaccuuggggcugucacaaggguuaaaugucaauaguauguaaaacaguuggccuaguggcuggcauauaguauauacucaaugaauaaugacuacuauuguuauuuugauauuaugaacuaauguuauuagggagaauaucuugcaguggacuguaggaauaggcuaucuugaaucaagacauaaauauuuuaauaacuuacucuguguaauacugauuuuccuaccucuagguggcaggugucacagcuuuagccuguggaaugauagcaguaggguccugcaauggagauguaacuuccacuauccuucagaccaucauggagaagucagagacugagcucaaggauacuuaugcucguuggcuuccucuuggacugggucucaaccaccugggugaggggauguuucuauuugggcaaagagcugacaguaacuggauacaacagggaggguuuaugugucaggcugugcuggauggaggcaaguauccucugaccccuugaaucuguccuguagggaagggugaggccaucgaggcaauccuggcugcacuggagguugugucagagccauuccgcaguuuugccaacacacugguggaugugugugcauaugcaggucugugucuuuaugagucugucuugugcuuccccagugacuccucacuucuuucuugguccuuauuuucagguuguuucuccuuucuccuucauucugaucugcucuagauucuuuagacuucuccuguuuuccaaagcuuuuccuugguaacuucucauuucuguccauucucccucaccacccugacgcaggcucugggaaugugcugaaggugcagcagcugcuccacauuuguagcgaacacuuugacuccaaagagaaggaggaagacaaagacaagaaggaaaagaaagacaaggacaagaaggaagccccugcugacaugggagcacaucagguuauaugggcagcugggcacuugcagagaggcugugagaagagauaagcauauaggggaggcuggguuugguuuuugcuuuagggccucucuggguauugccauguauugaaauagcgugugacuggguucuguauguaagggguaaagguguuccccacaggauggcuuuuuauuuucagaugggacuugagucaagggugacuguuuuuuauuccuugagcuuaauggguucugcucucucuucaauugcagggaguggcuguucuggggauugcccuuauugcuaugggggaggagauuggugcagagauggcauuacgaaccuuuggccacuuggugaguauagcaugaagaaaauuggaauauacugguuuugauggccugggguuccccagggaagauuuuucugauggguuuucuugguggagagcuggucuuuuugcugugccuuuucuuucuuuuuucuuuucuuuuuugaagcggaguuuugcucuagagugcaauggcacggucuuggcccacugcaaccucugccucccggguucaggugauucuccugccucagccucacaaguagcugggacuacaggcacaugccaccaugcccagcuaauuuuuguauuuuuaguagagacaggguuuuaccauguuggcuaggauggucucuaucucuugaccucaugauccaccugccucggccucccaaagugcugggauuacaggcaugagccaccaugcccagccugcugugccuuuucuacagaaguuaaggcccccuuuuacccaucaguccacuccuguaauggaauuuguuuuuacugcauuccgccuuacuguuguauuuucuuggaucaucagcugagauauggggagccuacacuccggagggcuguaccuuuagcacuggcccucaucucuguuucaaauccacgacucaacauccuggauacccuaagcaaauucucucaugaugcugauccagaaguuuccuauaacuccauuuuugccaugggcauggugggcaguggugaguauccggcagaagaaggucauaaacagauugggggaagauuugaagccccuuuuuucacuucuguaaugcuuaacauuuccagguaccaauaaugcccgucuggcugcaaugcugcgccaguuagcucaauaucaugccaaggacccaaacaaccucuucauggugcgcuuggcacagguaaagaauagaacuccuccacagagcgugccggggaaguaucuguggugauggaaggaggaacauggaguguuggcccaggaggaaagaugugaccaagugggagauuucuguuuggcuggguuaggcgaugucuccucagugguaacuccucaccucuacuucccucuguuuuuuucagggccugacacauuuagggaagggcacccuuacccucugccccuaccacagcgaccggcagcuuaugagccagguggccguggcuggacugcucacugugcuugucucuuuccuggauguucgaaacagugaguuccugucagaaauuuuauaucauagcaugcagggcucugacuccacccuuuccagggccacuuugauaauuuagguucaagaccccaguuuagcucuguaucgcucuagguuucugagacaggcuuugggccugugacaugagacuuucaucacccacacuuuugaucuggcccaaagagauuugagggugaugugcccagcgucugcuccuaagucacuggggaaaugcgauuuucaagucuaagggcuguaagcaaagugaggugggggcgucucugguucguaguaggguguaugaggggaggaguguggauucagucguaugacugacggguuaaagggucagcgcugaggugggcucucaauguuucuggccaggccugucuuuuugucucuuaacuuuuuguccugucugcuucccucaguuauucuaggcaaaucacacuauguauuguaugggcugguggcugccaugcagccccgaaugcugguuacguuugaugaggagcugcggccauugccagugucuguccgugugggccaggugagaggcugaguagaggggagggcucaggcuguauucucaaacuggagaauguacauauacuugcuuugcugaaacuggcgugggcgguggcuugucgcuacuuuuccaucucucuuuucaauuuucuuacccuacaggcaguggauguggugggccaggcuggcaagccgaagacuaucacaggguuccagacgcauacaaccccaguguuguuggcccacggggaacgggcagaauuggccacugaggaguuucuuccuguuacccccauucuggaagguuuuguuauccuucggaagaaccccaauuaugaucucuaagugaccaccaggggcucugaacugcagcugauguuaucagcaggccaugcauccugcugccaaggguggacacggcugcagacuucugggggaauugucgccuccugcucuuuuguuacugagugagauaagguuguucaauaaagacuuuuauccccaaggu

SEQ ID NO: 18056 - RNA, 1403 nt, Homo sapiens
uuuuuuuuuuuucaauguucaguuuccuuuaaugacccccaucucccugaagggcaggugcaggcagcuaggugauggcaagagauguucacuugaagaucuugccgugauugaaggcuuugcccacaugcuggaaggcccccucccaggaaaaguacucucgaaccagcgucugggucuccucucugccaggauccaguuuccgccauguguaugacucguaguccaccugccaaucuggacucagcggaaaggcaagcuccuggccucggaagacccagacuccagaaauggagcugcuauuguugguuccaaaaaggaugacacuggcgaaggcauucuuccucagcuuguccagucgcuggaacauuccagugaugagauugcagcucaugaaggucugagugaguucuucagggaagcgauacucugaguaccacagggaccagccguccuuaucaaagugcucccagaaauauggcagugccacagagaguguguccucauuggaguacuugcgcuuaaauucauccaacacaaagguacucuugggcaggugagcgaagggguccuuggccuugggcucagcagccagcgccugcucacauucauccaucuccuccucaggagcaggggcagccgccuuuuucuccuccuuccgcucagccuggggcuucugcuucucuucccgugaacccuucucuuuccgugguguguccuuuuuaggcugggucucugcaaacuuuuuagcaucaaacugggccaucuucucacacaguuucaguucccccaagacagcccggaacuggggcugguuaaugcaggugaggaaccagcgguugguauugcgaaaggcccggcggaaagaaggcucuagaaccugcuuauagagccacaacagggugcagacaacugugaugucagccaaugucacucguucgcccaccagaaaaguccucgucuucaaguaagcauccagcagccccagaauucgccucacuuccuccuuugcauucucaguggccuguuuguuguggugcaugaugcccaagguggggaacacccagguacuggcugggggcacuauaucggaaucagcaaagcucacccacugcaccaccugggcugcugccucuggaguacuuccccgcagcuccucauugcucacauaguaggcaauggcguugcucucaaacacacagaauccaucaucacccucaaaugcugggaccuugccggcaggaaauuugcgaagaaauucagaggugcgguugguuuggccaaaauggaagugggguggugcggagagcacgcggaucugagccccgcuguacugagcagcgaugagagccuugaaggcccuccaguuuucaggauacguguacagggucccagccgccaug

SEQ ID NO: 18057 - RNA, 10920 nt, Homo sapiens
cuacuuuggguggugacgcggcggucacgcccccgcgcuuacgucaccggcccgguucccucuccggggagcggcggcggacgcgcggcucccaccccuccccucucacgggcucuccccuccccaguguggccgcgacccuacccucugcaaggcgauggcccgcgccccgagcgcaggcuagcgugccugggugcccggccaugggcuguaucggcucucggagcccggcgggucaggguaagaggcggaggccggguacggguuggggagucgggcugcggccgccggugcgcgggccgcgggugggugggggccuugaggagggggccggugucgggagagggaggagccugcaccgggaggcgggccaggcaacaggagggagcgggaaugagcagggaaggggccagaccgacuccgguucgcucccacggccugccugccuugggguuuugcagggcagacgcauggucucgccgcuggcugccgugugcccacugcucaggguggccggagacgcacagccccgggaggggcugggcagcccgaugcccccaccacuccagcccucggcgacuggccuugcgcgcccacacacacacuccccuccgccuacaccucugccuucacaguccugggaguggcccugugcugggaaccugcuucucccagccguguccccaucuucuuaaagagguagccuuucgguccuggcuaagcacccuaccacagaauuuuugucggacauugacuccccucuucagucagucggcgaagggggacugaggucccguuuggggcaccugugaacacugaaucaccucucaccuauuacaguuguuuuaauguccugcccccacucagcaaaaacaaaucacucuacucuguggagggaaagaggaacccagaggcaggccaucagggcuuccuucccacagugcugaccccugccugggccucgguuuccguggguggccaugcacaccgggccuggccguaguccugugcaucagaggucggccagcuuccuuuacuccggugugguggauuucuccacgcauaaggcaaggcaggacuggguuugggauggguccuggaccuucagggcagguggucagucacacaggccuuggugugguugguacuugauguucuuuggagcuaagacuggcugagauuuguacuucccuugaggaauucugggauuuguaguccuaaguuaaccucguggcuuuugaagcugaggagcagcugacugcucugaucucucuggcccuaucaaggcuuggaguucaggaagucaucaccuucucuugucaggggugaguuuggcugaccucaggacuggccucgagagcccugguuagguaccaguugggggccagggauggccuguaaccuccuguuuuccuucugguugguagcauuucuggggaccaacagcuggccgaggcucagggauagagacggcugcuccagcuaaaggucaguugugauguacauugccuguuggcacugucuagggaaugggccucagcuccccgagucccagagagcuuggcugagcccugguguucccaccuccucagagccaugaggcaggaauguucuccuuaugugacuaggcacagguuccaaauggggaggggacuggcucagcauccggagccaaaacaggaauagaacugggagcugagccuggagcgguucugggcuuuugguucucugcaucaacacagccagcaugccuaugauuucugugcugggcaaaauguuucuguggcagcgugaagggccuggaggacgauggacuugucagacaagucgcagaggugagaccagggaucauggaugugaucugggagaugaugggaagcugagcaguagggugcuuagguggaaaaggaaaauuacucuggcuuagauauuaagaaccaggcugaaacagggagaaccaggcuggggccagacagggcaucaggaaacggcuucaggggacaggggugaaaaucagaaaaaauaucaugaguucgucagaaaagaagaguaaagagcuguggaccagcugaggcuggcgagaggaaagaaggcagcaggaagagagaaggaaggcaacccuccugcaaaggguccaggguggcgguggugggggggacagugauggcggaagaacucagugugcuuuccaagaggaauggguaggcugggaaacgggaaggagagucagaauuuaucauuguuugguuucacccuaggguuuugaggcaaaauuuauccagagcaggaagguggcaagugggcugccacagaauggccccaggggcccgagggucagugaugugugggaugggggcuuuuagaguugaggagagcacucagugggcgcuggucuucuggaaggugggggaggggccgagaaaugauacggcaauacuggaugaaaauggggaucucugcagaaguaggggcacagcucaacagccuuuccccuuccucucaguguccucggaccccgcuugggcuguggaguggaucgaacuuccucggggucucucucuauccucuuugggaucugcucgaacccuccgaggcuggagcagguccucccgcccuuccucgguggacagucaggacuugccagaggugcugggccccuggugguggggggaaggaggacgucauccauauaaaggggaucugcagcccccacccacgccuggccagccagcuucuggcucccuuuuccggcgggcggaggcgcuauccggcggcgggccgggaggccgcccccgugccggucugcucugcucggcgcugugccagcaggcggagagcucgcgccuuccgcgcugacgucagcgcaucccgggccguaucccgggagacccuguugcguggugauggguugccagggagacauacaccuuuucucugggccugggccgcagcugcgcggagcgccgggcacggauggcggcggcugaggggagcgaagcgagggagggagagcaagcuaagaaacacccagcaggugcucccccgccuaggccuggcuggaggcuacuggcgccacccugggggcccugucagccagguacccaaggggagggaucgagggugggccucaggucaaggggcaguguuggcugcccuugugagggacgggaacgugauagaagagagcugggcaaugccggggagggaugugugccuccaacuucauuaagugagggaaacauuugcuggggcuugucagggagcccugagccagguacaggguggaguuaggaacuuacgugcaucagacuuaggccuugccauccugagcucccucgggagacagacaagggcaaugaugggggcggggugugucagagaaaagaagaggcugucggcugaaagcauuauuugcaggugacacuugagaugggccuuaagugauggcaagcauuuuuucacguaaggauggcauucuuggcccagaggaaagcugaguuccuuuuccuggaggcaggcgggcugcuugcugacagggauugguggagaaggguuuuuguuuuuuguuauuuauuuuuauguauuuauuuauuugagacggaguuucgcucuuguugcccaggcuggaaugcaauggugcgaucucggcucaccgcagccucugccucugggguucaagcgauuauccugccucagccuccagaguagcugggauuacaggcaugcgcugccacgcccggcugauuuuguauuuuuaguagaggcgggguuucaccauguuggccaggcuggucuccaacucccgaccucaggugauccgccugcuucggccucccaaaaugcugggauuacaggcgugagccacugcgcccggccugagaagggggguuuuauugggcagaggagaucagcaguggauucaaaggaggcuuggaaggaggcaagggugucacagagugggauccuucagggccuggguaugaugccugcacuaaccucacuggacaguagcguaggcuagacaagauuuuagagauguguugugaccagcugcacuccaggaaaacuguuuacauuauaucuuaccucauucauccagccuuugcauuuuuguuugcuuguuuuugagacagagucuuuuucugucgcccaggcuggagugcaguggcacaaucuuggcucacugcaaucuccgccuccuggguucaagcaauucuccugccucagccuccugaguagcugggauaacaggcacccgccaccaugcccugcccauuuuuuaaauuauuuuuaguggagaugggguuucaccauguuggccuggcuggucucaaacuccugaccucagaugaucuacccaccuuggccccuuggccucccaaagugcuggaauuacaggcgugagccaccacgccuggcccagccuaugcauuuuuuuuuuuuuuuuuuuuuuuugagauggagucuugcaccguagccuaagcuggagugcaguggugcgaucucggcucaccgcaaccuccgccucccggguccugguucaagcaauuuucuugccucagccuccugaguagcugggauuacaggaacgugccaccaugcccagcuaauuuuuguauuuuuaguagagacgggguuucaccauguuggccaggcuggucuugaacucgugaccucaugauccgcucaccucggccucccaaagugcugggauuacaggcaugagccacugacgccuggccagccuaugcauuuuuaagaaauuauucuguauuaggugcugugcuaaacauugggcacuacagugaccaaaacagacugaauuccccaagagccaaagaccagugagggagaccaacaagaaacaggaaaugcaaaagagaccauuauuacucacuaugacuaagggccacaaaugggguacguugauggagagugauuuguuaagagacuacagagggaggacagacuaccaagaggggggccaggaaagcuccucugacgaggugguauuucagcccaaacuggaagaaugagaaagagcuagccagccaucagaauaguccagaagagauggggagcacuacacucacuacacuuuggccugagaaaauagcaugggauuggaggaggcugggggaacaccacuucugccgaccugggcaggaggcauugagggcuugagaaagggcaauggcaguagcaguagaaaggacaggguaggagcagggacuuugcagguggaaucauuaggucuuaucaacagauaugggcaagcaaagccaggggagaauugaugguaaugcugagguuuggagccaggcuagaugggacaguggugggugaugcaaaggaaagaggucaggaagcagggccagacguggggagaagguguggggguuugguuuccaucuugccgagucugccggaauguggaugggaagaccaagaggaggagcaaggggcagaggggaagggaaucuuaaagaaguccuggaugccacacucuucuuccuuccuccucuucccucuccucagaggucucacucgugguucuucauuuccugcccugccuccaucuccucugggugcugggaaaguggaggauuagcugaaguuuugcuucucggggccugucugaaucuccauugcuuucugggaggacauaauucaccuguccuagcuucuuaucaucuuacauuucccuguagccacugggacauaugugguguuccuuccuagcuccugucuccuccucaugccuuugcuggguaugggcauguuagggggaaggucauugcugucagaggggcacugacuuucuaaugguguuacccaaggugaauguuggagacacagucgcgaugcugcccaagucccggcgagcccuaacuauccaggagaucgcugcgcuggccagguccucccugcaugguaugcagccccucccauguuucuggccacuuuguccuuucuccucccguuugcacaucccuuuggaacuguuuccugugaguacaugcuggggucuccccuuucuucccuugcucaggugaaucucagccccuucucccacccaaagguucacauggauccuaacuacugccacccuuccaccucccugcaccugugcucccuggccugguccuuuaccaggcuucuccacccuccccuaucuccagguauuucccagguggugaaggaccacgugaccaagccuaccgccauggcccagggccgaguggcucaccucauugaguggaagggcuggagcaagccgagugacucaccugcugcccuggaaucagccuuuuccuccuauucagaccucagcgagggcgaacaagaggcucgcuuugcagcagguggauggcagaaaggggauaagcuacacucuuggcacagggcugcuuucuuucuuuauuuuauuuaauuuuuuuuugagacggagucucacucugucgcccaggcuggagugcagugaugcaaucucagcucacugcaaccucugccaccccaguucaagcgauucuccugccucagccucccaaguagcugggauuacaguugccugccaccgugccuggcuaauuuuuguaguuuuaguagagaugggguuucaccgucuaggccaggcuggucuugaacuccugaccuagugauccaccugccucggccucccaaagugcugggauuacaggcauaagccaccacacccggccagggcugcuuucuuaucuccucgggucugacauggggguuggagucuucccauacccuguuucuccucucuccugucuucaagcugagcccuagacuuagcucaccuucucugcuuaugcauucugucccugcgacaggaguggcugagcaguuugccaucgcggaagccaagcuccgagcauggucuucgguggauggcgaggacuccacugaugacuccuaugaugaggacuuugcugggggaauggacacaggugagggacauccugggcuagggcugugguggacccaccugauagaccuuggcauucuuucagagccacauccagaacacucucagccuuugcaaggggagggagagggacagacucaguccaggcaggccuggacacuccagggacaggaaggcuguccacacucaugggugggaaaugagcagacagaaauggauucguuccuuucccacaggugcugaggcuucucugccugucugcacaguugugccuugcaguccucaaaaaaaaaaaaaaaaaaaaagccgaaagaccucaaggacaccuucugugcagccaugucucugggagggucugcagugccuuugccucuuccucuccgaggcagccuucuggcuggcuguggcagggcagaugagcugcagugcacagcccagcaccucgcagggcugcagcccaggucaacaggaaggcaugcugggccuggaacacccacggggccaugcuggcuccaacucagcauccuugcauuccagcccgugggccuuucucugggccagugcuugcagaggggacccugcagggcucugcagcuguguucggcccuccuuucaucuuucauucccuagaccacauggcugacuuucucuguagcuucugggcucaagucucacaggccaccauuccccacaaccucuuugccuuugaagauuaccucuaccaucccauaccccuccagugaauuaacaaguucuccaaagcaggcaauacaugagagcagguuggagacugcugcuguggucuggagggcugauuugguugucugaagccaagauggaaccuuaaaccacaagcauuuuuguuugauugaguuccaggccuacuuugaccccugggguaaugauaauaacuaacauuuauccaaggcugcuacuagccuguguggaaucuuugugcaaauuagaaaaaggcaccccuuucucuggcaggcacagccuuucucuggcaggccagggcaugcugcuuggugagcagaguauggguuagauuuugcuauuucucacugccuuggacaggcccuguugugcgaugagcaaccuguauggccauaggcggugacccugcauuuacugcuuguuaacugugugccagacuuuuuuuuugagacggaguuucacucuuguugcccaagcuggagugcaauggcacgaucucggcucacugcaaccuccgccucccagguucaagugauucuccugccucagccucccgaguagcugggauuauagggaugugccaccacgcccggcuaauuuuguguuuuuaguagagacaggguuucuccauguuggucaggcuggucucgaacuccugaccucaggugauccaccugccucggccucccaaagugcugggauuacaggcgugagccaccgcacccaccugugugcgagacucuuguucuuguauuguuagaaucuccaacucaccauuaaggacacugaggucucaaaaaguugugacugguucaagguuacccagcaccuauccaccccuagagcuaugccagggguggaguggggugaauguggcuuccagguuguccaguugaaauggagccagcaggacugucuucuuuucucuucuccucacagacauggcugggcagcugccccuggggccgcaccuccaggaccuguucaccggccaccgguucucccggccugugcgccagggcuccguggagccugagagcgacugcucacagaccguguccccagacacccugugcucuagucugugcagccuggaggauggguuguugggcuccccggcccggcuggccucccagcugcugggcgaugagcugcuucucgccaaacugccccccagccgggaaagugccuuccgcagccugggcccacuggaggcccaggacucacucuacaacucgccccucacagaguccugccuuucccccgcggaggaggagccagcccccugcaaggacugccagccacucugcccaccacuaacgggcagcugggaacggcagcggcaagccucugaccuggccucuucuggggugguguccuuagaugaggaugaggcagagccagaggaacagugacccacaucaugccuggcaguggcaugcaucccccggcugcugccaggggcagagccucugugcccaagugugggcucaaggcucccagcagagcuccacagccuagagggcuccugggagcgcucgcuucuccguuguguguuuugcaugaaaguguuuggagaggaggcaggggcugggcugggggcgcauguccugcccccacucccggggcuugccggggguugcccggggccucuggggcauggcuacagcuguggcagacagugauguucauguucuuaaaaugccacacacacauuuccuccucggauaaugugaaccacuaaggggguugugacugggcugugugaggguggggugggagggggcccagcaaccccccacccuccccaugccucucucuucucugcuuuucuucucacuuccgaguccaugugcagugcuugauagaaucacccccaccuggaggggcuggcuccugcccucccggagccuauggguugagccgucccucaagggccccugcccagcugggcucgugcugugcuucauucaccucuccaucgucucuaaaucuuccucuuuuuuccuaaagacagaagguuuuuggucuguuuuuucagucggaucuucucuucucugggaggcuuuggaaugaugaaagcauguacccuccacccuuuuccuggcccccuaauggggccugggcccuuucccaaccccuccuaggaugugcgggcagugugcuggcgccucacagccagccgggcugcccauucacgcagagcucucugagcgggagguggaagaaaggauggcucugguugccacagagcugggacuucauguucuucuagagagggccacaagagggccacagggguggccgggaguugucagcugaugccugcugagaggcaggaauugugccagugagugacagucaugagggagugucucuucuuggggaggaaagaagguagagccuuucugucugaaugaaaggccaaggcuacaguacagggccccaccccagccaggguguuaaugcccacguaguggaggccucuggcagauccugcauuccaaggucacuggacuguacguuuuuaugguugugggaaggguggguggcuuuagaauuaagggccuuguaggcuuuggcagguaagagggcccaagguaagaacgagagccaacgggcacaagcauucuauauauaaguggcucauuagguguuuauuuuguucuauuuaagaauuuguuuuauuaaauuaauauaaaaaucuuuguaaaucucuauauacaucuggucauuggagguuccaguuauaaacccaucuuaguuccaccccuuuccccucaaagggggagcaggggucaagugaccccaacccauccugccagggcagggccuaucuuccugccucuggaagacuuguugcagguggguagugggucagauuccagguaggaugaacugggagaagcuggcaccccaggucuggagggggcuggggugcagccuccagcuguagcugccuccugccuuccgaaggcagaaggaaugaaagaugcacauucugggcugacgggcauggcuagcaccauccuaggccacccacgaggggcucauuggcauuugucgucgcugucggaagggcugcccucccgggggaggccaugacgggaguggggcccccagagugcaugcaccucaguggucuccgugucacugcugcugguggcacugucucggaagcuggcgaggggcggccggacuuucacacccugugcugugacagagcccucgauggccuuccggagcug

SEQ ID NO: 18058 - RNA, 6132 nt, Homo sapiens
cgcgcgcaggguggaugggcagcguagagauagugugagaggagcgagggcagcgcccaggaaacgcacaagugugcgggagagccagcaccaggaguaaggggcauuugggaggcagaggcggggcucagggggcgggagcagugcccgggaagggggggccuugugauagaagccagcacucaggaggaagggccagugugagggaagagcugguauccaagggacagggcagugccaggcugaaggggcacggaggggauccguguccaggagaaggcaguggagggggaacgcgcagcacuaagcuggagggguaaugcccgggggagggggguggcgggagcccggcugaaggggcgguguaggggaagagagcagggccuggggggaagagggagggcaguggugggagggugcaguacgagaggaggggacaaugcaggcuuuccucuucuccauagcgacgucauggcaaauucccaaacuggacggauccggcucggguuacguccagcagggccgagccggcccaggccggccccgggguccucggugccggcuggaggggcugggcaccucuggggcgggguucugcuccaccugcccucggcgcggacugugcccucggcgggcacgcggaccggcgggguagggcuagggcccggcuucucugggccaaggaucaaggucccugccuggguuaggcccccacgcauuccagucuucggaacccggccucugaagagggcgcaguagggccccagcggagcgcgagaacccgcucuacagccuauugcuuccccgcccugggcagagccaccuggacaugagacccgcccucaaugccgaagccucucggaagcaaucuuucgggacggaaguuaaguagccccgagcgggaggcuguggcggaaguggucgcguuaccgcuuguuugugcgcaugcgccacucucgucuggccgccgcgcuuucaggaggugcuuuugguucucuccggucuuguccacgcuagggggugcacguacucccaacuguggucgcgcucucaccccuucugcugcucucguggcccccucgcgauggcgggcauccuguuugaggauauuuucgaugugaaggauauugacccggagggcaagaaguuugaccgagguaaguaagguauguaggggcgguuuggaggaagaggcuaaccucgcggacaugccccugggccccguguccacccagcucuuguggccugccccuaccagcagguccugguguagggaccucccucaguaaacauuuuauggaugagaaaacggagacucccgagcucucucuggcuucacgcaugccgugcccggugccuggguggccuuuugucauggugcuggcaaacuccuaggcauauuuauaaucgcuaccugcucugugcuagacacugucuugugagaccagccuggccaacauggugaaaccccgucucuaccaaaaauacaaaaauuagccuggcgugguggcgggcgccuguaaucccagcuacuugggaggcuaaggcaggagaauugccugaaccugggaggcggagguugcagugagccaagaucgcgccacugcacgccagccugggcggcagagcgagacuccgucucaaaaaaaugacaguccucaugagguggguggugccuuucccauuuuucucugagagguugaguaaaccacccaaggcuucacagcgaguaaucugacuucagagccuauauucuuguauugcccucagaaucuuuagcgcuuugugaagucuucuuugaguuagaguuagcugcuugguauauaccuuuuuuuuuuugagacgcagccuuucucuguugcccaggcuggaguguaguggcacgauuuuagcucaccacaaccuccgucucccggguucaagcgauucucugccucaaccucccaaguagcugggauuacaggcaugcgccaccacgccuggcuaauuuuguauuuuuaguagagacaggguuucaccguguuggccaggcuggucucaaacuccugaucucaaaugauccaccugccucggccucccaaaaugucgggauuacaggcaugagccacugcaccggccuacaccucuuuauuuugucaucuaucaauaauuuucucuuugaugucucuuucuuugccuggagacuaagauguuuuucaagacggauaccaguucuuauacaucuuggucacuccccucagcacagugccuagcauagaaagagaaaaccuuuggaugauugaauaacuugcccagagucagguucucagucauccaggcaggcuuugcugcuggaguaucuuugguuguuuucuggggauuacguucgcuugccacaguuuuucuccccuuuuccuucuugcauaucugguucugauugagccugaauuucuaugagagcagaugagagaccacuggauguagacuggguuagauugaguauccuguugcauacaaucccacacuguaggaucugccuuggcaauaccucugucacucuuuuccugcuucuccccagugucucgacugcauugugagagugaaucuuucaagauggaucuaaucuuagauguaaacauucaaauuuacccuguagacuuggguaaguauugaauacagacaauaauaagagacuuuuugcugcuucugcuauucuuuacucucugauauugcuguuauuuucaggugacaaguuucgguuggucauagcuaguaccuuguaugaagaugguacccuggaugauggugaauacaaccccacugaugauaggccuuccaggugagggaguggagaagguaauacuugaaauaugccuugaggacuaaguagauaagugauauagaaagacucuucuaaaauuccuggaauaaaugaugaucagcagaaucugaguaaccuuaaggaaauuucugcacuuaagaauucaaacaggccaggcaccguggcucacaccuguaacccaagcacuuugggaggccgaggcaggaggauugcuugaguccaggaguucaagaccagccugagcaacauagcgaaaccucacugcuacaaaaaagaagagagaaaaaaaaaaaaggcugggcauggugucaugugccuguagucccagcugccugggaggcugaggugggaggauugccugagccagggagguugaggcugcagugagccaugauugcaccacugcacuccagccugggugacagagcaagaccgugucucaaaaaaaaagaaaaaaauucgggccgggcgcgguggcucacgccuguaaucccagcacuuugggaggccgaggcgggcggaucacgaggucaggagaucgagaccauccuggcuaaaacggugaaaccccgucucuacuaaaaauacaaaaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaagaaaaaaauucaaacaaccagguauuuaucuauaacagugauuacaugcuugugaguugcagccuuuugaaggcugaggagguaacugcugagugaccuaggccaugugggucuugugucuugggagggagcuuggugugauggaaagacuuuggcaccccacuugaguucauuucucagcucuaccacuuauuuguugaguaaccuuaaucuccuucagccuguuuccucaucaauaaaauagagauggucaugccuagcucaugggguugccaugaggacuaaaugacaucauguuuguaaugugccuguuguuauaaugcuggcauuuaguuaccaguaaccauuuuuuuuuuuuuuuuugagacggagucuugcucuguggcccaggcuggagugcaguggcgcgaucucaguucacugcaagcuccgccucccggguucacgccauucuccuaccucagccuccugaguagcugggacuacaggagcccacuaccacgcccggcuaauuuuuuuguauuuuuaguagagaugggguuucacuguguuagccaggauggucucgaucuccugaccucgugaucugcccgccuuggccucccaaagugcugggguuacaggcuugagccaccacgcccggcugaccaguaaccauuuuuaaaugggaucuuuuauauuguuaauuacuguuaagaauaacuuugcugcuauugcuccauagggcugaccaguuugaguauguaauguauggaaaaguguacaggauugagggagaugaaacuucuacugaagcagcaacacgccuguaaguuacguaaucuugugaggauucuuuuccucuuccauguucugagacuuugagcuaugcuccugcuuccucuguugagucccucuccucaggcaccucagaccgaggugggaacuagaaagaaauaguucugggagcaguuuccagucugaaauguagacugcccuuugucaggcccuccuggcccagugguccacaugagaaacugauuaucucacuguguaaagugcaaaggagacuugcuuccccaggaauaaaugcagcauuaagugauuagacuguuaggcuuuguguguguguguguguguguguguguguguguuuugcuacucuguaaaaggcuguguguguguguguguguguguguggcuacucuguaacccaaucccuaguuccuugguuuuccuguccagcuauuuuuucuuuucuuuaaagucuuauuaaaacaauaugugcuuuuuguaaguaauuugaaaugcagaagaguaaugugaagaaggaaaaaaaagucaccuguaauuccauauccagagagaaccuuuuacauagacuuuuuugcauauccugguguucuguuuuuuucuuggagacugugguguuuauuauguuuucuucugcucuuuuugcuuaacauuauguaaaacauguuuccccauguuaguguaaagcuuuucuuuucuuuucuuuucuuuuuuuuuuuugagauggagucuugcuguguugcccagccuggagugcaguggcgcgaucucggcucacugcaagcuccgccucccggguucacgccauucuccugccucagccuccugaguagcugggacuacaggcacccaccaccaugccuggcuaauuuuuuuuuuguauuuuuaguagagacaggguuucaccauguuagccaggauggucuugaucuccugaccucgugauccgcccgccucagccucccaaagugcugggauuacaggugugagccaccgugcccggccgguguaaagcuuuucuuaaacguuucaauaguugcauaacauuucaguaaguggauaugucuugauucauuugaacauuccccugauuuggggcaucuagguguuuuccacccucgauaauauaaagaacagugccuugcacauaucugugcauugauguuugucagaauuuugguuccuagugacaaaacaguaggaagaugccucuucuguuucuuaggcugagauggaacagugccuugcacauaccugugcauugaucuuugucagaauuuugguuccuagugacacaacaguaggaagaugccucuucucuuucuuaggcugagauugagagcugcugaguggcagugcuccagaaucacgggauggggccuucuguuucagcucugcguacguguccuaugggggccugcucaugaggcugcagggggaugccaacaaccugcauggauucgagguggacuccagaguuuaucuccugaugaagaagcuagccuucugaaccucgccugaagccagccucucugccaagucacucaggucaugggcauuguucaagccugaguggcagccgcucuugcucaccuguugaggaagggcuggcucacuguccaccguggcggcaucuuuaacuggccuccacucaaugggaaacugacucgccugugaaagacacagugggagagcugaaaaugaaucagaagcuuuauguauaugauuuuuaaauuaaacuuuacuuuuucagacu

SEQ ID NO: 18059 - RNA, 6132 nt, Homo sapiens
agucugaaaaaguaaaguuuaauuuaaaaaucauauacauaaagcuucugauucauuuucagcucucccacugugucuuucacaggcgagucaguuucccauugaguggaggccaguuaaagaugccgccacgguggacagugagccagcccuuccucaacaggugagcaagagcggcugccacucaggcuugaacaaugcccaugaccugagugacuuggcagagaggcuggcuucaggcgagguucagaaggcuagcuucuucaucaggagauaaacucuggaguccaccucgaauccaugcagguuguuggcaucccccugcagccucaugagcaggcccccauaggacacguacgcagagcugaaacagaaggccccaucccgugauucuggagcacugccacucagcagcucucaaucucagccuaagaaagagaagaggcaucuuccuacuguugugucacuaggaaccaaaauucugacaaagaucaaugcacagguaugugcaaggcacuguuccaucucagccuaagaaacagaagaggcaucuuccuacuguuuugucacuaggaaccaaaauucugacaaacaucaaugcacagauaugugcaaggcacuguucuuuauauuaucgaggguggaaaacaccuagaugccccaaaucaggggaauguucaaaugaaucaagacauauccacuuacugaaauguuaugcaacuauugaaacguuuaagaaaagcuuuacaccggccgggcacgguggcucacaccuguaaucccagcacuuugggaggcugaggcgggcggaucacgaggucaggagaucaagaccauccuggcuaacauggugaaacccugucucuacuaaaaauacaaaaaaaaaauuagccaggcaugguggugggugccuguagucccagcuacucaggaggcugaggcaggagaauggcgugaacccgggaggcggagcuugcagugagccgagaucgcgccacugcacuccaggcugggcaacacagcaagacuccaucucaaaaaaaaaaaagaaaagaaaagaaaagaaaagcuuuacacuaacauggggaaacauguuuuacauaauguuaagcaaaaagagcagaagaaaacauaauaaacaccacagucuccaagaaaaaaacagaacaccaggauaugcaaaaaagucuauguaaaagguucucucuggauauggaauuacaggugacuuuuuuuuccuucuucacauuacucuucugcauuucaaauuacuuacaaaaagcacauauuguuuuaauaagacuuuaaagaaaagaaaaaauagcuggacaggaaaaccaaggaacuagggauuggguuacagaguagccacacacacacacacacacacacacagccuuuuacagaguagcaaaacacacacacacacacacacacacacacacacaaagccuaacagucuaaucacuuaaugcugcauuuauuccuggggaagcaagucuccuuugcacuuuacacagugagauaaucaguuucucauguggaccacugggccaggagggccugacaaagggcagucuacauuucagacuggaaacugcucccagaacuauuucuuucuaguucccaccucggucugaggugccugaggagagggacucaacagaggaagcaggagcauagcucaaagucucagaacauggaagaggaaaagaauccucacaagauuacguaacuuacaggcguguugcugcuucaguagaaguuucaucucccucaauccuguacacuuuuccauacauuacauacucaaacuggucagcccuauggagcaauagcagcaaaguuauucuuaacaguaauuaacaauauaaaagaucccauuuaaaaaugguuacuggucagccgggcgugguggcucaagccuguaaccccagcacuuugggaggccaaggcgggcagaucacgaggucaggagaucgagaccauccuggcuaacacagugaaaccccaucucuacuaaaaauacaaaaaaauuagccgggcgugguagugggcuccuguagucccagcuacucaggaggcugagguaggagaauggcgugaacccgggaggcggagcuugcagugaacugagaucgcgccacugcacuccagccugggccacagagcaagacuccgucucaaaaaaaaaaaaaaaaaugguuacugguaacuaaaugccagcauuauaacaacaggcacauuacaaacaugaugucauuuaguccucauggcaaccccaugagcuaggcaugaccaucucuauuuuauugaugaggaaacaggcugaaggagauuaagguuacucaacaaauaagugguagagcugagaaaugaacucaaguggggugccaaagucuuuccaucacaccaagcucccucccaagacacaagacccacauggccuaggucacucagcaguuaccuccucagccuucaaaaggcugcaacucacaagcauguaaucacuguuauagauaaauaccugguuguuugaauuuuuuucuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuuuuguauuuuuaguagagacgggguuucaccguuuuagccaggauggucucgaucuccugaccucgugauccgcccgccucggccucccaaagugcugggauuacaggcgugagccaccgcgcccggcccgaauuuuuuucuuuuuuuuugagacacggucuugcucugucacccaggcuggagugcaguggugcaaucauggcucacugcagccucaaccucccuggcucaggcaauccucccaccucagccucccaggcagcugggacuacaggcacaugacaccaugcccagccuuuuuuuuuuuucucucuucuuuuuuguagcagugagguuucgcuauguugcucaggcuggucuugaacuccuggacucaagcaauccuccugccucggccucccaaagugcuuggguuacaggugugagccacggugccuggccuguuugaauucuuaagugcagaaauuuccuuaagguuacucagauucugcugaucaucauuuauuccaggaauuuuagaagagucuuucuauaucacuuaucuacuuaguccucaaggcauauuucaaguauuaccuucuccacucccucaccuggaaggccuaucaucagugggguuguauucaccaucauccaggguaccaucuucauacaagguacuagcuaugaccaaccgaaacuugucaccugaaaauaacagcaauaucagagaguaaagaauagcagaagcagcaaaaagucucuuauuauugucuguauucaauacuuacccaagucuacaggguaaauuugaauguuuacaucuaagauuagauccaucuugaaagauucacucucacaaugcagucgagacacuggggagaagcaggaaaagagugacagagguauugccaaggcagauccuacagugugggauuguaugcaacaggauacucaaucuaacccagucuacauccaguggucucucaucugcucucauagaaauucaggcucaaucagaaccagauaugcaagaaggaaaaggggagaaaaacuguggcaagcgaacguaauccccagaaaacaaccaaagauacuccagcagcaaagccugccuggaugacugagaaccugacucugggcaaguuauucaaucauccaaagguuuucucuuucuaugcuaggcacugugcugaggggagugaccaagauguauaagaacugguauccgucuugaaaaacaucuuagucuccaggcaaagaaagagacaucaaagagaaaauuauugauagaugacaaaauaaagagguguaggccggugcaguggcucaugccuguaaucccgacauuuugggaggccgaggcagguggaucauuugagaucaggaguuugagaccagccuggccaacacggugaaacccugucucuacuaaaaauacaaaauuagccaggcgugguggcgcaugccuguaaucccagcuacuugggagguugaggcagagaaucgcuugaacccgggagacggagguuguggugagcuaaaaucgugccacuacacuccagccugggcaacagagaaaggcugcgucucaaaaaaaaaaagguauauaccaagcagcuaacucuaacucaaagaagacuucacaaagcgcuaaagauucugagggcaauacaagaauauaggcucugaagucagauuacucgcugugaagccuugggugguuuacucaaccucucagagaaaaaugggaaaggcaccacccaccucaugaggacugucauuuuuuugagacggagucucgcucugccgcccaggcuggcgugcaguggcgcgaucuuggcucacugcaaccuccgccucccagguucaggcaauucuccugccuuagccucccaaguagcugggauuacaggcgcccgccaccacgccaggcuaauuuuuguauuuuugguagagacgggguuucaccauguuggccaggcuggucucacaagacagugucuagcacagagcagguagcgauuauaaauaugccuaggaguuugccagcaccaugacaaaaggccacccaggcaccgggcacggcaugcgugaagccagagagagcucgggagucuccguuuucucauccauaaaauguuuacugagggaggucccuacaccaggaccugcugguaggggcaggccacaagagcuggguggacacggggcccaggggcauguccgcgagguuagccucuuccuccaaaccgccccuacauaccuuacuuaccucggucaaacuucuugcccuccgggucaauauccuucacaucgaaaauauccucaaacaggaugcccgccaucgcgagggggccacgagagcagcagaaggggugagagcgcgaccacaguugggaguacgugcacccccuagcguggacaagaccggagagaaccaaaagcaccuccugaaagcgcggcggccagacgagaguggcgcaugcgcacaaacaagcgguaacgcgaccacuuccgccacagccucccgcucggggcuacuuaacuuccgucccgaaagauugcuuccgagaggcuucggcauugagggcgggucucauguccagguggcucugcccagggcggggaagcaauaggcuguagagcggguucucgcgcuccgcuggggcccuacugcgcccucuucagaggccggguuccgaagacuggaaugcgugggggccuaacccaggcagggaccuugauccuuggcccagagaagccgggcccuagcccuaccccgccgguccgcgugcccgccgagggcacaguccgcgccgagggcagguggagcagaaccccgccccagaggugcccagccccuccagccggcaccgaggaccccggggccggccugggccggcucggcccugcuggacguaacccgagccggauccguccaguuugggaauuugccaugacgucgcuauggagaagaggaaagccugcauuguccccuccucucguacugcacccucccaccacugcccucccucuuccccccaggcccugcucucuuccccuacaccgccccuucagccgggcucccgccaccccccucccccgggcauuaccccuccagcuuagugcugcgcguucccccuccacugccuucuccuggacacggauccccuccgugccccuucagccuggcacugcccugucccuuggauaccagcucuucccucacacuggcccuuccuccugagugcuggcuucuaucacaaggcccccccuucccgggcacugcucccgcccccugagccccgccucugccucccaaaugccccuuacuccuggugcuggcucucccgcacacuugugcguuuccugggcgcugcccucgcuccucucacacuaucucuacgcugcccauccacccugcgcgcg

SEQ ID NO: 18060 - RNA, 9545 nt, Homo sapiens
cucccuccuccccagcugucccguucgcgucaugccgagccucccggccccgccggccccgcugcugcuccucgggcugcugcugcucggcucccggccggcccgcggcgccggcccagagccccccgugcugcccauccguucugagaaggagccgcugcccguucggggagcggcagguaggugggcgcccgggggaggcgcgggcggggagucgggcucggggcgagucagcgccagcccggagggggcgcggggcgcagguggcucggcgcggcgggcggcccggagggugggcgggggcagaagggcgcggugccugggacccgggacccgcgggcagcccccggggcggcacacggcgcgagcugggcagcggccuccagccaagcccguccccgcaggcugcaccuucggcgggaaggucuaugccuuggacgagacguggcacccggaccuaggggagccauucggggugaugcgcugcgugcugugcgccugcgaggcggugagugcaccccgcggccggcccgggcccuggcggguggggagcgccgggucgcgcgggcgucggaguggacucggagcugcugagaaggagcccagucggcagauguuggggauauuuuucugguggaggaaggggaaucagccccuccaauucuuaggugcuguuacugaucgcccacucugugugaggcucugugccaacuccguuucguucccugcucaucuaacucucauggcagccuugcuagauagagaguauuauuauccccauuuuccagacagggaccuugaggcccagagagaugaaguagcuugucuagggucacgcagcuuguaaguggcagagcuggcugacucugcgggacauccuugccugggggggucucaucaguuggcaucuugcacucacuuggguuucccgccuuuuccgggagcagccucaguggggucgccguaccaggggcccuggcagggucagcugcaagaacaucaaaccagagugcccaaccccggccugugggcagccgcgccagcugccgggacacugcugccagaccugcccccaggguaagucuugcuccgcccugcggggagggaggcagggccacgauacuaggucccgggccacuuggauggggcgucggacuggccuuucccauggccagcugaagcccguguucuuacccccccgcccgcagagcgcagcaguucggagcggcagccgagcggccuguccuucgaguauccgcgggacccggagcaucgcaguuauagcgaccgcggggagccaggcgcugaggagcgggcccguggugacggccacacggguagggggcuggcgaacagcgggguugugguugaggcugggccaccaaagcggcguuugacagugcucaggccaucuuccucccgucccagacuucguggcgcugcugacagggccgaggucgcaggcgguggcacgagcccgagucucgcugcugcgcucuagccuccgcuucucuaucuccuacaggcggugagaaaggggaaggagcaaggaggggucagcugccggggcccgggagggaaacugggagagcugggaggggcugcuuuuggcucaguccggccucacccgaccucucauucccaggcuggaccgcccuaccaggauccgcuucucagacuccaauggcaguguccuguuugagcacccugcagcccccacccaagauggccuggugagaugaugccauuuaugagcacuugcccagucugggcacugugccgagagcaugcucugcauugccucccgugguccucaccacagcccagugggaggaaggcacugacauuaugaugcccauuuuacagaagggggaacugaggcucaguaggauaaugugauuuguucaaggucacacagcuaguaaguggugcagccaggauuggaacccaagcaucuggcuccagcguucuuucuuaagcuuccuagggcacccuggagguuccuuuccauguuccuuuuucauaagcccugccugggcauccuaauuggccuagccugcacagugucugagcguagggccuucuugucucucugcuccaggucugugggguguggcgggcagugccucgguugucucugcggcuccuuagggcagaacagcugcauguggcacuugugacacucacucacccuucaggggaggucugggggccucucauccggcaccgggcccuggcugcagguagggagcaaagagccccgggcgugaaguucugagucuucucuaucacccaggaaagggggggaggguuucugacgggcucucaucaucgucccuuccccagagaccuucagugccauccugacucuagaaggccccccacagcagggcguagggggcaucacccugcucacucucagugacacagaggacuccuugcauuuuuugcugcucuuccgagggcugcuggaacccaggaguggggguaagugggaugggggcaaaacacgugagaagguuagggagagcaccugucucagaaaggcccacaugugcggccuugcaggacuaacccagguucccuugaggcuccagauucuacaccaggggcagcuacugcgagaacuucaggccaaugucucagcccaggugaguggggaucuggcucucgcugccaccugucuuggccucuugcuauugcccaucacacccugcucuguccccaggaaccaggcuuugcugaggugcugcccaaccugacaguccaggagauggacuggcuggugcugggggagcugcagauggcccuggagugggcaggcaggccagggcugcgcaucaguggacacauugcugccaggaagagcugcgacggugaggcggggggggggccuggugcgccgggcaugcacaacugagagacacagacaagugccagggugggugugggagagauccuguggacuggggguguaagcggccaugggguaaaccuagccucaccugucuugccccuccguaguccugcaaaguguccuuuguggggcugaugcccugaucccaguccagacgggugcugccggcucagccagccucacgcugcuaggaaauggcucccugaucuaucagguaagagccaggggcugcagaaggugggggagggguggcgugggcagcaggccccaggccuuuacugccucuccacuuugcccuccuccaucccugcccaucaggugcaagugguagggacaagcagugaggugguggccaugacacuggagaccaagccucagcggagggaucagcgcacuguccugugccacauggcuggacuccagccaggaggacacacggugagggcuccagguggagcuggaccccagggcccaaugcaugggcugugggaagccagguuggaugagcagggauguucauuaucauccacucacucauggguucucccacucauucauuuauucauuugacuuuuuuuuuuuuuuuuuuuugagauggagucuggcucugucaccaggcuggagugcaguggugugaucuuggcuuacugcaaccucugccuccuggguucaagcgauucuccugccucagccucccaaguagcugggaccacaggugugcaccaccacacccagcuaauuucuguauuuuuaguagagacgggguuucaccguguuggccaggauggucuugaucucuugaccucaugguccgcccacuucggccucccaaagugcugggauuacaggcgagagccaccgugcccggcaugauuugacauuuuuagugagccccagacuagggacuagaguacaaagcaaaucauauguggccccugugcuuagcaagcucacagucaaaugggagcauuggaccuggagaacagugccacaggccacauauuaguaaauguaauggcaaugguugcuacuuauagggccuuuccaugugcuaggugcugcauugguggccuuacauaguuuuuggcuuucacaguauccauuugagagaugaggaagugaagacuuggagaaguuaaguuacucuugaagguuguuacauagcuaggaagcagcaggggagggccuugaaacugggccugccagguccuuauccuguguuucugguguguggaaguguguguggguggagugggggcacaaaaugguccaagacuucagaaccuuggacucgugugagagcugagaaggccuauccuccccugcccccaggccguggguaucugcccugggcugggugcccgaggggcucauaugcugcugcagaaugagcucuuccugaacgugggcaccaaggacuucccagacggagagcuucgggggcacguggcugcccugcccuacugugggcauagcgcccgccaugacagugaguguccuuaggggucugucugcccuuugguuuccuagaacauuugagggaugguggcagacagccggagccuggugugucuuucuuugugccuaagcuccgguugccaucugaagguggggacauauaggguggcccugcuggcggacucuuccuguugcugagguucaagggucuaaaacuugcugcucuccaggcccuggaccuauggacagugucuuccagcucguggaaugugugcuggggagcugggaaugcuggguuugagggcuugcccuaggccaccuucucaccugucaucucuccucugucuggacccagcgcugcccgugccccuagcaggagcccuggugcuacccccugugaagagccaagcagcagggcacgccuggcuuuccuuggauacccacugucaccugcacuaugaagugcugcuggcugggcuugguggcucagaacaaggcacugucacugcccaccuccuugggccuccuggaacgccagggccucggcggcugcugaagggauucuauggcucagagguaaggaugugaugguaggcggcagcuuggaacauuucuguuuuuuagcuugaagggcugugugggccuguguuggggaaagcagagagcaggcagccugguauagaagagcuggcauaaauaaaauaaauuaaacagugauuuguaggcugggugcaguggcucaagccuguaaucccagcacuuugggaggccagguggguggaucaccugagguaggaagcucaagacuagccugaccaacauggagaaaccccaucucuacuaaaaauacaaaauuagcugggcgugguggcacaugccuauaaucccagcuacuccagaggcugaggcaggagaaucgcuugaaccugggagguggagguugcagugagccgagauggcgccauugcacuccagccuggacagaaagagcaaaaauccgucucaaaaaaaaaaaaaaaaaaaaaaaaaaaaagagcuggcaugggcuugggagucagauagaccugggcaugacucugacuggcuuuuuauuauucauucuccuuucuaagucuuuuuuugguggggugucuuggauaguauguaauauccuggaccucagggggguaggugggauggacuaagcccuucaaguggggugaguucucauggacuuggucagagagaccuggcuuccaagcuccacacuauugccaaugggcuuugcuaccaugaagacuuuauuuaaccucccuggcucucaguuucuucaucugugaacuggggacaguaggcucagcccuaaagugccuuauuccuauccauuguccugucuaugugcaggcccaggguguggugaaggaccuggagccggaacugcugcggcaccuggcaaaaggcauggccucccugaugaucaccaccaaggguagccccagaggggagcuccgagggcagguagguggcgagugugggcagugggggcaguggggagggugcagaguuggaggggcacugugugccauugcacuagucacuugcugucucugaguccuggggguggucguaucacagcgcccccccggcugguggggaggaugagcuacaugaggaggcuggcagcccggcacccuaucccuggcagcugagaugauuguggagcgaauggcauccuccugggccacugcagcgcucagggggccgaggugucuccugcuggcuggccagcugccgcugguaaagacgcgagggggagccccagcgcugccucaguuggccucuccucccaggugcacauagccaaccaaugugagguuggcggacugcgccuggaggcggccggggccgagggggugcgggcgcugggggcuccggauacagccucugcugcgccgccuguggugccuggucucccggcccuagcgcccgccaaaccuggugguccugggcggccccgagaccccaacacaugcuucuucgaggggcagcagcgcccccacggggcucgcugggcgcccaacuacgacccgcucugcucacucugcaccugccagguaggagguccuggaagggcacacuggguccugggaucuggagcaaggggccuggacacucccgucaaugccucugcuccucucugcagagacgaacggugaucugugacccgguggugugcccaccgcccagcugcccacacccggugcaggcucccgaccagugcugcccuguuugcccuggugaguuccccgcaggggaguggagggaggaguuggcccagugcggacagguccuuuggggagggaaugaggguggucacucucugcuuucaccauuucuuuggcuccacagagaaacaagaugucagagacuugccagggcugccaaggagccgggacccaggagagggugagcuggaagggugcgugcagggugggaggccccagaggagccauuagguugaaccaggagggggacaagaaggggagaguauauaggggguggccugaggggcacagauuccaagugaugccugacaggacucauuaguguuacuggcccccaggugggcccuuggcuuaggcucguguggggguggccugaggcucaagccuugguugugggcccagcugaugagcucauacuaauggcugcugggcccuguuccccaccaggcugcuauuuugauggugaccggagcuggcgggcagcggguacgcgguggcaccccguugugccccccuuuggcuuaauuaagugugcugucugcaccugcaagguauggccacccaaucuucucuggugccauaacccagcggggucugcagagauggggaggggcugccaggugaggaaggcccguccuuggugaggagggcucaagaaucaaaacgauaugagaaaaggcccuugcgcucugagagucggcuuccugugggaaaaugaacagggcugaccuggguguggauucuggcucugccagcuaacuagugccagugacccuaggcaccuucugucccugagccucacuuuccucuccuguaagcagauaugauggcaccuaccuugcaggguucugaugaggagcugaguuuaggucuauaaagccaguccgggccucugaguaaaaggccacagagagacugcauuugagguguggaauaggagagggagugggcaggaggcuuaugugcccccugccugacacuccuugcucaauggaucccuacaggggggcacuggagaggugcacugugagaaggugcaguguccccggcuggccugugcccagccugugcgugucaaccccaccgacugcugcaaacaguguccaggugagagagguggcugagcacugaggccucaccuuuggguugaggcaggcuuuguccugggugaggggaagggugcucaguuaauugagcauuauacugagcacugcucugugccuagccuggagccaggacucuaaaugcaguggaaagaaugugauauacuagugggguaugauggguucugguuccugcuccauccauccguccauccauccauccauccauccauccauccauccauccauccauccguccauucaucuaucuauccacccauacaaccauccacccauugaugcauccauccaugcauccauccaucccuccauccauccacccauccacccauugaugcauccauccauccauccauccauccauccauccauccauccauccgucccuucauccauccauucaucugcccacccacccauccaaauuuaucaccuacuaagugccagaaacugcaacgugcuggguauucaaagagaauacucauaaaaccuuguugguccuccugggcugauccuuucucuuucccucucaacaguggggucgggggcccacccccagcugggggaccccaugcaggcugaugggccccggggcugccguuuugcugggcagugguucccagagagucagagcuggcaccccucagugcccccuuuuggagagaugagcuguaucaccugcagaugugggguaaguggggagcagaggcuugugugagguggguacugggagccuggucuggaguagggagaccuucccagggaggucccugaagaagcugaaggucacugugucccagugccucugggggacacucagugucugcucugucuuguaccaggcaggggugccucacugugagcgggaugacuguucacugccacuguccuguggcucggggaaggagagucgaugcuguucccgcugcacggcccaccggcggcguaagugagggaguccagggucagcagcugugaguggagggcucaccugccugugggacuccugaucagggaagggagcacucacugugugcaggaacagugcagccugccucacaagugccauuccaauccacccucacagcaaccugguggaauuguuauuuaugaccuuuucuuuacaaaugagauuucugaagcucagagaaauuaagcaacgagaugaaggucacccagcugugugcacugaccuguuuagaaaauacuggccuuucugggaccaaggcagggaugcuuugcccugcccucuaugccucucugugccucuccacucccucuccccuccuccaacauucccucccuucugucuccagcagccccagagaccagaacugauccagagcuggagaaagaagccgaaggcucuuagggagcagccagagggccaagugaccaagaggauggggccugagcuggggaagggguggcaucgaggaccuucuugcauucuccugugggaagcccagugccuuugcuccucuguccugccucuacucccacccccacuaccucugggaaccacagcuccacaagggggagaggcagcugggccagaccgaggucacagccacuccaaguccugcccugccacccucggccucuguccuggaagccccaccccuuuccuccuguacauaaugucacuggcuuguugggauuuuuaauuuaucuucacucagcaccaagggcccccgacacuccacuccugcugccccugagcugagcagagucauuauuggagaguuuuguauuuauuaaaacauuucuuuuucagucuuu

SEQ ID NO: 18061 - RNA, 1203 nt, Homo sapiens
acacacacuaaagccaugggcacccucgagggacaccugcugccagcaauguucuuccuucucuacucacucuacuauauggugcuggugucucuggcccugcuacaggaacagaggcuccucaaacucccucugcccuccagggagaagugaggacacagguggugguagcuggugccacuagaagguguggugaagguggucaucacccuggcuggcaucuuacccaaguuauucuacccgucuggaguaaaucggcugauggugguagacugggaggauccgcgguggccauucguguucaaggacagcuggcagcacaucaccauguacgaguucuuuaugcucacuggcgugguggacauuguaagccagucgugucaggaaugguagaauaugaagcuagagcaagcagucaaggccuugggcuccuaugugcuggcacuacugauggcagcccacauugagaacaagggcacccuggagauccgugugcgugagcucuucagcgugccccccuuccuggucucccuggugcucaccaucaaggucugggucccugaccagccccagcucugggugcucaagaccuggguggggcuggggcucagcaacuggaugcugcagcugugugugcugauguuugcgccucccuccggacagcccugcagguggagaaccccauggaccuugccuuccucacucgcuucuucuccuggcaccugggcuugggggcugccgugcuggcugcugucuauggccucugcagccucuggcaccgucacugcuccuccuggacagcguuaccaggggccagguacuagccgugccucaccaauuccaguggugaagagcuugagaagcucagggcagaggcugugcugcuggauggaggcgucuagguacagaaacugucuuuguucuaugccuuuuguaaugagaguuucaagggugcccacagcacgcauagcauggaaaugccuuagaauucacaggcuagcuucuaucucgggagccaucuuucucguucccaaauaaaccugccagccccugggguaacuucucauccaucauucucuucucuccaggucugucucuuuucucucucauuauucuggccaagcacauacaugaaaugagaacaggagugcugcuuuuuucuggcaguuuucaggauccaagaggaggaaaugaauugaggaa

SEQ ID NO: 18062 - RNA, 2260 nt, Homo sapiens
ggccugaccgccgcugccuacagagucacacucaauccuccgggcaccuuccuugaaggaguggcuaagguuggacaauacacguucacugcaggugagcacgcugggcugggcauggcugggcccucuccuggcacagccccagcucucagagcacauuugacggcugccucuucucucugacuccccagcccguguccacagugcuggccauccggagaaagugggguguuccuuuaucaggaauacauguaggguggggaggcccaggagaacagcuccaggacuggggccaggaggcugccaugcacagcgagcagccgacucguggcaucucucuccauccagacacuggcagugagcgcccaagaggcuccugcugugcccgucucgaggcccuugcucuucccgucuaccccgcagcugcugucggggccguguuuggccucaccaccugcaucagcgcccauguccgcgagaagcccgacgacccccugaacuacuuccucgguggcugcgccggaggccugacucugggagcacgcagugaguggcccccuccccacccccacccuccucccagccuggcagaaugaccccugaccucugcucauccuccacccucucuguuccaucccggacaagaaguaaagcagccuucuugaacaccagccauuucagucauagcgacagcugcugcugcugcuuaagcaccuacuguggcccucccugaccugcccuguccccuccccacccuccccuccucacucugcuccagccacacgggccuccucacugcuccucccacaugccagguacaguccugccccagggccuuugcaugggcagugcacugcguggaaugcuguuccccucacuguccugaccacccuguguacaagccagcauccccgccgcccucgcucugugccgccuuccuucugugugccuugucagaggacacaggucaccaaggucacccccugucucugccacuggccugugagucagagaggaggauggauggagucucgcccugccaucucucucccugcaccuggagcccugcaggggagcugcccccgcaaccuucacuuuacagaaaaggguauuagggcucagggagggaauuaaguggcccgaggucaccuggaggagcaaguggccuucuuugcagccaucagagggugcagcccugguggagaaggccacgcuuggcacaggggagcccgucuggagcaugagccagacaucacuccugcccucccaugggcccgggcucagcgucagugcccgccugugccccuggccuacccccagcccgccaaggcucgggcccucagggccagcgggaggagugaacgagcccucuugcagcucagccgcucuggccuggcauguugggagugaugaauggcagguuccaggcaggcagagagggagggugcgagggcagggcguacgccgucacugcugucucugcgucaagaccuuggggaggccuugucccuccccagcucccacuggaacuggucagagguugcagguggguugaggucuugacuguagcccagcucaggcuggaacugcucccuguccccaagccagccucccugucucucuucaaagagugugagucccuuuagguccugguguguggggacacaccuccuuccuccucuggcccggaggcuucggagcaggagagccuggagaagugggggcacugucggggcuccucgguacacagaccacgggacagaugcguggccuggcccuggcauccaugggcaaaggagagacugagacacaccgaugugucaccauggcccggugcccagccuugccccagccccagcugggggcagcacgguguccucgcagggggaagucaguguggggcgggaugaggacccacagccuggguuccugcugggaagcaaccuggacuccggccucccucugugcaucaguuuccacaucuccagagucuagggcccucuuccugagugacuuaaucccugaagagaguguccugucaggggucucagucuggcucccagggugggcaccggccagggcguggagcgucuugguccggccgagccccacccgggccugacaucaccuccccacucccacagcgcacaacuacgggauuggcgccgccgccugcguguacuuuggcauagcggccucccuggucaagaugggccggcuggagggcugggagguguuugcaaaacccaaggugugagcc

SEQ ID NO: 18063 - RNA, 2260 nt, Homo sapiens
ggcucacaccuuggguuuugcaaacaccucccagcccuccagccggcccaucuugaccagggaggccgcuaugccaaaguacacgcaggcggcggcgccaaucccguaguugugcgcugugggaguggggaggugaugucaggcccggguggggcucggccggaccaagacgcuccacgcccuggccggugcccacccugggagccagacugagaccccugacaggacacucucuucagggauuaagucacucaggaagagggcccuagacucuggagauguggaaacugaugcacagagggaggccggaguccagguugcuucccagcaggaacccaggcuguggguccucaucccgccccacacugacuucccccugcgaggacaccgugcugcccccagcuggggcuggggcaaggcugggcaccgggccauggugacacaucggugugucucagucucuccuuugcccauggaugccagggccaggccacgcaucugucccguggucuguguaccgaggagccccgacagugcccccacuucuccaggcucuccugcuccgaagccuccgggccagaggaggaaggagguguguccccacacaccaggaccuaaagggacucacacucuuugaagagagacagggaggcuggcuuggggacagggagcaguuccagccugagcugggcuacagucaagaccucaacccaccugcaaccucugaccaguuccagugggagcuggggagggacaaggccuccccaaggucuugacgcagagacagcagugacggcguacgcccugcccucgcacccucccucucugccugccuggaaccugccauucaucacucccaacaugccaggccagagcggcugagcugcaagagggcucguucacuccucccgcuggcccugagggcccgagccuuggcgggcuggggguaggccaggggcacaggcgggcacugacgcugagcccgggcccaugggagggcaggagugaugucuggcucaugcuccagacgggcuccccugugccaagcguggccuucuccaccagggcugcacccucugauggcugcaaagaaggccacuugcuccuccaggugaccucgggccacuuaauucccucccugagcccuaauacccuuuucuguaaagugaagguugcgggggcagcuccccugcagggcuccaggugcagggagagagauggcagggcgagacuccauccauccuccucucugacucacaggccaguggcagagacagggggugaccuuggugaccuguguccucugacaaggcacacagaaggaaggcggcacagagcgagggcggcggggaugcuggcuuguacacaggguggucaggacagugaggggaacagcauuccacgcagugcacugcccaugcaaaggcccuggggcaggacuguaccuggcaugugggaggagcagugaggaggcccguguggcuggagcagagugaggaggggaggguggggaggggacagggcaggucagggagggccacaguaggugcuuaagcagcagcagcagcugucgcuaugacugaaauggcugguguucaagaaggcugcuuuacuucuuguccgggauggaacagagaggguggaggaugagcagaggucaggggucauucugccaggcugggaggaggguggggguggggagggggccacucacugcgugcucccagagucaggccuccggcgcagccaccgaggaaguaguucagggggucgucgggcuucucgcggacaugggcgcugaugcagguggugaggccaaacacggccccgacagcagcugcgggguagacgggaagagcaagggccucgagacgggcacagcaggagccucuugggcgcucacugccagugucuggauggagagagaugccacgagucggcugcucgcugugcauggcagccuccuggccccaguccuggagcuguucuccugggccuccccacccuacauguauuccugauaaaggaacaccccacuuucuccggauggccagcacuguggacacgggcuggggagucagagagaagaggcagccgucaaaugugcucugagagcuggggcugugccaggagagggcccagccaugcccagcccagcgugcucaccugcagugaacguguauuguccaaccuuagccacuccuucaaggaaggugcccggaggauugagugugacucuguaggcagcggcggucaggcc

SEQ ID NO: 18064 - RNA, 181636 nt, Homo sapiens
ggggcggggagggggcgcucgcucgcucccucucggcugcgcacacgcccguacaaacucucacacagacacacgcggggugcgcugccgccgcccgccgcugcuccuccucccgccaccgccuugagagggagagagagggaggcagagagagcgcuuuguccgcgcgccgccgcccggcccgggacucugccccgaggaggcagccgcgccgaguccccgccuccgccucugcccccgggcgggccgggccggccgcgguggggggagccaggcugaggguggggguggguggcgggcgggcggagggcggggagggggggcggaggaggaggagagacgagggcagcggaggaggcgaggagcgccggguaccgggccgggggagccgcgggcucucggggaagagacggaugaugaacaagcuuuacaucgggaaccugagccccgccgucaccgccgacgaccuccggcagcucuuuggggacaggaagcugccccuggcgggacagguccugcugaaguccggcuacgccuucguggacuaccccgaccagaacugggccauccgcgccaucgagacccucucgggugagcacucagcgcggcccccuccccccgccucgccccgcucaggccgggacggcgccgggagggaggccgaguccggcgggcggcgcccggcggcggcucccgcgcccgcacgcucacuuccacgcaccagacccucaacucucgccgccggcccgcuccugggacggcccgcuccccuccccccacagcucuggacucugcccucgcccucggggccgcagccuuggggcgccccccgugccgcuccgaaggcucccgaggcucgccggcuccuuaggggcaccccucguucgccuggcgccccgggcugcucugagcuuccccgccccccacccuuugagcguccccugucucacuucuccccugaccuuccugucacccccuuugucaggguccccccuuccccaaauccagcgucucuuccuccucccccggccggaccuucucucuuccagugccucgugcccagaaccucucgcccucuggcgucuccugagccgcacucuccuuucgagcccccuccccaccucgccccacggccccccacuuuuggcacccccucggcgccacccuggugacccccuucgagaucucggggcucccccagccccagcccucgcacgacggcacauccccucgguccuuucccgaaccucaguccccucucgcuugcucucucaagcgcuccuauuuuucucugaauuuuuuguccgauuuuauugagaagaacucggggcugggggcuuuccgccgcccguccccccgccucccgcucggccagaagcaccuuuuuacgaggugcccugucucaacucggugggggccaggguugagaaccgggaaagaggcgaccggggggcccgcgagcgcgcuggagcccagacaggagacggagagcgacacacacacacacucgcgcgcgcgcacuccccaacucuccccagcacacgcuccgcucccagccgcgcgggcccccgggccccggccggcgccccccgaaccccggcccggcgggagccccuuccccaccggcguguggagugggggcggggcggcggcgaggccaaggugacacccaggagcgggcagggacagggcugucgcugcggcggacuccggggggcuucggcucguuuucucggggccaccgggaggagagggcagggaggggagcccgguggagccuucgggccccggauuagcggaauggagaggugggggccgggagagcagcggggccgcgccagcccugcagcuugaguuucaaaugagcucauccuuucaaauuggcgccgcucuuuauuaaauuuguuuuuccgguaaugccacccacggcuauaccugggguccgacccgggcucgcacccuccucgccuugucccgagacacggggcgcccaccuuucuuucuacugggaaccaaguucgcccagcucgauccggguaggagaccccuugggggcgcccgaaggcggagcccgagcguggaguuccgugcgugcccccccuagacccccgcgggcuugaucuaagcaagguucugagugcuuuaauuucuguuuuaaagguaaaguggaauugcaugggaaaaucauggaaguugauuacucagucucuaaaaagcuaagguaaauauacuuugcuuaguuuuuuuuuugcgauuggccuuacguauaaguaaaaaacguacacacagcuuuaaaaaacgugcucuugguaguuuuuaaaggggcuuuuguuuguuuuguuaguggagauacauaguuuagaaagcuacuuuuuuuuuuuuuacuuucauuauauaagguguuuacuguucuuggaaaauaucuggugccuaauugggggucgggguggcgaacaccagcuauguucaguucgcugggacccuguaacuuguuuaucaaaaauugccucccacccccaccucccgccccuacccccagcagaauagcagcaaaugcuugucaagacuuccugugagaugugaagaguaaauauuuacuaugucagcuaaauugcuuaacuaaacuuagcgauuaauuacuuuucucuuuuagauaguuuaauguugaauaguaaaauaauucaguaaggggucaauauuuugcauagcuuucuaaagaaguggguuguuuggauuggauggcaguuaaaagccggacuuuuucagucacugagacuacugaguauagcuucugagcauuuuguuguuguugcuuguaagaaauguuugcggcuaaaauaaauacccuugugaaaucuauaguuauauuuaagugcacuguuguuaaugacggaguaacaaguuuuguggagguuggauuucuccacagugauuugcuaacaugagaagagaagagaaaacaucuuuguuuaaaguuuauuguggacuuuaaauuugggcccuuuauuacucauucuaaauuuuuuucuucugcugugugucgaaacuuaguuuauaucccauucacauacauuucuucaccauuagucauuaaguagcuggacuggagcuguucaaugaaguuuuugaugaccaccuuuacaguuuaucagucaauaguuuaaccaccugauuuuugucaggauugaguagauuuuaaaacaaacuacccuaauuuuauaaauacuuagauguguugcugaagggauuuuuaaaaauugugugccacauuuccagauauguuuuauuuuaaguaagcaacagaauaacuuuuguuugcaaauaaucucuguggcauaugagaaaauuacuuaaauccuguuuuuuuuuuaauuuaaaaaaggugaguuaugauuugcaguuucauguguaauauuaagcuaguucuuuccucuauugggaaagauguaacguguaaccaauugguuuucaauaagguauucuaaauuuguauacuuuucuuuaaaauaauauuuuuugcuugagaaauccaaguugaagcuuucugauauauuaacuauuuacaacaaauauaaauuacuaucucacaacacuugaaaauuugcagaaugaauauauugaacagugaaauaacuaccccaaguauuugauacaguauguuucuauaaaugucuaauucuguuggcuguuugcgguugugaauacuuuuggggguuauaauuaguaaaaaaaaaaauuacuagaauuuuaucuuaguuggugucucauuucauguugcagugugcauuauuuaauuuugugguauaugugaaauacugguuuaucuaaaguuauuaacagcuccuaaaacuucucacaaauguacuacuuuuuaucuuuuuucuuucaaaaugcagauuauuugcuguuagccggagugucauuuaaguaauuuuguucuguuuaagaguucagaauugaaggcauguccccaguuuuuaguauaaguuaaauaaagagcaaucuaggauuuauacagcccuauuaguugaugauuucuuugaacaugugggcgaugugaaauacccaggagguagauuaaaaugcgcuguguaugauucacuacacugaaaauguuuaacauuccaaauguaugcauaagcugcugcucuagaggaguuacaucauuucugauuggaugguuuuaauuuuuuuuuccuuuccuuuauuaguuuaaaugcagaaauuagcuacuuguacugcaggcuaagggagagauagcuaaugaccgguauuguguacugagaucagacuucagggaugaagcagcuguauguucucauguccuggacacuaccacguugauggcuuucuaaauccaggguacugugacauuugaaaccaaagcuuuuauguuauauggagacuauuuugguguucuuguguugcauuucugugaauauuaacaaguuagaaguaaauuuggcaguguuaagucaauucuauaugugguuuuuguguuaguugaaaugaaaaugggaagaaaauaguucauccucauugcuugcuuacuuaaaaaucauucaacaauugagugcauuuucuuuguauuguagugauuucuuugauuucucaagaauuaguuugauuaucuguaucucaaauagauuuuuuaagguuaaugauaguuugggaggagauguuuuuaucuuaugaaauuauuggcaugccauuugcuuaccaguuguaucuuuuguuaaauauucuggcaucauuuuauaauagcauaauagacuagaugccauuauuuucucagggucacuuagaaauagaaaacucuuuucuuuuugcagcguauguuuuauucuuauuaaaugcaaauuauucuaaugucaaccgcacauaaagcauuuauuucucuuuguaaguugguuucaggcucuguugaauaaaaguguuugaaucuuuuuuucucuauuaauauuucuugguaguacauauggucaaauguuuauuaaagaggaaaaaacugguaagcuuuaaaaugcuguuaaaaguuuuggaaacuuccuugacagaaauuucauuuuugguguuguugaagguuaacuuaaaaauuauguguguguguguguguguguguguguguguguguguguauguguauauauacacauacacacacacacauacugcaugccuuguuuugaacuaagacaugcuaacuugaaugugcuuuuguaccucaaguugaaugauucugugagaaacaaaacuuugaaaaaugcaguuucugcccaccucuaggaaguaacuaagugguucuagacauucuuucacugagauggugugaauaguaugagauaguguaggaaaaagcuaugaauuugucuuucaugaguuaaaaaucaguaauuguguucacuccaaugcaaaugaauuuggucuccuauaggaauguuaaagaaaacaguaucucaauuguauuuugcuuguauguacuacauuguguaugguugaauuaaauaccaaaaagaagaaaaaaacauccaaucucaggcccucccugcugcagucuuuugcugcaucaauuuuuaauuuucuagaaacagaaaugacuuuuauuagguuaaaauugugugguaccuuccuacuucaagaauuuguugacuuagaaauuaauaccugcauuuacuuacauagauuccauguguagauauaacauauauuaacacagaauauauauuaaacuguaagguuacuuuugauuuggcuuuggaguuaaacuuuuaguuucccaggaaaaaaaaaaguuaguaauuuuuucacauggugcuagguaauacccuagagaguugcauauuguaaccucaaagagauaaguauuagaguuaaaauagaagcaauacagaaaaaagugaacuuggugauauugguuaaaaauucuaguuuacauuuuuaaaagacugguuauuugaugcuuuuaaaucauuuaauuaaauauuagaaaccaaugagauuuauacaucaaaauagauuuuaugguuugcuugcuuuuuuucaauucaccaaauacauaaaaauuuuaaauuguaauauaacaauuuauaaaacuguuuaauggcuaaacaccuaaacauuaauuccaaaaggugauuugugauauguagugcagcugucaaauggugcuuuucauguguuuccuuauacuuauggccagguauaagaugaccaguaagagauguucuaagcauuuuguuuuuuauuauguuaaccugagauuaucguuugguagacagaagaugagaggauauuaguaauauuuguacaaagccuuuuauacuugaugaucuaaagugcaauauguuuucuuuaagagaaaaagcauuuaacuuuuaaaauauuuuuaaaagaagauuuagaacaaauugcauaucagaauuaucauuucacaauuauuuugaguaaacacaugguuuuuguguuuuuuuaauguguggagguugcuccagauuuucaaguacuguguugaggaaauguaaaugauuuugaauuaugcauaaaaggauagugacuuaggcacauuuauuaaaagucagaaaagcuaugaaaaccagauuucuacaggaacuguuuauauauuugauacuuucaagcuuuucuaaauauuugcugucuguagcugaaucacucuuccaaguccucuaugaaacccucaaaaguagaugagcaauuggucagaauuguuagaggauauuauuugagcuaaauguuuccucucucuguuucagugguguaugugcaaguguguguauauguuuuuuguuggggacaguuucagguagaugguaugaagaggcagcaggagaucuuuaauugaacaacaguugcucuggaauucagucuugacaaggcucaagaaaguugcuuggugauugaaaccuguggcaaagggaauccagugcagugauauuugccuugagugaugaauaacucuuguaggugguuaaccuugugaaagccaagucacagguaccuggaguagguuuuacagugagcaugcuacugaaaggaccaucagugcagcaucuucccuccuuccuuuucacuuggcuauccccugucacaaaagauucugugaaggcuuugaugauguuauaagccauuuuuuuaagugucagaaaauucaagauuugaauaugcacuuccauuuagaaauucuauacuuugaaaagcaauaugguauuuugcauaacacaagugcucucagugaguaaacuucauuagaagaagcguuauauugaaauaguuucuuuggagacuuaaaaauguugaauuauacauuucaaaauauauuuuuaaaaauuauauuuaaacaucacaaaagucuucaguguucuuuucaguguuagaaauuagugggcuuggcuaagcuaauuuuuaaagaguucaugcucuaaaacuuucagucaaaagcauuaucucucaaaagcuaugauuaacuucuuaaauugagagaugggaguguucuguuuaacaaaacaugcccccagaauuuauuaguaaaguuuuauccuucuuauauucaaauucauguucaaauuauuuuggguauucauucaaaagcaguaucauugaacaaauaauagcaaauaaacagcaaacaccuaccaaugaagauaagucuuuccucccauuuaucaucaccauuaaaacauuuuaaaucuuuuacuuuauaauuugacuucaugcuuacaaacuuauaauuuucauuugguggcauggacucuauggguucuauuuuaggcagcaaaauugcagagugcucagagcauuauuuuuaagguuuuacuuuuccuguuuugaucauggacuuuagucuggucucuccauaaaauagugaagaaaaauuauuuucuuuuguagaaaacuucagauucuguugcuuggcugccaaagggaagaaggaauacaauaauuauuucuuuaauuugguuuagaguuugaugguauauugagauagaauaaguacaacagugaaaauggaugcuuuugcauuaauaggaggcauucaagcccaaaagcuagcccuguuccaucauuugauaguuaugucuccuccccaagccucugcuuuucacuaaauaauaucuguauuuuugagauacauuuuguuuauuccucauuauuuaucuguucuacacuuuauuucuuaaaaugugaacauucagauaggauuuucccauucuguuuagugucaaggacauuucauaaauaaagcagauauuuuaauaagucugauaaaugaaaauuaagaguucugauguauguuuugagcuuucucuuauuuacccauaucaaaauaaauguugcaucuaaugaccagaaaaauuuguaugggaacauugcaauaagaauuauauuuucaguuuuucuuauugucauguaauuaaugugucucaaaguaaggauuugcuguagugggaagcuugaauuuuuaaauuuuuguuuuaaaugugaucagaaagguugaugauuucauguauugauauuuaaacaaugguaguaguauuaucucagggaggaguauuuuuugccugcaucuuaauauucauacaguacugaugcuguuccagccucuuugacacauuauuucauuuauuccaaauaauaauuuugugaaaaauaggacaauugauacuaucucuuuuuuuggaugaggaaacucagccccagacaagcuuaauaauuuguuuaggccacaugacuguuaauuaaguaguagggcuagaacccaggucuuuugaggucccugagucucgcuccacuguacuuccuccccauuuaacguuuuacauuaaagaagucagcugaauguguuguaaaguucgaagaaugcuguucgagggugguagaaauauaugaaaauacauuugugaauugaaccuuugcaaugaugcuacaucagucugagugaucuguacuuugcuauaguuuuuagaaaaaaauaguuagaaauagagguaauuuuaaagguagcauugcacgucuucccaucucugugcuugcccacagacagaaguggggaauauaccuaagcagguugugggguuguuguuguuguuauguugcuuuuuucggcaguuguguuccugacauaacaagacaaacauuucuuucaacaucugagccacacagauuagacagcgaacugucacccgggucaagacuaugugccauguggugaaugaaagucuagcucaaggaaucuccuggguggguucuucacgggguucagacagccuguugcaaaggucagggcuguguugugguuuacguguuucccugguaggaacugccaggucuuucccagaggugguaucuuucucuacgucacuuucuguacugaauaaggccuugggccucucauacugucuugacuauggggugaguguuaauagggauaguauccauaaaguucugaguucuuuauuaauuuuauaaucgcacaaaaaaauaugcuaaauaaugaagcaugugaaguacaguucauuuccccucaacuguaaacuuuuccugcauuuaucuucguuuccuuuaacucuuauggacuguuuauggugcuggugggagggagagaggaauuaucaaggaaaaaaaaauaggugaaagaagguuauuuccaacuccccaugcauuucuuugaguuaguacaguccagagugggauauggcauuuuccguggaauucugacucaggagaugggggagaggaagagaguuaacuaauacuggguggcugcuacgugcuaggcacuggacuaggcuuccuguuuuauccuccccacagccugaagagauccgucuuuauccuucuuacacaaagggcucuaaagcuucagacucuaaaauaacuccuugcuccugaccagaacuucagaaggcaguggcuuguuguccaucucauuugaauacugcaacagaaccuuagcaaugaaguagaaaguugugauaauauguauacaggcuauaaaguaacuuuguauauuauuccuaacuuagaauaagagaaaauuuccauauauaaaaccuaugcugagaaagauuaggaacucaaguucaguauauuuuuaauuuaauauaauugaaaagaauuaaaaguguuagucauaauuugaaagaacuuccuugaaguaguccuauaguagaagcauuuauaauuauauaaagagaaagagguuuuuuuaaaaaucauugugguugacaguuaaguguaaaaaacauacauguaugcagugugggaggagggccuguuccaugccuuugacccagauauauauauuuuuucaaauccugaaaaaaaacuugagguuuuuuuguuuaggauacagaauguugcacaaagauuggcaugcuuucauuuuuauauguauuuuuaaaaauaucugugucuuagagaaggaaaauaauggaauuuuuguaaauugcuuuuuagaaaaugguucaccuuauuaacagaacauuuuaaaccucuuugacacgugaaaaagucagugaaagcacuuuuugauacaauacuuaaguaucuuaugcauuuguuacuuuuaucucaugcauuuuguuacuuuuuugguuuaguaacauaggacuuaagauacaguuaaaccaccaaugaaaugagauauauaagagguuuucuucuagauagacgccaugcuuuuugacaagaacauaauuuuauauaauuuaugagauaaaauaauuacuuuccucagucaagaaccucuaauagagcuuuaaaaauuaccaggaaagacauuuuuauuacuauaucuuuucuuucucuuugaaaaaugaaacaaaaaaucgaguggugauucuuuggacagguuaaccucauaccaauucauuaaauagaggguguuuuugaaaaagcucaugugaggauaggcuauauaguauuuuuggauuacauggagaccuuuuacuuuggucccuacugauccuugugauuuuuaacaaugcauacuucgaaauuucaguggauguuuuucuuuaucauuguaugaauaagguuuugaaguacaauguuuugugccccuuuauuuaagagagucagagguagaugauaaaagcaguuuaacacugaaaaaaugcaguugagccucuuaaauuauuaagaaagaaggaagggaggagggaaagggagggaggagaggagaaaggaggagaccauagaaguguaggugacuaaaccauguguacaucuucugcauuuucuuucuauacuuccagagcacguggcaaagacugguccucacugauaguguguggaagauaguaagugauuccaacggugacagcaggacugggagucucacacaacauauucuuuucuuugacacuuaaaaacucugaguaugugguugcccugccccaaaaaagguuuugcauuucuuucucuaaggccucacaccggccacuuccucucucauucuccuucuccuuugcauuuccuuggggauggcuggaaagggcuggcaguguggugccugguguguaggccugccugcagccccauugcccccugguuggccgaggguuggggaagcuggggaggcaugugugugcuugcucaauguguuggaauguauggguucuguggcauacacuuacuuggaaugugcagcagacacaugagcuucgaugguuguaggggucuaacguuguaggcuuuuguaagugguugaaaauuuggguuacuuuuuuccccugaagugcaguuguauuuauucuuuggaaagggaaaacaucuuuauuuuuuguuuuucaaccauugacggauagaaaauaauguuguggauacauaaauaaucuggccugucuccuggauccagcuguacuacuguuuaccccuuucuuuucgagcugauagugaugucuucaagucauggacacugaauuuguaaacuaagccuuguaaaacucccugaguugugccaccacuaaagaugaugaaaucaaggaucugagaaaccaaauuuuaagcucagauauugaaaaauguggaauugauucucccuuuuaaggaauagagaacaagauacuaguugcuuaauauuuaaaauuuuuggcuguuuauuauuuuuuaaaauguuuauauauuuuucuucuuaaaauauuugagaugacaaagguacugguuacucaauuauuugaauuaaagaagacagagauuuagauuuguaaaguagguaagucgaaaaggcauuuuaagaguuacaaagggcccaggaacaggugauugguucuaauauaauuauuucuacaucacgagaguguugccagggaagaguuagcucuuuguucacugauuugcauauuaaugguauguugugucuauuucaauaaugguuucaagaaaaugauuuagauauugaaauugaucaguggcuuuaguucacaaguaucgauuguggucacgguguuaauaccugccuuauaaauuucuaggccaacauuguaucuuuuauucucuauggcaguuuuuauuaaacacuguuccauagagccuuaggauuccaaggagaugccaaauuuaugggaaggacgaauggauguacguacaugggaauccuggcuucuuacccacugcccaauacgaagacaacugcauuuguugcuguuuuauauacagaauuggaguugagucuaagauuugguuuagaaaagggguuugcugcuuuaaaacacaguuuguaagcacccacccuacaguguguaaaguguguaauucugagucuucaguucauuccuugauuugacccaaagcccuuucuugaggaaaguuuagacccugcccuuguuacuccuacaucugcuuuccauggaauagcccucuauuuccugucacuuucauuuugguaacaaguaucugcuuugccagcugcaugccagacuacuaaaucuauggauuuuucuauagucaacaacauagaaugcgugcccuucaggaacuuuccagggagcuccuuggccagugauugcgcucuggcucuuggcagagccauuagagucaacugccuuugaagagugaugggcauggugacacgggacccauucauucaucgaaaacaaguuuuugcuucaggagguggaagcaggguuggcuugcuaauccuucuugaggcagagcagcccuccucuuaucuguuguguaagguggggcuccacgaacacaggagugaucuucaaaacauuuucaguugguuagaacgaacaaaugugcuaggucacaagccaugauacuuuaauacacacccccucaguaucaguccuacauacaugauuuuuguucaaaaacaggauauuacuuuaaaacaguaaaaauacuguuuucucagugauuucuuccccuauggccaaggacucuuggaaaguccugaaaguccuuggaauuuagcuacguguuguuaaagauccccugagagguucugaugcccaggcagggagagggggagagagagagagagagagagagagagagagagagagagagagagagacacccuacucugagcaccguccccugccaugugcuccaucacuguagccucccacagacuggccuucagagacccaugguuucguauuuugcacacaacuuuuguaguaagauuuuuguaagagaucaccguauguuuacagggguagaugauguaagugguggcaaggguguucuggauagugcaggagggacagcuauuaguuagcuccagccaacugcugccauuuggaaauguagggccaguguucccaaaucugauuuuucaagaggagguggaagucagaguucuuauguuaaauaucugaaguuuuaaauauuggcaacaauucaaaauuuuuuauggacacugaaggucaaaaaaagacagcuguggguugaaucuggcccacggguugccaguuugcagucucugccacaugaaaaucuguaucuucuauaaaacauuguugaagacacuguccuuuauguuuaguaucccuuacacauaggcuugucuaugagugagagggaaaaguccuuuucuugauaggcaggauuaacucguauggaucuuaucuaaugaugauagcuguuuggaaacucaaaaucaaauuaggucuuaguugcaguagccauuuuucaucaguuauuauuuuaccuauuaauaaaauaauaauuauuuuuuccauuauaaaguacccuacauuuuuaucuuuaugugaugaucuuauuguguuucuguuauaucaaaccaucugaaauucuuuuguaaauguagaauauguauauauaugcugaauaugugacuguccuauaaguuuauguaguauuucauaauacauguuuaugaaaaaaauaagccucuauuuucauauaauuggaggagcagguuuccacaucaaucuaaauuauacccucuccaauuaaacacuaagccaacuauagauaauguuuuaagccacuuucuaagaaaauuugauucucauauguccagaaaacauguuguaaaguaaaaacuugaguaguucuguuuuuuuuguuuguuuuuuaguuuuuguuuuuuguuguuuuuuuuuuugagacagagucucgcuguugccuaggcuggagugcaguggcacgaucuuggcucacugcaaccuccgccuccuggguucaagcaauucuccugccucagccuccugaguaacugggcuuacagguguccgccaccacgcuuggcuaauuuuuguauuuuuaguagagaugggguuucgccauguuggccaggcugaucuugaacuccugaccucaggugaucugccugccuuggcccccuaaagugcugggauuacaggcaugagccauugcaccuggccauucugccuguuaaaugucugauauaaggcaaaugguuuuaaaagcacacagugugccauaggaaaauauaguggugaaaaguggugcuuuuaaauaguuugaaaaguguuuugguuacugcugcacuuuucuguauuuaaguuaaggaaauugaaggccauauggacucugcuucuguucccugggugcagaaaauaaucauuaaggcuaaacgaaaggaaacuucgaguugccuaagggaccuuuuuauaaaacaaaacaaaacaaaacaaaaagccucagacuacucugauaguuggcauuagcauuuaaaaaaauguguaacuuacaugcagaaugaaauaacucauuaguaaucacuuuauaauggucagguaaagcgcaugucuuagaaaacuuagguuagcaaaucauagaugguagggcauagaagaguggcacacaggagccugggaauucaggauuuuauuaauauuuggcuccccucauuugugauggaucuuaacgcuucugcaaaaauagccaacucuauuuucuggacuggucuuuugaauuuaaaaaauuugaaguuccaugagagcugggucuuguuuuuucuuuggacaggugcaccuugagugccuugaauaguggaaauggcuguucaugaaauauuuuuggauaaauuaagauugaagcuguaauaucaauaaaaauuuacuuuuauuucuucuucccuuuuccucuuauuuuucgucuguauuuucagaauggagggggaaaauugugguuaaaagauuuugcuuuuuugugaauggguuuuuaaaacuuuuuacuuuauuaaaaaauuuuuuuucuuuuuucuuucuuuccuuucuuucugacagggggucucacucuguuacccaggcuagggugcaaugaugcuaucauggcucacugcagccucaucuuccagugcucaggugauccucccaccucaggcuccugagucgcugggacuacaggcaugagccacuguacccagccuuuuaaaacuugcgagugaaucuuuggccuuaguggaauaacauuucuucaugggcauuuuagguaugaagguucuuuaaaccuucauaaggcuggcugcaaagaacaauugcacagggcuucaaaaugaacauuggaaagcaaaauuuuagaguugguggaaccagaauagguuuugcaaaucagucuuucuuuucuuucuuuuuuuaacaaauaagguaagaauggguuaguuuuagaauaagauucagugugauuacaugaaaauauaauuuuccuuauagguauuucucccugaaagucaaauuccauuaaaaauuuacugggaaucacagaagaaaaaccuauuugaaaaaaaaaagaaagaaaagaaaaacaaaaaacaaaaaacccaacuagcuauucgcuuauugcaauauaauagguggauacaagaaucggauuuaagauauguuuguuuauaauaaauuaagcagacagcaucuaaaguuacugugaaaaaaccagacaagucuaacaauaccuaccaauggacaaaguaauucauauauaaccaaggaagugacugacuaaauuuuaaaugcaaagcagaauguugucaaaugcucucuauuagguugggugcgguggcucaugccuguaaucccagcacuuugagaggcugaggcagguggauugcuugaggccaggaauuugagaccagccuggccaacauggcaaaaccccaucucuacuaaaaugauaaaaaaaaaaaaaauagccaggugugguggcaugcaccuguggucccagcuacuuaggaggcugaggcaugagaaucacuugagccugggaggcagagauugcagugagcugagauugcaccacugcacuccagccuggguaauagagagagagagagagacccugucucagaagaaaaaaaguaaaaauuaaaaaaagcucuguguuaguaaucuauuagcaauuuaauuuuuaaaauuauuauuauuuaguauuuuugagacggaguuuagcucuuguugcccaggcuggagugcaauggugugauguuggcucacuacagccucugccucccagguucaagcaguucuccugcaucagccucccugguagcugcgauugcaggugccugccaccacacucagcuaauuuuuuuuuuguauuuuuaguagagacaguguuucaccauguuggcaggcuggucuugaacuccugaccucaggugauccacccgccucggccuuccaaaguccugggauuacaggugugagccaccaugcccggccucuauuagcaauuuaaaacauuuuuguuuguuuguuuguuucuuucuuucuuucuuucuuuuuuuuuuuuuuuuuuaaaagaaacgaggucuuggcaucuuguccaggcuggacucgaacucccaggcucaagcuauucuccuaccucagccuucugaauagcugggacuguaggcaugcaccacuacacccagcuaauuaaaacaaaaacauuuauuaucucacauguuuccugaggaucaggacaaugucagcacuuuagcuggauuguucugacucaucaucuuucaggagauggcagucaagcugccaucuguggcuacagucauccgauggcucagcuggggcuggaagguuggcuacuaagcuuacucaugugguuguuggcuggaggccuuaguucuucacagcaugacaauagucuucccccagagugaauaaaacaagaaagccaaggagagugacaucaccuuuucuuuuaugaugcagucacugagucugccuuauuuuguucauuaaacaugagacaugaaguccagcccauacucuaugggaaaggauuacucaauaaguugaauaccaggagaugagaaucuucgggagccaucuugguuuuuaauaauuaggaaaagucaacaaauugaaacgauacuuaauuuggggcauauacugaaaaguaauaauccccuuacauuuauaauuaaccucuuuuggaguaaaacuggaauuucuuauaacaguaguaauaauuacugauuacugaauucuuuuaugauccuuacugaauuuucacaacauuuuguagaaugaggaaggaagauacuguuauccccauuucauaaauuagagaacuaaggccuaaauuguucucagugcuuuagguggggucacauuuuuagcauucaaccucagguuuuuuuucuuuuucuucaccuuucuuuccccugaagagugauucaauuacuucaccuuuuauaaaauacaguuuaauuguucccuuucuguauuaucucagaaaccugauuuuuuucagugccuaauugaaaauuuuaaaacacugcccuucuaguaucaauaaaguuguuuguuacuuuucugccagcagcaaaaguccuuuuugcuauuuuuguaucugggugagguccgauugcuccagaauugugccauacugugguuagccaugaucuacaagaggaaaauaaauuuauccuucuuuaaaaucauugguuuucuaagaaaugcgccauuuacuauaccaaauaugaguaaaucuuaggcaaaauaaguguucauauugauaucaaauauguccaguucucuccccugcuaaaacuacaacgcaucaggcccucagaucuuuugcacuuaccuuuauuauauauuagaaaaauauugcaaauauuuauaaugguacuugaaacucuuuucuugaagaaauuugauaguguuuuguguuguuuuugaugucaagcauauccauguugauguuaaaugauucauucugugugagcauuuugccaaacuuaggcaaaccucugaauuuugccuauagaauguccuacauuguuuugacuucagucaaguauaguguauaauagucaaguuuuuaaauuuuuugaaucucagugcuugcuuuauuugcauuacauauucccauagcccauguaaccuuuucuuugaaagguucugauaacaugauaguuaugugaagugaaaaguuauuuugguuguuuccuuucgaauguguagacugaggcuuagaaaauauuagagucccuuaggagugcuuacucuuuaggauagauagaugcuuuuuuaugaguuaaaaaacacuacggguaaauauaauuuucuauauagucuauauauuuuagucaaccagaauagaugcuaaguuaucuuuuucccaccucuuuugugugcucuuaagugacuuccugaccucucuguaguuuaaaaucuugaaauauuuuuucacaaaacagucaaaugauaauaguuaaacuuuuuuuuucugcuucagggaguuuagagagaacucccugacugucuucagugggcagacugaguuuaagauuuacuucacauuuggccgggcacaguggcucaugccuguaaucccagcacucugggaggcugaggcggguggaucaccugagaucaggcugaggcggguggaucaccugagaucaggcauuugagaccagccuggccaacauggugaaacccugucuguacuaaaaauacaaaaauuagcugggggugggggguggugggcaccuguaaucccagcuacuugggaggcugaggcaggagaaucaguugaaccaggaggcggacacugcagugagccgagaucacgccacugcacuccagccugggugacaagagugaagcuccgucucaaaaaaaaaaaaaaaaaagauuuacuucacauuuuuguaaucuucccgaguuaagagguuaaaagugagccugaacagggaauuccgugagcacagaggaucaaaugugaucuauaacucuauguccuuguugguuuuuaaaauauuuuggcugccuguggauaugcacccaaagaaauguauuuuuuucucaguuuuccucaacaacuuuuuuucuuuguauaaucucggccuuggggaaagggagcagggaaaaucagaagccuuaucgugggccaaaccaccuccagugaccgguucaggucucacacagucuugauuauuccuccuuaauuugcccuucauuugauuuguuuuugaagucaagaacagcaccauuugggguaaaaagagaacauuucuuacuugguaaccaggcagucuuucccagcccuccugagaaagccucauaggucucucuaccuacaaaagcucaucacagagucuuuccacagcucaaguuagcaccacacuccucugagggucccuggauaugugcuaacucuaguuguaugguugucagccuuugguuuacuggauuuucagaaauccaguaaaaccuguguuuacuggauuuucagaaauacuucugggccaguacaauugauacuugaaccucagacauucacugugugugccuaagagccuaggaucuacguaaaguggaaugaaaaugguugagcauuuuccaucacauugguggauguuguucaguucguggccugagguuaugacuguaauuuuuuuuuuuuuuuuugagacggagucuugcucugucacccaggcuggagugcaguggcgccaucuuggcucacugcaagcuccgccucccugguuugcgccauucuccugccucagccucccgaguagcugggacuacaggcacccgccacccacucccagcuaauuuuuuuuuauauuuuugguagagacgggguuucacuguguuagccaggauggucucgauguccugaccucaugauccgcccaccuccgccucccaaagugcugggauuacaggcgugagccaccgugccuggccuaugauuguaauuaaauacauugaggccucauugauucaagcuaguugcgguaaagggaagagcagugauaauuaguagaaugccugaaugggcagauuuuaaaaaauuuauauuguuuucaauuaaauauuguaaccugaggaaacuaacaaaauguuacuaaaaaacaauccuacuggaccuucucauugaauagaaaaaaugacuuauauucagcuuaucaguuauauaucaauacuucugaaaucuguguuuuuuuguuuuuuuuuuguuugagacaaagucucgcucuugucgccuaggcuggagugcaguggcgcgaucucagcucacugcaaccucugccucccggguucaagcaauucuccugccucagccucccgaguagcugggauuacaggcgugcaccaccacaccuggcuaauuuuuguauuuuuuuuuuuuuuuuuuugagacguagucuugcucuguuguccaggcuggaguacaauggcgccaucucggcucaccgcaaccucugccuccuggguucaagugauucucugccucagucucccgaguagcugggauuacaggcacaugccaccacgccuggcuaauuuuuguauuuuuaguagacacgggguuucaccaucucagccaggcuggucuugagcuccugaccucgugauccacccgccucagccucccaaagugcugggauuauaggcgugagccgcugcaccuggccaauuuuuguacuuuuaguagagauaggguuucaccauguuggccaggcuggucucaaacuccugaccucaggugauccacccgccucggccuccuaaagugcugggauuacaggcaugagccacugcguccagccugaaauguguuuaaauagcuuauuucccuuuuaugaucuuguuuauauugauuccuuuguugaaugaguaccccuaccccccuuuaaaggaaagauuaauuucaguucuguccuauuacaauuagaauuaauaauauuucacuauucagugaacuacaaucuugauucauuuuagguuucuggugccauugagacacaaauaucugggugccacccuaugcuagaagaaguuaggaugaugucuuaauuacuuucaugugacagaaagugguuaaaaaauccauccauucaaaaacguuuaauuuaaaucauggcaauacaguauucuuuaaucaacagaaagugaaaauaacuuugaucagaauacuuacaauuaaagaaaauggaaauacuucuuuuuucaguacuuuuauuugggaaauauuuaccaggaagaauccaguaaccaguaauacuguaauuuagggcuauuuuauuuuguuuauuuuuuugagauggagucuugcucugcuguccagacuggagugcaguagcaugaucucggcucacugcaaccucugccucccagguucaagugauuauccugccucagccuccuaaguagcugguauuacaggcaccugccaccacacccggcuacuuuuuguauuuuuauuagagacaggguuucaccauguuagcuaggcuggucuugaacuccugaccucaagcaauccaccugccuaggccucaaagugcugggauuacaggcgugagccaccacgcccagccugauuuggggcuauuuuaauguuugaucacuugacauuucauucagcccucuaaaaauaaaauugagauacauuuuaguuuaaaaagaagugcuguggguaaccucugagauugagucuagcaaacuacauuugucagaaauaggauaacuggccgggcggguggcuuaccccugcuacauuagcacuccaaaggcuacucucagcacuucugcauuuauuuaagucuuucuaacaacaggaaaguguuuguggauguucucaucuugagaaaagcuuuuucuucugaauauuuucucucucaaggguuuuuagagaccuaaacuuucuugauggugcuuuggcuggcugguggguguguaagagaaauuuuauaccuaguugguaaugcugcauuggguuuugaaauuaacugccuaccagcucucaguuuccucagcuguauuaauugcugaaugcuaaauuaugugugaauaauuuaaaaaauguucucaagacccaguaaugaauucaacaaauuauuucaacuuggaagagcaugacuucagcacccacuacgaugcauuagccagaguggagcuagaguacagguuacagaagaggccaacccucugucccugcauucaugaacucggcucugaggaaucuucuguuauuuccaaauuugcagaaagaaaccuugggcaaacugcuucuuuuccaccuuaccauuccaacaccagccuuagguauuaccguaauuagucaagaacaugucuugguuagucaagaacacuucauguguuaagcuggaaugaggaugcuacuuagcaaaggacuagugaucagaaccucucuaccugugugcuccucugggaugcauuagguuuaccuuccagauuucuuuuuuuuuucuaauuuuaaguucugggauacaugugcagaacaugcagguuuguuacauagguauacaugugccauggugguuugcugcaccuaucaacccgucaucuagguuuuaauccccacauggauuagguauuugucuuaaugcucucccuccccuugcccccuacugcuugacaggcccuggugugugaugguccccucccuguguccacguguucucauucaacucccacuuaugagugagaacaggugguguuugguuuucugguccuguguuaguuugccgagaaugauggcuuccagcuucauccaugucccugcaaaggauaugaacucacucuuuuuauggcuacauaguauuccaugcuguaugugugccacauuuucuuuauccagucuaucauugaugggcauuuggguugguuccaagucuuugcuguuguaaauagugcugcaguaaacauaagugugcauguguuuauaguagcaugauuuauaauccuuuggguauacacucaguaaugggauugcugggucaaaugguauuucugguucuagauccuugaggcauugccacacugucuuccacaauaguugaacuaauuugcacucccaacagcguaaaaguguuccuauuucuccacagccucgccagcaucuguuguuuccugacuuuuuuuuuuuuuuuuuuuuugagauggaguuuugcucuuguugcccaggcuggggugcaaugacgccaucucggcucaccacaaccuccgccuccuggguucaagcaauucuccugccucagccuccugaguagcugggauuacaggcaugugccaccacgccuggcuaauuuuguauuuuuaguagagacgggguuucuccauguugguuaggcuggucuugaacuccugaccucaagugauccaccugccucggccucccaaagugcugggauuacuggcgugagccaccgugcccagcuguuuccugacuuuuuaauaaucgcuauucuaacugccuugauaugguaucucauugugguuuugauuugcauuucuuuaaugacccgugaugaugagcuuuuuuucauauguuuguuggcugcaugaaugucuucuuuugagaagugucuguucauauccuucacccacucuuuuauggaguuguuuuuuuuucuuauaaguuuguuuaaguuccuuguagauucuggauauuagaccuuugucaggugguuagauugcaaaauuuuucucccauucuguagauugccuguucacucugaugaucguuuccuuugcugugcagaagcucuuuaauuagaucccauuugucaaauuuggcuuuuguuacgauugcuuuugguguuuuagucaugaaaucuuugcacaugccuauguccuaccuuccagauuucuuuuaucauuuacucccagguauucagcaaguacuuucuuucuuucuuucuuucuuuuuuuuuggcucagucaccaaguggcaacuucucagcucacugcaaccuccgccuccuggguucaagugauucucuggccucaaccuccugaguagcugggauuauaggcaugugccacuaugccuggccaaguuuuguauuuuugguaaagaugggauuucaccauauuggccaggcuggucuugaacuccugaccucaaaugauccuugccucagccuugcaaagugcagggauuacaggugugagccacgacaucagcaaguacuuuuuuuuauuuuuauuauuguauuuuauuauuauacuucuaggguacaugugcacaaugugcagguuuguuacauggguauacaugugccauauguugguuugcugaacccaucaacuugucauuuacauuagguguuucuccuaaugcuauaccucccccagucccccacucuccgacaggccccggucuaugacguuccccgcuuuguguccaaguguucucauuguucauuucccaccuaugagugagaacaugcaguguuugguuuucucuccuagugauaguuuacugagagugaugguuuccagcuucauccaugucccugcaaaggacauggacucauucuuuuuaugguugcauaguauuccaugguguauaugugccacauuuucuuaauccagucuaucauugauggacauuuggguugguuccaagucuuugcuauugugaauagugccacaguaaagauacgugugcaugugccuuuauaguagcaugauuuauaauccuuuggguauauacccaguaaugggauugcugggucaaauggcauuucuaguucuagauccuugaggaauugcuacacugucuuccacaaugguugaacuaauuuacacucccaccaacaguguaaaaguguuccuauuucuccacauccucuccagcaucuguuguuuccugacuuuuuuuuuuuuuuugagacggagucucgcucugucucccaggcuggagugcaguugugcaaucucagcucacugcaagcucugccuccuggguucaagcaauucuccugccucagccucccgaguagcugggacuacagucacccgccaccacgcccagcuaauuuuuuuuguauuuuuuuaguagagacgggguuucaccguguuagccaggauggucucggucuccugaccucgugauccgcccgccucggccucccaaagugcugggauuacaggcgugagccaccgugccuggcauuuccugacuuuuuaaugaucaccauucuaacuggcgugagaugguaugucauugugguuuugucucugugacagucuugcucuguugcccagggauggaaggcaguggugcaguggagcugcucacugcagccuccgccuucugggcucaagcgauucucccaccuuagcuucccaaguagcugcgacuacaggcacaugacaccacaccuuggcuuauuuuuguuuuuguagauaugggguuuugcuauuuuaccugggcuggucucauacuccugggcucaagugaucugccugacuugaccucccaauauguugagauuacaggcgugagccacugugcccggccugcagcuucuuucuccuaaauguugaguaaagaaaaacuuagagccaggcacaguggcucacgccuguaaucucagcacuuugggaggcugaggcgggaagaucacuugagccuaggaauucgagaccagccuggacaacauggugaaacccguugcuacaaaaaauacaagaauuagccaggcgugguggugugugccuguagucucagcuacuuguaaggcuaaggugggaggguugcuugagccugggagccaagaccgcaccacugcauuccauccagccuggaugacagaguaagauucugucucaaaaaaaaaaaagaaaaaaagaaaaaagaaaaacuuaguuauauuuugcuuacucaggguuuucuugaacagguacugucugcuucuuaugauguugcauuaauaaaaaacucccucguaaaagcagguguuuuaaagcaaaugguguuuucccacaggaaaaauguuauauuuggguguuaacguccugaucaaggccuuggcaucaaauaaaucaugaaugggaccaauaaugugucauaaaaucaacaauacaauaauuacaaaccuccauagucauuuaaaauaauauacuccaaguccaauaaaauuggcaugaauguuguguaagaaaaauucauguggucauagaaacacaguuuccugaaucuauuauguaauaaauauuaacacuauuuguacucguagaauuuggagaggaaagaucuggauagccuaagucucuaaaaauguugaaggaagucuuuaguggaugccuuuuuccacuguagauuuccugggaguaaaccuggaggugaauaaaacaccggggcccagucacugucugucauuauuggagguggugagaaugugggcguguuuuucccugaaaagcaauuuuuuuuucucuugaggcagagucuugcucuucugcccaggagugcaguggcgcaaucucagcucacugcaacauccauguccuggguucaagcgauucucuugccucaaccucaugaguagcugggauuacaggugggcaccaccaccccuggcuaauuuuauauucuuaauagagaugggauuucaccauguuggccaggcuggucucgaacuccugaccucaggugauccaccugccucggccucccaaaguguugagauuacaggcaugagccaccacgcccggcuuuuuuuuuuuuuuuuuuuuuuuaagagacagggucucacucugucacucaggcuggagugaucuuggcuuaccggagccuugaccucgccaggcucacgugguucucccaccucagccuccucaguagcuaggacuacaggcaugcaccuccacgcuuggcuaauuuuuuuguuuuuuuuguagagagagaguuuugccauguugccaggcuggucucgaacuccugggcccagcugauccgccugcauuggccucccacagugcugggauuacaggcaugagccacugcuccuggccugugaaaagcauuuuuaagugaagggacugaugcacaguuucuccuugaguuucuucaaagcucugccugucagcugaaauaaaggugaaagagugaagccagcaaacucugcucuuaacugaaaaaccaggcauuaguuguuagaucauuaguccugcuuucuaggagaggaucuucagauguucucuuugggguguccaaauuagcauaggcuuguaagaguguaaacaaaugauauggccaaaagaguaccggacaugggaucagaagaccugguccagccuagcuguacuccuuacugcuuguguggcucuggauaggacacuccugagcguccaccucacuuuccuacauugugagcacaaacacaccuaccuggaagaauuguaagggcugaguagguucauguguaucauuguacccagcauaggaagcuuuuuauaaguaguugaaauaauugauuggugaagugaacauagagaauucugucucuuauccuucuugucccuggaguagaaagccugcuuuugguagauaccuaagcagaaauaguucuggggaaguggggagaaacaggguggggcagugcguuucucacuuugcagaucuuccugggaggccugagaguggaugggguuuggaguguguuguugguuucguaccuggaaucugaugugcauuuugacucagaaugcauugucaggaaucuugaugacaacgguauguugcucaguaacugaaagauuguuugaaccaaacuauuguagcaaaauuuucuuggcagguaugcccuguugauacugagcccagugugcauugauaguuuuauagugacuacuacaaaguaaacagaaguucacagugacucagaguaaaccgugacucagaguauacagguacuacacucuggacauccuaaagcaauuaacaaauaaaugugcugguaggaaaauuguugucuauuguauuaccuuagucucucucucuuuuuuuuuuuuuuuuuccuagcucaggaauuguucuugucccuggaauuuuuuuuuuuuuuuuuuuuuugagacggaaugucacucugucacccaggcuggagugcaguggugugaucucugcucacuacaaccucugccucucgggaguucaagugauucuccuaccucaggccccugaguagcugggauuacaggcguaugccaccaugaccagcuaauuuuuguauuuucaguggagacaggguuucaccauguuugccaggcuggucucaaacuccugaccucaagugauccgcccuccucguccucccaaaguacugggauuacaggcgugagccaccaugccccgccuaucccuggagcucuuauuucaagaauacacuagauucuauagccagaaaugguuaaguucuaauaugcaaacuggaucuaaggaaaagaaaaaaugauuaaaagacauaguaauccuuuaaauaaguuuuuucauggaacccacagaauccauagaccuuagggauuaucuauuccacucuccccugccuguggaaauucauacucggacaucaaaaaguauguccuguguuaauguuggauauuacuagaaaguuauccuccucagugcuguguuuuuuccucuacaucauacaaucucuaaaaauuuuuucauauaguuuguuguguugaaguaaagcuaaguuuaagaacaaaacaguauuuuucauuuucuuuuuucuuuucuuuuuuuugagacagagucucucucuguugcccagccuggaguguagugguguggucucaucucacugcacccuccaccugcuggguucaugcaguucuccugucucagccucccuaguaguugggacuacaggcugggacugcgccaccacacccagcuaauuuuuguauuuuuaguagauacaggguuucaccauauuggucaggcuggucucgaacuccugaccucaggugauccacaugcuuuggccucccaaauugcugggauuacagacugacccacugcuucuggcuucauuuucuuaaagaauucaccaacccagaugauuuugucuccucuuugucucuuucaagacacauuugaaaauagcacugauacauugugagauccagcaauuucacugccaggugugugcccaaaagaauugaaagcagggacuagaacagauauuuguacacccauguuaaagcaguauuguuugcauuggucaacauguggaaguggcccgaguguccauugccaggugccuggagaaacaaaugugguauggacauacaguggaauauuuucagccuuaagggagaagggaauuuugacacauguuaccacauggaugagccaugaagacauuuugcuaaugaaauaagucacaagaggauaagcacuauaugaucccacuuauagaagauaacuggaggcugggcgugguggcucaugccuguaaucccagcacuuugggaggccgagguggguggaucacgaggucaggagaucgagaccauccuggcuaacauggugaaaccucgucucuacuaaaaauacaaaaaaguagccgggcgagguggugggcgccuguaguuccagcaagucaggaggcugaggcaagagaauggcaugaacccgggagguggagcuugcagugagcagagagagcgccacugcacuccagccugggcgacagagugagacuccgccucaaaaaaaaaagaaaagaaaagauaacuggaguagucuaauucauagaaacagaaaguaaaaugguaguugccaggggcuagagaagggggaggauggggaguuucuguuuuaugggaacagaguuucaguuuggcaagaugaaagaaguucuggagauggaugguggugaugguuacacaauggcaugaauguacuuaccaccacugagcuguuuaccugaaaauuguuaaaauaguaaauuuuauggguuuuuuuuuuaucacaaugaaaaaaaaagaugugaccuccaaauaaagccaauguuuugaaaggcuuaaaaagaagcacuguugggaagggaacucuggaugugcauggacacuugaaugagaugguaaagucuaggguaaggaauacuggccugaguccuaucucaucugguucugucauuaaccagcucugugaucccccauugggcuguuaguuuucucaucaguaaugcgaggauguaaguuaguugauacucaaccuuccugucuguucuagaauucugugagucuaugauuaaguccuuagcaaagaaauauuuaggaacaacugccugugugaggauaaggagccagacacaccugugauaugagggcagcccgggucucuaggaucugcucugggccaggugugguggcucacaccuguaauccuagcacuuugggaggccaagcugggaggauugcuugagcucaggaguuugagaccagccuuggcaauguagugagacucuaccucucccaaaauauacauauaaaaaaaauuagccaggugugguggcaugcaccuguagucucagcugcuugagaggcugaggcgggaggauugcuugagcccaggagguugagacugcagugaguuuguuuguaccacugcacucuagccugggcgacagagcaagacuccgucucaaaaaaaaaaaaaaaaaaaggaaucugcuuugaccauuccuuaucuggggcauguuugcaaacacaaucaguaucuucaaucuacuguccauccuaccuuacugcuccccaggcagggccaaaacuccauagagcuguuagauuccaagacugggaaucuuggaauuccaggguuccaaaccugcuuugacaccaggcccagagacagggcuguuucucucagugcuuuagacugagcaguuguguuaucagaagaaaucaguuucuuacugccucaggaugggccguaacuguuccucucaaguuuuccuuguuuucagcaacccauagaaaagagucucucuuaccuaggcugaugugucaauuauaucaaaguuguuucuuuuugguuuggagcguguaauuugguaccaaguuaaucuguccccugagguuucauguaggcucauguuagcagaguuuugcuuuuguuacacacacacacagacugucagguugaaacgcacagugccauuguggucagcauguggauauguugggugagaggagguauaggcagcuuggcgugaaaaguagagaccauuuuacugggcuaggugcuuuaugugggcuaucacugaucucccaacaucccuguguggcagccuuauuccucagaagaggagacugagguucagauugccacucucccaaggccaccagcgagaaaggugacaaaccuuggaucugaauuuaacaacuaucuuaacugcaaaacuuguguucuuucugccacaccacaccuuuuuuccccugcagagugugcuggacugcaaacacuccuuaauguaggaagccauauaauugcgcaguaagauaauuccagaagacuagaauagaaucaguagccaaccacauuuguaaccaccccuguaaugugcugagaucugaauaguuugaagauguugagccguguuugugaucaccaugagcaaaguguugagugccucuugugugcccuugugugcuaaggcaguagaauauucuggcugagauagaggaggaagagcugugggcugcucaugagagggucuuguguggugugggaacugucaugggaguccagugcuacuaguucuucgcaggucucucugugguaccuuuggggaaugaugaugauaugaccaaauauucuuauuuugauugcaccucuguauuuuuuuuuuuuuuuugagacggagucuuguucucuuguacaggcuggaguacaguggcaugaucucggcucacuguaaccuccaccuccgggguucgaacaauucucugccucacucucccgaguagcugggauuacaguugcccgucaccaggcccggcuaacuuuuuuguauuuuuuaguagagaugggguuucaccauguugaccaggcuggucuugaacuccugaccucgugauccacccgccuuggccucccaaagugcugggauuacaggcaugagucacugcgccuguaaaaauuauuuuuuacaaaaaaaaaaauaauuuuuguauucuuaguagagacgggguuucgccauguuggccaggcugguuucaaacccugggccuuaagugauccaauugccucagccucccaaaguucugggauuauaggcaugagccaccccgcccagcccuguuuuuaaacuguuuguguugaggagaaaagcagauacucaauuucaaaacuaguuggacuuuauucuuuauagcugcuuuuuuggaggggccauaauuugacgguaccugaacccauuaaguaaucaucuacuuuuuaacaggauuuacuguaacuugaugauuugucugugaucauguauucaagccgaugguagcaguaguaguaauaucuuuaguaagauggauuucaguaugagaagaugcuucuggauuuagugagguuuggaaauaaaggaacagccccucuugucuucaaauacuugcaugauccaugccaaauaugggaauauuacaccucccaucuuuccuucccauauguuaccguccuagaagaucccccauugucacaguggcccuuuauuccuucuccuucccuccagcucugccuuagcagagguguaguggaagaagugaagaauuaggaauguggggguucaucccuggaacuguagcauuuuuguuagaauguguuuuuguguagaaacacuguuaaaugaauaauagguuacaugaugcuauaagcagucaguggcugguuaggauauuuaagcauauuucaaaaucaaaguauuccauugucuucucucucuucuuccuacuaaagaugaacccccuugaugagcagauaggcccugugaaagauggccuccaggugaugucagcucacugugaugcacaccuggaggaaggggcucucuuaucuuuaucugggugucagcagguauuauuagccuagugccuggcacagaggacacgcccagagauccuuguugaauuugguugaguugaagaaagaaaaacuuuuacuuucuccauuuccauucuuggcaguuucucaagaaaugucuuuuucgagacaggcucuugugccauauuuuacaggcugggcgcaagcuccugggcuuaagcaguccucgugccucagccucccaaguagcugggauuacagcuagaacuuaugugaaacucaagaauuuaugucgaacucuucgucagagcuggaaguaggacauacaguuggauuuauuuauugaucuuuuuauguacuuauucaucaaagguuuguuaaucaccuaugugugauacaccaggcacugucagacacuaaaaacacagcaguggaccaauacaguuccagugccuacccuuuagacagccuggugggagaauauggaccauaauuagacuagccaggucuggggucaauugucaucuagaaacuccugcuauuuuagaaaugcauaagcugaccuugaauaagccauuucugggggcagaauaucuuuuucuuuccuuaaaugcuagugaugaaaaaguacuuuuaaaauuauucagaauuguccuuaacaauaaacuaaugaaaaacaugaugugggcaguuuaccauuacguagucuuugauuagacaguaauucuuacuucucuuccuuucaaauaaagucuuauaguaacuugagauauuuuugaaagguaacacucuuuuuugaauauucugcuacuaaauuauuaauuuucugaguuuucuauuaaggcaaacaucaaguuuccuuguggcuggugacuaauucagaugcauacuguuucuauucauagcuccccaaucuuagguagaauugagcagauuuaacaugaauagcuuccucuaguuucacacggaaaaaacaauuuuaggaaggaaagguaggaacaugauaauacagaaaucagcgaaguaaagggugauuggcugguggcugggguuggaagaaagugaaauuuuucuuguuauucucuuugugauggaagauuucuuuccauagauuaguauaauuuacgugggcuguuugaagagauuaccuucuuagugguucccuuaaagcucuuuguuauguauauccugaagcccagucacuucuucccacuuguuuuugaguguuugaucuagacaauguaaaggcacuuuuaagauaaaaauuauuguauuugggggacuuugggagacucacuucccaaucauuuuguuuagaagcaaaaaugauuaaacaguacuuuaugucagaucugccuguuuaagggauuugagcacaccugguagcaaagagguuuaaccuaguuucucagaugaaaacuagagguggaggaaggacgaggaagcaguccagggugagcugaggagcugguuaccuuuagccuacuucugggaugaugcacauugucgucuaggucagucagccuccucagcccaugcauuaagauuccugguugcagcugggcacaguggcucacaccuguaaucucagcacuuugggaagcugaggugggcagguaaccugaguucaggaguucaagacuggccuggccaacauggugaaaccucaucucuacuagaaauacaaaaauuagccagaugugguggcggacgccuguaaucccagcuacuugggaggcugaggcaggagaaucacucgaaccuggguguuggagguugcagugagccaggauugugccacugcauuacagccugggugacaaagugagauucugucucaaaaaaaaaaaaaaaaaaaaaaaauuccugguuguuaguaacagaaacucacauagucuagcugaagcaaaagggguuuuuuuuuuugcuuacuuaacuagauuucaggaagagcuggaaugagguggguuuuaaggacauucauaaccagggacuugaaacacagcugugugcccuauguggcuccgugcucuccucaccuuuuaucucuuaguguugcguuaauuuuugucuugcugcuggugggcuuccucuacauggaaggggauaugacuguggucauugcccaucuauagacaucuuuauugcugugaucugagagaaaacaggcuucuuuucccccagcuuaaguuugacaaaucccagggaagaauggucacuggccuagccuaggucauguguuugugacaguucuaaggggugcgugauaggcucagcuugugucacaugcccagggaggucacacagaugauacccugagggaacugcuguaaacaguuaagauacagcaguuuucaugcauuuuuaguccauauggaacucagcucaaacaacuaguuaagauucuuuccuugauucauugaaaaucuuuuacagucuuuguugaugcuggugccuguaaucccggcuacucaagaggcugaggcgggaggaucgaauauucgcaguggccugugaauagacacuucacuccagccuaggcaacauagugagacccugucucaaaaaaauagaaugaggcugggcacaguggcucacaccuguaaucccagcacuuugggaagcaaaggcaggcagaucaccugaggucaggaguuugagaccagccugggcaacauggugaacacccugucucuacuaaaaauaccaaaauuagcugggugugguggcagugccuguaaucccagcuacucgggaggcugaggcagaauuacuuugaacccaggagguggaggcugcagcgagcugagaucgcgccacugcgcuccagccugggcagagugagacucuaucaaaaaaaaaaaaaaaaaaaaaaaaaaagucguuugucaguuuuggacuuuacaaccaguagacuugagauuacauuucuauuuuacucuguuuguuuuuccacaggaacccagacuagcacuuaugcuguaguguguucucaaaaacuaugguugacugacugaacuagugaaauaaacauaucaaggcauugaaacauacaacuuuauuauuauuauuacuuuuagagauggggucuugcucuguugcccaggcugagagugcaguggcgcaaucauagcucucugcagcuucuagcuccuaggcucaagugguccuuccacaucagccuccugaguagcugggacaacaggugugugcccagcuaauuuuuuauuauuuauagagacaaagucucccuauauugcucagguuggucuugaacuccuaggcucaagcgaucagcccaccucggccucccaaaguguugggauuacagguauaagccacuguaccuggcugaaacauacaacuuuagagaugacagggauccuagaauccaccugccuucaguaguuucaguuauaauguggggucucccaaauacuaaggacccagcaguaaaagaggguaaacacuuuuuucacauuucuaaauacagagcccuguuguaggaacagaggguacuuugaugaaacagacagauaaggaaaguccuugcuuucaugcaacuuagauuuacaugaagaaaaucuugacgugcuaacuagaaugccuaauuucuuuuugauuuuugccacgaaugaaucugaagcucugauugucuauauuaccuuuaaguaauuguuuaaaaaaacaaaacaaauuauuaacaaaugauguugaucuguuggagaaaauaagugaaaggaguucuuggugcugagaaaacagcauccauccuggcuaagagcucagucuuuacagcuucccaucucagcacuccacuugcagcuuuguaacucgugcaaacuguuuuuuuuuuuugagacagagucucacucuguugcccaggcgggagugcaguggugugaucuuagcucacugaagccucugccuccugaguucaagugauucucgggccacggccuccugaguagcagaaauuacaggcucccacuaccacgcccagcuaauuuuuguaucuuuaguagaggugggguuucaccacguuggccaggcuggucucgaacuccugaccucaagugaucugcccaccucggccucccaaagugcagggauuacaggcgugagccgccgcgcccggccugucagagcucuuuuagccucaaauucuucaguuauaaaaugaaaauaucuacucauuuuuuuuuaguggguauugaacaaacguuaaauauuuuuuaaaugacauauuuuuuauuucuuuaagugauuuuuuucauugugguaaaauacauauaacaucgccuuuaccacccuaaccauuuuuaagugugcaacucaggagcguuaacuacauucacguuguuuaugcagccaucgccacuaucuaucuccagaacugucuuugucuuguaaaacagaaacucuauacccauuaaacaguaacucgccauugccccccuuccagccuccggccaucaccauucuacaaaugguuacuuuuuuauaaauguuaagauuucaaaaaauguuagcuauuauuccucuggaucaggagucagcagacuccagcccacaggacagauuugggcaguaauuuguuuuggugggguccuugaacuaagaaaggcuuuuacauuucgaaagguugugaaaacaaaacaaaaaauaaagaagaauaugccuuagaggcaguauguggcccacaaaaccuaaaauacauuuauuauccaguccuuuacagaacagguuuucugaccccugcuguagaucuaaucuuuuuugaucagggaguccuuucagauuuugaugaaaaaaaauguauauguagguuuccacguaucuuaagaggguucugucacgcgcguccaugugaagagaccaccaaacaggcuuugugugagcaacaaggcuguuuauuucaccugggugcaggugggcugaguccgaaaagagagucagcgaagggaccuaggguggggcuguuuuauaggauuuggguggguaguggaaaauuacaaucaaaggggguuuuucucuuacgggcaggggcgggucacaaggugcucagugggggagcuucugagccaggagaaggaauuuaacaagguuaauugcucaguuaagguggggcaggaacaaaucacagugguggaaugucaucagugaaggcaggaaccggccauuuucacuucuuuugugauucuuuacuugcuucaggccauguggacauauacgugcaggucacaggggauacgauggcuuagcuugggcucagaggccugacagguucuacgaacauuuucucuacaccaggauuucucaguggggccauguugccuccaggggagugaacauugauucuuggggggagugaaaucuuagcuguuguaaugacuugcagccuuucaaagggacgcaguacaucaacagauacauaguuuaucuuugguauuaaaauuucuuggcggggguagugggugguaauggagcgauuugaaaaaaaaaaaguuuaauuagcucauuaggggagcgauaaugaaagauaaguuugaaaaacacugcuuaaaacugaauucuggaagacaggacauguaucuuaucaaccucugaauauaccugcauuuagcagagacuugagaacauuuucuucagucuauuuaauuuguuaucuuguaguugaaugaaagaauccuuagaucuacuuuuaaugaccaauucagucuagaaaugguuuacacagugaacucuaugcccuggaauuaauuaauuaauuuauaaagaggcgggucucccuuuguuacccaggcuggggugcaauggccccauuguagcucacuguagucucaaacuucuggguucaagugauccuccugaguagcuaggacuacagguauaugccaucaggcccagcuaauuauuauuauuuuuuuuauuuuuagaggcagagucuugauauguugcccaggcuggucucaaacuccaggccucaagugauccuucuaccuuggucucccaaguugcuggaauuacaggcacaagccaccaugcuguggacauuuuaauuucaaaacaucuuuuaaauccuuuagaaguuugucaaaugcuuaagucucccugauauaucagacagaugcuucuugccuauuagaccagaauuccauuuuuuuuuuuuuuaacacucguuauugacacaguaaaaugagugucuaaaugcuggggcauaacggucucuaccccgaaagcuccauauaagcucuucgcaaucaugucguuucuuuuuuuuuuuuuuugagaaggagucucacucuguugcccaggcuggagugcaguggcgugaucucggcucacuacagucuccaucucccagguucaagcgauucuccugccucaaccucccgaguagcugggauuacaggugugcgucaccauacccagcuaauuuuuguauuuuuaguagaggcugggugucuccauguuggacaggcuggucuggaacuccugaccucaagugaucugccugccccugccucccaaaaugcugggauuacaggcaugagccaccgugccugucccacgucagcuguuaauugaaaagaaaacacaggcauuucauuauuuucccugaaaaaauuaagucugauuuagaauauauaaauuuugacagcacaccacugaaaugucaggaauuuaggucauccugacuugccucacaggcaaagacugucuuaggcaucucuguauccccauugccuugcacauaguaggugguuagugaaugagcuucugggacuggcuguacuggugauacuucugcaaaugcccauuguacccuugaguucuccuuacaauuuuucuuuggcccagcuugcccucucacagacccaucucuguacauacaguuugacuugguuucuacuaccaguugaccuuuuugcugccguugcaggguuugaugaugaugaauagcaggggaucgcuggaacagcauucauugcauggggaaaguguucauagcaugagcagugcugaugcaguaguacccagcucuguagcugcucagaggguaguguguggagggccccuaaagagcaguguaaaggauuggugccuccugcugugcugugcuggagguggccuuugacgggugggaugagccauuccauucugagugcugagggaacuuccuagagauccagcaggucaguguuccucaaauaucucuacugaaauucucuucagagcaggaugcccgaggggauggaggauguuucgaucaaagugaccucuguaaacacaaaacuuugucugucugucugucugucuaucuaucuaucuaucuacuuguuuauuuauuuagagacaaagucucacucugucgcccaggcuggaguggaguggugcgaucucagcucacuauaaccucugucucccggguucaagcaauucuucugccucagccucccaaguaucugggacuacaggcaugcgccaccacaccuggcuaauuuuuuguauuuucaguagagacgaaguucaccauguuggcuaggcuggucuugaacuccugaccucaggugaucugccugccuuggccucccaaagggcugggauuacugacgugagccaccucgccaggcuguuguuuauuuaauuuuguuuuuuauuuuaaaauauuaacaaagauuguguauauuuuucguauguauguauaauaacuuucugucaagguacucuacuauauguuugcuuuaacguaaaaauaucaaaaaauauuuuaaaacuucacaagggguugauauuccacaaaaaugugauauccuuuauaauaaacuggggaaaauauggacuacacccauucuguauccccaccccaucacucugaaucccugggaagauuuacaucauagauggggaagcauagcugagcuacugguuaugcacaaauagguauuaaccacuucggccagucaggucuuggaaguagaggucuguuuuuacauaaggugauaaagacaaugagguacagaggcaaugaccuuuggcuggugaccaaguaacggcucucauagacuuucccugguuuaugucccuaaguuuguaaacaccuccuggguuggaaucuugggaacucuuuguccugcccucaggggugagaacuccacuuuugcugaccuuggcaaucacaguggcuuucuaccaccuuaaguccuucuuccccugugcagagcucccuguaacccuggagggccuagcccacucucccaccugagggccauugugcaguuaggccuuccaugaccuucucagagcagaggcuucaaucuauuuucaguaagaguccagauguuuagaaaucuguauaggugaggggcacauuuacuuuuauugcuguucguagaacaagaaggaccacucuugguuugcaaguaucuugugugucucaacugugaaucauauauaugauaaccuuuaaucuuaucacuauccuuuuauccauaaaccuucauaauuggucuagcuucaccaugacacuuuaguggaauuaaacuugaacuaaaaacuauguaauuagaacuauuaauuguguuaguaacuugauaacacaaggcccacagcugacaggugguuaaucccaacuacauaacuucuucauaugugcucuuaaagauggaguugaaaacaauaaccaccacaagacuuugggagaacaucucagguggguguuacuuggugaccaugccagaaagccagcgacuuccaccucccaguccccacccugggauccuggugaacuucaugccggcucuucucuguguaagagccuuguacccugugaguuucaugcuuugacuuauucuagucacuguguggacacaguuauguagcuauuuucagguaagaccaguguagguaugccuguuaauugacagucugcgcucccagugauggaauaaaauuacuaggaauaauuauuuuuuggugaccaccuuguaagugccaugguauaguggaaagcccuuuucaaagggucucaaaauuaguggaugguaauauaacuuucuauguaaacgaaugugaguuucuugaacaugguaaauuagagaacaccaugcccaaaagguuaauuccaagcagagauagucggugaaacguuucaagacuauuugaagcaaacacaugaugcuucuagucuaguugaauaucaaugugauacagaggaaaagggguagauuuuggagucaaauggaccaauauuagaaauuagccgugugauuuuaagcgaguuuuaaauaccuucaaccuguuguuuucucaucuaagaaaagggaguugggggcuaauaauucucuacaucauuaaaauuuuccuggcacauuaaguuccuggcacaaagaggguguuuuuagcaguacucacuacuagggccaucucuucacucuuuucuuucugaacgaagaaggaaggaguugucuuacucuacugagucacgguuuaaauuuagcaagaucucagaaccaguacauauguuuuaaaugguuaugggaaauaugccuucuauuugaagugagcugugcuugauucauauuuuuuaaacaauauauauauucugcccaauucuaaaaaaaaauauuucaaguagcuaauucacuucuuagucauacuaugaacucccaggaccuuaucccacaaaugcagcccugguuagaacuauucaaagagccuuugaugcuucaaacccacuaaccccauuuugcacauuuccccaaagcaaacgcacucaugcauacacacacacacacacacacaaacacaaacaacuuaugacccaacuuuugggaacaauguuaaagcaaacaaacaaaauucuuagaaaguugugaggugcuuaaaauaguuugauuuuuaaaugauugaggagcuuuucccauaagacuuggugcuugcugcuauaaauaaaggcaugcauauauguccagaguuguaucucucuagucacaaugcuuaaaccgacuucaagaagucaguuguauuauuuuaauauuauuauuuaauauccaggauccacuguaaccuuuuaacccuguuaacgccaaaccuuuaaaaagaguuuaacuucacaaagccuauaagucagauugagaauauuucacaugaaaagcuuccaggugucacuuaccuuuagaaauggaauuuuucagccuauuauucgggacagacaacuagauucuuccuuuccucccagcuccucaaacacuguugacauucucacuaugacauuucuaauggauuaucauugcugaagcugggagauggauacauaguauuugucugcuuuuguauuuguugaguuuuuuccacaauaaaaacagacaauuuuuuuaaaaaugcagaauagcuggaauucauccuuaaucuacuuuauguugaggauaggguaguaguauuuuuuugcagccuuauuuccuuggguuguucaaggcaagguauuggaaaaguuaaaaaacucaaauaacuagauuugagagccccaaaguguacauauuauuugaauucuaauguuucuccugagaauuuccaaccugaagcugccaaaaaacugccuuaaaauguggauagguauuauauuuaaauaugacaguguggcaaaugugguguaauugaaaugauagaggacuuggaaucacaagaugugagccaaggucuagcuuugccacuuacugguuagauaguccguagacauaucaugcaaccuuucugagcugguuucuucggcuauaaaauggggacgauaugugcucugugcacuucuuagggaucuuaaaaauauauuauuaugauuauacauagccuggugaguaauucauuuagguagaauucauaucauccgugggaaugugcaguagcagaaggaaucacguauauaacauguuuucagguagcucacagacaaaugaaaaaagcuaccuuucuguguauacacagaaaaaccaacaucauaccacuuuugaagaccuuuuuaaauagcgcagaauauacgcaguagcagcugaauguguaugugggagaaaacgcgagaaaaaauggucugugccaguguaccaaauacccgcaguuugcugaagaucuuuaaauuuucuguccaucuuucugcagccuuauccugaacauauguucucuccauaaacucauuuggccaaggaacuauauagcuacuugaaaaauauuugucccacaggugauaagugauguauucuccuuucaauuaauaagcaaauagaacaucauaauccucuuuuaaccucccaucccuaauccuggucccuuuccuccuuucccaguuguaaccacuauuuccuuucauuaucugucuuuccagaccuuuucucuuccuuuacauaugcguauauguauccagagagaauauauaaugaggcauuuguguuucuuuucuuuuacuuuaaacaacugucauacuaaguggaacauuccacaacuggcuuuuuucacgcaacaugucuagaacuuuccaugaucuggcucauucacuuuagccuccguuuacugucuguacugguuuguuuugccauuugccuaugguuaggcuguuuccaauuccaaacaugcugcaauaaacaucuuuguaauauccuguuauuuacgcuuauauacaaguauuucucuaggguagggauugagaaguggaauugcuaagucuuaaaucauauaccuuuacauuuuauuguuuaauggcaaauaacucucccaaguaaaaugaacacuguauuuuauacuuugguuucuugcccagcuuuucagaauggcaauaggagaagcuuucagaggacaguuacgguggucuagaguagaccagugcuuuuguaaaccuuagcgugcagacucauuaccuggggauuuuguuaaaauguaaauugugacucaguaaguuuggaaugaggccugggggucuguaguuuuaacaagcucccaguuggugaucagggaccacacuuggaauagcaagaaucuugcuccaguucauuuuuuagcauuguguggaaguuauuuuaugggugugugugcccauguauuaacucauggacacaagcauguuuccuaggaagcuauguuuugccagaauuuggaccauagcccccagucaucuugaccuuuaaaguuagauacugugaacauuuauggcaaaauguugauggugauugaaacugggugaagggugcuguagaucuguuguaugucucuacuuuugugcagagaauucuguggaaaugcucacaauacacuuugaaaauagaagaaagaucccuuuaaaguuugaguuauuccuaaagauuuucagcuugguacaugcugccaugccuuuccuagauuuccugugguagaugauuuggaaguguuuuauuuuaaucaguaguguauuuugacucaugaguuuuaauuuuagcauaucaaaguauuuuuagaaguuuaaaaauaacugcaaaaaaaaaaaaagcuuuguuccauaucugccuaccuuagcagcucagucaaaucacccucagccuuccuuuuucaagagaggaugccauagagcggcauacaccaugaucacugcaugguaguguguuagcucuggaggcacuuuagagaaggaaccucuaaggccagagugcccauguugacuuauuggugaucaccugaacacuguuauguaagguuuugaggucucaucuggguucaacagaaaagauuucugugauuaacuagcaauguuggucagagugugcuggauuggagaauuguagcacaaauagcauguauugguugacucugguucagugaaaguaguuauuuuauaguugagaaaacaagacaccaaaaauguaaaugaccugucuuggguucaugguuagcagaagagcuaguccuguagaaccagguguccagauuccgagucuaguucccuuccugcugugccauccugauaaugagacugugacuagcuguagaguacuugcauguugaagcaacuugguagaggggaaggcauuauucgccuuuuaacuaggugaucuugggcaaaucaguuaauccugagagggaauauacagcaggucccaaauaaugucauucaguuuuauguugcuuuauuauaauguugaugagaaaaaaguugacuccuggcuaggccgcuguguagaauuugcacauucucccugucuguguggcuuuucucugaguacuccaguuuccucccauauucuaaaguugcacacauuagguuaauuggcgugucuaaguugucccugucugagugagugugggggugugugugagugccgugagauggaaugguguccuguccaggguugcuucuggccuugugcccugagcugccaagacgugcuccagcuacucucaacuuuguauuggaauaagcagguuggaaaaugaaugaaugaaugaauauaaauuacuguaaaaugaaaguagaugguaguacaaaugcaugacaguaagugauacagcacaacaaugcucagcgagccuccacauuugugauuuuuuuuuuuuugacggagucucacucuugcaaucucggcucacugcaaccuccaccuccuggguucaagagauucuccugccucagccucccaaguagcugggauuacagaugugcaucacugugccgggcuaauuuuuuuguauauuuaguagaaacaggauuucaccauguugaccggguuggucucgaccuccugaccucaggagaucugccugccuuggccucccaaagugcugggauuacaggugugagccacugugcccagcccuugugaugguuuuugaacuguguggugauaggagaugcuccuuacaauuuuagcuuugcaaacauuuauuccuugauuuaacccaccaccauuaugacugacaucacucacugauucacugaaaauuggguaaauaaugaucuuacuuguuuuuaugaauauuucuuagaugugugcauagcucauuuauuuaaauguuuaaaauugaaaguguuuugggguuuuucuuuuagaaguuuggugauuuuguuauuguuguuguuuuuuugagacagggucuugcucugucacccaggcuagaggcuaguggugcgaucuuggcucacugcagcuucgacuuccugggcccaagccauccuccugaauagcugggacuacaggcaugagccaccaugcuuagcuaauuuuuuuuguuuuguuuugguuuugguuuuggcuaaucuuuuauuuuuuuagagacaagguuuugccauguugcccaggcuggugguuuugugaccagaaauauaccuuaaaaacuuaacucuucuuuauauuaacuagccuaugguaaaauugguuuuguuacacaucauuuugcuuaaaguugcaguuuccaagaagcuauugacaacauuaagugaggacuuccuguaguuucuucuuuuggaggcaacuaucucucuuuucacuuuggccacuaggaagcucagagccaaacucauagcucuaauguagcaacucuuuaguacccuuuugaacugaauaauuguauuuuaacccuacuuucuuucugagucugcuucugucuugaccuccuaaucuaauuuccuauuuucuuacccugauguauucauuucauuuauauugcacuguuuuauuguaugucuuuaccauaagcugccucaaauauuugugaaacagaugguauauaaauaaagaacauuggaauguuugagaaaguuguuguugacaagaccgaugaagaugaaaauaguguaguucugagaaaauguugguugcuguggcaucugcucuuuuuuucucccuugcacucuuaucuccuggggugguccaucuucguuaccuucaacucccaugacaccccugcuguggcuuuggcugcauucuggagucuucucuaucuccgcccucacccuggauucacaaaugcagaucuguauuucugacuuccuuccuauuggauagcuccaucugaaugucccuaagucccucaacucaacacguucaaaacgaggcucagcauccuuucccccagauccucucugccuggaucucaguugcaccaccaucaacuucauuucuccagucaguaacccgguccucacuuuuuacuuuuuccauuuucugauccuucacauccaauccacaacuaagaccugucacuuuaaauuauaaacauguuguggaucuguucucucuacuccauacuaccuauaaggcucuuuggaguuuuuaaucuauccuugccuaccuugggguuuuuauuuuauuuuuauuuauuauuuuuuuagaggcagagucucacuucuuucacacaggcuggaguacaguggcaugaucguagcuuacuacagccuugaauuccugggcucaagugaucuucccaccucagcugcccagguagcugggacuacaggugugcacuaccacacccagcuaauuuguuaaguuuuuuauaaagacgugaccucacuguguuguccagguucgucucaaacuccugggcucaagugauuaucccgccuuggccacccaaagugcugggauugcaggcuugagccaccuugccauuugccuauugcuaggcuguuuccaauuccaaacaugcugcaauaaacauuuuuguaauauccuauuauucacgcuuauauauaaguauuucucuaggguagggauugagaaguggaauugcuaguucuuaaauuauaccuuuacauuuuauuagugcuuggacuggcguuuuuauuauugcaguaaucuucacucagccaucuucuuuuauuucccuaacccagcccauccuuuguccuacagucagugaucuccauuucucuucaagcuaaaguucaaauaucuuagaccuuucauacauugcuuuugcuaagcuuauuagucuuauguuuugccauuccccaaccuugcucagaaugauguucccucuccuauucuguuggugcacuccaguucaccuuucuccuugcucuggaucauucuccuuccuuggaacucucaggcugcuucuuuggcuugucaagauccuauguacaucucuguucuagcucuuaccauugugugauguguuguuuaaaugaucaucuuccacuugauuggaugcuguuuggaggguccagauugcggcuucugagucucugucuccagaguuuagccacauauaagauaucauaaguguucauugaaauguuugcugaaugaaggcacugcaauucuuggaacaacuccuuuacaaaacaacaccaguaauauggguauuaaucacacaucaacaguuauuacugccaucauuuacugagcucucacaaggcagguauuguuguaaaugcuuugcauguuuuucucauauaacuucugaacaguccuaugaggucagugcuguuauuauucuuuuacaaauaaagaaacugagaccauagagcuuaaguaacuugcuagaguucauccagacaaguguuggagccaaaaucugaacccagcucccucuuuuuuuuuuuuucuuuuuagacggagucugacucuguugcccaggcuggagugcaguggcacaaucugggcucacugcaagccccgccucccagguucaagagauucuccugccucagccucccaaguagcugggacuacaggagcccaccagcauccccggcuaauuuuuguauuuuuaguagagacgggguuucaucauauuggccaggcuggucugauacuccugaccuugugaucugccgugaccuugugaucugcccaccuuggucucccaaagugcugggauuacaggugugagccaccacgcccguccccagccgccucuuaacugucacauauacugucugugagacuuauuuaucaaugggaaagcaggaguuggccccacugguguuucuugaaguuguuuuuacuuucuuuucuuuucuuuuuuuuuuuuugagacagagucucgcucuguugcccaggcuggagugcaguggcgcgaucucagcucacugcaagcucugccuccaggguucacuccauucuccugccucagccuccugaguagcugggacuauaggugccugccaccaugccuggcuaauuuuuuguauuuuuaguagagacaggguuucaauguguuagucaagauggucucuaucuccugaccucgugauccgcccaccucggccucccaaagugcaggccuuacaggcgggaaccaccaugcccggccuguuuuuacuuucuuaguccgugauuuagcaguaguagaggaaaacaagcagacaucugaaaccuggugaaagucauugaaaccaugcaagcccuguguaaccgucucccuccugcuugcuugugcucuagacuguccauacccgccucaauuguaugaacuggaguaaggaugaggccauaauuauuugcccuuccagaaaggcacacauucuggcacuccuccagaaaauuguguucagcacuguguuaaggagagguagagaacagcaggcagcucucacuccagccagagaucaaaagagauuuguuucuccucucagucagugaagucaggacuuccaggaagggagggccagaagugagaagaucuccgcgaaggagcugagaaaguauuugucuuuguuagaucacuugcaugagugugcucagcacguuaaaaauguggcacaagggcuuuuagagcacuuguuuuuaaacgaguauucagacugcaaguaaaauugagcuaaugaaaagaaaauugugagaauuuaagccuaagaaguuacacugagaaauuucagcaagaaaaagaaaguggcaugagaagaugaguugaucaaaggaauuguaaaguacuguagggauaaggccaguugcucauuuuucuaugagcaacugaucauguuucuuuugaccuuauaaauaaaccccuccuuggccuuccuaacuuaguuuuuauguaggaaauuuaaacuuaccuaaagucuauuuuguucuguuuuuaacuaaguaguuuuaagcauaaacacugaauuuuaaaaccauauaucuggggaaaauuuccuacuucuaaaaauuaucuauucauguauauuuccauuugaauguguaaucugcacucaaacuuuguaugggaacaauuuauauuuauuuaguacuuccgccuguuaaauuauuugaaggucuaauagaucauucugucuuagccaaaagcucaaguucuauagucuauaguguuauaauagugauuauuccuccuuaacaauauagacaaguaggaauuaucuguuuuacuaaucaacacacagagcagguaaauggcucaguaauaggaguuagaauagcaccuaggagguauaaaaauguggccagcuaucuuuuugguuugucugcuuaccugguccuuagugaagagauuuggaaugguauugugcuauuuagccuccuggguagcagucacgugcuuugcugcucuugggaaccuaauugguacccugaugggguuaguuaucaggccuccuggagcaccucuauauucccuugcagacaccauuuaaauccuggagcuugggaagcagggaugaagucuucugcccauucauuaauagauggcccaggcuaugacauuauugagagcagacauuuagaagggcgaaagagaaggaaagggccgggcacgguggcucacgccuguaaucccagcacuuugggaggcugagguggguggaucaccugaggucaggaguuuaagacuagccuggcuaacauggugaaaccccgucuguacuaaaaauacaaaaauuagcugggcaugguggcgcaugccuguagucccagcuacuugggaggcugagacaggagaaucgcuugaaucugggaggcagaguuugcagugagcugagguugcaccacugcacuccagccugggcgacacagcgagacuuugucucaaaaaaaaaaaaaaaaaaaaaagagagagaagggaagaaaaggaguuguauagggauuaucccauuguaaugauugaugaugauauagugauauaauacacuauguacagccguuguaguacugaauugcuaacuugugaaggagagaugagaaucuuucagauacagaagcaugaggaguagauauuugggaaaagauaaauuugaaaauauuuagauaucguguggaagguugguaaagaccaagcucuacagagccuagcguuuucucuucagcaaauagaacagcccacugaauaaaacuuacaguagggaaaacucuuuaaggaaggcucacaguauucauuauucagcaaacauuuuugaguaucuaaacauuuuuguaguaucggccaggcauuauucuaggcacuugagcuagaacagugaacaaaacagacagaaauccuugcccuuguagagcaaacaauuuaguguggacaagcagaaaagaaaccaaauaaauacauaaaauguauuaucuagagccuuuugguucugaguaauagaaacagaaucaagcuagcuuaagcaaaaggaguugcugugaaggaguuucugacuggcucuguuuggggcagagaugccuacuucugaccuaaccagauauggccacagugacaggguuccaggauauaaacaccgccuccagaagcccaccucugugacaaagaggccgugugagcugcauagccucaaaaaugggucuguuauagaccccagaccuuuccaguuccauuguuuucuuucauuaccaagacuaaguguugcaaugcaaguaagcucauaguauuugaaauguaccauuaaaaaaaacucagaggacaagacuacuuauucaaacuguaaggaaaaaugagaccauaggaagaagagaaagagauucacuaauuuauugaaauuguugagaagcgacggcagccagagccuugguuaucuagaaaguuuuuggaaaguggaaaguuuaccuccuuaagcaaauguuuuaggaguuuuggauaucagucuuucuaaaauggauuucucauuaccuacauguuuuagcagagucucauaaacauauuuuaauuguaaaacaguuaaaacagugauuauauuuagauucuuuuuuuuuuuuuuuugagacgaagucuuacucuuucgcccaggcuggagugcaguggcucaaucucagcccacugcaacuccaccucccagguucacgugauucuccugccucagccacccaaguagcugggauuauaggcgugcaccaccacaccuggcuauuuuuuauauuuuuaguagagacagggguuucaccaucuuggccaggcuggucucgaacuccuggccucaagugaucggcccaacucgcccucccaaagugcugagguuacaggcgugagccaccaugccuggcccauuuaggcucuuuucaaguuuuguaggccuccuugucccucuucuagucuuaggcuuguuuacuuuuuaaguucugugacuguucuuuggauuuuuaaaagccguuugcugggugccauggcucaugccuauaauuucagcauuuuggguagccaaggugggaagauugcuugaggccaagaguucaagaccagucugggcaacauagugagucucccucucuaccaaaaaaggauaaauuagccagauguggucaugcacaucuguaguccuagcugcuagagaggcugaggugggaggauuacuucagcccaggaguuugaagcugcagugagcuauaauugugccacugcacuccagccugggcaacagugagacccugucucuaacuaaaagacaaauagaacagaaaccuuuccacaagaucaucuauuacagucucuuugugcugcucugacugugacugccuagaggggcuccuccucucauaauuuguaugugcugguaauuaaggcaccuccaccuugggugucacaggugcuaugggaaacauaacagacucugggugagucuugagucuguuaccaauuuuccagauuacacaggcaagccauuuaacuucucagucuuuuuaaaaucuggugccuuggaauaaaggccuauggggucauaaccaaaggagcaaauaagaugcuugugaaaauacuuuccaauguauaaaauccuuuuuaaauauaacccacuacucuuucucacucugacauggugaaucucuguucguugguuuugcuuuuccuaucacaucccauuuuccuugagagaacuggaguuucccguaaaucaccagauaugcucccucggguuggccgguccugcucgaccaguccugaguccuaacuauguggugugcuaugacagagcaaggguagagacuucauuuuucugauguaaauuacacgcccgccaccacaucccuucuuaugagacguagauucuguugacauaggagccuaagagagagaccaucccccaguucugcuuccuugaggacauagagagaaggcucaggauucguuucccuuccagggguucccagaucuuauuggguuugugugggccucugguccccaggggccgaacuuugggaagagggauacaguggcugcugcuauaggcaguuggcacuucuuuagagauaaaaugugaaaagaugguuuguggauuuugccuaauagauaguaagcaugacagaaacacagaccucuugguucaugugguuuugugacugagaugaaauuguuucuuuuuuuuuuuuuuuuuuuuuuuggagacagggucucauucuaucauccaggcgggagugcaguggcagugaccacaguucacugcagcauugaccuccugggcucaaucgauccuuccaccucagccuccugaguagcugggaccacaggugugcaucaccauuaauuaaaauuuuuuguagaaauaggaucuugguauguugcccaggauggucuugaacuccugggcucaagcuauccuucugccucaaaccuccaaaaguguugggauuacaagcgugagccaccgugccaggccauuucuaaucuuuggagaccaugauuucucugucuguaaaaugcacuugagagcaaauugaagaguggccuuugagcugaauaccuuuacuugguuauggcauucacuauuuaagaguuacagguucuucugaguguuugcugucucuuuauaacuuccguuuuaaacaauagauucaccuuuuuuuuaaaaaaaauuuggagacagggugucauucugucucuuaggcuggagugcaguggcaugaucauggaugucucauugcaaccucaaacucgaggggccaaguccuccuuccaccucaacuccuuggccuaauccauccucccauccuccucagccuccccaugcucagcuaauuuuuaaaaauuuuuauagagguggggguuuugcuguguugcccaggcugaucucaaaugccuggccucaagugauucucccaccuuggucucucaaaauguugggauuacaggcguggaccaccgcgccccgcccagguucaaccuuuuuuuuguuuugauuuguuuugagacggagucucacucugucgcccaggcuggagugcaguggcguaaucucagcucacugcaaucuccaccucccagguucaagcaauucuccugucucagccuccugaguagcugggacuacaggcgcaugccaccacaucuggcuaauuucuguauuuuuagaagagauggaguuucaccauauuggucaggcuagucucccugaccucaggugauccacccgccucagccucccaaagugcugggaugacaggcguaaaagccaccacgccuggcuuagauucaaccuuuuaaaggugcuuauugaucuaucagaagcuucaaagugaaagcaugauacuccaccacuagagggcagugcuguccuagucacaugaucugaaucuacaaauugcugaauuugaagcuuccuucaguccuccacagaauuagacagaaaauuuauaucauuuuuauauguauuaaguauauacauauucaaaauauaauuuaaauauuuaaguaguauuaaaggaccuuuuaaaaauacuuagauugacuuaaaaggguuaacaugcaguucuuuaucauuaucauauucuuuaccaaguuaaacugaaucccacagaaaaaaaucuauccugaagguuuguaguucaucaucagcccucggguuagcucagcaucgugacaccucuaacuacauacucaugucgcccagguucuucacuguuucacuuacagggaugccaugcaucuggcugaggauguuuuaauuaacaauagagauacucuugggaaaguucucaacuuuccuuuuuccuuuuucuguaggagguaaagagcuaaauaaauguuuauauagugucaugaugccacuaagaaaauaacagccccuuugucucuuuucccucaaucauaaggaaguuaugaccugaauagaaagacaaagcaguacccuucuguguuuuucucaagugagaacauuuuuuucuuuugcauaaagucacaaaaguguauauaagggcugaggaucugguaauuguccacauuucagauuuuuuuaaggaaauauuccuagaaguauaauuggauuaaagaguaauauaaggauuaagacacuugcuauuuagguuggugugaaaguaauugcuguuuuugccauuacuuucaguggcaaaaacugcaauuacuuuugcauuaaccuaaaauaaucauugccaaugcuuuccaaaauggcugcacuaaaauauauccccugaacaguacaugaaaucauuuucaacccuaauacauuccauaauuucacccaacauauuccagaauuguauuccucauuucagcagccuuauuuuaaaauauuuuauaauuauaaacuuuuuuuuccaaguagaagguauguugaucaauauuuccccaaauauauuacuguacugguaagacauauuaaaaaaugguucaguggucaaauacauuuuucaaauguuguauacuugucccuuucuuggagauuugugaagcacacaugcauuuuaaggcucugagaaguccuguaguaaagaaaucuguuuaacuugauguuuuauaauuuauuuacauaacuacagaauccuuuaacaucuuauggaaaugggauuggauuuuagaagauaguaaugauggugggaaguuguucuggaagguuuuaggaaacacuguaguauuauaaggauuucuucugaacuuguguuggucucuggucaucguuguggagaacagaauccacagaguagcuagauuaagcacaaaagaaugcauugagguauauagauagaucacagaauugucggacaggcugaagaaacaggcugcagguggagcuucuugauagucugcagaacuggucugccaagagagcuguugccuaugccaccaucgagaagcuucucccacaacugccucugccagauugggaagccacuggguccacaguugugugucucuauccuagcaggaaguggggcugggcaguuuguuuucaguccuauuuuaggaaggagggacuuuacacuaaggugaacuaucaaauguggagagaaugucuaaaagacggcagcuacaauuagcaggcauccaagaagacagcuguguguugugaacaccuugggauauaggucagaaaacugggguguagcccuggccuugccucuuaacugcugcaugaccuugggcaaguccacuuucaaacuugcgaucucaucucuaaacaggauauaacucacugacuuggagugaagauaaaaugaaaguaauaggugugaauauaccagggaaaacuauaaaguauuaaaugaaaucaguaaaaaguauuuuucacaacccagguuugucucuagaccagggguuggcaaacuuuuucuguaaagcacuagcuaguaaauauuuuuggcuuguuagaugauacuaucccuuuaguaccuauucaacucugcaagagcagccauagacaauauguaaauggaugagcauggcuguguuccaauaaaacuuuauuuauggacacugagauuugaauuuuguauaauuuucacaugucacggaauauucuuuuuauuuuuuuuccaaccauuuaaaaaaagggaaaaacauucuuagcuuguagacuauacaaaaacagguggcuggcuggauuugaccuaucaaccguaguuuguugguccacguucuagaucauuauacuuaaaauauuuuaaaauguauuuaaauuuaaauuuaaaauauuuuaaauuguuuugccuuaauguaguggcaaauaaauuuggggcuuugaugauauugucuaaauaguuuuauugcuauucacuggaccugguaguagcuuccucuuugauaguagaauuaaauaugcuuaguggccguguauagcaccuugggcuuuauuuaggugaaagcaucccgagaaggaugaguuugcuacccagccaucggguucuuagaaccuccacauuuucucccaucuucaugugugccuuugguuuuggaaaagggauggggcagucagauacuucuuuuaugggaaaaguugcauuuggagacauucccauacccaugcccacaaacucuccuccguaaaccugccucauucccuucuuuggcauguuccguauuuagcuuuacagcuuugcugccuuguggacaagaauuuuccccccaaaaucuuguuaccauuauaauaucuucaucccuauuagaaaaccagaaucagagugucuuccuugcacccaagucccauagaauuucuuucagccaaugaaagucaaagauaaguuugacaucagucacuggagaugaagauguggggugaagcugcugcaguggugugcuuuggagcagccuggucuacacucccuugguccucgagcacuucugcgugccuuucauguauuaauagauggaccuuucucaauucuccucuuuucccucuaggugcagguggaguguagagugugauguagguacacuggcaucuagaaauggagagcauagagguggggguggcacugaaggagggcagugugggaucaaggggggaaggaguggucugagauuaaggaggggaggugguguguuugccuuucuaggcgcaccugcuacuuggugugagacaggugaggcugugagcugucuuuggaggaggagaguacuucuuaguauaugaauguuuguaugagcuuuaacucagguuuacugauugaaagaaacuauauuuaauuuugcuuuguauguaucccuuuuauuugggcuuuacuaaauauagcuggaugggagggacggagggggaaacaguguguagagcagaaguuaaaacacgccagagcuuuggcagcuuugggacagaaaaauaaaacuuuaaacuugcuuucuauuuugaggccaucacaagauguuuugugcuuacauucauuccuaagucauaaacggguaggaggggcugggaauuaaguaaauuaucucuugaaaaauacuaauuugaaauugagauaaaauuagcaaagggaagaagggggaagaaaguaaaacacuggacccagccuguuugcaagcaaaauaauaaacaccucguggggguagaagaggcgugccaguguccuuccagauuuuggccucugcuccuacacagagccccauugucucagagcugggggcaaggcugagugcugugagaacugacuugacaaauaaagccugucaggggauuuugacacaggucaaccccuucuugaagcugugaucucagaggcaacacgauuucuuacucacaggcaguagcugucauacuaugagcuguuuuaucguaauauaauuaucacauacaagaugugguaauugccuauuuuuaggaaucuccccacugggaaucauggugaagaugaucucuagaaaagcucucugcgguccugugaaacaaccucccuucucaagacaagacuccccuuccugauaaccuguugcugcucugcagauuggucucuucaccuccaucaagggcuucuugucuguuucacugaauauuaggaaugcuucucccuaggcuucagccuugggcuuuccccucagguucugcuugccccuugggaccuauuuguggaucugcagcaaaaacauaagcagaagaaguagagaaugugugugaggaagccacuuugugcuucggacaucucauaacccagccuccuaaagcauagcccugaugaggucacauuccugcuuaaaaaaucuuucaugacugcagacagaaaagacugaaaggaaaugugccaaaauauuagcaauuuuuuuuuucugagugaugagcuuucuggugauaauuuuuauuuacuuuauggauuuuacuccuuuccaauuacuuauauaauagacauauaauaguauuuuuuaagaaaaguguuauuuuuauaauaaggaaaaguaccauuuaaaaaccuuuaguggcucccauuugccaauuaaaaauccucucuaugacauucaagguuuuggcaauacugcuacaauccuucugaccucacccucuucucucucugcccucacuccaagaaacagcagcagaacggaguuacccacugucaccaaauacauuuggugcuuugccuuugcucaugccccuucuccacccgucaacuuuccauccuucaaacagauuucuccuucuuuagagacuguuucccauaacauacauccuguaaaagacuuaaaaaaaacacgcaaaaacaaagaacauucuuaaucccacuuccuggagauaaccacuguuagcauuuugauauaugucuuuguucugcagcugagaguagucuaguauaccuuggcugucuguuacagauuuuauauucuauauggugguguuauuuauuucugucuuaucuccauucuggauuuuaaguuccuugacagcuacaagaauggcuuuacauuuuuguagccuccacaggccuugagcacagugacauucacauaauaugcauuccaaaaucaucugcugaaucaaacaagggagauaagacaagcuuguaacuuaagcacaaaccauaguaacaaacauaaacaugcugguuacauuaugaauauaaugcugaguauauccauaaaugcuuaagucgcaggagaaauacaaaugcuuuaaccuuggagugucaggaacaauuacaugaccagggaccuacuaagguaggguaauuuugguacaguacauggaggagauucagccuugaagagagaaaaagcuuguuuuaaaauggaaaaaacaaaaacagaaaccccacagauaggacuugguguagaaagaggagguguuuguacagaccauugauucucaacccagguuuauguuggaaucacugggaaguuuuuuuaaaaaaaauaccagugccuggauccaaucccagaccaguuaaauuagaaucucugggugggcuuagcugcuuuauuuuuuguuguuaaaaacaaaacaaaacaaaaaaacaucuauacaggugauucuaaugaaucccuguuuugggauccccuguauccaggcuugagaaucacauucuaggcagauaaaccuucuuaacaaauaaaaaguaaguauuuugcucuucucauauuguugaaaaaaccaggagauugguucaucuugaggaagggagguuuuggugggggugagaauagcugcugcagauuguucuguguuaaauguacuuuaaagcacuuggauaaaauucauccauuugcuauuauuaagaaacucaucugugccucuucaauugcccagacuuuucuccccucuugaaggcugcuucuuccuagagcaguaacugaaguagacugcagccaguauaagcucuauuauugcauucaccucuauuauuauaucuaagcuucuucaagggauuugaccuguauucaaauacuaucaaaacacacugucucucaaacaugguauuucccaaauuugugucucuuuuucuuuuucuuuucuuuuuuuuuuuuuuugagaccgagcuucccucugucacccaggcuggagugcaguggcaugaucuugucucacugcaaccuccaccuccuagguucaagcgauucuccugccucagccuccugaguaguugggacuacaggcgccugccaccacacccggcuuuuuuuuuuuuuuuuuuuuaaguaaagccuggguuucaccauguuggccaggcuggucucgaacuccugaccucaggugauccacuugucuuggccuccggaagugcuaggauuacaggugugagccaccgugccuggcuaauuuuuguauuuuucuuuuaguagagacaggguuucaccauguuggccaggcugcucucgaacucuugaccucaggugaucugcccauaucggccucccaaagugcugggauuacaggcgugagccaccgcaucuggccuugggucucuuuuucacaugcuaaaaccuaacacccacaccacccaacacuaacaaaacaaauacuaacaagcaaaaaauuuuaugcaagcuuuucuaauaguacaaagcaugguagaauaucuacagcaguuuaucacaugggaaaggaaauucgugucccuuggucuagcugucaaguaaccacggacccuagaauaacacguuuuucacuccgugcccccuuggaucgaaugcagggacuguuauuuugcuaaauugugcuuucacguucugaagcacacuugcauguuguuaugcagugguguuuaaauccuaaccaaaguguuuuuguugcaauggaaauauuucaauuaauguuuaggguuggaacauauaaacaaagcuuggguccagauuaguugauuaaucauugcauuccggggugcaggaagaguuuuguugaacucuaucaggggaggaauuaauauccucugccugugaggucuuuccuggagaaagcuuggguuuuaauguuucuccuuacaggauauuuuucuuuuggcaagaguaaagcaaccaguacccccaguaaaaugucuuaaauagcacuugggauggggaugguucuucacacuccuggcagugaagccguaguucuuguucucugaugcugacacguacacuucacagugaaugcaguaauauuaauggaggcaucagcccagggccccggagugauaccuuccaugucuguuuucuuccuuuuguuuauuuccccugaccaucaagucuguuacguuuaguucucuaaacuaaagcugaaucacuaacauuuccuucacugauccugccccacacauacaccucuuuuuuuguguguacaggaguaaauuucacacauccucacccaagucgucuuugaggcauuucuuuuucuucuguauccuuucguuggagccuaacaccauguuuuugggaauaucagccuagguguccaucaucagaaauaaucauaaucaaaugauauuuuccugggcuuuaagacaugauaagauaguaccagaaugucugaagauaaauguuaugcauucauucuuuacugguucccccccucaaaaaaaaguauuuaaguacaaaauauuugaaguauaagaaaauauaagaaaaaugcaaaugaacaaaacaaaaggaaaauuaagguugaauacuaaagugaggacagagggaaauuuggugagagaaauguaugugauaauaugcuacacaguuauuaaaguugggcagcaaguuuaagccugaacucucuaacagccauagcaaaaagaaacagcugauccucugcucccagauuagggaggagccaggagagccugcuagggaaucuuacuccaugaaugccggccagauauuccucguaucucccaggaaaguuacugccuuaccuggggguuggaggacagacccccaaacaaguuuacacagugugagaguggaguaagaauguccggaaaggcaaaauccacagaggcagaaagccagcuggugguugccaggggccgggaaggggcgaggcuggugagggagagacugcucauggguacagaguuucuuuuuggguuaauagaaauguucagaaguuaaauaguggggaucacugcacagcuuugugaauaugcuagaaaucauugaacuguacacuuuaaaugggugaguuuugugaugugaauuacaucucaauaaagcuguuaaaaaaucuuaaguaugcaauuacaaaagagaguaacauacugaagggaaaaaaaaacugaugagucuaauauucuugucuuccacaaaaugcacacuucucaggggacgugucauaaccgaggcacugcugugagggaguuugggucauaguggguagaaacugaaaugugcagucccuaaguuucuuuccauugugaacauucaguuauuggcuaacuguaaaaagaggaugggauuauaagacaauuggggacauuugaacauuguaaggacauauuugcuaguauaaggaaauggcuuuucauuguuaauguuugguaaugguauugugauuuuuaaaaaaauccuuaucuuuuauauacugaaguauuuauaaauaaaauacuaugauaccuggguuucaguuuaaaauaauccaguggguaugguauagaugaaacaaaauuugucauauguugguaacuguuaaagccggguucaucacaucugucuacuuuuguguaaguucaaaaucuucauaauaaaauguuaaaauggauauuaucuuucgcuguuaacuacagaaagaucuagcaacauagccagaguccuugcucaugagaaauuaugcuauuugcagcacuugucucauuggcugauuuaugggcgacuucugagagauuggaagccugggugcuggcucuaagucacauguauaaguaagcaugaaauucuaguaaggucauccacagcuuuuucagccuuccgugugcuucucagauacugcugcauggggcuguggaagggaugguugccacucuuaacagaaaggcagagaaugcuggacucuuaccucuuaagcguaguuucgcccuuuacaguucauuuucuccugauucuccuuucucuucaguaagaugugagugcugaauacuuacauuuagugucaucuuacagaggcuauauauuuuagcaaggugcuaaagaauggcauuuuuccuugacuuccuuuaugaacuugaaacacauucaacuaaucuaugcacauacaccuuuaagacuggacagaaauggguagagcagacaguaguacauguuugagagugaaugccagcuucugguucaauacuuuuuuuccguuucucuuuguucucaggagagauggaaacugggcauuuguauuugcuccauuuccuucucugauugugaagacuggcacucuuauucauaguaacauguauugcauugguaucccagguguuauauuacauuggauacagaguuccauuguaacugaaacucauucuuguguucagcaaacauuugugugucuacuaggugugucccccucacaguggccugcaugggagcugaauucuuacacugguuuuggauucucagcauuaccuuaccuaaagaacaaacauugguuuuaaaagcaguaguggccuucuaggaguuuacaagcuguuuaucucaagguaaaggacugcaguuaaaucuccuaccguggagcucuaucaccccaagcaguuugaauugcugaaagcaacaagugaccaugacacgagggugguuggagaugaguauuguauuuaaaugcuuugggauaauguugcuuaugaugucagugaaacaucugaguuuccacauuaccuagccuuuagugauagauacguguucuaaggcauaagauaguuuuaugucucccucucuuauuuuucucucucccgaaaggucugccuugagauugucuugcuggauaugcagcagugcuaacacagugcccaacauuacagauaucacuacugccuguuuaccuucuccuucagcaauagcaacagcuuaccacuuacugaacaucuacuccgugccauguacuuuacaugcauuaucucauuuaauccucaaagcaaacccugugagguaggugguccuguccuuguuuuacagagaaggaaaccaaagcugagcaagaucagacgucucuccacauaacuagugcuaaauccagcagucagacccagguuuucuuaguuccgaagccugugcuuucucuuggguguugucucuucuugguguuugguaaauauuugcuuaauugauauacacuuuggaugcuugacaggcauuuugcauaccuccuaaggcuauaugagaugagaugguuauaagucucuaaggcauuaauugagugggacucuuugacaguacccauguuuuguugcaugaacguaugaaggcagagacugccuauaucaucuccuguugccauucagaaguacaccuuguccuguugugaucagaguuucacaaagugcucucagugccuaaggcaaacuggcacauucucuaugaaaaagacaauuauuguucuuggucagguggccaguuggcccaguugauuuuggagcauaguguuaauaaagguuagucucuucagauaugagccaguugacuuggcuauauaaauagcuguugucacgggcaggucagagguauguguguggauagacuggaucuguaaccaccaaucagaaaucaaucagcaaucauuuacugagcauuugcuaugugccuggcacuauacuaggaguggagcuuugaaagauuuuuuaaaaauacaugagcuauaggcuagguacaguggcuuauaucuguaaucucggcacuucgagagaccauggguggaucauuuaaggcuaggaguuugagaccagccugggcaacauggcgaaaccccaucucuacaaaaaauacaaaaauuagccagaagugguggcacacaccuguaguccagcuacuugggaggauaaagugggaaaaaucaccugaacccgggaagucagggcugcagugagccaugaucgugccacugcacuccaggcugggugacagagcaaaacucugucucaaaaaaaaaaaaaaaaaaaaaaaguaugagauauagucucuccaagggcuauacuuaauugguacagauaugacucauggagaaaggaaaauauaaaaacaacaacccuguuuguguggaguuuuuuucaccauuuucuacucagcaacuaacuuggugccuugcacaucauaggaaguuaguagguaaauacuuuuugaaugaaugagaaugcagaggcaagugcuuaguagcuuuucugauggcuuuguagaagagguuggauuugagcugaacacucagguauaaauagaauucaaggaagaggagaagaguuggaaggugauucaaagugcaggaaaagguuucaaggguaauuuggaaacacaagugugcauaaugugucccaggaguagaaaagaccacuuuugcuaggauagagauacggcuagaaccauggaguaucgugaguguuggaagaacacauuaagauuuuauucuguagucuccugaguuucuuuuauuuauuuauuuagagacaggaucucacucuguugccuagacuggaguucaguggugugaucauagauuaguaaacuucaaacuccugggcucaccuucccaccucagucucuagacuagcuaagacuacagaugcucaccaccaugccuggcuaauuuuuguuuuaauuuuguagagauggaguuuugcuguguuucccaaacuggucucaaacuccuggacucaagcaaucuucccaccucagccuucuaaagugucggauuacaggcaugagccaccacgcccggccaccuccugaguuucugaucagcagagaaagauuaucaaaacacguggccauagauggaauggauugauguguaugggaggccaguuaagagcuuauagauauguuuagguguuggguaauaagagccugaacuaggauauugguugaggaagccaaaaaaaaagaggcagaugggagaaauauugugcagagagaagaaacaugauuuguugaguuagugacuggauauugaagccuggcaaagguaagaggaauaaucaaagaucauucagugauccuguguuacucuguuuuuguauugcuauaaaagaacacccgagacuggguaauuuauaaggaaaugagguuuaauuggcucacgguucugcaggccauacaggaaguguggugcuagcaucugccuggcuucuggugaggcuucaggaagcuuccaaugauggcagaaggugaagggagagcaggcgugucauauggcaagagcaugagcaagagugagaagggggaggucccagacucccuuaaacaaccagaucuugcauaaaccauaugagaacucacucuucaguaaggguauggcacuaagccauucaugaaggauccaccuccaugaucuaguacuuccuaccagguuccauuuccagcaaugaggaucacauuucaacaugagauuuggaggggccaucauccaaaccaugucauucugucucuggccccuccaaucucauguccuucucacauugcaaaauacaaucaucccuucccaauagucuccaaaacgcuuguucuagcaucaacucaaaguccgaaaucucaucugagacucacagccgauuuccuucugccucugaaccuguaaaauaaaaaacaaguuauuuacuuccaagguacaauggugguacagacauuggguaaacauucccauuccaaaagggagaaauugcccuaaaggaaaggguaauaggccccaugcaagucugaaacccaguagagcaggcauuaaaucuuacagcuccaauguaauccuuaacuccaugucccacaucuugauuugaaagguggacucccaaggccuugggcagcccugcccucguggcuucccugagcacagcccacauggcugcucucuuagguuggagcugaguaccuguagcuuuuucuugcugaggguguaagcugccaguggcucuaccauuuuuaggucuggagggcaguggcccucuucccacagcuccacuaggcaguacccugguggggacucuaugugggggcuccuauacaagcuuuccuguacauccucugaaaucuacgcagggggugccaagccucauucauucuugcacucucugugccuguaagcuuaacaccauguggaagcuaccaagguuuaugguaucuugcacucuccaaagcagcccgagcuguaccuggggcccugugaaccguggcuggagcuggagcaguggagauggggguugcagccuccugagguggugcagggcauuggugccccaggccuggcccacuaaaccguucuuuccuccuuaggccucugggccuguggugggagggguaaccuggaagauuucugaaauggcuuugaggcuuuuuucccccauugucuuggauguuagcacuuggcucccuuuuagucaugcuaaucucuguaacaaguggcugcuccacaaccuacuuggauucuuucucuaccauagggccuggcugcaaauuuuccaaacuuuuauacugugcuucccuuuuaaauauaaguuccacuuuaagucauuucuuuguucccaauucugauuguaguuuguuagaagcagccaggccacaucuugauugcuuugccgcuuagaaauuucuuccaccagauacccuaagugucaucacucuuaaauucaaacuuccacguaucccuaggacaugaacacagugcagcucaguucuuugcuaagauguaaugcaggugacuuuuacuccaguucccauuaacuuccucauuuccaccugagaccucaucagccuggacuucacuguccauaucucuaucagcauuuuagucacaaccauuuaaccagucuuuaagaaguuccaaacucucccucaucuuaaugucuucuucugagccuccaaacucuuccauccucugcccauuacccagauccacagccgcuuccacgucuuucuuuaucuuuauagcagugccccacucuucaguacuaauuuucuguguuagucuguuuuugcauugcuauaaaggcauaccggagacuggguaauuuauaaagaaacgaaguuuaauuggcucacaguuuugcagucuguacagaaaucguggugcuugcuucugcuuggcuucuguugaggccuguggaagcuucuagucauggcagaaggugaggggaagcaggcaugucacauggcaagaaugggagcaagagagagaugggggaggucccguauucuuauuuuauuuauuuuuugagacagggucuugcucugucacccaggcuagagugcaauggcacaaucucagcucacugcaaccuuugccuccugggcucaagcaauucuccugccucagccucccaaguagcugggacuacagcuacacaccacaacacccagcuaauguuuguauuuuuuuuuuuguagagaugggguuucaacauguugcccaggguggucucgaacuccugagcucaagugauccaucugucucagccucccaaagugcugggauuacaggugugagccacugcaccuggcaucagacucuuuuaaacaaccagaucuugcaugcacuaacugagugagaacucacuuaucaccaaggggauggugccaagcaauuugugagggauccacccccaugauccaauaccucccaccaggccccaccuccaacauugggaaucacauuucaacaugagcuuuggaggggacacacauccaagccauaucagauccugaaaugcagaucuugggagaaggaugcugcuauuguuuuauuaaauguaaauggaaaucagaagggggagguggguuugaagagauuuuaaauuugagauacugggacaucaagaggaaaugucuacuuagccgcaggaagugauggcuguggccugcuggucucuuuggauugcgcaguugccuuaucuucgugugacacagaggcagacucggccaccccagguaugacuuguuuugggaagugauaaauaauauuucacagggauauaugaguugauuuuuucccuguaugucauauaucaucuuuucugcaucuuucccuguaacguugguucucccaagaugaaagaccacaugcuuugaggugagaaacgagaagcagaagacacagacuuggaggggcugaguagagggggcagaagguuuccuuacaggcagagagcaccccguuccgcaaguacaguucccaggaguuauaucaccucuaacaccagagaaagcaguggaggccacaauuguauguguuucuagaggugaaugcuugguauuggaaagguaauucugacacucacaguaguugguuuuaugagaauccuuugagaagcacagcguaaaauggaaagauuugaacuugaucucacacaaggucuuugauucuuuaacaauauuaacuaauuaaaauguaucuuguaaggcuuagauuugucuccccuacuaccacccucagcccccugcauucucucuguugugaaugaaaacauaguaaauaauuuguaugucuuacuucucccucuuacuuauuuuuuuaaaaguuuaaaauugggcuuggcaugguggcucaugccuguaaucccagaacuuugggaggcugaggugggaggaucacuugagguuaggaguucgagaccagccuggccaacauggugaaacccugucucuacccaaaauacaaaaauuagcugggugugguggcacacacauguaauaccagcuacucaggaggcugagggcugagacaggagaaucgcuugaacccgggagguggagguugcagugagccaagaucaugccacugcacuccagccugggugacagagagagacacugucuccaaaaaaaaaaaguuuaaaauuaugcucuuacuaccuuuaggcccuggggaauguguguaaaguguacucagguuguauuuaauuucauugacaauuaaauuucccauuaaaacaaaauuagggggaaauguuucagcuguauuggaguauaaaagagaauggcuuuauggaccaccugcuaccuaauauuacagugugaagaaaugaagagaaaugcuuuuuaaguaauuuaaauguuuuuuucucugauuaagaaagucuguucacaaauuuauuagguaauaauuccucuagcuuuaucauccaaugauucuacuccugcaauggccuguuccugcacauggccuagugauggaguguagggguuguaaauggaugugucauugugcuggacccuaaguagacauaacaugugcgagagaggaaagacuccaaggaguuaaggaaauuauuguccaccuaugccaugaaacccuuuguagccacuaaaauuaauguuguagaagaauauauaaagacuuguacaauauacuaagugaagaagauugcagaagaguaauaaacaguauggucccauuuucauaaauaccuacacaacuaauagcauucaucagauuauuauuguuauuauuauuauuauuuuuugagacagagucucccucguugcccaggcuggagugcaguggcacgaucucggcucacugcaaacucugccuugcggguuccugccauucuccugccucagccucuugaguagcugggacuacaggcgcccaccaccacgcccagcuaauuuuuguauuuguaguagagacgagguuuuaccauguuggccaggauggucucaaucucuugaccucgugauccgcccgucucggccucccaaagugcugggauuacaggugugaaccacugugccuguccucuucaucagauuauguuucuuucuuuucuuuuuuuugagauggaguuucccucuuguugcucaggcuggagugcgauggcgugaucuuggcuuaccacaaccuccgucuccugccucaagcaauucuccugccucagcaggagaauacuaguagcaauucuccugccucagcaggagaauucuaguagcaauucuccugccucagccuccugaguaccuggaauuacaggcgugcgccaccaugccuggcuaauuuuuauguuuuuaguagagaugggguuuuaccauguuggucaggcuggucucgaacucccgaccucaggugaucugccugccucggccucccaaagugcugggauuacaggcaugagccaccacacccgaccccuucauuagauuauuaacagugguuaucauugggugauagaaucacuaauaucuuaauuuucuaauuucuauauguaugauuuuauaauguuacuugaagcaauuuuuuggccggaggcaguggcgcagucuccacucacugcaaccucugccuccuggguucaagugguucuugugccuuggccucccuaguagcugggaguacaggcacaccccaucacgcccagcuaauauauuuuuaauagagacgagguuucacuauguuggccaggcuguucucaaacuccuaaccucaggugaucugcccacauuggccucccagagugcugggauuacaggugugagccaccacgcccagccaggaagcaauuguuuuaaaagaagagaaugugaguggacauaaauuucagaggaaacacguguucaaguggugugacgguuugcuuaucuuuggcugauuuaugauggcuggcaccuauccugguucugaaagacauuuuugaacuugaguaaaaguacacaggugaaggggcuaugacaguauaugaggggggucuggauuggagcagagacagggauacaggaagacaaagaaaucccagaggauugcacguaaucuuuucccaagagaagccuuucugucuugucuugacaucuuguugagaaaucuuggauagguaggaguuuguggaggaagaguuccuggauuacaagugaucuacguagagaacuguagaaguccuuagcaaggaccaggcaugauagccuugauguuuacugaguuuucuaugaauucuggcugagagcuuuagauacucaggugugucuuacucuagaauuuguaccucuaggggaugggacaaguguuauuccaggcgagaugguuccuaggcuaggggaguuucucuccuuucuuuggaaggugucaaugucuagagagguuuauaauuuauagauuaaagaucaacagauaauaaauucccagugucaaggcaaaauggggcauuuccugaaggauccuuucacaaugcggcuuuccagugccuuggaggggauguuccccacagaaagguaagcauucucugaccuuuguucacacuacauaauagauaagccaggacagugauucucagugugguccucucacugucaauggggaccuuguuagaaaugcaaauucuaaggccccaccccagauucacccagaaauacuggaagugguuccugcaacuugcuuguuaacaagucuuccagggacuucuuaagugugcuaaaguucaaaacaacugagcuaggagauaguccuuaccuacaaagagcuucuauucuugcaguaaguccgcgugggugauaaaugcccagauaucauuguauuuuugguguacuuuuaauuuuuguuaaagauguguguuugccugauuuuucucaggcacaggcucauuucuuucugggccaaccuaauucaugcucuuggcuuggugucaaggacguuuuuuaacacacugcaacuuuguuaauugaaauagugccuuucaaugagagaucauauccuggcuaauuccaagucugauugcagguccuauuuaacuuuuuacacuggguaguaaaacaaguuuuuucucaaaauuacccagcggaagaaguuauguccagaaaagagaagcuuauauuagugcugcugcaccugggaggaaaugucaugggaguuaccagagagauucagggauagauuuggggauagacugacacagugugaggacuagaggccaguuccuacucagaagagcaauuagcucauucaugaauuguuuauacuucuuguaucaacuuuaauugcuuguuugaacuuggacuuuagcauucauuauaauuguuacugucuaaucaacaauugauuguguauuuuaauuccucuaagugaguugaaucuucaagugaugaccccaacuucucaguuuuuuucugccucuagacauuuaucuuuaaggccaggagccugauaaauaaacuaguagacaauuauccuuuacaacagagccuugacauguauauguguagguuaaauuacuguucucaguaaaaucaagccagaaaagagagaauuuuuuuuucuuuuuuuucuuuuuucuuuuagacggagucucgcuuuuucaccuaggcuggaaugcaauggcgugaucucggcucacugcaaccucugccucccagguucaagcaauucuccugccucagccucccaaguagcugggauuacaggcaugugccagcaugcccagcuaauuuuuguauuuuuaguagagaugggauuucaccaucuuggccaggcuggucuugaacuccugaccucaagugaucagccugccucggccucccaaagugguggaauuacaggcaugagccacugcguccagccaagaaguucuuagauuacuaaauuuaaguaaaaugauuuuuacuuuaaaacaauuuuaauggcugauaaggggaccuuguagaauuucugagguuaucaauggcauuggaguucuuugugucaggaacuuggggaacagauuuugcaaaaugagacuuaccagggugacuuuugaaugcuguggggacagccagauuuucugggacaggguugccaccgugcaggcuguuuggguagggugagauggcaguugguauauucuaaaucaagagucgaagaauucagucuauaaugauuguuauauauuaugccuuagcaguuucuacugcuggucuacaauuugcugguugggaauuuuuagaaguacauucuaaaacuuggaggagaacuucuauguaaccuauuacuggagggaaagaaaauugaaguuugaaaagguugcuguuugacuucccacaauaggaauagcagcaggcuuuguggcauauuuuucuauuuuccaguugcuacuucugauauuaagacacaguaguacuuguucacugacacacugaguacaggcaggcaguauaucgcauaccuaguaguguauccauuauguaaccccccaguuccuuccucuaccucuuugcuccugugaagguagucuaaaugggagcccuuuaaaaagugauagguggccgggcaugguggcucacgccuguaaucccagcacuuugggaggcugaggcggguggaucacaaggucaggagaucgagaccauccuggcuaacacggugaaauggaucacaaggucaggagauugagaccauccuggcuaacacagugaaacccugucucuacuaaaaauacaaaaaaguagcugggcaugguggcaggcgccuguagucgcagcuacucgggaggcugaggcaggagaaucgcuugaaccugggagguggagguugcagugagccgagauugcaccacugcacuccagccggggcaacagagcgagacuccgucucaaaauaaaauaaaauaaaauaaaauuggaguagaguagaguagaauaaaauaaaauaaaauauaaaaucgugauaggaaggcaccuuugaucaccauguuugggacauucucagucuacuaaagaaaccaaauagucauuguucauauauauaugaacaauauauauggacuauuuuauuuauuuauuuauuuuugagacggacucuugcucugucgcccaggcuggcgugcaauggugugaucuuagcucacugcaaccuccaccucccagguucaagugauucuugugccucggccucucaaguagcugggauuacaggcaggugccaccaugcuuggcuaauuuuuauauuuuuaguagagaugggguuuuaccauguuggucaggcuugucucgaaguucugaccucaggugauccaccccucuuggccucccaaaguguugggauuacaggugugagccacugcacccagucuauauuuuuuaaaacccguaauaacagaccaucuagacccuaaauaccaaagacuuuaaaguccaggguuggugacaguaccauaacauaaggauagugagaaaaagugauaaaucguagcguuaccaguuuucagagcuuuaaaauauguuaacaucuuaaaaaucuaaauuucuucauagcaguaaaacgguagcuauuuauaaauuguuaaguuagaagcugaaaguggauaauuuaggaagaacaaagauccuagaaaguuaaaacauaguaauuccauugauauguagauggauaauuauccucagcuccuagugacuuggaaauuguucguuuuggaguuuucuaggucucuggcuuauuuuucuguuuugccugguuuuugccuuuguuuuugauuuugccucuuguccaaucacacuuccagaagaaggcaggccaggaaugaaaaagagcccacacucaaaauuuagcagggucacauuugcauaccuagaucuuuacagaccuacuuuuacaacuuugcuuaaagcagcaaagagaucuuuuucugguccugcuuccaaacauaagagcauuuucucuuuugcuauauaauagcuccgauaacuucuacaggaaucccuagcucaagaaucuaccauuuaaauggaaguuuaauaaaaguuauaaauagguaucuugguugcauaauaugauauauguuuccuguuggcuuuguccccacuuuugcuccgcccucauauauaaucuuccucauaaagguacacaaagcuuauaaguuaaauggugucuccuaccuguuagugagagcuggcuuuuuugauccagaagcgagagacauucaguuuggacccguguuccagugauagaaaggccaguccuucugaauuaggaugguggccuccacgguuuugcucauaggaaaauaaucguuaaguagauccgucccugcuuuuacugggagaacauggaguugcucacgugaauugcccugccacugggagccccugcccuugagaaugcugcuguuuggaaccagcugcuuuuauguccauggucgcugugagcaguuagguggugucuuggcuuuaguggcgcugggacaucacuuccuaucacuuugauugcccuccgcccacucaaggugcccccaagucaaauuugucaagccaggcagacuguauaacaggcuuauuuuuaaaaucagggauuagaauugaauuuguauauauguguuggggagauuuuccaguaaacaguaacuaaacauuuuuguuucuuuucaguagcuuuuggaauuacuaucucugggguccuuauaauaagguagauucucuuaagucuggucugguuuacuugugguuuuaucugaagaaagguugucuucccaaaccuagguucuuggcuacuucaguuagcaaggagugugaaaaaguggacaugaccuugccaagaagaaaacuuucagaccacccaccaaaccagaggaagguuaggacuuuuuuuuuuuuucuuauguacaaccuucccacagcucauuauuuuuauugccacccaguggcauucacaauacgaaauggugcgagugauauuucaaccuguugggcagcagcuaugcugugcacugugaccagagcuguuuguuuggccagcuacugcaggcgcucauugcagcagccaguguuuuguuugugagugucuucucuaugguuuccugcuucagugaauagaagugggaguugugggggcugagggaagaggacagacagaagacgguuggacucauuuccugaaucaucuuaggcauucuugccgucucuugguuccaucuuggcugggcagcauuucccacugguuugucagaccaacuuucccagccaccucugggggugggaaggaaaaccacaccuugcucugugucagccaguuaacaggcagaguuuuguucaguaaauauuuauaaaaccucucuacuaaccucgaacccugcaacucuguacuuuugaaaaguuuauucucuuucccuggccucccaaguaacuauuugggcccagcaguauaccucacacggacagcacugguaccccuucaucugcaggccagguaccagagaagcuugugcuuccugaucuuaaccuugaacuuggucgaccauuccucuauuuaggauugcagagaguucaugggaaagggucagggguagauugucuuucacaguuuuucccuuuaaucugucaaguuaaacccgugugaucagaggaagugcaaagcagcguguggaggggaaugaggccuccaagugcagggaggcaugucuccuccuggcucugccgcacaccagcagcaagggcaugccuccacacgauguuacuuucugugaaauagaaauaaaggcccucugguccuuucggaaauaaauuuagaaacaaccuaaacaucgaacaguugggaauugguuaaaaaaacuagguuuaucuuuauuaagcaguguugaauuuuuaaugccguaugaaaacaugauaugcugaguuuaagaaaaagauacaaaauguggaaaaugugauuccaauuuuuucuuuuuuuugaaagagucucacucugucuccccgccuggagugcaauggcacagucucagcucacugcaacuuccacuuccaggguucaagcuauucuugugccucagccucccaaguagcugagauuacaggcgccggccaccacgcccagcuaauuuuuguauuuuuuaguagagaugggguuucaccauguuggccaggcuagucucaaacuccuggccucaagugauccacccgccuuggccuccuacaguacugggauuacaggugugagccauggcaccuggcugauaauuccaauuuuauaaaaacuaagaaaggaaggugucaaauuaauaguaguuuccucugaugggauuaugggagauuuuaaaccuccuuuucugauuuccuacaaugaacauuuauaccuuuuguucuuuuuuuuugcagacuauaucauacacaaaaguacacaaaacacauauauacaguuuaaugaaugaguauaaagugaauacccauguagcuacuacccagaucaaucacauaaaagcagcauuacuuuuuaucacuggaauacuaacaauaaaaauuuuauugaaaaauacuuuuccugaguuccucacuuggcuaugguaggaauaaaauaagacuguauaggaaagugcuuuauuuuucaaaccuuaaaauuuccaucaaacauuagaaguuaucucucgucucucaggugccaaagaugacaggugcacauaagcaguaagucauugccagagucuggggcugcuugugucauacagagauuugcacuaaaaaauguaucaauugugccacuugcacuaucugcaguuuuucccucccaggaaacccuuuagguguagacuuagacacugggagaacugcuaggacugacuggguguuaaaaaccucuuuccuacauuuugugcggauuaccuuugauuuucuaugaucccuggauuguugcgugugguggaaggagguuguguuaauucguugauuucaccaaagccagaauuccaagcaggaguuuuuguuugcuuuguuauugaauuaucuagucuuuuacaucgugauuugagguuugguucaaaagaggcaauggauuggucauaauuuaauaauuuuaucugauacuauaacuaaagccagcuguuuaauuugcuggaccaagugcagaaugaaaauguggggucccuuguucaaaaaacaggaaaaguaucauuaaauaauuaaaauauaggccagacgugguggcucacaccuguaaucccaacacuuuggaaggccaaggugggaggaucaccugaggucaggaguuugagaccagccuggccaauauggugaaaccccauuucuacuaaaaauacaaaaauuagccaggcguggugacacgcaccuguaaucccagcuggucuggaggcugaaacaggagaaccacuugaaccuggaagauggagguugcagugagccaaaaucguguuacugcacuccagccugggcaacagagcaagacucugucucaaaaaauaaacaaaaauaaaaaaauuaaaauauaaaguuuuccuuucuuccaucgucucucuccugacuugucaugguguguuuuauuuguuacuuaaagucacucuaaguaaaaaaaaaaauguaauuauuaguaugaauuuuauuguuugccuuuauauugugcaaugcaguuuguuuguuuguuuauuuauuaagacggagucucacucugucgcccaggcuggagugcaguggcacgaucuuggcucacugcaaccuccgccucccagauucaagcaauucuucugucucagccucccuaguagcugggacuacaggugcacaccaccaugcucagcuaauuuuugcauuuuuaguagagacgggguuucaccauauuggccaggcuggucucgaacuccugaccucgugaucugcccgccucagccgcccaaagugcugggauuacaggcaugagccgcugugccuggccgcaaugcaguuuaaaaugcaaauaugagagcauuuagcuuguuaucacugaaaucaugcaguucauauuuuguacuucacacauuguucuaaccaaaauuguggaaaugcugcauuaaacuaacucagcuguuuuuguuucacuuuuauuuuuauuuuuuuugagaugagaucucacucugucauccaggcuggagugcaguggggugaucauagcucaccguaaccucaaacuccugggcucgagugauccucccaccucagccucccaaguagcugggaucacaggugugcaccacuacgcuuggcuaauauuuuuuuuucgaaauggagucucacucuguugcccaggcuggagugcaguggcgcaaucucggcucacugcaaccuccaccuccuggauucaagcaguucuccuaccucagccucccaaguagcugggauuacgggcacccggcaccaugccuggcuaauuuuuuuguauuuuuaguagagaugggguuucaccauguuggccuggcuggucucgaaccccugaccucaaguaauccacuugccuuggccucugaaagugcuaggauuacaggcgugagccacugugccuggccggcuaauuuuuuuuuuuuuuuuuuuaagaggugggcucucacuguguugcccagacuggucucaaacuuauuucacuuuuuaaaaaaauuuaucauuuauuauuucacuucuuaauauaugcacauuuuaccaauauucuccaccuucagcuuacuaaugaauaauggagcuauggaaaacuaauggaaaagaaacuaugaauuaucucuucuuuuccuucuauaacauacaacaccauuuuuaguguaagugguuggcuaacaugaagaaguaacaugaguaagagggguuguucauguuucucagagugccauugccuucuuucuacauucaaggcaaauucuaguuccaguagaaaguguggucucuugggcugcacccacacauacucagucauagauauaacaugcuuaccucgugcuugcucugcaucuuguggaacucccacucauggugggucuaccaaaaucccguacucauugggcaucaaaugagcucacccaugaagccagcccugacuguuguaauuuuuguaaugacaguggccaguuacuguugucacccuuuccauggcuuuuuguucuggguugaguucuccuuaucuguaaucccaugggaccuggaauuuuucucuguucagagcgaauuccagguuuuugacaaugacaaauagcaguuauucaugggacagggugccacucaccacugauacccauucauucuuuuaucuugugucuauuggucaaauuagcccauggauccugaauaggaaagaaaugaaucugaaaggucagcuuugagauuuaugaaguucaauaaaaaucaaaauugacaaccaguagcuucaaaauuguacuucugcuugcagcaagguauucugcauaugguucuguuggauuuauaaaauuaucgguaggcuggcaagagguuugaaaaucaauaacucgcugaacuuaucucugagaggauuuuuauaugcuauuggaguauuuuacccuugugccuuugacagaacaauuucucaagaaggaaauaugcggccgggcacaguggcucauuccuguaaucccagcacuuugggaggccgaggcugguggaucacgaggucaggagaucgagacauccuggcuaacacagugaaaccccgucucuacuaaaaauacaaaauuagccgggcaugguggcaugugccuauaaucccagcuacucaggaggcugagcaggagaauugcuugaaccugggaggcggagguugcagugagccgagaucgcgccaccgcacuccagccugggcgacagagcgagacuccgucucaaaauaaauaaguaaaauaaaauaaaaaaagaaaauaugcaaacauuuccucaacuugcagcuacucuugacagucccuugagugaguauagaccacaaagcuugguaauuaagagcauaaguccaguuugggcagacucaagcuuacauccuggcucuaaccuuuacuagguauauggcuaugaguaagacaccuaugguucugagcuugguuuccucaccugugaagaagcaaugauaagaguagcucaaaggauuacucuugauaacauuaagaaaauagguuaguuugaccuuugacauagaguagguauucaaucaguuuuaacuauuaugauuauuagcauaacacagaacaaaaagacuucaaaugacuauacuucuaagguugggaggugaguaaaucugauacucuuggcuaguucuguuggaaacucagcagguagacauuuaauaugaaggagaaaauaguacuggucuguauuagacugugaauguuuugagaaugggaaacuguguguuauugauuucaguguccucagcccagcacagugcuuggcacauaguaggugcuguugauuaaaugguaaaugaaugguuuaguguuuuauucuucaccuuguaugauauguaucuuucuaaauaugcaaacaaacauuuauuuuucaugccaguccaauuguguggacauacaugguuuuguguaaagauccccuuugcuuuucaacaauugagaaggaaauaaaaaggccggguaugguggcucacaccuuuaaucccagcaguuugggaugcugaggcggguggauugcuugagcccaggaguuagagacuagccuggccaacauggcacaaccccgucuguacuaaaaauuagacagguauggugguguacgccuguaguaccagcuacucaggagggugaggugggagaaucaccugaacuugggaagucagggcugcagugaccugcauuugugccacugcacugcagccugggcaaugggagugagaccuugucucggggugggggguagggggggugggggggagggaaaaaaaggacauaauuugaugguauauuuauuuuuaauaaagauggagauaaaugguaauuuucaauaucugaacguaggcugaccugagucuuaagcacgguggcagauggucuggaaccuccgccgagaucuggguugcauuguggggcuagacagaaagagaagcuucgcgugucuggguaccuggacuccuggucauagccuucccuuagagcucccugacuagagaaucuguccucaucacgggacagcaucagugugucugcuccuggccaaauucagcugcauuccggcaggugguagugauuccugaggagccaggagaaagccaggcugucauuuagauucaagggaagaucuauuugccuuuugauaacagaaggguuuaggaagacauuugagccauacggcacaauuugaaggacuuaguuuaaaagaaaauaauugacagaguaauuggaaugcuaucuuuuuacaguuuauaaagaggccccuuuguauguguuuuucugccaauucuguuuaaaugcccugcaauuuaaacacacugaggauuagagaccagcagugauguuugggcuuugaaaauuccaggacagguuagaggcuuguaaccuaguacaguugcaauggccguuucguuuuguuuuaaguccaccguuguaaucccuauuccacaagaguauauuuuucagaacgcugcuaaaucccagacauggauauuuauauaugccaccaaagauaugugaaaacacauauaaaagggcagcuuuuaggaauauuuuuauuauuugaaaauugaucugaugucauuaaucauuucuugugcuauuuuuuaaacuggguuuugugacuuuuuuuguagcuccaauugauuuaauuuuguaggaguggaaaggaaaguuauucaucuuaacuuauagauauucccacuuuaccugagaaaguauuuaaggaucuuuaaggauuaaagguccucuucaagcuugacaaucuaaguuuuaaaguuuguauuuagcaaaauuauuguuuaauacuuguuuuuauaaaacagcauucucugugaaggaagcagcagugaucuugugcccuuuguuggaugaaguaccaggaauauuuucugauugcuuucuccagggacagaaaugcaacuguaaaugauagagauuaaaacaauaaaacugcccagugaggcuuagcccugaauugcuaaaccuucauauaauaaaacauuuucugagagaggaugguaguggcugcaaagaccaacaacugguuccucugccuggauucaucucuuucguucuccccucucugguuaagacuugcucauccuucaaaacccagcucggauauugccaccucccugaagcccuuccugacuccccuaggcuguuccugccuccgucuucuguguugcuuuuauacuuuucauguucucaaggaaggaccucugcccacagugcucuauaauuaguucuguaauuauuaguguuuaucuuuuacacuagauuaugagcccuuuaaaggcaggaucugggacuauuucaucuuugugguuuaacccccaguuuuauugccuggaaaauaauaggcacucaguuaaugucuuuugaaguacuaaagauucuguugaauacuuaccacaaggcgacaucaaaauagauagcaagugaggauacuuaaucuugguagaaaugaauuuauuuuagauuuuuucaugccuuuauuuaugaauucuaaaagcaauucauuagauuuggaauaaagauaauauccaguguuggcaauggccugguaauacacuguuaaacauuggcagugaggguagaaauuggcacacucuuucugggaaacuauuuggaaauuugaggccuaaauauggucacacccuuugaccuaguaauucuguuucucagaaucuacucuaaagaaauaauaagagaucaccacaauguuauaaagcauaauccaagagacagcaggaacagcuuccugauauucugugauccaaaccaaguacugagugucuaagaacuggggaugaccaucauaacuucucgaggucuuugcuucauguucucccacauugucuagucugucuucuuguguagaguagaaguuaaguaaauacuuguaguaaauggauaaauaauucuuugaaguugaaauguaaagcacucaauguauagaauaauguaacuguuacugcgaaugccacuaucagauuuaacaaguuauuugacauacuuguuuccaauuuuuuuguuuauguuuuuaauauugugcaaauacuauaugcacacauucuuugugcacauuuacuuuauaaucugcaaagugauuuuauauuuuauacucucuuuugaucaagccaaaaaagguguuacucccauguuauaaaagggaaaacugaggcuuggagcagauccaggacuagaacuaccacuuuugacucccaguccaauauuuuuucacaguaggagucuuuggagaacucuuaggaaacaaggagcaccuagaauguuuauuaagggaggguguacaucagcuccagaaagauguugacagauuggaaggaauuuaaagaggagccaacgcugcuggaaggaaggacauaggagagaugaaaggaauuuaauauguauagcuuggccaacggaugauuaaaggggauaugauaacagucccuaggaaugugaaggauguaaacaucauggaaagagaaaauguauuuagaaucaaucaaagcaguauauaaaaagaaauacaaauuaaugcgaaacaucacaaaaagccauuuucauggugacacuuguuagcuuguaaauuagagucccaagacaaguaucaaaagcccuucuaagacauuuaggacuaaguuauucugccuagauuuggggagggcuguuccauuucuaauuuugauggcugagaucaugucccuuccuagcauagauuugccacccaguacugauggcacaguuuugcguaucagggucaaaaggaaaacucuuguuacaaucuguggaagccaaauucaggcauguccccaacauugugcaguccgacaucgcagagacugcccgugaagccuaacuugaaacccuaaguguugagcucauuaacucugccaucagaugacugauuccccaccugcaugguguccccugcugggaauuucagguugugagcaagaugcagagauguucucuuauuguuuaauucacggccacauuggguaagcaagugggccuauuccaguggaggaaaugucauccccaagauguugccaucgcauggguagggaaugauggugcacauauugugugugugaagccauguccccaagaaggggagccgaacccauggcagugucaaaaucugaggucaaagcuguaaaaaguguucaccuuggauugagauguggccauggaauuaucucuaccccauaggaguuaggcaacagagauguccuucaaacuaaaucagaauuuagagggcagucuuaaaaggaggagugugguguuuggaauggaaggguuuguuggggcccuuggaaggagcuggaaggcacucagacccugugaaagaguggcccccccaccuccgaguccccgugaccuuggcccaguacccccuuagaccuagaggugccaaggcagcuucaaccaggugcaggagcugcuggccuuaaggaucugauggauuugauccaacaaacuggacugaaacggugaucugggggaccccuuggggccugugacacuaccacuaagaaaaaacucugagagggaggguggauuccuucugguuagccuuacuggagugguccagcauucugugaaaucagagcugagcuaggacuugagauaacaaaguguaugcauauaguuuauaaacuaaucuucucccccguuuucuguggucuucuuuggugucacuaucccaccccccauucauucacucauucaacaaacuuaaugagcuccacuucuguggcuaguuaggaguccaugcuguuaaggauaugaauuaagaucauggugauggaaaugaaaagguauauuuuuagaaauauuuaagaguuauggaugugggauuaggagaugcuauuuaguggcagagcuguaaguacagccugggucuucagguuccugggguaaggagccuuccccucugcuguguaaagcuuauuaucuccucccggaggaacucuguaauuuagcucuuuuuucuugaccaaggacuuggcaugagacugaccaucgauaaugccaaacacugucauaaaagcaaagauaugagagcuuuguucuuagcuauuuauauuuaugcuguaaauccuuuaagauagacauaauugcugugcacauagauuaagggauguaaggccaggcacaguggcucaugccuguaaucccagcacuuugggaggccgaggcagguggaucaccugaagucaggaguucaagaccagccuggccaacacagcgaaaccccaucucuacuaaaaauacaaaaauuagccuggugugguggcuaaugccuguagucccagcuacucgggaggcugagggacgagaaucacuugaacccggaaggcggagguugcagugagcugaguucaugccgcugcacuccagccugggcgacagagcgagacuuggucucaaaaaaaaaaaaaaaaggauuuaaauguauuuucaagcauugauauugucauaaaauguaauucacugauaaaaugcacauaaaauuaauauauuuucuuuagucuguaacauuaauaaucucaucugccuuuuagaguaaggacugccuuuuguagcuugagcacuuaugugugcuuucauguuacaacgcugucuucgcuauuacagugugagggagcugcugcucuuaucuccacucugcagaggggagauugaggcacgucggaguugaguaauuggccaaggucaaaugguaagugggaaaaccuggauuugaacccaggcagccuggcauccaacuccaaaauccuugaccucuauacucuaguguuucugacaggaggaggguuuuggaguuagguuuuagccugagucucauaagaucuguccaaagaaaguugagcuuacaauuaauuucccugcuguaagcaggaaaauuaaaauuauuuuuuuccacguuacugcugccuuaaauacuguagacaaguuucagcguacuucucacuucauuggaaaccuauaaagauaauugccaggugcuaacacacacuuguuaaaaaccagcuuucacucguuuuuaacaaugcaaaagugagcaguuucucaucugcccaguguaugauucuuugcucagaagaaguagaauggaugaacagagacgcugaacgauuguggaauuuuugauuaugcuuuaauagggagguaaggaaaauguauacaggauuugggaacuagacaacgugaguuugcauuugggcucuagcauuaugaucucucugaccuugggcaagucacuucaccucugaguguguuuccucuucuauaaaaugggguugauaaguugcccaacccgcccucacagagcuguuguuggaauugaaugagauaaaguaugugaacacguuucaccuauguaacuaugugcagaugcucauuacugccauggcuagggagagaggugccggagcagaggugagcagcugccuagaggaacuugagcagguuucccuggguuacuguauuccuaaggaaaugugcacccucuuguggcgaaguaaggggguuaaggguucuugugaaaaauacuucaguguuguuacugugggauuuuuuuggucaccagaaauacuuucccaguaaugaauguacacacucuuucuaaacaaauccuuaaauugcaaggugagugaauuauuuaguccuuacccaguuuuuaauuuuucuucaugucuuuccuguuccauucauagagagacuugcuaaacuuuucauuuuccuaaacuacuguuuguuuguuuuuaaugugcuuguugcauuuacuuuauuuuuggcucuaauuuauuuauuuauuauuauuauuauuauugaggcggaguuucgcucuuguugcccaggcuggagugcaauggugcaaucuuggcucaccacaaccuccgccucccggguucaagcgauucuccuuccucacccuccugaguagcugggauuacaggcaugcgccaccacacccagcuaguuuuguauuuuuaguagacaugggguuucuccauguuggucaggcuggucucgaacucccgaccucaggugauccgccugccucggccucccaaaguguugggauuacaggcgugagccaccgcgcccagucuggcucugauuuauuaucuguuaaauuuuaaacacauagggcuuucuuugucugccuuugcuaacauaggacuucuggugcuuagcaucuaguaaaugcucaguaaaugaugaugaguggguacugacagucuuaaccauuccucaguuuccuucucccuuugacuguggagcacccucuuuuccuugggaucaagcuuccugaaauauacggaaauggauugagaaaauauggcuuaucaaucacuuuacauuuucucagguuccucuuuaguaaaauaagaaugagaauagaugauuuccaagauucuuacuuuguagggacaagggaaucagaugauuguguucuuuggcagagccuagucugugaaaugucuuaugacuaucagcuuuauuguauccuccccuaguuccuagaugaauaggguggggaagcaggagaaugcaguauaguggaaggaagggaaguggggugaugaacaacaggauaagagaacauuguggugggcagguugggggagggauuaacaggacaguagcaacauuccagaaagaagcuguaacauccugagguaugugaacauuuuucaaaacguauacacaugguauuaucugugaggccuacaggggauuaucuaacucaacauccuuuauucccacacauugcuuacauuaaauuuggggaaaaaauauuuucucuaauugaguuaugaaguccuuggucauguagcaguucaagcuacagcagugacuuuauaauugucuucauauacucuucauuuuauuaaaaauuucucuuuccaaccugguugcuuaaaagcauuguuuugauuuuagagagcuugagacaugggucuugcagaaggaggccagccgucucccuagggaggguccuuguaguauguugggggcugggcaaggggugcuugccuuagaggguuuugaagucccagauuuggaucucaguuuuacaguuucagguuucacaccagucuuaacuauaucaagacuugcuagugagucaaaaugucaguuguuuaucauacugagaaauacuaaaaauccuguacuguuucucccagcuggucaacauagucuucccuggagaagccacauugcugcugaaagauugguuggugcauguuagggaguugcuugguuuuauuaauccaacagaucuuuucugaguuucgcucugcaugccaaguacugaggaagguaccaggauuaagaaaaaauucuagcuuucaaggccucacacucccaauagagaaaaagccacauaaacaaacaucagagccaugugcuuaguguauagaaaagggauauacaggguucccgggggcagagaggagaggcuggcacuauauguuuugaaggaggguuggaguuucccagauggaccagagagaacaacgagugcacaagacuagaggcaggagcugaacgugcuccggaaaccacaagaaguccggaaugaucuuuuuuuuuuuugagacggagucucgcucugucgcccaggcuggagugcaguggcaugaucucagcucacugcaaacucugccucccggauucacgccauucuccugccucagccuccugaguagcugggacuacaggcacccgccccgacgcccggcuaauuauuuuuuuguguguauuuuaguagagaugggguuucaccauguuagccaggauggucucaaaucuccugaccucgugauccgcccgccucggccucccaaagugcugggauuacaggcaugagccacugcgccuggccaagacugaucuuuaaaauuuauugucauuaagccuuaaagaccgauaagaaauuggguccuugaaacuuacuugccgagaagucuguaaaauucauagugacuaggcauggcuccccuccgucaccuagaaagugaugcagaccuggugcagcggcucacgccuguuaucuuagcacuuugggaggcugaggugagcggaucaccugaggucaggaguucaagaccagccuggccaacauggugaaaccucaucucuagucucuauuaaaaauacaaaaauuagcuggagugguggcacaugccuguaaucccagcuacuagggaggcugaggcgggagaaucacuggaacccaggaggcggaggccgcagugaaccaagauugcaccauugcgcuccagccuggguaauacagcaagacuccaucucaaaaaaaaaaaaaaaaaagaaagugaugcagcuacacagccugcucuuugucuucucuccuucuagguuccauucuguacagcagugauuuucaaauuuuggucucuguaucccuuuauacucuuaaaaauuacugaggaauccaaagagcuuuugauauuuaccacaucuggaguuaaaaccgaggaaguuuuaaaguauuuauucauucauuuuuuuaaaaaauuacauuuuaauguaaacaucaguuuauuuaaaauaacuauauuuucugaauacuaaacauuacuaaccaucagagaaaugugaauuaaaaccacauugagguauuaucuuauaccagucagaauggcuauuauuaaaaacucaaaaaaaacaacagauguugggguggaugcagagaaaaaggaauccuuauacccuguuaguguaaguguaaauuaguacaaccucuauggaaaacaguacggagauuucuugaagaacuaaaaauagaacuaccaucaucucacuccugggcaucuacccaaagggaaccauuguauaaaaaagacaccugggcuggugucuugggaagccaaggugggcagaucaccugaggucgggagcucgagacgagccugaccaacauggagaaacccggucucuacuaaaaauacaaaauuagccgggcgugguggcgcaugcuuguaaucccagcuacucaggaggcugagguaugagaacuguuugaacccuggagguggagguuguggugagccgagacugugccauugcacuccagccugggaaacaagagucaaacuccgucucaaaaaaaaaaaaaaaaaaaaaaagacaccugcgcuuguauguuuaucaucguaccguucaccauagcaaagucguggaaucaaccugggugcccaucaacugaugauuggauaaagaaaaggugguauaaauauaccacggaauacuaugcagccauacaaaggaaugaaauuauuucucuugcagcaccauuuguauuucacauuaucuuaugugaaauaacucaaauacugcauguucucacucauagugggagcuaagcaguggcuacacauagacauaaagaugaaaauagcagacacugggaacacaaaggggaaagggugggaguggggugagggcuaaaaauuaacuauuguguacaguguucacuauuugagugauggguucaguagaaacccaaacuucauuaugcaguauauccacguaacaaaccugcacacauaccccuggagacaugaaaaccaaaacaauauuuuuucuaaagucuaaaaaucuuagcgagaauggauacauuguuuuaccuuuuuguuuuuacaaaucucucugaugccuugcuuaagagaagauacauauauucgcaugucugccucugcacucaaucugaugcaauacauuauuuugguugaaaaauaugaaggaaaucuggguucauccagauauguaauuggcaaagaguauuuuaauagccuuuucagauaauuauggauauucuucuuugauacuacaacaaaauuugacaagcaguaguuucuuaaagguuaguugccauguaguaucugaaagcauaugaacguuaauauucuguuacauuaaaauuuuuuacuaaugcaggguuuuguagcauuauacauuagucauuuggaaaauauugagucacuggguuauucagaucuuccggauguugauguugcaccauacaauaccaaaaaauuacauucaucacuaucaugacgaguauugggaagcugcaagcucauaauaguaaauaaaaguauuccaaaauucuaguucuuaagaggucaaauuuuaucauuggcaacaaauacugugaguuguuuuauuugcagugacaggcggacuuuauucauuucaagaaaaaugugugagagcuacccagaucugaauggucaucacugucugucuguucugucaaguacaaaugacauacccaggaagaaaguggccauuucagcucccaauucaaaugaucacacaguugccuuuccugagacaucuuacuucaggaugcagcaauaguguuuucugcauacuuuccauuuugucacaccaaauauuuuaaaagaucugcauuccagggucaaaauuuuuguggaaaaaaaaaaagcaguaaucuuuacugcuuugucaaggacaguuuuaagugaagcuggcuuucccuccuccacuaagaguacacaacagugagcguacgacuuggugcaguguggagccacugccuucaugcagccucaggcacuggcaguuuuacccgccauugcuuuugcaccaugagugaaaauacuaacacgauaaacaaggcaaauaacaucuugguaugauuaggaaaauggguuuuaccuaauaaccccugaaagggucuugaggauuccaagggugugcaggucacgcuuugagaacucguggcguagugguuaagagcaugacucgggguuuugauugccugcguuugaauccugcuccugcugcuuaugagcugugagccuuugggagguuauuggaccuuuucgugacuguguacucucuguaaaauggaugucauaauaguaccuaccucacuaagcaaaucuguucaauaguuaaaccauaaauauuaauuaguauuuugaaaauuauaagacucaccuaguuuuuugauuuugugauuggcugguugaugggcuggggaaauggccaaagcccugcuugccuugaagcugucuccucugucagucuuccaggaugaaugagacguccaccauugucauuuuaccuuuauggugguaaaguacauguuaacugaguuaaaaaacaaaaacacaaaaagcccauauccuagaaggguaacaugugagugagcgacuuaacagggauuggugaaucugguuaaccuaccaacucuugccacccgagucaaggcgcugaugggcuggaggagcggagagcgccugaugaagggagcaaggggaaggggcccaggagcagcaagggucuggcgccgugggaaagcuggaaggcagugugagaguguggaucagagggcgcucuagggugggguaaagcgggcagcaguaacuuugccucucauaggcugggguugguccuggucaauucuuuauuuugugugaaucgcaaacauaguucagguauacguaacggaagugccccucccuaugcauucuccagcuguaggguacagucaucuccggggcauuauaguaaaucucauuaguucagaccugauuaauguugaacucacgacuguugagauguagguagugcaguauacagaaaagaacaagagcucuggaaugaggcaugucagggcuggaauccuggcuccaucauagacuagcugcauggccuuggguaaaagauuuauccuuucuaagucucuguuuagucuguguaaaaugggcugccaguaucucaugaggggauucuaaauauugagagggcauaugauagacauucaguaaaugccucuugccuucccugugccaacuuuguuuauccuccacuccaucuaauuuauaauauucaaacagugucaugauugcauuuuuaguuuuauuaagaaauugaauuuuuaggaaaaaaguaaauauaggaagaggaaggauuaugaugcuacugcuucuccagggauuucaaguaaagucuuuuucacaaaaccauuacucuuccucuucacuguuucuggggcccccugagguguucucauccacagcacuaccuuuuuguucaccuguucaaccugugaguaauccaauuacuguucugucuuugaggccaagagccucaguccaagccagccauguucaugcugugucugccccaagugaggaggcuaaggcuggugcauagcccgcucugugaggccccuccccacagccucuggaucugcccagacuaaccuuccggagggcucugcgucucccuugcuguucuuaacgaucuccauugcuccugugauuucuuuuucuuuuucuuuuacuuuuuuuuuuuuuuuuugagacggagucucucucugucgcccaggcuggaguucaguggcaugaucucagcucacugcaaccucugccucccagguucaagcgauucuccugccucagccuccugaguagcugggauuacaggugccugccaccacacccagcuaguuuuguauuuuuaguagagaugggguuucacgauguuggccaggcugguuucaaacuccugaccuccggugauccacccgccuuggccucccaaagugcugggauuacaggcgugagccaccgugcucggccuccuguaauuucuucuguuguuuccagaaucuggcuggcugcaccuuuuuuucccacaacccccuugguaaguuucagagaaccuuguggucauuaauguaucuauuuucacagccuccccagaaacaagccucuucuguauuacagaucaaagaaccuguuacugacacaaaaggaaucuagccaacuggacuuccccacacagaaggcaggcccuguucuaaucuugccuuggcuuuugacuugcuguguggccuuuguuuccucauccaacgauaauaucuaccucccaggaaugcuggagaguucagcaaauguuaagaacuguucucugaaggcugaaagauagguauugggucuauuacaauggcagagaacucaaagcacuuuauaggaaucuaauuuguguuuuaucuuugugagguagauaaguggcagguguuccugugcccacuuuauaccuuuaggaaugugcauuucaccaucucauuuuagcaguuccuacugcuucccgcuuccagacccacaggaaauuuccaucugaauggagacugaaaacauucugauguguacccagcaggguuuguaauuucauucauuccccaguuugugugucuuguuucauuuuuggucagggauggagaggcccuccucugaccguggguccauuccuccucugacccuggguccauuccuuauuaccuguuggguuccagucccuuuucucaaucuuucuucucuuucaccucucuguagcauuuggcacuaaugaugaucgcaccuuuccaaaacuuguucgugaaauuauacucucagaauucugcaucugugacuggcuaacccuggucccgcucaccuguucuccuaaauacaggcaugaucugagaggugaucucauccauuuucaagguuuuaaccaacaccaguguucagcuucuaguccuggauuaaguaauuaauuuauuaauuuauuuuuugacaguuucacccugaugugcaggcuguagugcaguggcauguucauggcuuacuguagcuucaacuuccugggcucaggugauccucagccucccaaguaacugggacuacaagcacacaugcccgacuaauuuuuuaaaaaaauuuuuauagagauuggggucucaauauguugccaaggcuggucuagaacuccuggccucaagcaguccuccugcuuuggccucccaaaguguugggauuacggaugugagucaccacagccagccuaguccugaauuuguaacuucucauuugauacuucuuagauuauacugacaucaugcaaauuccauguauuuagaauggaauuuaccuccucuccucuaccccgacuauccaccagaaaaaaacaauauuagucccuucuggaugaaccuaauuaugucaaguuccgcuaguaguucaaaccuuggugucauuugaaguucuuucuuuuugucgaccccccacaucuaauuugugaccuuuaacacccuccaccugcccuaauauucagguuugcaucacauaguaucagugcucuccuacugaguccccugccgacaaccucagcccacugcaaucagguuagccuucuggaagcguacaucuugcuuuuucaccacuuucaaaccuuuccauggccaucuguugccuuaaaacaauuauauugauuaucuguugcuauguaacaaacccaaacaaaguggcauaaaauaaccaccauauuaucagacucacagauucugugggucaggaauuuggaaaggguacagugggaugguuugucuuggcccuguuaugucugaggccucugcugggaauauucaaaagcuggggugaauugacaucuaaaggcuuacuuguucacauccuuggcgauuugaugcggccugucagcugggaccucagcuggggcuguuggcuggaacaguggccucuccauguguugcuugcucuuccucacagcaugguggcuggcuuccaagagcaagcauuccuaagaaaggcaugcuaugaucugguuucagcagucacaaacuaucacugucaccauguucagaagcaugacuaucaagggggaggaaauacagaauuccgucuuucaaugggaggagugucaaagucacaccauaaggaaagcauauaggcaagauucugaugcauuccuuuuugggaaauacaaugcaccaaacaaaguccagacugugauauggggauuccuuuaaaaucuggccuaccuugccuuuuaauuagaacacuagaacacugucacucacagaacccuuccuagugccaggugccauguugaaagcaacuucugcauucuuaccugaucuaacaauucugagaguuuagaugaaggagcugaaucaggaaaguuaaagcaacuucgcuaagggucauucaguuaauaaguagcugggugggcuuugaacucggaaccuuugacuccagucugaacuucugggcuauaucgucuccaccucuaccagggcaaaaaccuaggugcagggagagagggaaaaaagggauagcaguuauaaaaccuauuaggaauuaguuguaauuuagacucugaccuccccacuugucuaguugcaguccuagaaagcuuacaacucaacagaaacaagacuguuguuggcugauugauagaucaagcuaccuuagucuucagaccacaugucgcuccaguggacaagaagagcccagggaaugaucucagugacugugucugccucuucagaucuuagccgggcaauuuugcucacgugcugucuggaaggcucucuucuucugguucucuccuuaucuguucauuccugccuggguccuggugccacuuaggacuuuuuggcccaagcauguguuugcugugaccgcaugcucauugcagccccacguagaguuaccgaaauuugucucugcauagucuggcgcuggauuugucuccuucggcuucccugggauugcccagaccgaaccugcuuacccgcuucgguugccucccaacuuugcucgaugguguuuucucugcaggaucacugucuuuuguccucuucuuuacuuggaugaugccuacuuuuccuucugguuccuacacccucccucaaggcuagguauagccuuuccucugagcucccaucguaugcugucuguucuucuggaaugauuucaccccauuccauacucaccuguuguuuaguuccaugggacccucacuagccugggagcuccaguaaggaagaaacugugugucauacacaaguuuggagcucucagcgccuguucagagcuagacaucaaaaacacucgguccuccugaggggcuuggcccagugcuggaacaccugugcuaguuccugucuguuaauggauugacugggguggaugccaccaacagagacacuggggugggaagaagguucagggaucuggagacucagaagauguggcuucucauccuaaauacuguuguuugccuuugaacaaaucacuucucugggaugcagcauccuuguuuaugaagugaagggauuggccuaaccaucuucccagcccuaauacccugugaaaaugacuuuaucugauaagcuuuugacuguaggcugcuguggacccaagcagugaguucuaaguauuggaaauaugaucauuuccaagggauagaaaucaauaucaugauuuccaagggauagaaacuuagcuguuugcguaauuuugauugugccccuaauguggagcuguggccgacuggauuugauggaaucauaaacauguucacaaaccuuucccacuucccacauaaaccucagcagaucucaauucugaagacguaaaagucucuguugauuuguauugguucucuccagcuuagccaacgagaaacguuucaacaguuuucaacucuuauuuagcaaaggcagaacaaaaugacauaccccuuugggaacaaaacaaagcauguuuuuauggccaagaguuuucucuauauuaaaaugaaggcugauuuugaaaacacucuaucauaguggguucuuguaacucaauuauaauuacauaauuauguaucauuugugcauuuauauguuuauagcacauauauauguguacuguguauauguauauguguguuuguguauuuguuuauauaauuauaaaacuauauaaaaacauagcaucaggccagaguucucuacccgccagcccugacguagaaagggcuguuccuacaguuuuccagugagcugugagcagcugaggugucauuucccagagucucuguguaaccuccaccagauugauuuuucuuaguuugauuaucccaggucuggauccuacaagccucucauuuuaccuucccuguuuccaccuucccaccuucccaccauaucacuuacuuccaagcucacuguaccgccuccagaaagcacaaaaugacauaaaauugaaaacuuaaauccaucaauacugcuccucauaaaaguucaucucccaguuggcugguggaggaaguagaaggcaaugcuguaguaaagcgugauucaguucuuguugcaguuucuuccuuacuuuuugaaaauaacccaugaagcugaauuacucucaucuuauaucucucugcaguggcauauccugauggugauuuccucuuuuugugccucaguuucacccccuauggaauggggauaaacacuugcggcugggcaugguggcaugugccuguagucccagcacuuugggaggcugaagugggaagauugcuugaggccaggaauuugagaccagccugggcaacauagugagacacucucucuacaaaaaaaaaaaagaaaaaaaaaaucagaugugguuggugcaugcuacuuaggcgacuaaggcaggaagaucccgugaucuuauaucaauaaaauuaaaaaaaaaaacaaguacuugccaccugaaaguuucuaagaacugccaaggaugcugguuagugauaagugaaugguugguaaauagaagacauaucugccacccagaagaaaagcaccucauaaacagaaaacacugcccugacuugcugaaagagacuucuuuucaagcagaaaaagccaggaagaaagccaacauugcugaaguuuacccaggccguguuagcccugaugucaaaggaacucacuaggugggcugguucaugacuuuucagaugagagugagggaggugguagacagagaagaggaagacagguacaugagagaccuacuugaggcuuagacugauaaacaguguuuuauuagucuggaggaaaccagcaugaaaguacaguuuuuagacaaagacuugauuuccaauuaaauacauaauucacuugcugagaugaggagguagcaaaauuaaaaguuuuaaccauuaaaaagagaaaagaaaaaaaacugcuugaaagaagagugggccuggugcaguggcuaugccuguaaucccagcacuuugggaggccgaggcgggcggaucacuugaggucaggaguucgagagcagccuggccaacaugguaaaaccccgucucuacuagaaauacaaaaauuagcugggcauugugguggguaccuguaaucucagcuacucgggaggcugaggcacgagaauuguuugaggcagagguugcagugagcugagauugcaccacugcacuccagccugggugacagaucgagacaccaucucacaaaaaacaaauaauaauaauaauaaacaaaaacaaaaaaagaagaagaagaguaugagccucuccuucaugugugucauucauuaauugguuaaaauccacacacuaauuuuuuguuccuuuaauuaagacgccuggggcuucuuacucuauugacaguacacaggagguggcauuuaugagugcuuccugacaucugcccacucacaugugugcaagcgugugcacacacaacuuguaggcauccagaugucuuuucugucuuuccuuugaccacauuacccuugaaggacguuucccugugucugcugcacuguaauggaguugacuguuuucgacuaccuucucacacagcaguuacugucugguuucagaauuucuuacugauuauguaaagcauaaugacaccagcccucacaugcagcucaaggagaacagcucuggaccucaguuuccuaaucugcaaaaugaguuucuuccaaagccugaagcugagguucuucuuugaagaaugucagcuguaagaucugccucugaauaacugggugaguggaguggguucagcagcaugccuucguaguggccugucaguguccuuagauaucacaacagaccaacauccaguuaagagcugcuacaagcaacaagcuucauuuccagugcugugcuagagggcuccccuggcucaccagagccaauugugugcauccuuuccaauuuccguuuuggugauaucauguuaguagcuuuaaauaggcuuugggggccgggcgcgguggcucccaaaggggccgggcgcaguuguggugagucgagaucgcaccauuacacuccagccugggcagcaagagcaacacuccaucuaaaaaauaaauuaauuaauuaauuaaauaaaauaaauaggcuuuggugagaguauuuacaccacagaaauuggcaaaaacuacagauugcuuuaucucccccugcaagagccguuuuuuaaauauuuaccagcauagcacuggauauaucuguuauucuagugcucucacuuagcugguagcccuuucuuauagaccacggccagagacugaagacuccuggaaggcagggcacagguucaaugcacugcuuuacgcucagugcccacaagcuccuuguugauggaagguugccugggggagaauauuuucccacuuuccgggggauuucacuuuagaagggacagucacaauuguacaucugcagcuguuuccacaccagaguuugaguuuguauuuauucauggcccuuggauucaguguggcuugcuuuucucauuugaguuuguuucuaucaaggcucacuucuuuauacuccaacuuuucuuccuuccuuccuuuccuuccuuuccuuccuuccuuucuuuuuugagacagagucucgcucugucacccaggcuggagugcaguggcgugaucucggcucacugcaaccuccaccucccagguucaagugauucucuugccucagccuuccaagaagcugagauuacaggugugcaccaccacguccagcuaauuuuuguacuuuuaguagagacaggguuucgccacguuggccaggcuggucuggaacuccugaccucaggugauccaccugccucggccucccaaagugcugggauuacgggcgugagccaccacacccagccuguacuccaauauucacuccccagucaacacuccuggucauuuuccaagcucaucccugccuuuuuucugcuuaacuccuaggaauguucaugcaaauaagaugaagcacaugaaggaagagcucugcguagggguguuugagccuguugcugcagcagauugcuagugacagccaucuuguuagcaccuuuauucuagcaaauccaaucuguuuugucuuucauacuacuguucaucaaagauaugcagugucuuacaguuuuguagagcuuugucaugccccacuauccuuaucucacaaauaacuggaaucacaaaugacugcccugugcaaaucccugcagugaucucccauagccuacuguaucagugcaaacucuucaccuuauuaaauaaggccucugcaguuauccccacuuaguauucaucugucucuccauuagauguacccuauuuucucuuguccaaacacagucuguuucuuccucugucugcuuccucuccccacccaaggucaucucugaccaucauaguccuaccgcgguccacacugaauaacaccuggcaaggcaugauuugggucuguggcuucccaagaaugugguccuguaagcuguaaggagcagcuucuugggaaggucugggaagcccagaauagcccaucaaaauggugguucuugacuccaaaagauacaggaucuuaccuuggugucacuucugcgcuguguucauccucucaguuucucagguuuugaucguggcuuugcucuucccugcuuccauuuuccacucagauuuaacccuacccaucugccaguuccaggagggaguuucugacuuucuuuuuuuuuuuuuuuuuuuuuuuugagacagagucucgcucuguuguccaggcuggagugcgguggugugaucucagcucaccacaaccuccaccuccuggguucaagcgauucuccugccucagccuccugaguagcugagaccauaggcacgugccaccacgccuggcuaauuuuuuguauuuuuaguagagaggauuucacuauguuagccacgauggucucaaucuccugaccucgugaucugcccgccucggccucccaaagugcuggaauuacaggcgcgagccaccgcccccgagccugacuugcuuucugauagaguuacugcuuuagcccuggaaccacaucccacuacucccuuggucuuaaucuucucagcuucacuaucugccccacuaguccaagguucagcacauuuuuucuguacagggccagauuacagauauauuaggcccuguggcccauaugguuugugucacaacuacccagcgcugccaaugcagcaugaaaaaagcuguguacaauagggaaacaaauuggguguuuugauaaaacuuuauuuacagaaacaggcuuuaggcuggauguagcgcaggggccguaguuugcccagcccugcccuagucagaugccuauuaaugugcacuccugacaccgguucauguaacugguugccagccugaauauuugauguucguuaguacagcccaugcaagagaucaugucugggacaugcccagcugggaaugcacagugcaaagcugucagugaagugaacagaauaugccauuccuguucauucucacuuccuucccuccuucuccgcaucccaagacugggguuuuuagccuuauaaacucucagugguaccuacuucccaccugguggacuuuccucauuagugcagccugggacauagaugugucuacuuguccucuguugaauccaggugcguuugugucaccuccugcauuuguguacugcaccauuuauuugccccuuagacaauuaauuuuguaucguuucaaagcucgcucuccagcuccugugggccugcuguuucacagucuuucucuuggaacucuuguuugcuguagauguuuuuacaaguucuuagccaugggcuucuuuucuucuagccuuuacaaaccuuuuuucuuggcucacagauuacagucgcucuaucucugacauugaacaaagauuucuaaaacuugaguccuauucucagaguaaaccacucacagcacagaaauucuuccuucaaagguuuuuuuuugcuuggacagcucaguucuugcaucauaucuaugggaggaagaggcaucuguucuguccuggagggaagucagcaggcaggacugaagaacucucagcacugaggagaaucuuaggaagaggccaucuggccccagagaagugaaauacaugccagagucacguaucugggugguggccaugugcccguugguccugaugcccacucuuucuguuuguggccucccaauaaauagaccggggugcccagcccucaggaaaccagucucucucagagcuccacggcugccaaaggccugcaagaagccuggucagagacagagaggacccuuuacauucagaugaucugaaaugaccaacaugagcugaauugagaggcccaguuccaugggcauaagggcagccacuccugcugucuguucacuuguuuauagucauccauugagcauguacaguacuggguggugggaugagaaaaucacagaaggcggagucuggcugggcagcagagauguaaacagagcguuacaacaggaugugauaaauuccacgaacaagccaccagguaagggcugucggagcucugauccaggcugcguagccucucuuuggccccucaguuaaggugaaauguuaaccaggcaugaccuggaaaugaaggauguccucccacuuccauucugaugaccagccagcgcugacaggguuggcuuccuccaugcaccaccauggcccugaguaaauacacucuccuuaaccagaucagggagcccaagacagcugagggcuggugcugugcuucccuaccugcccccgaagaaaaguaggagguaaauuccuuacugaggacgugagucugguggccagcccagcagucuuggcaucugaggagggcuacaggauaaagcagcccacuuccccaaaagcuguucuuuuuauuguuagcagagacauaagaagagaccucugagauuuucuuuguuucugcugaauauggaaagagggaggggaaagaaaagagggauauucuguuuuaacacagagcauauuuauaagauuguauuguagaccaaaaggcaaaucaguuacgucaguguuuauuggauaaaugcugcagaaaauaucauuaaaagaauuccaaaaauaugcugggcagaggaaucauugucggaauaaguaaauacuuuucuaagagcauuacuuugauggaggccuuauucguguguacuaaaaaaauaaaaguucugguguuuuuuuuuuuaaucauguuauucaaucauacccucuacuaaccuaaaacauuccuaauauauuuaauggaucuauuuguuaugcuuucaagaagugugcuaaauaccuguuaaaaacagaagaguauuagaauaguaauuguggagaugcuuuuauuuugagauaaagaggcauuuaauuuguugguuaaguggaccuggcagccacaugucaaaaagaagugaggaaucaggcugggcgugguggcucacagcuauaaucccagcacuuugggaggcugaggcagguggaucaccugaggucaggaguucaagaccagccuggccaacauggcaaaaccccgucucuacuaaaaauacaaaaaaauuagcuggguguggugacgggugcugguaaucccagcuacuugggagguuaaggcaggggaaucucuugaaccuggaagguggagguugcagugagccgagaccaugccauugcacuccagccugggcaacaagaaugaaacuccaucucaaaaaaaaagaaagaaagaaagaaaaaaagaaaugacguaucaucagaagacuguccugauggugggauauagacagccacagaacagggucgaauuacacuugcaccgcacauuucagagcuguagaguucucuuuucugaggaugaaaagucaauaagaagaaaauaucuucugagaagaaaguuagugcugcuggcugugcuuaccugccucccgguguuuaccuggcguguacugacucuguguggggcgugaugauucgugucugagucuuggugaaagguuuaucacccucgugguuuaacucaggaaauaggaagucuuugccauggguucuugccagccuguccagccugcucucuugccuuuccuuggaagcauucucugcuccucucaaaucagaggacuugagauuccucaaauuccuguucuggcugccaugccuuugugugccucauucccuuagaauaucuuucccgaccccucuaugcucucacuuuucccauuggcguauucugccuuccauuccucagagcguugcuaagguguugccucccccugguuccuugccagguuuccccuccugucugucuugccccucaggcacccuccaucauggugcaggcuugucccuuggcagugcggcaugugaggugcacucccugcccacuagccuccugguugggagcaggugguucaugcugucuuucugguaucuaacauaguaaaugcuugguaagggucuguggaauaagugaaaugaaauuaagaaagccaauagucaccugccugaauacugagaaaaagcaaggaagaauucugugaaguuucccagagugaaugggaugggauagguugguugcuuugcuuuuugauagggauggagucuugcuacguugccuaggcugggcucaaacuucugggcucaagcaauccucucgacuuggccucccaaagugcugggauuagaggugugagccacugcaccuaaccauagguucuuuaauauaugaaaaaugaucacccucauuuguaauuaaaaugcaaacaagauaguauuuuucaccuauggaugggcagaaaucaaaaguuugauagcuccauguuuucagcucccauguuucagauacauggggaaaucagcauugcacuguguguugauguuacaaaugcacagcccaauaacuguuccacuuuuaggauuucacuucuaggaguuuaucuuccaagauaugcucacacgugcaaagugagauggauggauggauggauagcuagaugauagaugaauagauauucauugcagcauuuacuuacuuuuuggaaacagcaaaagauuagaaacaucuuguguccaucaguagaagaccaguuuaauuaugguacauucauaaaacugaauauuauacagcugucaaaaagaauaauacuacccuauacuaagugaaaaaaugcauauacagagcauuaauguuuguguuuggguaaaaaaaaaaaggaauguauucauauaugcuuauguauagacuacacgggaaggauuuuuaaaaaaugaguaaugggaccuggaggacugaaguauagauguagaagagagaauuuuucuauucuauucuuugguacauuuugaauuuugugcaaagaauauacaguacuugggcuagacgugguggcucacgccuguaaucccagcacuuugggaggccaagaugggcggaucaccugaggucaggaguucaagaccagccuggccaacauggugaaaccccaucucuacuaaaaacacaaaaauuagccgggugugguggugggugccuguaaucccagcuacucaggaggcugaggcaggagaaucacuugaacccaggagguggagguuucagugagcugagauugcgccacugcacuccagccugggcaacagagcaggaguccaucucaaaagaaaaugaaaaagaguauguagcacuuacuucuaaaauauaaauuuauuucaaauauaccaguugagugguagauauagcuguucagauuugcugagauccacagaaucgcaauguuaaaaauaacgagaaagagcuccaugugaaauaaacaauuuucauucugaugucucaccagcacuccccacuccccucaaaccccugccuuuggagucuaucuuacuuaccuguuaccuugaccauuggaucuggaaagggccuuagacaguuaucuagugguguugccauuaaaccaagccgcccacugcugcuuuuccaauaaaugugccaugccuuaaguuuuccucaccugcugcuaaagcauauuauuuuaaaaaugugaaaaugggcuuuacagagcuguuuagaucaaagucgcaauaacaaguggaguaucccuauauuacuaauuaaccaacaucugaguuaugggccagaguucuguuucuaugcagugaaaaugugaacuuugaccuggugguuuaugacagugguacaguuccuugggugcaguucuggucuucucauucacaguauuacaccaagacacacacacacacauauaugucucuugcacacacacacacacacacacacacacauacauaucuguagggcaggcuaugcaacacccucuauucuguucauaguaaauuucaugaaauaaccuuauacuuucaaaaucuggacaccagauauuguacaagaguauccuggcaguaaugaaaguguaagcguaaagcuuccuguuuuaggagagggaagaaauggguaaauggaggcuguagggucaugacacaaguagagucacaaacccauuguuuuuugauuuguaagccauccaauuauaaaauacaguggaguuugucaccuaacuuauuuauugggauguuaaaaauugugacccaaacaaaauucaagauuuguugagauuauuguuuuuuuuuuuccaaaauucagcaucuauuuguagccuaagguccaugugggauaccucuucuuucugcuccuuaccuucuccuugcaacaguucuguuuugcugucaaaaugagguaaaucauagauuuagaaagaaucuucucugucucauggcugaggcauuagagagguugaaugacugacucagcaucgugguagagcugggauucaaauucguaucuccaguucccacuuggcauaucucucacucugcuucucuauuguguuggaauaauggcagccuuugguaacaauaaaauguuuuauuaggaguggggagaauuaugguguuagaaaaucuagggaauauauuuaaaauuuguauuuuuucuuacgucauuguucccuaggaaaucaaggcuuuuucuuugcuuauagacacuaguaaauaaaaauguuugcauuuucauaaguauuuaugauugauuauugcaaauuuuacauuucacaccaaggaaaaaagguauucuuaguaaguaugguaaucagggugcuauuaaauaaaaaauaagcauaaucuguugguuugacaguugcacuucucagcuucugaaaccauccugaacuaggucuuuagcugaaucuacaggugacucuguauaacuuuaauaguuucucuccugauucagugcuggcuccaggucaugccuucuaauuaguugccagauucauucacauuucaugggaaaaccaggcaccaacucuccugagcacaucaggaccaaagcugggaaaggggaguuugguguuuguagaguuugcaguuuguggaguacuuucucauaauccuggggcuugaugaaagccaagugagaggagagggcaggagcuuaucuaccauggugacugggacccugugaacagcaaaggagagggcaccuacucagcucucuuccuucucucaaucaugcugcuaaggacaaggcucuaggcaaggaaagguccugaaaguaggaggcacuccugggcugcguccagggaaggaaaaagagguaggaaaaggaauuugaagcugugguagcggggacugccuguggccaccugcugagccagguaggucguucaccguuauucacuucagguauugacucccaugugcaccucucugcugguggguccugcuggagccugcucagcuaauggugcugucuugagaggaagcgaugaaaacucaggaagugaugaaaacucaggaaccgagacagaugcuguucauugucuuuguaggacacagaacucagaagauagugugaaucagccgcuggaaggaauucuguguuuaagcaccagagauguuaacccugucauguucauucauucaucagguucacugagagacugcggugcacaugucacuagccuagaagcugugggugugcagggauaggaauaggauuugcauaguucaggaaagauacaggucagaaaucuuggauuucuaucagcaccacuggaacaauuauuugugcaaaagucuagucucccaaaauugguuauaaaucaaauuugcauauuuaaaguuaucucugcccuaauuuucccccuuuacagaacugauucaaagggauccucagaugaauccuugauaagaugauaaguucuuuuaauaauaagaauaauuuauaugcuccuuuucccuaguuuguucaucuguuuuuaaaguuggcuauucaagguuuuaaaaaguaguuuuuauuguauuuaaaucacgugacauuagguuugagagcuaauaauauucuucagcauuuuaugaugauguucacugauuuguuuuucacuguauccuacgaagugguuuuuuuuuuuauugguauuauguaagaagcuauuuuucuggcuacccucaccuuguugauaaauaacuuuuccuauagcguaaaaaauuuccuuuuccuccuccucucuggagcaaguaaccagaaucacucgagguuuuuuguuuuguucuuuuuuuuuuauuuugagacugagucucgcucuauugcccaggcuugaguggaguggcgcgaucuuggcucacugcaaccucugccuccuggguucaagggauucuugugccucagccucccaaguagcugggacuacaggcgcccuccaccacgcccagcuaauuuuuguauuuuuaguagagacgggguuucaccauguuggccaggcuggucuugaauuccugaucucaagugauccgcccgccucggccucccaaagugcugggaauacaggcgugagccaucgcuccuggccagucuuuuuuuacuuucuucagcauaucccuuccuguaacagaggaaacuucaggggccaaggggcagacucugcguguugggaaaagcuguucugacacccuucuggggcaauggaggugucccaugcuguuaugcacacaauaccuaccccaucuuuaacuugcccacagucuguggaaacagugacucuaugauaccauuuccuagcugcuauuacauuauaaagguacugugcagaaauaggcauuuaaagauauuagguucacuuuuagcaaaaaaaaaaaaaaaaaaaaaaaucuaaaacuacgagcuaggaaaaggcaaggaguuggauugaguaaccaacucuaauuuuauuguuuuauugaaauuaaguucucagaauugcugagaucaauauuguccuauuuuuguucuguucacuacuguaccccaacaccuaacauaagugcuuagccuauaauggguccuuaguaaacauuuauugaaugaauuuggaaaagcuuuuaguuuaaucuuagagaucaucccauucuccagaauccaggugaaaugucuguuaaccuccagucgaaaaauuuggguagaggggguuuggauuguucauuccaccugacccucaguuaggugagauggugcucucuugugugaaaugggagauacucuuugauuuacauggaaagagggaggaguuccucuuugagggaggagcaagugauuuggccaacccucuccuguguuuccugcucucuugguagauuuagggcuauauuauagaugaauuuaauuuuccuucaucaccaugacgaucaugaauaagaucaacaucuguuauaacuggugggaauaguuucuucuuuucagaaguaaacugcugucacuuuaacacucauaaacuggaaaugaaagaaauuggcuuguuugaagaccagugucuuuaguaagcacguguuccucuuacagucgaaagacagaaugugggauggagugggccaggaaaaagaagccagcgcccagcagcaagugccccuggggagcuugcugauugcugcgcacaugcugugcuccagacacugcuugggcugaagaggaaggaaaaaacagacacagguaguaggggaggaaggaaagggacagauucaagugcuguuuggagaaccaaagagaacaauuuuuuggaaacuaauugacaagaugcugaaaggauggcacaguugguguuugggcaugugacccucuuggccuuuacaaagaugguuuuguauuuaccaugugccacacaaagcaaacauuuauauacuuggauuauaacuuguguuguaucauguuuguacauguuauuuaucugagcucaaaugaugauguguaaauauuuguuuuuacccucguuagucuuaauuacagauaaugaguugaggaccauguaagggugacuaaucacuucucuaaaaacacaauuugguuuuguuaaccggaaucuucaucacagcagaauuaaaacauuaaggaaaaugcuuuugguuuuuacucuguuuagaccuugaaaaacugaaagcaggcaugcagauguuuggcucauaacaacucagccuuacaucucaaagucucaccuuccugaauccaaaugcauguuuguacucaagcacacgugaauguucuugcucuucugaggacuuugucuagcugucugggauucacucugcccuucccuguagagcaauccaugcuuugaggaagguucucaaacuugaucuggccccaugaggcugggcacugcccugauuggagccagggauaagcagauauuucuugugucaccauuccacccucaggcccuuccauguaugugcugcaccccgccgugcgccaggggagccugaccaucaaccagaagucggcuaauucaugaaggaguuuacaguuaauaccuuuaucaccccucuaaagggcauuuauauuuaaguaaauccuuuugaggagcaaagagugagcuaucacagugaaguuuccaaaauaacccuuccuggagauguuuuuggucagugacucuacguugcgguugaugcugagaaggaaaagcuggacauccuuccgaaggcacguuuucuuaagguuugccaguggagggggacaucuugaccaaaauucauugaacuaaaauacaugccugaaauguaaauuuuguuuuuggugaauuaauaauuccagugacauuugaagagcaaaacuuuaaauauauagagaccacaagucaaaaauaccacucccuaaccaugaucccuaacugugagacucagacaagggacucaucagcuccucaguguauuucucugaaaaaugggaauaacaacaccuaguucaaaaggguaaggcuuaaaugagauacuuagcauccaugaaugucaguaguaauggugauuugggaaaaccuucaugccaaacacgcugugaagaauguuuuggguuuaccucagaaacauuagacuucaucaaauaaaauaaauugagaaacggggaaaagauaguguucagcgaagcccuuggagaaguucuaguaaaacuugagcuaaaacuacguuucuuucucuacauugcacagaaugaguugaggagagggaugguggaagggagagaugguauuaucguagggaauuguauacaaaccuugauaaggauaaucaccauuuuuuuguguuaggguuuuuguuuuuguuugauuuccgaaagagguccuugacccccuccucccaaaaaauuaucauguuucuuggaauaauuauauagauuuuuagucuuccuucaguucacauaguugagcuauucaccacuauuccaguaaaaguaggcucuucgguggcucacgccuguaaucccagcacuuugggaagccaaggaggguggaucacaaagucaggaguucgagaacauccuggccaacuuggugaaaccccgucucuacuaaauauacaaaaauuagccgggcaugguagugggcgccuguagucccagcuacucaggaggcugaggcaggaaaauagcuugaaccugggaggcgggaaguugugauuagccaagauugcgccagugcccucuagccugggugacagagugagacuccaucucaaaaaaaaaaaaaaaaaaaaaaaaaaaaaagccccuucguuacacacugaauauaaauuuaaaaaagcagaauuuuagauagugaugucuuuuuuuuuuuugagauggaguuucacucuuguugccaggcuggagugcagugaugcgaucuuggcucaccgcagccuccaccuccuggguucaagcaauucuucugccucagccucucgaguaacugggauuacaggcgugugccaccacaucugacuaagugauguccuuuuuaaagaacuaaaauacugaaucucugggcacaguggcuuaugccuguaaucccagcaccuugggagacugaggcagguguaucucuugagcccaagaguuugagaucagccuaggcaacauggagaaacccugucucuaauaaaaauauaaaaauauagccaggcgugguggugcgcuccugucaucccagcuacucgggaggcugagguggaagaaucaccagagcccaggacaccaaggcugcaguaagccaagaucacaccauugcacuccagccugggugacuggagugagaccuugucucaaaaaaaaaaaaaaaagaaggaaucucugagaaaucugauaaucuauuucacuagaacagugcgugaugguuucaaucuguaaacaagcaugcuaauuucuuuuuaaugggaaaugguuuuaaccuuccuguuacaauucuguccaaaagauuuauagaauccugaagguggaaugaaacauaauggucauuucaugcaaguucuacucuaacccaauagaggaauuccuucaccaucuuguccaagaguaaccgucaaaccagucuucucacagacaucuaaacaucaucuaaugauccguugacucacugacuuuucuccuuccacuucuuuuuuauuuuugcuagagagagagggucucacucgguacucgguugcccaggcuugagugcaguggcacagucacagcuuucagcagccuugaccucccaggcucaagugauccucacaccucagccucccaaguagcuaggacuacaggcaugugcuaccacaccuggcuaauaauuaaaaaaugaauaguauuauggaauuauccaccaucucuuuuuguagagaugaggucuugccauguugcccaggauggugccaaacuccuggacucaagccauccucccaccuuggccuccccaaaugcugggauuacaagugugagccacgacguccggcuccacuccuuucaacaggaaacaauuaagaaucuuugauggcuuccucaaaagagaaaucuagaauuguguuaggucuuuuugugagcuaguaggcucugagagggcuguggggagauaaaugaauuaaucucagacuauugcuuuuugcuguggucuaaaaguuugugucucccccaaauucuuauguugaaauccuuacccccaagguggugauauuuaggggccuuggagaguugauuagaucauaagguggaacccucaugaaggggauuaguaccucuauaaaauagaccccagagagauaucuaguccuuccuccauccagagacacagcuagacagugccuucuaugaggaacagacccucagcagacagcaaaucugcuggugccuugaucuuggacuucccagccuccagaacugugagaaauaaauuucuguuuauaaccucagucuauggaguuuuguuauaguaguccaaacagaccaagauacaucauauuaagugauuuuuuuuuuuuccuguuucauucaagcagugaacuuccaugaguuucugucucugaauugcccaggaagcaugaguuaugagggcuguucuggggcuuaugguuuugugaacaugaguuuauagagccagggaaguuacuggguucauaacugcaguucuccuggcucaaaacccuuugcagggcugggcacaguggcucaugccuguaaucccagcacuuugggaagcugaggcaggcggaucacgaggucaggagaucgagaccacccuggccaacauggugaaacccugucucuacuaaaaauacaaaaauuagccagguguggugguacgcaccuguagucccagcuacucaggaggcugaggcaggaaaaucacuugaaccugggaggcggagguugcagugagccaagaucgcaccacugcacucuagccugggcaacagagcaagacugcgucuugcgggggagcccuuugcagcaggucaccacaguauuuaauuuaauccucuuaugauuuggcucauaacacuaccaauauucauagggauuugugcuuaucauuuguuuuuucucuuaaaaaauaccccaaacugcuuuuuguucauuguguucauuuucaacaguuuauuuauguugaacacauuucguuuccuaaugcauuuauuuuauuuuggauuccauagaggcggaggcaauuguucuuagucauuuugcaacaaagaaagugacuaaacaauuuuuuuucauugacucuuaaucagucucugugauccucccguguggugucuggguuugagagaaagagagaacuuuaagagacaguugggcuggcgugguggcucaugccuguaaucccagcacuuugggaggacaaggugggcugauugcuugagcccaggaauucaaaaccagccuaggcaauaugucaaaaccccaucucuacaaaaacuacaaaaaauagcugggcaugguggcuugggccuguagccccagcugcucaggaagcugaggugggagggucacuugggccggggaggucaaggcugcagugagcugagaucacgccacugcacugcagcaugggugacagagcaagaccgugucucaaaaaaaagagacaguuggguagaggguuggacuuggcuaucacuggugauuuauuugcuuccuugagcagcccuagguccuaguucaguuuagcacaggaugucccuuguacagagugaccagaaguuuuuaggggaacuuucaaacuaaugaggaauaggaaagacacacuaaugagcgcgugcaauagacuggaaucugacugcagcgcuaaaggggaggagggcugggagcgcuggugguuucugucccagcucggggccgguuagcauaccugccucucuuuacagguaaugcacaugaggaaaucccuuuuaucaucugauggagcucagaaauguuguggaaacagaugggacguauuuggguagaaucccgcauggagccccaaaggacgcucucacaaggcccucuauguugccucucuugcccaaaaguuaccugggaauccuccaguuccuaguuggccuaauucuccaauggaagcuggaauccuacaagcuggguucucacaauucauguuaauuuguucucuagucagacccacagcauaaccaaggcuugguuuagaguucucaagguagcugauagacuuguggcuaauagaccauaugccugaaaacuauggcauuauccuccucacaccaaagcagguguuuugcuuucuuucuuucucucuuucuuucuuucuuuugagacaguuucucucuugucccccaggcuggagugcaguggcucagucucggcucacugcagccuccaccucccagguucaagugauucuccugcuucagccuccugaguaacugggacaauaggugcacaccauccaccaugcccggcuaauuuuuauguuuuugauagagauaggguuucaccauguuggccaggcuggucucgaacuccugaccucaagugauccaucugccucagccucccaacuuuuuuuuuuaauaauacagaugaaaugguucuucaguuucacgagguuccucaauaguuaaauaugauuuuauuuccccagcugauugccuccuuacuuuaagcaacaaauucuaccguaacuaaauaauuucugccaggcccuugaaauucauaacaauggacaucuagcuuaucugaaauucacucaguuggaaccuucuguuaccucuggguaucuacagccaaagauaacguauuauaaauauaacagauuauaaaauguaugcugaggcauuuauauguugaaaguccuuggaacccgucaacuauaaauuaguuagaugagcugggauuacauauauuuuauucuguaguucuuuacaguuugauaguccacacaugugugcuauaaucaauugaccagaguccagaaucggugaagguagccaguucccuagcaaagcaggguggcuccagggcugcauuacucguuuccugguagguggcccuuucccacacacuuaguuuacuugaauuugagagugggaaguucuaacuuccugaauccgaaagccacagggaaagagccuauauauuuguauuaaagagcacccuucgcuugacuucaggucuuauucugcuuccaguuaaaaugaaggugaaauaaagacauguuccugcugcucuuuuuacuucuguuugagggugagcugagggaguugaaggcucauucuggcacacuugugaacugcagguggaggggcuuggugugaaggaguguuuaaagauagagauggggaggaggcagcagcagggagucaaggaaggcaggaguagcccucuccguguguggaaaaagugacuggcagccaggugaggaguggaugggagagggggaggugcaggccaaagauggagggaccagcugggagacggcuguaauaguucuguggcucugugagugaggaugaaaaaugccuuuuaccuguaauuagagaagcuugguuucaucuuuaacauauuggaacugugaaauuauuauuuuaaaggacaaagaauuauuuuccuauuaccaaucacuuuccuaaguuacuguguguuugguuuuuuuaaagcagggcacaguuucagggagaaagaucgauacucucauuugagacugagccagauacuuuccuuucuugucuaaaggaaggagggaaacgaacaccuccuucccucuccuguugacuuccuggcaaagaaaaaauagacaauucguuuuccuggguggggucaggaggaucuucaucaugaacagacugcagccagcagcaggagugcucuucucagccccuguguaugagaccccgugcuagaugguggaauaguaaacaaggaaccuguccuugaugaaaucaccgcggggguugaggggacacagcacuagcagauaaguaauuauggcgaagagugagcuaccagaacaaccgaaaagugcagaggaaacaguucuuucuggagacauucuggaaagcucagcagggauuaugugugagcugcguuuugaaggacaugccagagucccucccggggaaggaggggacaggccuccuggguacccugaugagaaggcauacuguccagaugaugccacaggagucagcagaucucagagauccuaauugcucaugaccccaaaagauaaucccucaggauagucucccaaaugaccggcugaacuccagguuaguugguucuaccguagugaucuccauuucucuuuuuagcucucaguuccuuccuuuccauccugaucugagaucagaggugcgacaguccagcuuuuaagagauuauuccuccaagugucuggcuuaacaaagcaggacauucccaguuacugaacuuauguguaguguuuacuugaacuauuacagggaaaugccauuguuuuagaugcauucaguuaguauuugggguaaucagcauugggcggaguuuuccuacuuuugcaccgugaaguguuugccacauacauuaauaguucuguggcagugaggaugagaaacgacuuuuacuuguauuagauuucaagaauaagaaauaagauuucaagaauaccuaguguaauuauggagaaaaugaggcuugguuuuuucuucuuucuuucuuucuuucuuuuuuuuuuuuuuuuacuuagcagguuccaguauacuuuaaaaaaaauaagucuuguauauuaaggcaacccuaauagaaguuuucauuguucguuuuuuaaagccuguaggauaagacaugaauauauucucaauuuuaaaaaguaaacaaggggugggcaugguggcucaugccuuuaaucuuagcacuuugggaggccaacgugggaggaucacuagagcccaggaguucaagaccagcaggcaauauaucaagaccccaucucuauuaaaaauuuaauaauuuaaaaaaauauaaaaaaguuaguagcuaaaaguauucuuuuaccaacuaaaucugcuuggugcagccuuuuucugugcauuuacacacauacacauugaauaacagguaguuugguuuugugcuuuuuaaaagcaggaucaauuuaaucuguaauuaccucuuuucuuguaacagcauaccuuggagaguuuucuaugacagugcaugcuugucaacuucauuuuuaagagcuguauaauauucuauauucagcuguauuaugauauauguauucaucucucguugguaaauauuuagauuguaugcacucuguuacaaauaauguuacaguugcugucuuuguucacaucucucugugcucauucgugaguuucuuccaauagaauaucuaccaguaaauuguugguuagcaguuggagucaauguuuguauuuggaaauaacaaaaauauuuuucuuuagaaauauuuuauuuucuugagaauucugaugcccuuucuacagacuguuaggcuuggugacaucuuccauagagaauuuccauguagccacuguaugggauggugcuggcaguuuuauucugaacuauugccaaaggccaugucgggaauuagccuucacagcauagagguagaaauuaguucuugauucuuuuuccguccugauacacaauuagugauucuguauagucauuaaagcagcccuaguaaggcacgaauacauuaauauuuaaaaaaagauagacaagacugaaguaguauaugggagcuagaauggugggguugccccugugacauuucauaaaaaggagcugagaaaacuagagccccucauuuaauucauuauuuccccauuuguuuccaucucuguaccucugugugugugucucuccuuuucucuuucugcuugaguuguaacauuucucucuggggcuguugcccagauuaaagcccuggagaaacaugugacuguguauagccacuguuuaguaccucugaccccgcaaggugguacaccacaucucuuuucuggcaaccccccaaaaugaguauuuauaggauuucagugucaagcucuucuauuaaaacaacgucucuaacauuuaaaugcuuuauuuccaggauauccagcauguucucaaagauaaaaaaaaauuacauaacuuauacuguucuuuuuucugucuaauuuuaauugcuuaaguaaaaacaagaaacaaucuaagucauucaaagcuuucagaccagcaggaugucuuggggaaagccucugaaugaaaaggcccaaauguccauuaguaggggauggauuaaauauacuucaggauaccuauguaguuaugaaauagagugaggaagcucucuaacucuaccuugaggaagaucucaagaauaugacugucaggugaaaaaagcaagaugcagagaauguguagaauaugcagauacuucucuaagaaaagggugaaaauaugaauauauauucacauuugcuauuauuugcauaaagaaucugaaggauacgcaaauaacauguagaaaguauuucuggugaaagaggggguggugagacuuuucacaguauaacuuuuuauaguguuuuaacuuuugaauuaggacuguaguaccuauucagaaauaaaaauauuuuuaaauggcauuuugccuuguuagguaagggggcaacuaaaucugaucuuguugaagcccacuauaugaccucaccuguccuguuugagccuagguacacuuuggggucaggucaguugcaggccaauauauuuugaggaagaaggggauaauuguauaaauagaaucuguaugaugacuuaaauucuaacuacuuugguaggaaauugaaaagaugagucuguauuuaaauuauuauuauuauuauuauuuuagcuuguugggauuucuuggguuuuucauuuguuuuuuguuuuuuuccaaaguaauugaaaaccuuaaaacaugcucaugaggccagugugguggcucacgccuguaaucccaaaacuuugggaggccgaggcaggcggaucacuugaggucaggaguucgagaccagccuggccaacauguugaacucccaucucuacuaaaaaugcaaaaauuagccaagugugguggcacaugccuguaaucccagcuacuugggaggcugaggcaggagaaucacuugagccugggaggcagagguugcagugcgccaaggucacaccacugcacuccagccuggaugacagagugagaccccuucuuaaaaaacaaacaaacaaacaacaacaaaaaacccacaaaaauuaggugugguggugggcaccuguaaucccagcuauucgggaggcugaagcaggagaaucgcuugaacccgggaggcagagguugcagugagccaagaucgugccacugcacuccagccuggaugacagagcaggacucugucuuaaaaaucccagcuauuugggaggcugaggcaggagaaucgcuugaaccugggaggcagagguugcagugagccgagaccgcaccaccuauacuccagccuuggcgacagagcgagacucuggcucgaaaaaaaacaacaaaaaaacuaugcucaugauucacaguaggaauuuuuuguugaugccauggugaacacagugagaaaacaaauucaaaugacggguuuaagccgguuuuuauuauuugcuguaguuuguguccuggagaaaguguuauagucugugguuuuaucuuuacaggagcaggaaaauucagauucgaaacaucccuccucaccugcagugggagguaagccagugucaauuuuuaauggguugaugagacauuucucccuucuuuaguuccauuuuacauuuaggaauuagagggccucaguguuucccacaaagcuucuggguccugccucuuucuuuucaguacccuaauguaugugaucuguaaugaguuuggggucguauuuguuucuuucauagaauguguacuuugaucccucauguucugucuuuucaaguaccaugcuaccaagcaccagcaaauaagccaagaaacaaaauauauaccugguugugauuuguaucucaugguuuguugguuuguauguuugagacagugucucacuuugucacccaggcuggagugcaguggcccaaucauggcucacugcagccggguccagggaucuuccuaccucaucuucccaccccagccuccugaguagcugggacucgaugcaugccaccaugcccggcuaauuuuuguauuuuuuuagagaugagguuuugcuauguuguccaggcuggccucgaacucuuagguucaagcaauccaccugccuuguaucucaugauuuuuaaaaagauuuuuaucuuuccagauuauaauuuggaaaaaaaagugaaugaaaaggcaacaaaaguagaaaggucuuuguugguuuuagcagaauuuuuuguuuguuuugaauuaguugcugugacaguuaagguauguuuucagaguuguaaagcuuauaagauuucuaccuuaaaauaaaguaagaauaugaggaguggccuuauugugauuuaaaaacaaacugccucauauuuuauuccccacccaaagaaaacaccgugccuuaaaggaaacaauguuuuaucuaauguuuuuauuacuuuaaaaaaaaaaaacacacgauuauugccugggcgugauggcucacgccuguaaaucccagcacuucggaggccaaggcaggaggaucacuugaggucaggaguuugagaccagcaugaccaacauggugaaaccacgucucuacuaaaaauacaaaaauuagccaggcauggugacaggcaucuguagucccagcuacucgggaggcugaggcaggagaguggcugcacuggaacccaggagauggagguugcugugagccgagauggugccacugcacuccagcaugggugacagagggagacuccaucucaaacaaaacaaaacaaaacaaaaaaccugauuauuauggaacauuucaaacauacacauccuauuaccuuguaaaaugaagagauccuuguaaaagaauuguuaaauauuucaagaaaguggagugagucuuguacuuuauucugcuucucauuguaagaguaguguguuccaaccaucaugacgaaugugauuguuaacaguuacuaagagucugaaauucugcuguguaaccuuagugaacagauuaauugggagccaauaagccaauguaggucccauauauuuguucaguucuaacuguuuuuauggaagaccugagauaucaauuuaauuagauuauuccuauaaccaucuuuuuuuuccuuuaauuuguuugcugggguauaucacuguaguauuuuuuguacauaugaucuugccuucccauucugacauggaagcuuucucuuuuagguguuggauggacuuuuggcucaauaugggacaguggagaauguggaacaagguaauaagugaggaagccuuuuggguuuuggagagagauauuaucuguuauuucuuauagguuaggucaacuccagggagaaauaguaaguucauauuucuuugaaauaagcuuccuagaguauauguauuuacaucuauguaagauguaucuuacauagaugugagagauaucugucucuuucuauguaugucuauguaguuugccuuuucgaggaauauuauuuacaagcuguuucucauauacugugcagugugcucaagcacugacaaacgcugucaggcuaggguaagcuuaauucacuuaggaguaauuggauuuacacgguugcuacuuuccuuucccuggauaagaaaaacagaucccuaaugucuuggacugaguguuacccaaugaauaggacuccuauaccaauaaucccuugaagugcuugugaauugcagacuccuagggcuuacuguagaccugcugaguaagagucuugcagggaagagcucgugaaucuauauuuaaaaaagcacccgaggccaggugugguggcucauaccuguaaucccagcacuuugugacgcccaggugggcagaucacaugaggccaggaguucaagaccagccuggccaacauggcaaaaccccaucucuacuaaaaauacaaaauuagccagguauggugacgcaugccuguaaucccagcuacuuggaaggcugaggcacgagaaucgcuugagccugggaggugguugcagugaaccgagauuacaccacugaacuccagccugggugacagagugagacuuugucucaaaacaaacaaacaaaaacccugaagugauuuuuguguacacucaaguuugagaacaccugucucaggagcagugcugcaaaugcccagaagauacuuuucuuccugccaaccucuuuuuuaucuucuaaagcaugaaauacuaugauuuuuaaaaggaaaacagugguaccuaaagcugauaucuuaucuagcucuuuaagagucccagaaaaguagauuccaaacuccugaugugacaggcaauaauacaugauaaagauuauuuuugccuugaccuagaaaacagaauguaaauucagucauuuacugacugcgaacccuugaaaaagucaaauaaccucacugacucaguaugcacaagugucaaauugagagagaaauuucuacccuuccucugucacuggauaguuguguuacccaaagagaaccuguauaaggcauuuguagacagcagagucauacguaagcugaagggauuguucaaguucacuuaggaaaaauugcaaacaacccauuuucuuguauaugaucuauucugcuaguuuaauuaauaguuuuaaagcaguaauuauucagauauuauucaguuuaugcugcugccugcccaugcccaaaggugaagggaaagagcucagaaagaagacaugauuuauaaggauucuauuucuuaguucuuauuuccuucgacauggaaagaagacucccccugcuuuuuuuuuugaggcggagucucacucugucgcccaggcuggagugcaggagcaugaucucuacucccugcaaccuccaccucccggguucaagcaauucuugugccucagccucccuaguagcugggauuauaggugagcgccaccaugccuggcuaauuuuuguaguuuuaguagagacaggguuucaccguguuggccaggcuggcaucaaacucccggccucaagugauccacccaccuuggccucccagagugcugggaucacaggugugagccaccgugcccggcagaaaagaagacauucuaaugauuggguguuguaggcaagauggucuugcagacaugaaccuguaaaaguuacuaguuaagauuauauuauaaacugaggacaaugcuacgcaagaaaaauauauuccaggucccuggggcaguuuauagguccuagggcagcugugugcuggagaccccccaguuuccagcugccuaacaacaacaggauagaacuguugggcuauuguuuuguccuguuacaugagugauuccugauucagcaggaaaauauuuucaguagaguuuuaggcaacuuuauagaacuuucaugcccagugaaauaaauuauuugaauggagcuuagcucgucacagaaucaaagaacugccugauuuccugaagacuaacaucuuugaagaacagagcauaugacuaagaagugagcacagaaucugagaauccuaauggauagcuuuauucaggagguucaaacccagcccuuucugggagucuacagccuuaucuguagcacuagaaagcagcaaauaugaaaccuuuuuagcauucucugugucagcacugagagaggacaguaaugugcuacaccuccccuguuuugcacugugaggacuucuguggguuaagugugaauuaaagcgugcuaugaacacuccaggccaaggccagagcugggcucggguuuauuacauguaauucucaguggcagcucuuucugagcauuacauacaacucccugcaacccauaaaggcugcagcugcuuuaaaguuauuuaacaaacaguauuuuuaacaguaguccuuaagcuuuucggggucucaggucccuuugcaaaucuuguaaaauaacaagaaaaauucacauuucuacaaguuugaaucauuuuggagggguuuauagaauucuugaagcucaagcauggguccaguguaaagaaucguauauuauagaguuuuauuauuacuuuggacagcagguuuaucauaauuuucuugaauuaucuuuaacuuaauguuguuguuaacuccaaacucccaacagcuuaaaucuuuuaaagggaagaauugaucuagucaccuuuguuuugggaaacauauauuuuugguguuuaaguuuacuggcuuggauugagaaaguuuucucuggcauuugaauuuauuuuuaauuucuaacuauagaagaagaggcaagaaauuaugaucuaagacaagacaacucacaagaguaaucccuuauuagccaaucauagaguuuauacuuucucuuuuagccaaguaauuagaauugucaguuuuauuuauuagauuuaacccacacagucaaagaguucagucaaagggaaacaaaaauagugaugguucaaccuugucagugaaugaauaauuuaaauuaaaauauuuucuuauuguuuuauauguauauccaauuauuuaagaauuaaugcaaauuauaauuaaaacucauaccuugauagugauguaauaaauugauacaaacuucuaggagaccagucugaaaauaugcauuaaaaagcaucauguucuuuuacugcauuacuuuucuucugugauuuuagccuaaagaaguaauucagaagaacacacaauccagugauguuugcaacaaaggugauuuuuagcaacacuauuuagacuagcaaauagugggaacagccuacuuaccaacaauuggggaaugguuaggcaagucaugguacauuugacucacugcaauuuuauauagacauuaaaaaugaaaaauacaaagaaaauguacugauacaaaauacucauauaaaaguguuuauaaaauauguggaaaauauaguucugaguuguucauacgauugauuacaaacguguuauauacaauugauuacaaauuacugugaacucagaugaauaaacguagagaugcagauaacuguggagccagugugaugaggguuuuaugcauuuuucucuaaaguuugucuguuuacauuaagccagagggugacagcacuuuuuccuaugacaguguaguuuuugccuuuucccuagucaacacagacacagaaaccgccguugucaacgucacauaugcaacaagagaagaagcaaaaauguaagcagauuugggcuuauuucuguuuaaauuuauuuguuuuuauauuugaauuccauugaguucuguguuuuuaaauguuuucuaaaaagaugcagaucuuugagcuggauaugugccaccuuugacauacccauggagcuccacggcaucugagccaccuuugacauauugguagagcuccaggguguuccugccaucuuugacaugucaguggagcuccaggacauucacaccgggauauuuguggauuguguagagacuugaaaaauguugagccuuggcaucaaaaccaagaugggagcugugucuugacaugaucgggaauagagggcaccauaccugugacacugugucuccuagacucugcuuugccaaacacuugggaccacuuuuaccuagagcuuccuccaugcacugugaagaggcagcacaagccuauaccaaaacaucaauuuuguguguguaacauuaggagggaauccaccucagugagagcagcagccgagagaauugucugagagugguuacucaauagcaccugguuuggguucuuuucuccaauccccauccucuuuccagugcccauucauuacuucagggaugguuaauuuugagcuuagcuguuaauggacaugagaucaagucucuuaaaaaacaaugaggccaggcaugguggcucaugccuguaaucccagcauuuugggcaaggccggaggauugcuugagcccaggaguuugagaccaaccuggacaacauagggagacccagucucuacaaaaaaacaauuuaaaaauuagcugggaaugguggcuugcaccuguaguuccagcuacuugggaggcugaggcaggaggaucacuugagcccaggaugguaaggcugcaguaagcugugauugcaccacuaccauccagccugggcaacagagcaagacccugccucucaaaacaacaacagccggaugugguggcacaugcuuauaaucccagcuacuugggagggugaggauuacuugaagccaggaguuugagaccagccugggcaaaauaaugagacccccaucuuuaaaagaacaacaaaaacaaguuccuuuuuuguaggagguccuuaaagugccugucaggucauuauaacuagaauuauggucacauuuggucuugcuuuauggguguggcauaaccuuggcuauauaucccaggauuauaguguucuuuuucaacauacaaagauauuuaacccauuuucauacugcuaguuuucaaaauguuaauuuugcauugaaaaagauaaugguucaggccaggcgugguggcucaugccuguaaucccagcccuuugggaggccgaggugggcagaucaccugaggcugggagaucgagaccagccugaccaacauggagaaaccccaucucuacuaaaaauacaaaauuagccaggcgugguggcgcaugccuguaaucccagcuacucgggaggcugaggcaagagaaucacuugaacuugggaggcagagguugcagugagcugagaucgcgccauugcacuccagccuggucaauaagggcgaaacucugucucgaaaaaaauaaaaaaaaagaaaaagguaauaguucauuuaguguuaacuuuaccuuguacacauuuguaaguggagauacaccaacaacucaacuccacagcccuuaucuagcugcugcuuggguggaccucucuacaugauauuacucuauugcuuuuauuaaauucaaaaggugcugcuuuguaauaaauuuacaaguccuagacauuaaccuaguaaaauuggguuaaugcuacuaaaaauaugugaaaaggauaguguauuucgugugucauuuuaagaauauaauagugguauaucauuuauccccuaucaaauugauaaauaucuuuaaauaacagcgcucugugcauuugaagauucaaggacacaaaugcucucuccuaaacugcuaugggaucauaaauguugaaaccauuccaggggcccacugggcaauaguuaacaauucuacuaggaauuuguccugugugcaaaguuguaguugcaaagaugccaauggugacaguguguguaacuguaaaagguuggauacaacagauaucuaacuauaaaggaucaguugcaaaaacuaugguaaaucaauagaauguuaaacagucauuaaaaauuauacugauacugcaguugagucauguguaaauuauacugaaagguacuuagugacauugaaaaauguuuuagaauauuaacuguuuuuuuaaagguuagaacauaguauguacaauauuaacccauuuuuauaagcaauaauauguuuauauuuaagaaagacaguaaagauaguggauuaggauuuuauuugcacuuacauauuucugaauuuucaauaauauguaugaugauuaaaaugagaaaaaaaugagucauaauuuuauacugauauuuauaagaguuuuugauaagggggaaauggccuugagugguggagaaaccaggcuguaauguuggauaugaagccugaccaggcugaugcguugugauuacuuguuuaacuguuaaccguaagcccugagggagcagagauggugucugucuugcucaccacuguauguucagugccuggcauggcaccauauaggcaccuauuaaaugggagugaaugaaccagucuugcgggagggucuuucuuuuuuuuuuuuuuuuugagacggagucucgcucugucgcccaggcuggagugcaguggcaggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccacccgccucggccucccaaagugcugggauuacaggcgugagccaccgcgcccggccgggagggucuuucuugauguugguuucugacgaagcuccccuguccugcugcauuucagagccauggagaagcuaagcgggcaucaguuugagaacuacuccuucaagauuuccuacaucccggaugaagaggugagcuccccuucgcccccucagcgagcccagcguggggaccacucuucccgggagcaaggccacgccccugggggcacuucucaggccagacagauugauuucccgcugcggauccugguccccacccaguuuguuggugccaucaucggaaaggagggcuugaccauaaagaacaucacuaagcagacccagucccgguacgugccuguggggcuuccuuugcuuccuucugagggguccccugcgugcuggugggucucagccacucuuaggucacaauugcuuacaucagcaguggggggcugugcuguaagagacaguggcuucuuucaacaggacuacuaacagacuaacaucaagcugggggcugugacaagcuuucaugcugagaggcuaaaaguucauaaagaggguacugauaaccucacagccaggacuguuccuguaagcgaacuaaugcuuauggaugcauugauuucuacaaaagcagagguuuggagcucugcgggauccuagaacccacucaucauagcucuuccucuuccccugagucagagcccuggggguggccauucuugugacaacauagguagucucacaaagaagugggugagucacugccacgucaagcaagaaauaaagcacacuggccuucuguuuaguuuccucccuguucaaggagacugaacugauuguaagaguuggugaauaaaacgucuuauggaauuguugauuuuuguaucuuccuaagacuguagcaugauguaauaaagcaagcucgggacuugaaaacaaagacuuacguucaaguuguagcacuuuaaaugguuuugugaucuuggaaaagauguuaaccucucugagcaucaguugccucuucuauaaaaagaggguucuggcugggcacccucuguauuacagagacucaucccuguaaucccagcacuuugggaggcugaagcagggggaucaucugaggucaggaguucgagaccagccuggcuaacauggugaaacccugucucuacuaaaaauacaaaaaucagccaguugugguggcucacgccuguaaucccagcuacucuggaggcugaggcaggagaaucacuugaacccaggaggcggagguugcagugagccgagauggcgccacugcacuccagccugggcaacagagugaaacuccaucucuaaauaaauaaauaaauagaggguuccugucuguuuugccaggauuauuaugacaauuagcacaaucagggagauugagugaaauaauuaauaugaaaguacuuaaauugcaaagcacccaauuacugacacauaauaauuauuuacaugggcugguacacuuuauucaggucauucagugggugucuuguaaccugaaagagaaaugcuauuuucuucagaaugucuuauuuauccccaaauaauagacacugauauggaugagucuggagugccacaucuuagaagugaggaaauagagagggaaguuacuguuugguauccuuuuauuuuaaaaucagcccuggcuuuuccuccaaguucacugcgaaagugacuuuuauuugugucuuuuugugcaaaaauuguguaagguggcuugaaaaaaaaauguaacaaguuuaaauagaagugggguuagcucucaaagugugugcccauuuuuuagacgucaaccaaagacuuggcucuaggcuuucuaacaaccaaaguaaaaaggauauaaucaguuauguaauuuugaaaguuaacaaaaacagguaggaccacaacuacccaaagaagucugauaaagucaucaagcuuuugagccauuagucuuaauggcaggcugccaauggaaaggaaaccaaaaacuuaggcagagagagggcaugccucuguuuucuauccacacucaaauauauaaagcuugcuugaauuugguguucggauuuggauuaacauauggcuuuuaaaagcugcaaucaguucagagaccggcacugugccaaugugcaguauuauccuucucacuuuacucuucacuucugcagucauuugaaagacuacacaaaauacuucauuuaccaaacuggcuucauuacugaguuggcuuagugccuuuguccuacagcacuccuguaagaaccguucccuucuaaaugaagcugcaaauaauuaaaauuuggcacaagacccccugcacugcuugccuccuucuuggagaauggcacugauugcaaacgugcugaugacgccuccuugucugucuguguccuugcuguacauggguuggugugacgcuuucuuggggcuaggguccuauccagaugaccuuguaaucauggcuccugauucuuuuccuacaggguagauauccauagaaaagagaacucuggagcugcagagaagccugucaccauccaugccaccccagaggggacuucugaagcaugccgcaugauucuugaaaucaugcagaaagaggcagaugagaccaaacuguaaguuugcaugcaaugcccagaucacucaacagagaaaaagaguagauucucccucauuuaacccaagagguuuuuuuuaaaaacuccaaaucuguuacucaguaacagaggcagggagggauuguguuuaagaaauuuguucccaaguagaauacagugggaaguagaucuuuugcauuuacauauggcugucucuucacuugcaugucucucggugauuuugaugcuucuaucacccauugauaguaauuauugggaggaacauacagacucaugcuguccaauagaacuuucugcaaugauagaaauguucuauaucugcacuguucaauagccacauguugcuauugaguauuugaaauguggcuaguacaguggaagaacugaguguuuuauuuuuuuacucagaguuugguagccauguguauagcuaaugcccauugaauuggacagugcaaguguagaaaguauguugucaccaaagcuaucauuuauuguccuggaaaagauuucucccaccaugcuucuaaauuguuugcacucuuaacauuggauuacauuuccuuaaguaguagaaacuaguuuacacauggcugcuuuauucuucuuccacuuuuuucuucuaucuguccuuccuccucacuaccccccucuccuuuuuuuuuuuuuaagacagagucucacucuguugcccuaggcuggagugcaguagugcaaucuugucucacggcaaccuccgccucuuggguucaagugauucuccugccucagccucccgaauagcugggauuacaggcgugcgccaccaugcccagcuaauuuuuguacuuuuagaagagacaagguuucaccauguuggccaggcuagucucgaacuccugacuucaaaugaucugcccaccucguccucccaaagugcugggauuacaggcaugagccaccauguccagcccuuuccccuuauuuuaugaaguaauuauaggauuccacaguguaaugaggguugucccaguuugaaugacaaauacaguucuuaccaaacaaauuaacuuuguauuauaaaugaaugaguggugauggaauagauaauacaauaaaaauagacuuucaugcugggugcaguggcucauaccuauaaucucagugcuuugggaggccaagguaggaagaucgccggaggcuaggaguuugagaccaggcugggcaacauagugagaccuccaucucuacaaaaaauuuaaaaaauuaguuagacauggugguguauaccuguagucucggcuacucaggaggcugaggcagaauugcuugagccuaagaauuugagcaaugagcuaugauugcaucaccacacuccagcuugggugacagagcaccacccugucccuaaaaaaagaaaaaguagauuuucaguuuggcaaaaucuguuuguggguagcgguggcaguuuuauagagaaguagugaggggugaaucaaauaaugucaaacaugaguguuccaaaaccaagaugaaaaugguccuuaaaagaagaacauuacaaaucuauucuuagauuucauaagagacucuauccuuucuauuaugaauuauuuauucuacuugggcuuuugaaaucccccaaaugccacaguuuaauuugaaaaagacauuucucauccaaguuccugggaacuuaguaaauaauacuuuucuggauuccuuuuuuuuuuuugagacggaguuucacucuugucgaguacaauggcaugaucuuggcucacugcaaccucccgucucccggguucaagcaauucuccugccucagccucccgagcagcuggaauuacaggugccugccaccacaucuggcuaauuuuuguaauuuuaguagagacaggguuuaaccacguugcccaggcuggucucgaacuccugaccucaggugauccacccgccuuggccucccaaugugcugggauuacaggugugagccacugcgcccagccaccuuccuugauucuucaaccuaggugcaaacaacuuaauaaaauucuaaauuagucaaaaagacuaauuuacaacuugggcuuuuauguuuucauguagagccaagauagaguuugaauaucuuagaaaaaaaauuuuucagugccuacacugugcuaaucacugcuggagguugaggcuacaaccaugagcaggacuugguuccugcuuuuuuuuuuuuccuuccccacauaccauuuuuucacccauugguuccugcuuugauggagcaguccagugggagagacacucauuaaacaaauaaugaguaauuacaccaauaaguaauuaagugcagcuauaagaaaugcuacagugaggcuggauguggugacucacgccuguaaucccagcacuuugggaggcugaagcgggcggaucacuugaggccaggaguucgagaccagccuguccaacauauagugaaacccugucucuacuaaaaauacaaaaauuagcugggcgugguggcacacgccugaagucccagcuacuugggaagcugaggcaggggaaucucuugaaccugggagguggagguugcagugagccgagaucgcgccacugcacuccagccugggcgacagagcgagacuccauuucaaaacaagaaaagaaaaaaaaaaaagaaauucuacaguggaaaaauguaguauccaaugaugacauguaacugaagguccuaaugaggguuuuagggggacaaggauuuggggguuucagagaaugccucccuguguaggugacagagcccugaagggacugaauaagagguagaagauauaggagaacagagauccuaaacuuucuuuuuguucauuuaccaaauauuuauugagcagucacuaugugccagacacuauucuaugugccaggaacucagcagugaacaaagcugacaaaaaugcccauccucugaaaguuacauucuaaugcagcuucuucaagcacccucuuuauuuugaggcaguaguaaugcaucuguuagaugcuuuuggucuucaagcaacagaaaauacaagugguauaaccaauaagaaaaggaugucaugucacauaacaagaaguccuaaggcacacggcuccaaggucaguugaaucaugggcccagagacccagaacauuuuucugcucuacguuccucagcaugucucacguucccuugguuauaauaggaugacuauagugauuucagaugugcauucccacaaaaaaguuacaaauugagggagagggcaucccuuccuuguguccuuuuuucagaaaacuucuuuaaaaguugugguuaaacaaccauaacauaaaauguacugucuuggcugggcauggugucucaugccuguaaucccagcacuuugggaggcugagacaagguggaucacuugagucaggaguuugagauuggccuggccaacauggugaaaccucgucucuacuaaaaauacagaaauuagccagguguugggguggacaccuguagucccagcuacuugggaggcugaggcaugagaaccgcuugaacccaggaggcggagguugcagggagccgagagugcaccacugcacuccagccugggugacagagcaagacuccaucucagaaaaaaaaaaaaauuauugaucauuuuuaaguguacuuuucaguagucuuaaguauauucacauugcugugaaacagaucuccagaaccuuuucaucuuguaaaucuggaacucuguaccuauuaaacaacucucuuuucccucucccgucagccucugguaaucaccacuucuuucuaugaauuugacuacucuacauaccucauauagguagaaucauauacuauuauucuuuugugacuggcuuauuuuacuuugcauaguguccucaagguucauguuauagcauguaacaggcuuuccuuccuuuuuauggccaaauaacauuccaguguauguauauagcacauuuuguuuaucuguucaucuggugauggacauuuugaggucuucugcuucuuggcuauugugaauaaugcugcuaugaacauggguuuucaaauagcucuucaagacccucuuuucaauucuuguggauaugugccaagaagugagauugcugggucauaugguaguucuacucuuaauuuuugggggagccuucauacuuuuucccauagcaguugcuccauuuuccaaccccaccaacagugcacagggguuucaguuucuccacauucucuccaacacauguuauuuucuguuauuucgauaacagcuaucuuaauagguaugaggugacagcucauuguggucuugauuuguauuucucugaugauuagcgauuggugauauugagcaucuuuuuauauauuuauuggccauuuguauaucaucuuuagagaaaugucuauucaaauccuuuguucauucucuaauugagauauuugauucuuucguuaugggaguugcaggaguccuuuauguauucuugaucauuaacuauauauuaguccaguuggugcuacuguaacagaauacuaaagaccggauaauuuauaaggaacaaaaguuuauuuggcucacaguucugggaaguccaagagcgugaugucagcaucuggugaggguuauccuaugguggaaggccugaggcagaagcaagugcaagagacagagagaagaaauagguccaaacuaucccucaacccacuaauucacucugugauaacugcauuaauccauucaugauuaauuaauuaauuaaugcaggugauuaacucaucaccuccuaaaaguccuaucuuucaacacuguuccaguggcaguuaaauuucaacaugaguuuugaggggaauuugaaaccauagcaaaccccuuaucaaauaaauaauuggugaauauuucucccaucccauggguugaccuuucacucuguugauuauauccuuugaugcacaaaaguuuuuaaguugauguacucccacuggucuaauuuugcuuuuguugccuaugcuuuugguaucauggugaaaccaagaagucuuugccauguccaauaucauaaagcuuucuccuguguuuuaggaguuugauaguuuuaggucuguuuagguccuuaaccuauuuugaguuaaucuuuguauaugguguaaaauaaugguucaacuucauucuucuauguguguguccaguuuccccagcaccaucugcugaauagacugcucuuuccccaucuaguggucucagcaccuuaucaaaaaucaucggagacuauacgcaggauuuauuucugggcucuauucuauuucauuggucuauuuaucuguuuuuaugccaguacuacacuguuuugauuauguagcuuuguaauauauuuugaaagcaggaagucugagcccuucaacuuccuuauuuuuugaaaucauuuuggcuauucaaggucccuugagauuccauaugaauuuuucuauuucuucaaacaaugcccacugugauuuugauagagcucauauugaaucuguagaucacuuucgguaguauaaacaucuucacaauauuaaguauuccaauccaugaacacaggaugucuuuccauuuauuugugccuuuaaauuucuuucaggaaccuuuugugguuuucaguguacaagucuuuuaccuccuugguuagguuuauucuuaaguauucuauacuuuuugaugcuauuguaaguggcaguguuuucuuaacuucuuuuucagauuguuuauuguuguguauagaaauguaaaugauuuuugcauguugauugauuuuuguauccugcaauuuugcugaauuuauucuaaccuuuuuuguaaaaucuuuaaggcuuucuacauauaaaaucgugucaucugugaauagagaucauuuuaugucuuucuuuccaauucgaaugccuuuuauuucuuuuuuguaccuaauugcucuggcuaggacuuccaguacuauguugaauagaaaugggcaggagugggcauccuugccuuguuccuggucuuagaggaaaagccuugcauucagucuuucaucguugagugugauguuagcugugggcuuuucauaaauggucuuauguugaaguaauuuccuuuuauuccuaauuuuguuggguguuuuuuaucaugaaaggguguuaaguuugucaaaugcuuuuucuaaugacaugaucauguaguuccccccccuucuuucuguuaaugugauuuauuguauugauugauuuuuuaaaaaauguuuauaguaauggggucucacuacguuucccagccuggucuugaaccccuggccucaagcaauccucuuuccucagccucccaaagugaugggauuacaggcauaagccacugcgcccagcuccccauuaauuguaugcugaacaaaccuuccauuccaggaacaaaucccacuuggucguggcuuauaauccuuuucauaugcugaauuugauuugcuaguauuuuguugaggauuuuugcaucaauauucaucggagauaauggucugaaguuuucuuuuuuuguggugucuuugucuggcuuuggaaucaggguaaagcuggccucauggaaugagcuuggaaauguucccuccucuucauuuuuuuggaagaguuucaggaggauuggcgauaauucuucuuuaaauguuugguagcauucuccgaugaagccaucugguccugggcuuuucuguguugggagguuuuugauuacugauucaaucucucucauuauuggucugaucagacuuuccauuucuucaugauucaaucuugguagguuguguguuuccucuagaaauugguccauuucuucuagguuauuaaauuuguaggcauacaauucuucauaauauucucuuauaauccuuuuuaucucugucguauugguaguaauguucccucuuucauuucugauuguaguuauugaauguucuuuuuuuuucuuaaucuagcuaaggauuugucaguuugguugaucuuuucaaagaaccaacucuuaguuuuguugguuguauuuguuuaucucugcucugauuuuuauuauugccguuuuuaugcugguuuuggguuuaguucuuuucaaguugaaauaaaaggauggggccgggugaaguggcucaugccuauaaaucccaacacuuugggaggccgagguggguggaucacaaggucaggaguugaagaccagccuggccaacauggugaaaccucaucucuacuaaaaauacaaaauuagccgggugugguggcacacaccuguaaucccagcuacucaggaggcugaggcaggagaaucacuuuagccugggagguggagguuacagugagcugagaucaugccauugcacuccagccugggcaaaaagagugaaacuccaucucaaaaaaagaaagaaaacgaaaaaacguuaaaauaaaacauaaaauaaaagaaugauagacagcaacacaaagccauaugaaaauauauaguuaucugguaaggguaaauauuaacaaauauaguaaccuguacuguaguaauuuugguacauagaauuuaaaugacaaaaacuuuuuuuaacuauaaaucuauguuaauggguauaaaaacauauaaagauguuaauuugugauauuuggggaugggguaaaaaaguagaguuuuuuaugcaauugaagugaaguuguuaucaguucaaaauaggaugcuaugacuuuaagauguuuuauguaauugcaauaguauccaccaagaaaaaaucuaugagaacgcacaaaagaaaaucaaagcacaucacuauaauaaaaaucaacaacacauaaaggaagacaggaagaaaggaaagaagggacaaaaaagcuacuagacauacagaaaacaaugaaaaugacaaaaguaaguccuucccuaucaguaauuacuuuuaagugcaaaugaauuaaacuccccauucuuggcuaaauggauuaaaaacaggaucuaacuguauguggccuacaagagacuccuuuuagauauaaggacacauauaggcugaaaguaaaaagauggaaaaagauacuccaugcaaaugguaaccacaagagaggaggaguagcuauacuauuaucagaugaauagacuaaaaacaaaacuguuacgagagacaaagagggacguuauacaauguuaaaggaacaauucaccaaggagauacaacaauuauaaauauguacacaccaaaccucagaguucuaaacaugugaagucaacuuugaaagagcugaagggagaaauaauuagcaacaugauaacaguaggaaacuuaagugcccuacuuucaauaauggauaaaacuacuagacagaagaacaauaaggaaauagaauuggaacaacacuauagaccaacagacauacaagaacauuccacccaacaauggcagaauauacguucuucucaaaugcauguggaacucuccaggagagagaacauacaaaacaaaucuuaaaaaauucaagaagauugaaauuauacuacaaaguaucuuuucugaucacaauggaaugaaaccagaaaucagcagcacaaggaaaauuaagagaauucagcauuuuuuguagagcuugucaagugguaauaaagucccucaguuuuuauuuaucugggaaucuuaauuucuccuuuguuuuugaaggacaguuuuaccacacaugguguccuugguuggcaguuucuuucagcacuucaaauauaucaucccacucccuucuggccugcaaaguuucugcuaagaaaucugcagauaguguuacggaagcuccuuuguaugucacaauugcuuuucucuugccacuuugaagauacucuaucuuugacuuuagacaguuugauuauaaugugugucagugugguuuucuguggauuugucccaguuggaguucuuuaaauuuuuugauuuguauguacauuuuguuccucauauuugggaaccuuucagccauuacuucuucaaauaaagcucuaugccccuuuguucccucuucucuuucugggauucccauuaugcuuauauugaucuacuuggcaugucucauaggucccuaggcucucuucacuguauuuauuuauuuuaauccucuaacuugaagauuucaaaugaucuacauucaaauuugcugguccuuuccucugucuggucaaaucugcuguugaacuccuuuaacaaauuuuucuguucaauuguauuuuucagcuccagaauuuguuagguucuuucuuauaguuucugucucuuuguugauauucucauuuuguucaugcauaauuuuucugacuuuauuuaguugucugucuguguucuuguuuaguucauugagcaucuuuacaauuauuuuuaauuacuggucagggagcauguagaucuguguucuuuagagucaguauuuggaguuuuauuuuggucccuugauugggucaugcuucucuguuucuuuguaugccuaguaaguuuuuuuguugggauuugggcauuugaaaaaacaaccaccucucacagucucuguguacuggcuuugggcaguggaagaccugaaaucagccuagcuagagguucuaggaccucucaaaccuuuucuaaucucuugaucccucuggugucugacuguagaacugcaguucuuaaaugcugcuugccucuguuuucagcagcuucugaacucuaaugcugauccuucagugcucugagucagugacacaaaaaccaguuuuucuggcaccuuccagacaagccaaaauguuguaugcauaauccagucuuuguuucugucccaaaggaggagcccagccuuuaggguuuccuccccuuugcucuucaguaugccauguagcggguggggccuugaaaacacugaauguucuuaccuuuuuuacuggauauauauacaucucucucucucucucucucucucucucucucucucucuauauauauauauauauauauauaucuccauauauauauauaucucucuccauauauauaaucucuccauauauauauaucuccauauauauguaucuccauauguauauauaucuccauauauauaugucucucucuccaguaaauauauaucucauauauauaucuccaguaaauauauauacaucuccauauauauauauccaguaaauauauauauauaucuccaguaaguguauaucuccauauauauauaucuccaguaaauauauauauauuuccaguaaauauauaucuccauauauauauauaucuccaguaaauauauauauauauacaucuccauauauauauaucuccaguaaauauauauauauauauauaguuguuguuuuuagacagggucuugcucuguagcccaggcuggagugcagaagugugugaucaugguucacuguagcuuuggccucccuggcucaagcagucccaccucagccucccaaguagcuaggacuacagguaugcaccacuaugccuggcuaauuuuguguuuuuaguaaggacaguguuucaguauguugccgaggcuggucuugaacucucgggcuuaggcgauugcccaccuuggccucccaaagugcugaaauuacaggcgugaaccacggcgcccggccuggaauuccucuuuaguuuacagcggacuucauauuauagcuucucagcugaucuuuagaguucucacagagguguucuggucuaucucuuguuaauuugaggugugugugagggggaaagagaccuguggcuuccuagucugccaucuugcuaacgucacucucccuuguaccuuuuuuuaagagcaaggagaacauucuucacccaauagaguucuuguaauacccucauuggccagaucagccucauggauccacuuccaaccagcuacuacgagggaguagaauuaccaugguuuggcuuauguuaaucaaaauucaugaacuggggucggugagggaccugaccucucccaaaucccaucaucacuugguaccugaacaaaaugacuuccauuuauaagaaaaaagcaagguaaugguuuuugggagacaaccguuauacguaucugaaguguuaacuugcugcuugucucuuuuagagccgaagagauuccucugaaaaucuuggcacacaauggcuugguuggaagacugauuggaaaagaaggcagaaauuugaagaaaauugaacaugaaacagggaccaagauaacaaucucaucguaagccacuuacucagauuacucaugcccaauaauggaacaccugagcauuucgauacgucuaguucauucaucuacuuuucccuaaaaugggaauauaaucauaagugaugcaauuaucuccaucaucuuuuaaaaaaauacauaaauacuuaccagguagacauuuuucacuauggaugugaucuaaaucacugguaagauuugaaauaagauggcagggauucuccaccacaguguguugggagggaauugagucuucucucucuccgccaaaacuuguuugugauuuuuuuauuuuuugggcauuuuauuuuucccguugaaaacaaaauuucucuuuucuucucaugggucaguuugcaggauuugagcauauacaacccggaaagaaccaucacugugaagggcacaguugaggccugugccagugcugagauagagauuaugaagaagcugcgugaggccuuugaaaaugauaugcuggcuguuaacguaagucccuaaugcuuucuucuccgcugguuuucacuaggcuaaaaauacuugccauucagcuaaugaggaagugccuuaggauagguaugcagaguuuuuccugacuuccuaggauaaaagcauuaaaauaaucaggaaaccaacuaguaaauuaugauaagugcgcuggacaacaucacgugaagacauuaaaauuauaacuuugaagacugaaauaaggaaaagcuuaugauauaguguuuauuaagaaaagcaagaauaaaaaaaaaaaaaaaaaaaaaaagaaaagcaagaauaacugggugugguggcaugcaucuauagucccagcuacucaagaggcugaggcaggaggagcacuugagcccaggagguugagacuacagugagcuggcauuacaccacugcacuccagccugggcaacagagugagaccccaucucuaaauaagaaaagcaagauauaaaaguauauaaguaaauuuacaauuauguaaaacagcauggaucagaaugacuggaaggcuacauacaaaaaugaaaauagcuggcacauuagaaaagugggauuuuuuccauguauguagccuucugaaccuuacauaauauuguccuguuacuuuuuaaauuuuaaaaaugcaugcuuuaaaguuaacuucugauuuuccucccuugcuugcugaucugcacuuuuagauugccugauaaauguugucaaccaguugagccuuuacuguauauuuguagcagacucauuagguuuguccuuccugugauugcuaccuaauuuuuacucuuaauggggagacacugauccggcauucaaaaaacaaacaaacaaacaaaaaccuuuaaaauaauuggccaucagcaaaaguccagcucagcucagaggaguaaauuuuuuucacuuuuuaauuagauuuuuuuggauguauacaaaagugaauggaugcuccaauaaguccucauauacccauaauccaccuuuugcaguuaucaacucaccaccuguuuuguuuccucuaaacccucauccacauccacuuuccauaccuguuggaugaccuugaagcaaaucucagaccugauaauauuucuuagagaaauaaaugucgacaaagcacucuuuagauuaaacccaggucccucacugcagcacuuucuguuguacccucuauacuccaggcaguaaucuguccccaucucaccccgacccccaccuuagcagcccacgucacaugacaauuaugaggugugaugagaagagcuagagcaggagacugcaguggugucuucuccccauguuuggauauauuuguggaaguaucaucugacaaucucauuuucuuccuguggguucuugacaucuugugguaaacaucucuuucugugaacaccuggaaaagcuacagaagggccugagugauucauacaucuucaccugagcuuaccacuuagguucauucaugucugugccaaagucacgcacugguaggugaauaacaaaauuacuacaucuuauagacaaaaugagguaaagaugaaggauacgagcacugcuauuccaaaaguucuaaaaaaaagaaaaaggcaaguuacagugugaauguagacaaagauuagaaaauguuaggaaauugcuucauguucagggagacaaagauggaagcagguuggacacagccuggaaugggugaccacguuccucugccucugaagagcuguguggcuaaacccacccccagucugugugaccauccccauguagaaauguaagauaagcaagcaagcaagaugaucacaaagccgacaacuaaauaguaaagagacaaaguuguaaaccaucccgaaccuggcuaauggaguuuacguaugugggaauuuacaucaugugaagaaucugaucucuccauggauagaguuggaaaacacuguuaauccaauuuguuuuaaacagucauucaacaaauauuuauugaguacuuacuauauaccaggcacugagaacacgacacuaaguaagacauucucuguuugcaaggaaauucuagucugaaaggggaagagguaacuaaacaggcuauucacauaccauguaaugagugcugucuuagggaaacaggaaugcuggagagcacagacagggcauuugagcugaucuuugggaugaaagaaagcuuccugcaugagggguaaucuaugcucaggugaaacccacaggucaguaggacuuagccaggugagaagggagaaaagcacuuccuugccuaggaaauaaauagcaugugaaggggcucagagguauuuaggaaacaggacuggccagguuggagaugaaggguuagcaggagugaggcuggcaagguggcugccauccccaggaagagccucauuuuccaugacaagauauguagacaugcccaaguguggcagagaagccuugaaggaacaccauggucagguuaagauguggcacccaccucugauacaggguaggaagagccugggcagagcugauuaggagacgcuggugccauuaagacaagagagggagguugacccaggcgugcgggccucucuggucuccucccuucaucuuuuuucuccauuucuauucccagcaacaagccaaucugaucccaggguugaaccucagcgcacuuggcaucuuuucaacaggacuguccgugcuaucuccaccagcagggccccgcggagcuccccccgcugcccccuaccaccccuucacuguaaguagcucagcuuguggagguuugcuuaugcgcugggcaccuccaggcagcagcaugccucugcuguguggaaucagaacggaagcuuucauuuaaaggccaugcucgaguagagaugaauccaauguagguugaacucaacauuucuuaggacuucuuccuaaugggcaacuuaauauuaaaccaauccucuaaacacguguucuuaaauauaguaugucauaacuagcaaagaaagaaacucauagcaaauucaucaacuagaagcuaauuuauuauagaaaagaacuuguuagcucaaauaagaacauuucaugagugaugguaauuuauuaaaauauauaggguaccuggaugauucuugaagagagauauauaucuacauacauacaugugcaguuucuaccuauguuuacaagucaaauguauugucuuauuaauaggcaauuuuuaaaagaaaauauuacauacauuguuuaugucuaaacacuuagcacaaugccugguauuuaguaaguucucaauaaguauuuguucacaacagaagaagaaaugugaauuuugugaguguuuuacuuauugcuuucauucacaagcauuauucaagaucaguacauuaccaaauugggggcucaggauacuugacagcuuuuuuucauuccuaauuuuucucuacgcagacugcuuauuuuuaaaagcaaacuuucccccaauguuuaugcuguuuaaaugggaagaaucaggugggugaacauugccucagccauucuguucuuuugagaagugcuuucugggguaggcuucacauugugugaauucccaguagcuuuuuggguuaucuguagagagacaggaugaauccccugugccauccugccaacaaaaugcagacacaaacuggcacccacaugcugagucacauauaugcacacauucugcauucuugcuuauauauggcucuucugaaucuuuucuuuuucuuuuucuuuuuuuuuuuuuuuugagauggagucuugcucugucgccaggcuggagugcaguggcgcgaucuugucucacugcaaccuccaccuccuggguucgagcuauucucgugccucagcaucccaaguagcugggauuacaggcaugcaucaccacacccagcuaauuuuaguagagaagggguuucaccauguuggccaggauggucuccaucuccugaccucgugaucugccugccucggccuuccaaagugcugggauuauaggcaggagccacuacgcccagcccccugagucauuucuaaaucucuucauaccaccucuuuaguuauaucauuuccccuuaaacugaaggaggggacugacacugagccuuguguguugaguagccugaagaugcaguaugagggauuguggcagcugucagucacauggcugcgccaagcaguaagaauagcuugggaguuucacaucucuguauuuuugcugucagaucugagaauggcccaaugagguacaaccaaguggcauugaggcacaucaucauuucuugggagagaggcuguacauacagccccacagaagauaaccucaaacguuaggcuacccucuuaguauagguaauauaaguggggagagaaaaagggcauaauaaauuagaccaauucuaaaaucgguaaucuaggccgggcaugauggcucacgccuguaaucccagcacuuugggaggcugaagcagguggaucuccugaggucaggaguucaagacugaccuagccagcauggugaaaccccgucucuacuaaaacuacaagaauuagccaggugugguggugcacgccuguaaucccagcuacuugggaggcugaggcaaggagaaucacuugaacccuggaggcggagguuacggugagcugagaucguggcacugcacuccagccugggcaacagagugagacuuugucucaaaauaaauaaauaaauaaauaaauugguaaucucaaauauaggagucagcaugcuacaaccugagggccaaaucuagcucaccauuuauuuucauuaauaaaguuuuuuaggggacacagccauggcuguuuauauacauauuaucuauuccugcuuucccccuguaguggcagagcugaguagauacauacagaucacaugagccacaaagccuaaaauauuuaugauuugcuccuuugcagaaaaaguuugcugaccccugaacuaaauuuaacaaggagagaauuuuucuuuuaauagcagaauauuuucuaaacuugaaaauagguuuugcuaguuggaaagcuuccuuuauaucucagauuuuuacuaaaauaguagaauaaccauuuugcuaaaauauguguuuccuguuauuuguaaaauagguuuuaaauaaaaaauuguuaaacuaaaaacaaaacaaaaacaaccagguaauucugaucuugauuccaugggucaauauuagaguagcuucuaauccaguacacugacugacugagacaugauggcuucugcagacaucuccuucaugcagcugcagaagugcagguccaauggcauggaggcggcccucacugcccaccugugcaggaccuaggcuauuccuggagugauaccuggagaguccacaccgcagaccugugggcuucccuggugggcccagcagaccugugggcuucccuggugggcccaggacuccugagaacagcagcauagggugguggagauacuuuaaauacuuaaaguauuguuuuccugucacauaggcauucaaauuucaaggaacuaagauauuucuugguugcuuuuguauaucacaaaguucugaugcuuuugcuuuuagcauccaaaggucagggagucugugucccuccuuauaacuggcucauccacaccuagguugguuuccgaacucuggaauuuuuaaugcauauguguguguaggaaaacuuuaccccccccccuuuuuuuuuuuuuuuacuguuuuucugguuauaauaguaauaugugcauaguguuuaagaagcagggaguauguacuuuugaauuucccaaaaaacacauuucucugauccuaaaaaagaagcagcaaauaauacagaaaugcagaacgugcaaguuuuuccuuaaccuagauauaaccaguguuucuguguagguaugugcguguguguguguguauauuuauauaugauuuauauuuuucccccaaauuuucacucuuggaauggaaauccuuguguguauacaucuugauucauuuauccaauuauuuccucagaauaauuuccuggaaguagaaucaaagaaucuguacauuuucuaugcugauacauaguauauaauuuugauacaaaaaaagguauauuacuuuucauucccaucaagaguguguguaacggagcaagauuuuuucuuccauaccaccacuaccaauuccucgcagucugauguuuuaaaauauaugcuuuuuuaaauuauaugacuaaacaauuucauauuagccauuuuuguucucucugauaaguugcuuucuguauuuuuggccccucaguuauagcuuagguucuagagcagacugcgugcauuugaauuucuacacugucacuugcuauuuuuaacuuugagcaagugacuuaagcucuucaggucugggauuaauaauaguaccuacauuaggggauuguuauaacgguaauuaaguuaaaaccuacauacaguaacugcuauguaaaucauagcugcuguuaucaucuuuuuauuucaucuuuuucuuaaugauuugucauagcuaauuacauauuaaggcugcuaaccacuugucauguuguaaauauuuucaacagauauucucuuugcuuuauuuguggugucuuaugucauaaauaauuauauguauauaauuauauauauguucauuuauagugaacaauaguucauaguucaacuuaaaaugccaacuuugucauacacagaauucccacuuaacuauauauguaguacacuauauauauauauauauauauauaucucucucucucucucucucucgaacaaaugaacuuuuguuugaaguuaaauguaaacauuucccuucagccuuucuucuuuuauccaaauuucacccaauacccccgcccuagaaguguaguaguuauguuuacacauuaaaaaaaguuuucucggcauauauacaaucauauuauucaaaaauacaaaugaaauuaugcuguacacagugaauuacaaauuuuguuuuuacuuauuaugggcaucuuucuauaacuagaccuaguuugauuuaauggcugcauaauauuccauuaaaugaguuuaucauaauuuuuguaaccagcacacuaguuuuacgcauuuggguugauuccaaguuuuuuguauuauagacaaugucaaaaugaauaucuuuacaggcauaucuugaagauauuguggauuauauuccagaccuccauaguaaagugaauaacaugauaaaacaaguuacacuuuuuuucuguuucccagugcauauaaaagcuguguuuacacuauacuguagucuaagugugcaauagcauuaugucugagaaaacaauauccaugucuuaauuuaaaaauauuuuauugcuaaaaaaugcagacacagaaacacaaagugagcacgcgcauuuggacaaaugauaccaauagacuugugugacauaggguugccacaagccuuccaguuuguaaaaaacacgauuaucugcaaaguucaauaaagccaaacgcaauaaaaugaggugugccucuacauaaaucuuugcacaagugugugaguauaucuguaaguaaauucucuaagacuggaauuauuaugucaaaggguauaugcauuuuaaauauucacagauuucucuccaccagaauucaugcagaaaacuuaaaaauuaagguaguuaaauaauugauauuuuccuuuggaguuucugaccuuugacgucaugcuaaggaaaaaagccuucuuccauccaagacuguaaaauaaaauauccuccccuauuuucuuuuucuuuaagagaccgugcuauguugcccaggcuggagugcaguagcuguucacaggcacaauuauagcacacuacagccucaaauuccugggcucaagcaauccucccaccucagccuccucaauaacugggacuacaagcacuugcuaccgcaccuggcccguguuuucuuacacuaauuuuuaguuguugguuuugggggauuguguaugucugcaauucauggagaauuuaucuugacuuauacugagauacagaucuaacuuuauuuuuuuugaaauggauauucaauuuucccaaaaucauuuauugaguaauccaccauuuuaucguugaacuuaaaaugcuaacuuugaaucucaucgaaugccaacauagaaucucauucacuaaaucaaauuucuggccucuauucccuuccguuugucucugucuacacagcagauucuguguguuuuauacuauuugacaguuuuaacagcaauguuauuuuuuccucaaagaaugaacuggaaagguggccaacuuuuacuaugcuugggaaaaucaaagaaaagauuggaauuuucucuuccuugaagaauugguaaaaauucaaucaaaaaacaugugggccuaccaacuuuuguuuggagaaagacugauuauuaccuuuucaauuucuuauaaguuuuuaacuucauuuuguugauuuauauuuuccuaugaaaauacacauuuuuuuccacuuaauuuuucuuuuuauguguauugauauaaagugauacaaaacagacuauuauugccuuuuaaauauccaaacuugugguuauuucucucaauuucuuuuuuuaaaaauauuuauuuauuuauuuauuuauugaguuggagucuugcucugucgcccaggcuggagugcaguggcacaaucucggcucacuguaaccucugccuccggguucaaguaauucuccugccucagccucccagcugggauuacagaugcccaccaccacguucggcuaauuuuuguauuuuuaguagagacgggguuucaccauguuacccaggcuggccuugaacuccugaccucaggugauccaccugccucggccucucaaagugcugggauuauaggcgugagccaccaugcccggccuaagcuuguguucuuaauaaauacacaaccgcauaauccaguuguuuagaauuaacuaaacuuuuacugguuucauugcucacuacaaacagcuucuuguguuccacacccuaucaauuuuugaguuacuuauuugaauuuuuuguuguuguuugucuggaguauuuucucaaacaaguuuuaacagaaauagcacgaguauaauuucuaagccuuucuguaucugaaaguguccuuuuuccuucacacgugaaugaauucugggugucuagaaauucuagggucauaguuccucuaucuaucuaucuaucuaucuaucuaucuaucuaucuaucuaucuaucuaucuauguaccuaucuaccuaucuaucuaucugucuaucuagagacagagucucgcucugucacccaggcuaaagugcacuggugcaauuuuggcucacugcaaccuccgccucccagguucaagcgauucucaugccucagccucccaaguagcugggacuacaggcaugugccaccacaccuggcuaauuuuucuauuuuugguagagacgggauuuugccauguuggccaggcugaucucgaacuccugaccucaaguaaucugcccgccuuggccucccaaagugcugggauuacaggugugagccgccgugcccagcccauagcuccuuuagaacucuaaaaauguuacuucuagaauuguuucuuuuguagauauccuccuccuccuccuccuucuucuuccuuuucuucuucuuccuuuucuccuucuucuccuucuccuucuccuccuccuucuccuccuccuccuucuccuccuccuccuucuccuccuccuccuucuccuccuccuucuccuccuucuucuccuucuucuucuucuucuucuccuccuccuccuccuucuccuccuccuccuucuccuucuccuccuuuuccuucuccuccuccuccuucuccuccuccuccuucuccuccuccuccuucuccuccuccuccuucuccuccuccuccuccuccuccuucuccuucugcuccuucuccuucuccuccuucuucuucuucuccuucuccuccuccuccuccuccuucuccuucuucuccuucuccuccuccuccuccuccucuuccuucuccuucuucuccuucuucuccucuuuuuuuuuuuuuuuuuuaagaaacaggguccugcucugucaccuaguaggcuggagugcaguggugugaucccagcucacugccaucucgaacuccugggcucaagugaugcucccuccucagcuucuugaguagcagggacuacaggugcacaccaacacgccugucuguuuuucccccccgguaucuauaaguuuuuuugccuuuuauaauaauuugccuuuacccuuggaauucaggaaucugaaucugagugcuuugaucuaaagauccguguuuuucuuuggcucaggagaauguuuuccuuccauaauuaauuuuagcguugcuucucucccauccacuuuauuuucuccuucuggaguucccacuccagaagaggaaaguuauagcaaaccucacucuacucuuugugucuguccacuucccacucuuugucuugguuuugugugguuuaacagucucgugcauugaugggcuuuucagcagugucuucccuacuauuuguacauccucuacugaguuuuuacuuaaccauguuuuucauauccagggucacucugguucucugauuguucauuucucauagcagucuauauacaaauuauugaagcacuguccugcugaaucucacuaggagaucaaaucacaauuuuguaaaaagcucucccuucucccuccauuaauucacucgggucauuugcuugucuugugcagcugggcuucucuccuucaugcuggugauucuuuauauaugucuaauggauuuuaauuguccauuuauauauuuaaaugcauucaacagagagcauaauuacaauccuuaggggagcuuuuucuuagcaugcuccccagaccccaccugaaccagugaguucagaaugucccaggugagcgcagcagugagugcagugguuuagaucuugggcugcagaggcagacacagagaucuguguuagcaucucagcucuaccucuugcuggcucacgaguuccuagcucccuccagcuucuaagguugucccaugagaacacacagagcaggacaggcagcuccauguaaagagacacuuugacaagcuggcauagagcagugcaccuucugcaucuuagaaagcuauguccacaacacugaacccuccggccaagucgucgccccuuccuaaggcccaugucccuggugcccagagggagcaccugccagcuuugcagucugguaucacucuaucaucacacuaaaacuauuuaaauauuugaacauaauucauauauaugccuuaaaauaccagcaaaccaaauucagcaguacauuagaaagaccauucaucaugaccaagugggauuuaucccugggaugcaaggaugguuugacauaugcaaaucaaucauuguaauacaucauaucaacagcaaaauuaguagaagaaaauaaguaauaaagaucaggguggaaauaaaugaaauuggaaugaaaaauacaguacaaaagaucaauuaaacauaauuccuaugccugguccuugcgcuuugcacucaccuuucccacccuucacuccucccacccccugauuucuucaugcuucagaauaucaccuaaauuguguaucagauggucacacaucgcagcuugaacccugcaguucucccaggaaaaggaggcccugcuguuuauaacuccauuuuuuaauuuucacaaguguguuuuauauaugcuccucuaccuaccccccagaagagucaaacucagagaaaaggcagacaccaguguuccugaaguugagaguuugaaacaagccuguggauaacaauuacccaucucccucugccucucaguuagugggugggaggugagggagugaggacacaccuggcaggagugccuucaccacaccuccuuucccccuccccacugccaaaaugauuuugaaacacucaaaaauaaaguagcuucuccgucauaaaauaggugggacucuccaacugggacagugagucuaauggccacauuggggucaggguucccuaccaaccucccuaucccucagggacuugaaccagaugucagaugacuacaaccugcuuucccauuaaaauaguuauuugagucauugccaaguuacuuuuucugaccauuauaaauaagcaagauuugaaagcccccuuccauuugaggcuguagacaucaccuaacagaaaguaugggaauggggcugggugugguggcucacucguguaaucccagcacucugggaggccgaggcagauggaucauuugaagucaggaguucaagacuagccugaccaacauggugaaacccugucucuacuaaaaaugcaaaaaaauuagccagcugcaguggcucaagccuguaauuccagcacuuugggaggccguggugggaggaucaccugaggucaggaguuugagaccagccugaccaacauggugaaaccccaucucuacuaaaaauauaaaaauuagcuaugcguggugguggguaccuguaaucccagcuucucaggaggcugaggcagaagaaucacuugaacccagaggcagaguuugcagugggccaagaucaugccacugcacuccagccugggcaacagagcuaguccaucuuaaaaaaaaaaaaaaaaaaaaguaugggaaggggaaauaguaugcucugauaagacacuuuuuuuuuuuuugucuuuuuuucuuuuugagauggagucucacucugucacccaggcuggagugcaguggcaugaucucggcucacugcaaccuccgccucccggguucaagcaguuccccugccucagccucccaaguagcuggaacuacagaugugcaccaccaugccuggcuaauuuuuguauuuuggguagaagugggguuucaccauguuggccaggcuggucuugaacuccugaccucaagcgaucugccuaccucggccucccaaagugcugggauuacaggcuugagccaccacgucuggccagaccuuucauuauacauaagcacucauuuaucacuaauuaauuuagcucauccagugcccagugaucuuucauuccugugaccucacugaaugccacauagcacccgucaagggcgucuguccugcugagugucaagucuguagcccacuggugcugccucccccgccacauccugcuaacccucauucacauucaccacacugcccuccuuucuguuuuccaguaggccaaccccuuuucuagcucuggaccuccuagaacccugcuuagaaugcuccgucccagugccuuuucuggggcuccaucuccucccugggucuugacugcagcagucuuuuccagaccacucaccuccacaccugcuccuugccuguucuuguucauuucuuucacaguacuugaaguucucuuuugugccugccuccccgguagaacacaagcuccaugcugacagugaccauuacugucuuaauaacuguguccccagcacccgggacccgggucaaugccucccacagaguaggugcucagaugccuuuuuuuuuuuuuuuuuuuuuugagacagucuuguucugucacccaggcuggagugcaguggcaugaucucggcucacugaaaccucuugucucccggguucaagcgauucucccaccucagccuccugaauagcuggaauugcagguguccaccaccacgcccggcuaauuuuuguauuuuugcuagcgaugggguuucgccauguuggacaggcuggucuugaacugcugaccucaaauaauccgccugccucagccucccaaagugcuaggauuacaggcaugagccaccgugcccagccucaaaugccuuuugaaugaaugaaugaacaaacccucacaacaguacuauaagaacuagauauuauuugagucuguuuguggauaaggcucagaaagauuaaauaauuuuuuccaacuuguagagguagugauucagagacucagaucuucugacaccagaaacuaacuucuauauacaggggcuaauggcagagccuccgcuagaaacaagcuccugauugcaaguucaagauucuuucccugugacaauuuuucagcuguuacucaugaauaaaagagaauuuguccuuuuuauccuuugacagcuaauuuuaaaaaucucuuucuuacccugaguuccuaggaagucuaaauuugauaguauuuaugugagaaguauuugaacccagaauaggagccacacuguggcuugucuauucccggccucacaugaguuuuguaaggaaauggcaaaucauaguucaaaggaauuauuucugccaugagaccugaaggaacgauucuucaggcgggaggagggcugaagugcucuuuucccagacuagaguuuugugcagaagaguugcaugaauucucccccagcucuucauggcccaggacacggaccugcagagaaagcucuggagcugauguucuuuccaggggguccuuagaagcagagccaagagagagaaacugcuucacccaccuuccugcaaaacuugagcuugccaagagacugcugaucucauagcgcccucuugugggcaugaggggcugcugcagccccuuuccaagucaaagcaaggcucucacuacagccguguuaaguggagcucugucgccggcaggcguggcugguaaccuacagcagcccuggagcagcuccucaaguuguucacaucucugccuucucauuccaagcucaaaaagggcaacgguuucauuuugucccuaaugggucauaaggcaaaauccuaaccuucaggagauucgggggauggagggcauugccugucacugugagauuugcucagggauccucaagugaaagcugggucaccagacuccaaaccucagccacgucugaccacuguuggaaucgucuuccuggaggacuaucuugcagggugggccugugggaauugguuccauggugcccagagcuguucacuuccuuuccuggaacagcaaugucaguguugacccagccuuguguaaagcacagcuagcaauucugcugacucaggucagcguucugccuguaagaauauaucagaccgggcgcggugguucacgccuguaaccucagcacuuuaaagggaggcugaggcggguggaucacuugaggucaggaguucaagaccagccuuaccaacauggugaaacccugucucuacuaacaauacaaaauuagcugagcuugguggcacaugccuguaaucccagcuauuugggaggcugaggcaggagaaucgcuugaacccgggagguggaggaugcagugagccgagauugcgccacugcacuccagccuagucaacgagugaaacaccaucucaaaaaaaaaaaaguaucaaaucagacauaguuccuucucauaggacuguugugaggauuaaaagaguuuaugaauagacacaaaauaucuauguuaguaucuaguacacaguaccuauucaguaaaaagcagcuacuuggcagggugcaguggcucacacuuauaaucauaucacuuugggaggcuaaggcggguagaucaccugaggucaggaguacgagaccagccuggccaacauggugaaaccccaucucuacuaaaaauacaaaaaauuaaccaggcgugguggggggugccuguaaucccagccacuugggaggcugaggcaggagaaucgcuugaaccugcgggggcggagguugcagugagccgagaucgcgccacuucacuccagccugggcgaaagagugaaaugccgucucaaaaauaaagaaauaaaauaaaagcagcuacuuucuaaauuucuauuuucuuaauagcucuacuuuuuuucuguccauaucugcccuccuguucccugcuccucucucuccacauucauuuucuuucucuccucucucagucacucucucucuuuuuuuuuucuuauggagacagggccuugcucugucgcccaggcauagcaccagugcaguggugcaaucauagcucacugcagccucaaauuccuaggcucaagugauccucccacuucagccuccugaguaacugggaccagagugcacacuaccacacccagcuaauuuuuuauuuuuauuuuuuauacagaugggaucucucugugucacccaggcuagucucaaguuccugaacccaagugauccucccauuucagauucccaaagcucagucuccuuugacauuucucccuucucaggauucuuuccauuccuucuagaauucucugauggagcugacugaucuaucugcccaggaacacauuugcuuguucugaauaacucuuggguauuguccagcacacucuguucuuuuucaucuacgacucaucauucuccagaaaacggaaggcacuggccccgccucuccacccgagggcagguuaagaguguaugggugcaagugccaguggguguauguguguauguguguguucacacccaugguauguuccuaggacgccucaggcaugacucagcuuagaaaugaugaacauuuagcccagagagcuacugcaaccaggggacaucuugccaagcauuccguggucugagugggagaaguggagcagagaucugagacacagagggacaggcguguagacacgacaguggagccagcugaugccacagagagccugugucgcauguugggaaucuggccucccugaggccagugacagucccugagagcacccgcccacugacucuuucucucaugcugcagacccacuccggauacuucuccagccuguacccccaucaccaguuuggcccguucccgcaucaucacucuguaagugcccccucaguucagccgcaccugccacuucuccuggggcuaggcccacuuggcccuugguggccagugaauguucacaaugcagaucuugucuccugugguucugguuuguccugggagugacacaccucaaagccugagcacgccaaacuccccagcacccgagugcucuugagguucugcagaggccuaggccguugcuguugcaccuguggaugcucgcacaccucacaggucgcaggaacugcugcagaugggcaagcagaaggccagaugagcacgugcuguuggcacugaauagcagaguuuccaaagaucuuugaacaaagucuagcaaaugagaaugucauuugcacagaccccacuugcaaggaccccuggcagccuugcccaagagccucugccuuuugucacagggucccaggagggaugguucaccccaucuuccuggagccagucaccgugcagcugggucaggucaaguuuaguugugaaaaugcuucuccggauaccagauguguugggcagcuuuccauucccucuaacagaaugccuuggggccgucuucaggccagguauguuuaauagcuguuuucauuucuugggugaagacacaggagagauacagaucacauuuguauaagacagaaaaccugcgaucagacagcuuuuggaauccaacaaauugagaagcucaagaggaggaugcccuugauuaucacuagcgcugccugugcucaggucccuuccucaggcuucacaccugcagagccgcaggccgcagaaggauccugugcaccauuuuggccauuuccuuggguggcggggccuucccaccaugggguucaugguaaggugcuugguaccuguugagugccuggaggagaaagccugguuggaaugaugucuucuuucuugucucgcccucccaguauccagagcaggagauugugaaucucuucaucccaacccaggcugugggcgccaucaucgggaagaagggggcacacaucaaacagcuggcgagauucgccggagccucuaucaaggugaggcugcuccugacggcccuguggcccuucuaccaccuccucucaucccacggcccuuguucccucucagucccaggcagcgccacaccaugcagagacagagucccacagagaucuagaacauuugccccaugacuauucccguccgcucucaucuuuccuuuucuuauuccuuuacuguucagcuaaccacugaauuagaaaaaaauaguagcagacaacccaacccaguccuuuuuguuuuaucauuguuguccucaagaagauaaagaaagguugaggauuuucccaagcuaagggaagggacugcggugaagugauaacuuagcagguaccaguaugcggugcuuuaaugagucuccacuucacaggcccugaacuaccagaaaauaauguggauaaaaaacucuuugaaaagcaaugauaaaaucauaaacaaaagcugagggucuaacccgauaugcaacccagccugagcauagcaacucaggaaggacgguccuugacuuauggaaaggcugcgaaugcagacguggcugcagcuccaggcccacauccugccuccuugagcacaguguggagaaucaucagagaagcugaaaggggaggauuauuugccccugguccugcuccaagaccagcuaucagcucugacucacgggcagaaugcugagcacgucccaagccucaugaaacauuuucggaaacagaguuuuuguuguuacgcaaaauaauuugcuaccaugggacaacccagaauuccaaaugagaagucucaugacuuggagagaaagaaugcuuacacuuucuccccaggaagagcuggaauuucucccacagcaagugugcuagaggaaaaacaaaaacaaaauauucugaguaguacagaacaaggguugcacugagaccaucagagaauuucacuuuggugaaucauuuucccucucagaccucauuuaucuuaucugcagaguggacagacaggaugagagcccugaggugugggggcccuugugcccagcaguccugcugcaggugagaccccggccuaggcacugauaggcaggugcuggccugaccccugagggugggcugaguaaaguguggaagacccccuggcuggcugcagcccuugggccuugcccagcuuucaguccugcagucugagaugccggcaggagaaaggaccguuucaacuaaaaggggcuugagggaccaucucauccaauccccgucuuguucagcagagaaaagugaggcucagagagugccgggacaugggcaaggcacacauguggcagggcugccucugagauggaaauucugcugacuucugggauauccagcaccuccuggggcucaccacuacagcgccucuucauuuacuauugcccaugaggagcuggggccuagggaguuuucacuggcuuguccaaggccacaaagcugaagaaugagagagccaagauuugcccagguuauccuguuucuggucuaguguguuuuuccaccauaucaaccuaacugugaugccagaaucauucccagcagggccuuuaggaaaagaagagaucagucgcaugggcugcaucccacagucccaggucccagcaaggucgaauggugacgugucacugugcuccuggccucugugaugggcaaagacagcagugcugcgucaggaggacagaauggacucuacagcuuaggaagguccagacaauguuuuuuaugcugggccaacaaucuuuuccagcaaccuucuacuuccccagccccugccucgcuccauagcauaaaccagggaggccaaauauuugugaaggaaauuuccaaauuuuuaaaaucagucagccgggcguggugacuuauaccuguaaucccagcacuuugggaggcugaggcagguggaucaccugaggucaggaguuggagaccagccugggcaauagggugaaaccccaucucuacaaaaauauaaaaauuagccaugcaugauggcgggugccuguaaucccagcuacuugggaggcugaggcaggagaaucacuugaaccugggaggcggagguugcagugagccgagaucacgccauugcacuccagccuuggugacagggcaagacucugucucaaaaaaauaaaaguaaaaaaaucaaucugguuuuugcuagauucccuuugucucaacaggucccugaaaacaucugucucuaaagcaagauggaugaucucacuaacuccagagauucucccaccccuaguuucuacuuugccagucuuugggggccacaaugaggggcacauuugaugcugcugggcagggagagagccucacacucauccaugggaggagagcgcccagaggaggugggcugagcuaagaucugggugaugcacuccaagagaugcuuuggcugcaggugagagcugagcucccgucaccugccuuuccuguagaacaggcuuccagaugcugcacaaaauucauucagccagugacaccuaauuccagauccugacuccagcccugcuuacccugugaucuuggcaguuaucucugggucccaucugcuucagucauaagaugggguccucauuccugccccuuuagagggagugugugcauggaaugacauuccaaaacugcacaagugcacaaguagcccuccgacuucuggacuaggcuggccagugccaggcaguagagcccucggagguuucuuucagaaucugagcaaagcagccacaagucauuacgaaguggacggugauggcagaacugauuuggucagcgugaaucaugaaucagccauucgcccuucucgguuuggguggugguaggagcugggaaccacacagccaugaucugcucucucuugcuuacucagagauaaggaccagguuuaaugccagguauggaucucaaaguagagucaagggauccugccagaagucucaauggccaggcucugugugaucugccagagggugucagaccccuggacacacucagauccguguuuuucggccgaggcccugccaagaaauggcugcccacagcaaaggaagucccccaggaagcucagcuguugaucaccugagucucacauuuauccgcauccaccaaggagucacagccagagaacucuuugcagaucccaugaaggggccccuccuuccagagcgggacagggucugagcaugucuuggcuauguacucacaauaaagcaggggcagccacccuggauccugaggcccauggauggaagcuggcuuauagcacacacugagaggaaacaaaauugaaccuucuggagguggaggucuucccggaggaucucaagugacacagugguccagaggugauccaugcacaaaugcaacaccgaggguaaaucccauuucacuaaacagaucuuucucgagaccuagacucaggauuggugccucccuugaaucccuacuuugguuuugccuuagaacaugaugucccugucauugaccauguuucuuguuucguauuugcucuuagcuuagaacugcaucuguggccaaccuggggcagguguguaggaccuuaugagauguguguguucugaccucggucuuggcucauccuuacaauccuaaaugccugaugugcacucauuuuacuuuuuuuuuuuuuaagacggagucucgcucugucacccaggcagugguuugaucucggcucauugcaaccuccaccuucuggguucaagugauucuccugccucagccucccaaguagcugggacugcaggcacgcgccaccacuccuggcugauuuuuguguuuuuaguagagaugggauuucaccauguuggccaggcuggucucgaacuccugaccccaggugaucuguccaucucggucucccaaagugcugggauuacaggugugagccacugcacgccuggccucauuuuacuuuuaaugacauuuaauuuugcuacaauguguuaauaaguuuuaauuuuguauuuauuuuuagcugaaguuuuuuuuaauaaagcagggcaugcagaaacaaauauguaacaaagaucucucuaacaaaaaugccugcucagcccaggguuugagucguguuacaagagaaccugaacucacagaaacugagagaaggaagcugggcgcaguggcucacaccuguaaucccagcacuuuggaaggccaaggugggcggaucacuugaggucacuugagcucuucuuuggaggacuuugagaccagccuggccaacauggugaaaccccaucucacuaaaaaugcaaaaauuagcugggugugguggcagauaccuguaguccuagcuacuugggaggcuguggcaggagacucgcuugaacccaggagguagagguuguagugagcugagaucgcgccacugcacuccagccugggcaagaaagugagaggagauuuggagcuuggugggcccagccccuauguuucacagaugagggaauggaggcacagcgaggggaggaauuuucagagccaggacuagaaccaacgugccuccauuucugcucugcugcuguuuuacuuaugacccacuugccguggaggaagcggucuugaccacacauacucuaacucaauugucacuuccagcugacuacccuugugagcugagaauuagaaccagagauaccuuugcugcaagcucgacuccaauuuaacaccuugguggaccugcccuuccuucccuuugggcccuagguggguuggcagagccuacacaucccucuuccuagagcuuuugacucccugguuauuuccuaaaacuuggcucaaugagaggaggcccaucacagcuggugcucaggacagggacaggcaguaacuacuggccugugucugacugucccuggguggccaaaaacccaaauuugauacugggcauuacagucaugacuuccuaagaccaggguggaggcagcauggcaucagacagaaccagggguaacggcagaagcaagaccuggaaccuccugcugguaugcuugccguccacuuagacaagaaagaggggcuggggaaugcagccgagcaucagcguuuuccucuccugugaaccacagauugccccugcggaaggcccagacgucagcgaaaggauggucaucaucaccgggccaccggaagcccaguucaagguuagugccaagggacaccucagcccugcaggcucugggcacagagcagccaccucagaggcacauucaaggcucuucuuuggaggcccagccuccauuucccucccugcugcugcccaccaagcucaggcucacccugucaucccuggcuguucuucugcauguuugcccucugcugggaagcccucuuucccuucccucucauggaaaaguagaucaucuguuggugcccaguucgaguggccccugcucuggcaccucugaucccuuagcccugguuuugaggauggaugucuccggcucauuuagucaugucuacccuucaagcuauggaggacuaacacagguguaaggggaaguagcaugguuuguuggaagguuuuuuggugagguguguuuugcuuuguuuuguuuuugccuuuuuuucuucccuaggaaaauuauaacucgagcuuucuaaaagugagaaacacauauuuauuuauuuauaaaaguacaauccuuaucauuaaaaauauuuaaaauuuagcugagaagaggaaauucacacauguggaaccacucaaaagcaauagccucagccaggggcagcagguggugguaugcuccuguagcucuagcuacuggggaggcagaggcaggaggaucccuugagcccaggaguuugagaacaggcugggcaauagagcaagaccucaucucuaacgaaaaggaaaagauaacaaaaaacaguaacccuucaacucaguauuggacaacauguggaauauccauuuaacagaauguuauucagccacagaaaggaaugaaguacugaugcauggugcaacaugggugaccaucacacgaaguaaaagaagucaaacaccaaaagccucauauaggccagguguggaggcucauuccuguaaucccaacacuuuaggaggccaaggcaggaaggcugcuugagcccaggaguuugagaccagccugggcaacacagugagacccccaucucuacaaaaaaaauuuuaaaguagcugggugugguagcauguaccuguagucccagcuacuugggaggcugaggcaggaggaucacuugaacccagaaguucaaggcugcagugagcugugaucaugccacugcacucuagccugggugacagagcaagacugucucaaaauaaauaaaggccacgugugaagugauuucguucauaugaaauguccagaauaggccagucccuagagacagaaaguagauuggcaguugccagagaauaggaggaguuggaacuaacucccaauaguuaugagguuuuuaucugggggaauaguguggaaauguucugaauagauaauggugaugauugcacaacauacugaccacugaaauugauauauuuuuuuuuuuuucaguuuuuauuuuuuugagacggagucucccucugucacccaugcuggagugcaguggugcgaucucggcucacugcaaccuccaucucucggguucaagugauugucgugcuucaaccuccugaguagcuggaauuacaggggcaugcccccacaccuggcuaauuuuuguauuuuuaguagagauggguuuucaccaugaugaccaggcugaucuugaacuccuggccucaaacaaucuguccaccucgaccuuccaaagugcugggauuagaggugugagccaccacgccuggacugaaguguauacuuuaaaacggugacucucagauuauguaaguuauaucucaguauuuuaaguaaagaaaaaaaaagaacauuguaagcugugguucuuuuucacuaaaaaaaaaaaagaaagauagguucuuggcuccucugccuuuggaguuagacaucaaaaagaaagauuauguugaauguaguggcuuacaccaguaaucccagcauuuugggaggccaaggugggaggaucacuugaggccgugaguucaagaccaaccugggcaacauagaccucaucucuaaaaaaaaaaaaaaaaaagaaugaaaacaugagcuaugaucgugccacugcacuccaaccugggcacagagcaagacccuguucuccauuagaaauuuuuuuaauuaaaacaauaucaggcuccucaaaucccauuaccaccaccaucaccuccauccuuacuaaccagggguaugacccuguggugaugggauaagaauccccugaacaaauucagucaaucaagcaaaucuuuauaggugauaauauggaaauaagacauagaguugcauccccucacccauccccuuagcccugacacacagaaagcucccuagaggaggcagucuugugcaaaccaccaaaacaugaaugcccauccacauuuuucaaagugcagccaucugacguggcgggagcagcgccccccaggucugugagcggaggcuggggcacgcagcuuccugugugucccagggagugugggaaugggacugacccauugucuggacucuccagugcccuucgcagcacugaugaaguggccggcugcuggcugacugagagucauuagucaugucuugcucucucaggcccagggacggaucuuugggaaacugaaagaggaaaacuucuuuaaccccaaagaagaagugaagcuggaagcgcauaucagagugcccucuuccacagcuggccgggugauuggcaaagguggcaagaccguaagugugcuccgggcucgcuucaucaccugggucagauuccccgcucuggccuugccugaguucccucagucuccccuuggcgccuucugucccaauguacagucagggucuuuggcagauaaacuaaggcucuccuggcaucugagcccuuugaggcaugaggaucccaaggacaaaaaugucaucggcuucacuccacaacuuagggcccccaauccguggugcuguaagcccagcaccaaaaauaccacaguccugugcccaguaauacccaucuugacuccauggucagugaaggccuccacucccugaaaacagagaggcugucuucugcccccuuuauacccacauguagcagccauuaaaauuggaaaggggggauucccaccgagagagaugcuaacccacuuggcagaccaccaccuucccuggauuucacucaggccugugcccugcacucucuucugacucucagcccuccugacagaugccuccagucccuaacucccccuccacaggcucuaucuucuggcuguuucccaaacauggcucuaggggagcuaguuuagcaguaggagggugggcaaggaggagauuguuuuuugaaagaucaucugcauuuucuacuggaaggugcaggaacaaacacaguguaguuugaaaagugccagagcguuaacuuugaagcuuguuggaaugagccagguggucuguagacccagguauguucuggaaugugacuuacugaccuggguggggagaugaccacugagaaguuccaguagagccuagugcaggcuugcuggcaaaguagcaguguuggguggcaggaacuuggcggggaggcgggggucucuugaguccugaguguguauguguauauauguauauguguguuauuugcuguuuuuguaaagcuuuuuuuuuuuuuuuuuugagacagaguuucgcucuugucacccaggcuggagugcaguggugccaucugugcucacugcaaccuccaccucccugguucaggugauucuccuuccucggccuccugaguagcugggacugcaggcgcccgccaccaugcccagcuaauuuuuuauauuuuuaguauagacgggguuucaccauuuuggucaggucaggcuggucucgaacucccgaccucaggugauccgcccgccucggccucccaaagugcugggauuacaggcgugagccaccacacccagcuguuguaaagcucuuuacauagaaacucuuaaacggaauucaaaaccaaguucuagauguaaugagucagcuuuauacgaaagaacgaagcgguguggaaucaaaggauuccccgucuccagaaugcagucggcgcuccagggcacacacugcgcuuuaggcggagcuggaauguaggaggcaaaagaaagcagauggaucagcagggaguagaauccugagccccuggguguccuguuuagcuauuucagaaccagucacugaauucucugcauccuccagacuuucagguuuccccuaaagcacaugcugaacccgccugugagcucggcaucaggccagagggccagaggacggggucugagcccucaggaagcgugcaguccuguugggaagcaggcccagugaggcagcggggaggaugaacaaugcaggcagugguuggagacacgaggagcucagcaugggcuggaggcuucauggaggugggccuggggugggauccaguggccgggagagaggacaacaauccaaggguaggaacagcaugagcaagucuuggcggcaggagugaaaacgaggaggagggaacagcagggcugauucgcagggaaaguuaaccaagaggagguuugggcucguggucagcacccaggacagcauguccaggaggaaugaucuuacaggguagggguggggaguggggggguaugggaaagccuggggucucugugagcaugugcaggccugcguugaugggaacuccagaauaagagaacuucgccucagaagcagccccaggaaucuguggcuggacucccucucccugucauugagccugucagggcccaaccaacauggccccaugugcucaggggcagaggagcccccgggguguccuugauaaaaggaaaggagagcagaguccagccccccuccuuccccugcuccaccucuuggccccucacuccguccugagcccaccacguugacggggagggaaccuauccaacccguugccguuucucccuucacaggugaacgaacugcagaacuuaaccagugcagaagucaucgugccucgugaccaaacgccagaugaaaaugaggaagugaucgucagaauuaucgggcacuucuuugcuagccagguacugugcugugagggcccugucucuccugcaagucucuuuucaauucucugcuaagcugcugguggccugucagguggccacaggcccugagcaucaauccacgccaagauggaaccucucccugguucuuccuggcucuuuagggauggcccccggggcaggggacauuguuucacacuucucuccacugucauccccgagguauguaugcuaggagcuuggggaagagugaagaguuaagcgcuuaagcaaagccaugugguuccaagcccccugcaguguuuaagggcauggccucagcuucccucacccucucuccucaggccucagucccagccuccccacugggagccaggcaagcccacccucuggauuccucccugaaagccugagcacucccugugaaagacuacaugcucacggcauuucucucuccuccuccucuucggucucaccacaacccacccuaucaaaauacugcaccuccacacagccgcuucucuuucauugggaaaggccagcaccuggccucuuucucuuugaugcuuuuguaaauugaguuuuggggagagcguuccuggucuuuguccuaaaccagugaagacaaacaguguacuugguguaagcagacacugaagguuugucuaagcugucagccugcucucccaacaccugugccugugcugagaccugaugguccaggaaagggcagcugccacacuguggaucccccgccacccacacacgcaccccccgcccagugcccuuugaaauucucacuugagucuucugcagucagagucccuggccacgccccugucugcugucucccagcucagcuccucagggcccugggaaugugucugaacagccuguuccuacaggaguucagucugcagggagcugccugcagggacagugcuaggcugggugaggggacagguggggguucaugugugugcuccagcuguucaggguagagcaucugggcucaguuccucccucccuccccugucccucacacucaugcccuccuagccgcuguagaacgggggcgggagcagcacgggagcccaaguguagcaucugacucugcacggcccccaguugcuggcgcccugcuucugcuuccuggccuguccguccagcagugaacuggaagcugccggagucccauccccuuacccuggaccuuggggugggaguggaggggggaccucugccacuuacuuccaggcagaaaagggccuggaguaacgugcggggguggguagaugaugcuugucugagcauuccacccuucauccccaagccccagagccuccccugccguuuguccucagaacuggguuccuuuuuuccccugucccuuccucucccuucucucccuugcugcagacugcacagcgcaagaucagggaaauuguacaacaggugaagcagcaggagcagaaauacccucagggagucgccucacagcgcagcaagugaggcucccacaggcaccagcaaaacaacggaugaauguagcccuuccaacaccugacagaaugagaccaaacgcagccagccagaucgggagcaaaccaaagaccaucugaggaaugagaagucugcggaggcggccagggacucugccgaggcccugagaaccccaggggccgaggaggggcggggaaggucagccagguuugccagaaccaccgagccccgccucccgccccccagggcuucugcaggcuucagccauccacuucaccauccacucggaucucuccugaacucccacgacgcuaucccuuuuaguugaacuaacauaggugaacguguucaaagccaagcaaaaugcacacccuuuuucuguggcaaaucgucucuguacauguguguacauauuagaaagggaagauguuaagauauguggccuguggguuacacagggugccugcagcgguaauauauuuuagaaauaauauaucaaauaacucaacuaacuccaauuuuuaaucaauuauuaauuuuuuuuucuuuuuaaagagaaagcaggcuuuucuagacuuuaaagaauaaagucuuugggaggucucacgguguagagaggagcuuugaggccacccgcacaaaauucacccagagggaaaucucgucggaaggacacucacggcaguucuggaucaccuguguaugucaacagaagggauaccgucuccuugaagaggaaacucugucacuccucaugccugucuagcucauacacccauuucucuuugcuucacagguuuuaaacugguuuuuugcauacugcuauauaauucucugucucucucuguuuaucucuccccucccuccccuccccuucuucuccaucuccauucuuuugaauuuccucaucccuccaucucaaucccguaucuacgcacccccccccccccaggcaaagcagugcucugaguaucacaucacacaaaaggaacaaaagcgaaacacacaaaccagccucaacuuacacuugguuacucaaaagaacaagagucaaugguacuuguccuagcguuuuggaagaggaaaacaggaacccaccaaaccaaccaaucaaccaaacaaagaaaaaauuccacaaugaaagaauguauuuugucuuuuugcauuuugguguauaagccaucaauauucagcaaaaugauuccuuucuuuaaaaaaaaaaaauguggaggaaaguagaaauuuaccaagguuguuggcccagggcguuaaauucacagauuuuuuuaacgagaaaaacacacagaagaagcuaccucagguguuuuuaccucagcaccuugcucuuguguuucccuuagagauuuuguaaagcugauaguuggagcauuuuuuuauuuuuuuaauaaaaaugaguuggaaaaaaaauaagauaucaacugccagccuggagaaggugacaguccaagugugcaacagcuguucugaauugucuuccgcuagccaagaaccuauauggccuucuuuuggacaaaccuugaaaauguuuauuuaaaaaaaaaaaagaugacaaagaaaaacagagagagagaauauuggagauguccugaauuuuaauaggguacgcgccauuagggcuuuuugcgcuaaaggaugaacauguacugguuuauguggacaagccauuauaccaccagacugcaaugccaguuuccucuacugcaaacaguguucugugacaaaaaaaaaaaaaaaaaaaagaaaaaaaaagaaaaaacagaaauauauccagcuaacaagau

SEQ ID NO: 18065 - RNA, 2244 nt, Homo sapiens
cacugcauggaguggcugcugggccucuacuuccucagccacaaccccaucauccuguucauggaccuguaggcggugcugccgugcgaacucuacccaguacaguuuagaaaucugcugaagugcuaugcuaagggguucaaaggcccgcugcuacaggagccaccaguuugguuuaaguccuuucuguuuugcgagcuuauguuucaggugccuuucuuucccauugcaaccuaugccuuccucaaaggaagcugcaacuggauucgaaccccugcaaaucaucuacucaguucacaccaugauaacuuuaauuccacuacucuccacauuucuguuggaggauuucuccaaagccagugguuucaaaggauaaagaccugagacucugcaugaacgguuaaccccuguaucugucuaugcccccuacuuacucaucccauucguacuuuuaauuuucauguugcagagccccuacuacaaguaugaggagaaaagaaaaaagaaauaagagaaacaaccauuggcccaggguagaaaugccugcagggcaguuguuuguuggauacaauacagggaacacugcucagaacccacaucuucaucagcauuugaaacacuggcagcaaugcacaagagcaagauggugucagaaaccacgucaaaaacucaccuuuuuuuuuuuuuuuuuucagacugucucacucuguuaccaaggcuggagugaaaggcaguggcaugaucucggcccacugcaaccuccgccuucugggcucaaacgaucuucccuagccucccaaguagcugcgacugcagacauacaccaccacacauggcucauuuuuuuuaguuuuuguuuuuguuuuguggagacgggguuucaccauguugcccagguuggucucgaaugccuaggcucaagugauccgcccaccucagucuuccuaagugcugggauuacagacgugagccccugggcccagcccaaaccuucaccuucuaagugcacugggaugaacauacugaccggcuucagagugggcaaagaggugugggcuggguuauagggaagugguaccaaauacuugacuaugugccuaaguuccacugcaccauuacuaaaagcaggaccaaaccagaaacugcuaaagaacuuggccugcuugacauguucaugagucaccugaccccacagcauauaugcuuauuaugauuaaacccucuacuccugauucucuagaguauaucaccugucagcaaaaugaacagugggauguuuggggccauuuaaaaugucaaauuuugccucuuucguauuaauucaaaacuaugucauguuuucuuguccucaccucuaacccaaggaaaaaagacaaaauacuaugcaaaggaaguuuaaacuuaguuuuccuuaagguucagcccuacaaugacuuucagucagaaauggguuaaacuggaaaauguuuuuguuucuguugcgaacagaucauccuaggagaaggguuuuuuugguuuguuuguuuguuugaaguuacuuugcuggccgggcacaguggcucacgccucuaaucccagcacuucgggaggccaagguggguggaucaccagaggucaggaguucaagaccagccugaccaacauggugaaaccccgucucuacuaaaaaauacaaaaauuagcuggggaugguggcaggugccuggaaucccagcaacucaggaagcugaggcaggagaaucacuugaacccaggaggcacagguugcagugaacagagaucacgccauugcacuccagccugggugacacagcaagucuccgccuccaaaaaaaaaaaaaaguuacucuguuuauucuauuucuaaaucuuagucuucucauuuguagaggcuaccugacauaagucccuuuaucugaagucuaguaucucaagccugaucuagaagugugcucccuaguggcuaacuucauccuucuaauauaguucaaucauucccaucuuguucucagaagaagggaagauggcagcagcugggcauaacauagccaccuugugcauauagggucucuucacguuggugcuuggcauuccaucagcuuucucuaaguuuguacucaagucugaccuuaaaaugauguuagacaauaggucccggucaguucccucuauuuucacccauguugcucacaagccauacuggucugacucacgugucugauccaaauauagguaccuccugac

SEQ ID NO: 18066 - RNA, 436 nt, Homo sapiens
cuuaagcacguucuccacguaugcggcgugcuagcuggaugucuuuuggcauaauuguuacacguuuggcauggauagcacacagguuggugucuucaaaaaggccaaccagauaggccucacuugccuccugcaaagcaccgauagcugcgcucuggaagcgcagaucuguuuuaaaguccugagcaauuucucgcaccagacgcuggaagggaaguuugcgaaucagaaguucaguggacuucugauaacgucuaauuucacggagcgccacaguaccaggccuguaacgaugagguuucuucaccccuccaguagagggcgcacucuugcgagcggcuuuuguagccaguugcuuccugggugcuuuaccaccggucgauuugcgggcagucugcuuuguacgagccaugguacagagaccuccuuacuuacc

SEQ ID NO: 18067 - RNA, 542 nt, Homo sapiens
guuuucagucaggccccgcugacccacgacccaccaacccacgaacuggcccggcccucacgugcaccaugucuggcuccuccagcguugccgcuaugaagaaagugguucaacagccccggcuggaggccaggcucaacugcauaaaaguuucccaggcagcugcagacuucaaacaauucugucugcagaauguucaacaugacccucugcugacuagaguaucuucaaguacaaaucccuucagaccccagaaaaucuguucuuuuuuguaguaaaaugaauuucaaaaguuucccaaaccacuucuuaugauccaguggauauucaaaagagagcuaaauuugaagccuguacaaaagcuuaucccuguagcacaugugcuguaauauacgaacuucuaguuucaucagucuuuaacaucuaccucucugaauuucaugaauuucuauuucacaaggguaacuguuuuauccacacuggcagcagcauacaauaaaacucaguaugaaaaaaaaaguuuucuuucccagaaaaaaaaa

SEQ ID NO: 18068 - RNA, 542 nt, Homo sapiens
uuuuuuuuucugggaaagaaaacuuuuuuuuucauacugaguuuuauuguaugcugcugccaguguggauaaaacaguuacccuugugaaauagaaauucaugaaauucagagagguagauguuaaagacugaugaaacuagaaguucguauauuacagcacaugugcuacagggauaagcuuuuguacaggcuucaaauuuagcucucuuuugaauauccacuggaucauaagaagugguuugggaaacuuuugaaauucauuuuacuacaaaaaagaacagauuuucuggggucugaagggauuuguacuugaagauacucuagucagcagagggucauguugaacauucugcagacagaauuguuugaagucugcagcugccugggaaacuuuuaugcaguugagccuggccuccagccggggcuguugaaccacuuucuucauagcggcaacgcuggaggagccagacauggugcacgugagggccgggccaguucguggguuggugggucgugggucagcggggccugacugaaaac

SEQ ID NO: 18069 - RNA, 2604 nt, Homo sapiens
ccuggcugggaaaauuuccagagagcaggugaaaggccucuguuccgccagggccacacuggguggguggcagcgcagccgggccugcagcuuaccugcuguugaauuuuucaggauguuucucucucaucacauggaaucugugugcaauggaagcguccugaaagugaaagagacaaagcagauccuuggugaguggucaugacagugcagugcggagggaagggacgcacgcaugcacucgcugagucaugccaacccugggacucuaucuaucgcaugguggggcuccaggucacauccgcggagccaacagaggcucaacacugccuccagggggaugagcuagcaccaccaauacucuuacagccuaugccaguugacucuggaguccuugcuauuucacucuagcccggacccgcugagaacagauagauaguucaggggugagugaaggggaaagccuuugcccucuggggagacugagagucugugagcaguuagagaucaggagccugugucuggggcugagcaugagucucuggaaaugacuuuccauacuaguucuuuuuaaaauaguuuuuauuuuggaauauuuugacucacaauuaaguugcaaaaauagcauagaguuccuaggucccguucacucagcuucccccaaugauaacauuuuauauaacuauaggauauugucaaaaccagaaaccugacauugguagaugcuauuagauauuaagucuuaaccauccacaccaauagaaauaauuaguggcacuggauaacaugcuuacuagauaauaaaacaaaauuaaacucuggcuucugcuucuugaucacuucacucgaaggacucccuccaaggccaauaagagucauuauuacaucauguggacacugcccuccuauuagcacaucccuuugccacacuagcggcccccugcacuccagcacucacaguuaggauggcugucaugcacugugcuccugggcucuccauccucugaccacaacucccuaacccuggguucuaccugcggcccccacuccacaccguggccaucucgugaguucucguggcuguuaccagcaucugaaugaugauagcuccaaagugucaaucucuagagccaacccuaagccucaaaccugaaacggaacuugucuuuccuccucaaacucggucuuccacccucgacaauggucucauuuuccagcagaagaauguguaacgccccuucaccgcucaggccccauacugguacuuugggugcaggugcugggcuucagaaauaaacaggcuaauugagccggagauggggggugacacagaaaccagggaguugacuagauuuguuuugcaaugaaaaauauacaaacccauuuacuggaauacauggcuacaaaacacuugaaauuccaugcagugaauuuugaauuuucaucaaaugcauauuaauucuauuucuuauaugaaaauuucuguguuuuuuuuuuuuuuuuuugagauggaguuuugcucuugucgcccaggcuggagugcaguggcaugaucucgucucacugcaaccucugccucccagguucaggcaauucuucuggcucagccuccugaguagcugggauugcaggugccuaccaucacaccgggcuaauuuuuguauuuuuaguagagacgggucuucgccauguuggccaggcuggucucgaaccucaggugaucugcccgccucggccucccaaaguacugggacuguaaaugugagccacugcaccuggccucuguguguguuuuuaagcaucaagagguauaguucuaugaagaagcuuuuugagcaugaacucuguguggugaggugcaccuggcauaggaguccagcagcccacaucugaaagguggcagggcaagaggagaagaugggcuuauuuugugauuggcaaacauucuuugcuaaaaugauguuuugagaguuuaaaauuuaaacuuuagcuauugauguuuuuuuuuuuuuuugagauagagucucacucugucacccaagcuggagugcaguggcacaaucuugucucacugcaaccuucaccucccagguuccagagauucuuccgcuucagccucaugaguagcugggauuacaggcauccgccaccaugucgggcuaauuuuuuguauuuuuaguagagacaguguuucaccauguuggccaggcuggucucaaaacuccuggccucaggugaucugcccaacuuggccucccaaagugcugagauuacaggcaugagccaccaggccuggccaauuuauuuuuuagcuuaagauauauuaagaguuuaaggucuuggagaggcacccccaugggugcacgggugagaugugcggaccccagagaggccucugucccugaggccuauccagccugcaccgcuucccugggcagcagcacuucaugcucccagacuguacccaccucccacucucugagcaaauuucagugaacacccucaauaagauucaugugacauuugucaaaugcuucucuaaaauucgagaaaauauuccaucuacuucuauuccuuugaagcacuaauuuucgucugucagga

SEQ ID NO: 18070 - RNA, 20743 nt, Homo sapiens
uauuugcaggucuacauauccuucagaaccuuaaagauucuuuucuugaaagguccagucuaauuccccuccccaggaagagggaugagccuuuguggcugccuccauaaaugaaaaugcgauggaaaggaugcugcacgacuuaugaggcuaagucauaagaagaacuaaagcuucuacccauuuccacuuccuuuugggaaacgugucuugggagcccugagccaauauguaagaaguccagcuauguauagccaccaugcugcagaaaccacacagagauaaagauucgugaggagucuccccauuuccaguucccagcugcuugaguccucccaccucccagaaugaacugucagacaugugaguagaaaugacuccagacccagccuucaagcuguugucccagcugacaccaaguagagcaaaggaguugucuccaucagucuagcucauauugcagauuugugagaaaaaaacaaauguugcugcguuaagccaguaaaugcuaggauaauuuguuauaugacaaugacaagaguaaccaggacaccacccuuguguuaucauuacguucuccccuugcuucuugugaugcccuugcuuuucuucucuaccaguugcugagaauuagaggaagaccuuugcucccaccaaugucaacauuucuuuaccagaaaacacagaggcauuuaacucauauuucgaagacuuacagcuucuuauaauggcccuggugguuauacuuuuuguucuacugacucuauuuuguuacaguuacucugcccacaaagugcaagacccuuugugauuauguugggggacaucaauucaaaugacaccgugauagcauuacugucaaaucaugcuucccucucaaugcuguugaugaagcugguguaccccaacccuguucuuacagguuaaguugcuuuuucccacuugaaacauuguacaacagccaaaagcuuaucuggucaguuuuaaugcguccugccccuuccuaggacuuauugcaaugacaaacauauaagagcugugaaaacucugugacuuacacacaguaggcaccugguguuuuaagugcucuuccugaaaugcucacugacaauaaaacuauugaacagaucaggacugaaaacauagcuuuguuuugugccagcaaagacucucuucucuccuuuacagguugacauugagccauuaaucaacaguauguucaacaguaacuagugaguuaugaauccaacuaugugccucuauuuuaucuccaggggauaucacaagaugaaucaucaaacaccuugcugaaaacauuaucacauuuccuguucugguuuaauguuaccuaacugguagaaaacacagaagacuuaauuacaugauugcuuuuuuuuuuuuuuuuuugagauggagucucgguguguuacccaggcuggaaugcagugguggcgcaaucuuggcucacugcaaccucugccucccacguucaagugauucuccugccucagccucucaaguaucugagauuacaggcaugugccaccacaccuggcuaauuuuuguaucuuuaguagagaugggguuucaucauguuggccaggcgggucucgaacuccugaccucaggggauccgccugccucggccuuccaaaguguugggauuacaggcaugagccaccgugcucggccuuguucuuaaucaccuaauuuggccccuugcaguggcuuccauaacuguuacuaauucucggaaaccauccuuuaauuuauuauuauuauuauuuggcagaaucaggcuccaaaucaaaauccagccuguauggcaucugccuugucuacguuaagauuaagggagacuaaaagaggaggguaguuaaaugcauuauuauuugaguuugcauugaaaauuauaauuauuauuguuuuacuuaauauccugauuuuuaguggcaagagcuagaaaauggcuuaaaaaaaaaaaaaaaaaaacaggucuggggcuccagagccgauagcucucacggcauuauuuuagcgccaccuucacacaaacaucaugcauugcagagggaaggaaaauuuuaaaaaaucauaagccucccaaaccucaguugugcaacauauauuauuaacuuguucuuuuugaacugccuaucccaagagaggcauuccaguuguaaaugucaaaucaaccaacaacucuaugaaacauguacuguuauuaucaccauuuuacagagggagaaauuaaggcacaacuaguaaaugguagaacuggaauuugaaucugaucagugugauucuagagcaugcacaugguaacacuaugguacauaaaaccucccguuuuguuucuauauucugucaaaaaaugauguuuucaauauaaaaggguaaagugaacaucaguaagaggaaauggaaguccaagagggaagaggugauugaugauaagaaacacuuucuuugaaggaaauccugucuucuggacuggagacaauuccagaauacugagaaaaucaccuaaaugugaaagugaagaucccuaggccccaguaugggcucacgaagagugucauaacagacacaccucauuuccuaacaggcuguugucuaacuggauuucaacaagaucucucagcauaccuguguggacaagauaaagaaauauggcuagaugcaaaaucaauuauucuuauggagguugauacgacuuuacccugauguucagaugauugucaaccuggagcaagcuuucaguggcaaaaucuaacuaagaguugacuucaauucuuuggcuagugcuuuuauucacuguuuagaugaaaaucuuaugucucagucaauacagugcacagauaacaucagguggagaggcucauacugaaugccugaauuggaggaucccaaaacaugguaacagacuggaccacugggccaacugagugagggggagguaacugaauaggaguaaauaugaggcccuuuaucccaaaguacuagucaacuucuguugagugaccuggcacagccugggcgagacucuuagagcagugcaauccacagaaauauaaugugaacuacauacguaauuaaaauuuccuauuagccaaauucuaaaaagugaaaaaaacucaggugaauuuuaguaauauauuguuuuuaauaaucuauuuuauuucaccaguuauauucaaaaugcuaucauuuaaacauguagucaauauaaaauugagacauuuuacuuuuuuuuuauacuaagucuucaaaauccaguguguauuuuaugcuucauagcaccucuguuuggaugagccacauuucaagugcucaauugccacauguggcuaccagauuggacuaugcagcucuagaggguuuucacugacacucagugugaugagacugcccccaaauuaugucauucucaggcuggcugcauuguuggaggaacugugcuuaaaguuauaccacucagaaauauuucauuucuguuaauggaauaagaaagggucggggcucuuugacaucuaaacucaugacggaagcuguacuggugcccacugccugugaccuguguccaacccuucacugugaguccuggagcaauuucagugacuaaaauacuagaauuuuaaaaagugaacacuuaccaaguggugucuucuucucuugcuuaucuuucagagcccuuggauaucuuuuguucaugguaaagguugcuacuggagccaacagcagcuuuuuuucaaggaauagaauaaaauuaucuuuccauucccauuucuaguaacacccauuggaccuuuucaaacagguuuuaaguuuccaaauccuguucccuuuucagugauuucugagcacuaacauccaucuaggauuuggcaauccagcaccuaaccaauagugaaugcagcuaaggggcaggaguauauguaagugaauaaaucucugaguagcccaaaaagauguuuaagaugcauaaaagaccaagcacaaaaauaucccccuucauuaucuccauuuugcagaugagaaaacugaggcuaacaagcuuccucagucauagaaauuaaaucugauuccaggccaagcauccuuucagccucauugcauagcucccuggaauggcuuuuuuccuugcagaacugaagacacuauuaucuguucuuccacauuaauuaccuagcauccuuccucuaugguguuuaucuucccuucuuaagaaaaucuauggaauuuuaauauaaaucuuuccaaauuacaaugugccucagauaaagcacuuaaagcuaccugaagcucagaguccaauaaugaaagaauauucuuuaacuuauuaaaucacgacaaucuagacaauggauaaaaaggagugacaaagcccaggagugacaaagccccauuaacauucuucuuuguaggaaacacauuaucccuauggggucuuucucaccaagacuagcagcucuagcucuuaguaucaugacugacccuugcauacaucuuggaaaaauggggauuaguaagugcaaauaaugaucaagacuucuccggggcugauauauaaaggaaaugaugaucacuccugagaaaugcucaacuagaggcaauucaguacauaaugaaucuuacagguacaaaaaguccacuaaacuuacauacguauuugugugguuucacuugauuuuuuguuuuuuuagagauggagucuugcucugucacccaggcuggagugcaguggcacgaucuccccucacugcaaccuccaccucccagguucaagcaauucuccugccucagccuccugaguagcuggaauugcaggcgcccaccaccguggccggcuaauuuuugcauuuuuaguagagacgggguuucacccuguuggccaggcugauccugaauuccugaccucgugaucuacccgccucggccucccaaagugcugggauuauaggugugagccaccacgccuggugauuucuaagguauguauagcccaaaggcagggaugcugcuagaacuaugcugauggcuagaaggcagcuccacacacaauacgcaacaucaguuguuaaacagaauugaaauacucacuagcagagacaaaaaguccaaaguacaugaaaaguagagugugaugugacuauauaugugaaaaugagggagauucaaaagucaaauguacucgucacauagcaucugaauugggugccaugagaugagcaaacauaauuugcaacucuaaauuccuuuucuagaaccagugguaguccuuguuccuaaacaaaccaaaggcuuucuaaccaugaggucaacugaaauuauauacaugaaaggugcuuucuaaacaguaaaguguccauaucagauuauuauucccaaauuaaaugagagaaaauauacuucaaggacaauuagaucuuuguguaaccuucauucauggaccccaaucaaccauucaguuucuuccaagcuccuuucuagcagaugccguauguguaauugggcauggggacuggaucuauaucacucuuuugcaugcgugugcauccaucuugcuugaugggaggacaacccaaauagcucacagaagaaacaggagucaugaaaaaaauaacaacaaaauguauuuaaaaacagacuucuccaguuggcauuuugaaugaaauugcuaacaacuccaacccucuauauuguguuucuuuugcuccuggaguccucuugcagcuuuaauucuugaaacucaggcggcagcaccagacauuaaauccccaaagggagagguauuaguaaaccuuuugcuggucauucuuuuccgaaugcaaauggacaaauucuuaagcccucuuauucauuucaugaugaucauuagauaaaaaaauuaagccuaacuugcauauugaaaauaaaaacaaaaacacacacaaaaaaaccuugcagauaauaaauaucgcuuauucacuuauuuuaaacaaaguccaauuuuauucacucucaauauccuugcaguccauuguauaccuucugcacugacccuuguuucaguagcuguuugauaccugaagaaagaaugaacaaaugacuccauuaacaaaaaaauguuacuuuccuagcguuuaaagagcauauuucaagaaaaagcucauaaaaggccuuaugacaaacauggaugugaauuaaauaacuaccaaucuccaacguaauugcauguagguaaccccacacaugcacauguguguccaggaugaucccuugucuuuuaggcccacauaccacauacaugucccacaaagcucuaugaaaugaggaaugagaagaggcaaucaaaagggaaagaaaacucuucagcucagucuuccauuccuucuucuguauccucuuuucaguuuuuaccuccuucauugcucuccuuucucuuacuauuuaggacccccaguggggcccucuucucaaccagucauccuagacaugcacccauaagcuucuaaucuuucuacagucuaccucaucuucccuuuuacagugugguccaguucauuuguuuuaagugauucuguuucacucccauauacucuaucacucccuagguuuugaagcacagcuuacauagacuuuuguaacacaaagaugcaggauuuuuaauauaucgccuuuacagagaaagaugaguucauuccuuaguguucuacuagcauuaaugauugaugucucaugucacuggagaguucuucuauugccauccuuuucucaucucacacacacacacauacacacacacaaacacacacacacacacacacuaauaugccauaccuucucucgcuuccucuguuaacuguucuuuuggaaaauccacaucaaaagugauuaucaaagagcccuugauauuguuguugucaaaguuggggagcccuuccccuuucuuccauagcuucgcuccuggccuggugaucuuaucccgggaaauauguaccuagaaaaccaaagggaauguacugcagcaggagcgguacaucugaaguacaucacacagcuucuagugagcacugguacacaaagcuaaugucacagcucagcaaaaagaaagaaugaaggagcaaaggaaauaccauuaagacaaugugagucaagaacaaaggauuuuaaagaagaaaaaucaaacacaaaaacaaguaaacaaagaaagguuuucgucaauagaaacuauaaggacaagauugucaaaggccgugcaauccauucugaguagcugaaaggucuggcacuguuauugcaguaugcucagcagcagaguaaguacagacggcagaauacgaccaagaaaggaguccaucugguucucaaugacugaaacagcugauacaucucaaaacuacccacauaaaggcuucaaaaggaugcagaacgaguaaauugguuuguuuaccuugugaccauccaagugaguaauauccaucucaaagccaaccagugacucaacuaaugagauugucacauuuguguacaaaucaucuccucuccuuucaaauauugggugccuaaaaacagaauaagguaaaaaucauuaauuuccaacuuuaaguucaaacaguuguuagaaaauucuuggaaaaaggugaacaccacucuuucaaacaauaaacauuucuuagacauacuuuuguguguaguauuaaucgagaauauaaaguuguuuaagucuuauuaaaugcuacuguuaaggaacacacaaucagcaaaagccagaguauaaguaaaacuauaaucauuagauuauggaaaagagagaaaggcagcuucuggggagaucaucuucagaaauaggucuacagaaguuuuccugagcugggcucacaagacuaaguuggcuguagaaaugcagauaaaauggguggagggaaggggaaauagagugagaaggaauucuggcaaagacaaggaaggugucagguuuauucaggaaacaacacauguuccaguuucucuaagaagugaugauaaagacaagguagguaaagaagcuggggaaaacaacacugagauuaaagagugcaggaaggcaaagucccagacaguggggggccauuucuccauauucuggugggaacccuguuuugaugacuccuuacaaaggcagagauauuacugguuuccaaagugguaacaagagagcaacaguaaucaagaaagcuggagucccaggcaaaacugucuaagcagcacuucaugcugaagagaagcucacaaaagaaaagcucucuuuacagaagcugcauauuauguagaagguucugucuauggaaaagucuccuauucuuguauggugccauacuucuucagcuaaaaucucagcuuugacucccuaucuuguuuguuucucuuuuauaacuccuuacuuaucaauuauuuccuuucaacaucuuuugcauuuuuaaguccuaaguaaauaaauaacuggggcucaauccuagggcccaaccccaaguuuucagccuuguagaggaguuacaaaucaucguuuaggguaauaaggguaagaaacagagaaaaaagucuaacugcucugguggccaccuacgucucuauaauuugacucaucugagaagaccucuaaaauuagauuacuuacuugacaacuuugauucggaaccguaaaucuccaggcuccccauccacgugaggcucaccuagucagagcagauuacagcauauuguaaaucauacaaguugaauaccacaaaucuauuuggcaacugauacauuuuuuuaauccacuacuuugggcauugaccugucaaaucugugacggcagugucucugccugguuguaucaaguuucagauuauuagaaaucaucaccuuugccucagauacagcaguacauaacuugacccauuuccuaaacaaagaaugauacacuggucuccugaaccuaagucuuaaagcuuuuuuuauuuuuagaguuuuaaacuuaagucuaaaggugagguccugagagcaucuuauuaaugccaacuagaguuacauaucuucuuucauugcugaauuaaaacucauuaaggucugaacacccuaaauuuugaugaaacuuaggcuaccucauaauaacuuuuggccaugacauucaaaggauaaacgguaaugcuacugcuucagguaaacaaaaggcuuuguauauccuaaaauuggccgaagaguguuggaaauuauauaugcguuuacuaugugaacauuaagauggaguaaggcaggggugaaagguauucacaaacaagcagagagcaaaaaguuaucacaaucaaaaaaucaaauaucaauauuucaccuucuccaauaaagggguacuccaugccgucucucaccccaggcucuauuucuacuuccagcguucguucuucauucacuagucugagguaaagagaauuaaaagaggagaaaaauaaugaaaauauaaacaaaacaucagauauagauaaaguuauaccuauuuuaucagagcuuuuucuuggaagacuguagugugccucuacuugacaaaacuaucugauaaucauuuacaucuucuauaugcuaaaauccagggugaagcuacuauacauuuauaaacauauaaggcugcucuaauaguacaagaaggaagaaaaugaagcauuaauacuuguugaaaauguaucagaaauaaagggcacugcuuguuaguucagaaacauaaaaggagauauuuacaaauacuucagaaaaaaauguacauuguuuugcucuauccuuuugcagaacauggcaguggggaggggacagagaaagaucuaguauggaccauuaguguuugacuagaugaacgaaauuaacaaguguuucuugguagaacaaagaaggugcuuucacuuacuugacauuagggcauucgucgcagaccaccuccugggucauuuggaagcgcccagggcccagcugggugguccgcaucucuugccgacaauugcacuuccguuugccaggagccugccuugccacagguuuguuucuaacuaccuaggaagugcauaaacaacaucagcuucucucuuguguaaaacagccuuuccuuuccucaauugaucaaggcucugcacauaugccuggacugaaacuuccccuucucuggcaaucuaucccucagagaucuaaagcugacaaaacucuuugaagaguacaaaucagcccccaaacaggaaugaagcaaacacauacuuaaaugacucaaauucuaaagcuggagaaguagagacgggaguaagaaacaagagaaccgaaaaauaaaguguaugauaucagcauuucuaagccacaacuaaaugcuacugaguuaaaguacuucauguaaugauuaucuuuuaggaaauccgagcuguguaaagcauaaccccugaggaacaaucacuaccuucaaaaccugguauguggcuacuauccaauccucugguuaaccuacugaaaaugucuccuuauuucaggaaaugcaauccaggacuauuuucuggagcuaucuccauucagauacuuuaacauguaggaagagaaacaaugaccaucucuuuguaguugacugcaaucaaacauucugaucccucuaagaauguaaaauugauauauaugcagaaauguauuccuaguuuugccuguuuaaauagucaaacaucuaaucacaagguaugugcucacgcagcagaaugacgaaugcuuggagaaaaauccuuuaaagccuaccaacauaugaaaggcccaggucaacagaguaaauuauagcaacaauaacaguaaucagagcaaacauuuuauagcacuuacuacaugccaagccaugugccaaacacuuuuacauauucauuuaacccucacaacucuaugagacagguacuguuauuauccccauuuuacaggugagguaacagaaguauagaaagguuaaguaacaugaccaaggccacaugacuaauacauggcagagccaggauucuaaacuaggcagucuagcugcaaaguccaugcuccuuaaccauugugcuauccuauuucucaagguauuuuuuuuucuuuaaaaaauaauuuacauacagaaggagcaggauugaaaacaaggaaaaaaagaauuuagcaugggguuacugaaccagcaaagccauuuacagccuuuacaauaguuggauuaaaaaagaguuuguucgggaacacacuaacagcaaaaagugaugucuacuguguauuagugacaacugcagaacaggcuuggaagggaacaugggcgcuaauuaggcucaccucuuuccucccaucuaaacaaccucacugguuuaugaauauuuuuaaugcccuuuucuccugcagccucaacaguauuacaagucaguugcaucuucugugauugucuauaucucuucuuucaauuauucagagaagcagcuacaacuaagaagaauacgcuucuugucaagauggcacauaugcacaggcuaccggcugucuccuccaguauccuggaaaaacuacaagaaaacauggauuccaggaaacaguaacuacagcacagaauauaugagaaaaucccacagauagagggcuguuuugaacuguuucccaugacugcagaaaacaaaagacuccagacagcaaacaaaacaaaaaacaccccaagacaccaaacaaaacacaguuaaaaccagugggccagggcucagcccaugaugcucugcagggaaagguaguugcugguaccuguaagggaauaucagcucaaaggccaagacagcuagauaccugagaaggucuaucaucugccccacaaaagacaacaaacugaauaacacauauauuuuaagcaacuguacuuugcuuaaaaaaagauuagacagaccaggaacuuaaaacaagcaugauaauacuuaaggagggaaggcauuaguaaaaugauauagaguaagaaauaaugcaagaaucaaguagaaauauuaugcauaaaaauaugaguugaaauuaaaacacagcagauggguuauuauuagaauggauauagcugaagacugaaguaguaagcugggagaucaaaaugagguaccucccagaaggaagcagugaaggauaaagaaaauuuauuuuuuguauuuaaaagaaaguuaagagcagacagaaguaggagugauagaauuguaaaaaauaaugagacauauuuuccagaauuuaaaaaagaugaauaaccucauauuaaaagaucccagaguuuuagcagaaaauauaggugaacagcuuucuuauuuuauuuuaaaauuuuuuuccagagaugaguuucaguuauguuguccaggcuagagugcaguggcuauucacagaugcaaucacaggacaugauagccucaaacuccuggccucaagcaauccuccuaccucagccuccugaguagcugagauuacaagugugcuccacugcacauggcugcuuucuuauuuuagaacaaaaacgaauuucuuuaaaaagacacaaaaacuaaccauuaaagacugauagauuuaauuacauuaauuaguucuguuugcugaaaauugaaauaaaucuuaaacauaaugaaaagacaaguuacaaacagauagccuauaucugcauuacauacagccaacaaagaauuagcagcaagagugaaguacucuuagaaaucaauaagcaagaggcaaaagaaagaacaggcauuucacaagagaggaaacaaauauggccaauaaacacaggaagagaugcugauccuaauugguaauuuaaaaaauguaaaacaagaccauaaugagauauuuuauacccauuugaugagcaaaaauuaagaagucuaauaauuccaaguauuagugaggcagugaaucuauaggaucucauaaauugcauguagaagcaucaguacaaucaauuucaaaagcaauacaguauuaacuuguaaaaaugaacauugguucauauuacccagcaauucuacucucaagcauauccacccaagagauauucuuguucaucugaaccuggaaauauggauuaaaauguucauaaaagcgcuguuuggaauugaauaaaacuggaagaaacaaaaaugccuauuaauaaauuauggucacaauauagcaauaagcaacaagggugaauccuaguaacauaauagugagugaaaauaaccagucccagaaaauaaugaauaaaauaccauuucuaaaaaaucaaaaacaauauaauaaacaauauauuauucagguauucauauauacaugauaaaguaagaauggcaaaagaacaauaaagacauaacucaauacaguaguuaccuuugaagggaggcaggguaauggaacagggaaguagcauguagguagauuaagucaugguaauguuuuacuuaguucuuaagcugggugauaaaacaaugacaucaguguaucaugaaccaagcauuauaauuaauucaauuuugugcauuugaucacucucucuuacccucaaaaagacagagaagguacauauaaaccucuuauuuuuagucaaaagugcaaguucugggagucaauaugaacagcuauauuguuugaacuuacuuccacaaaauuuccugcauauacuucuuccaaagugacuucuagaucuacaauaauaucacuuccucuuggaauauuucugucuugcugacgagggguuccuccaaacaugaaaccaaaauccccaaagaagcuaaagauaagugcaaaaucaucaggaaaaaaaaaaaaaucaagacucuauguuucacaauuaacucauuuucuuuacguugauaaacuauuguuucuaucaaugcauugugcaaaacuacaagguauuuuuuaauacaauggagucaacuaucauacauaauuuuaaauuuauauacuaucaaccauguuguaacuauacggucccuuacuacaaaaaaauccacuuuuuaacaaaauauagcccauacauauaguacaguacauacacacacaguaugccaaugaauucaauguuggacccaaccaaugaaauaauaaucuuucaauauugggaaaaaucugaauaugguggacuuauugagaaagaguauaguauacauaaacuuguguaaugcuaaauguaaugguuaauuuaagaaauuuuuaucgguaauuuuaacauauguaguguucucuuuacaugcuuuuuagaagcuaacuuguugaaagaagcuacugcucuacacaaaaaucuugaguauguaauuaaauaagcuaaaaaagcaucagccuuaguaaaauccuagugcuuaaggagaaggaaguucuagccucuauaagacccaaacuaauuuuuguaaguaacaagaguaacuugagauuaacaaaaaaggugaccuucaauccuacaggugguuuaaucuaauguuaauuuuugguguuauuaagaagccuuguauauuagcauagcgaagaugauaacuauauaacucccucucccaccaaccaacucaggugaaugaauucccugaaucuuaaauaaaggcaaggggaaagaacagggugggggcuggggaagcuguuucucuuucugguauucccuagggaucacuucagccagccaaauugauccuggcggggggaaaagauguccuaaucauguuacucacacaucuuuacagacccuaaaaaucuacucccccaccccaggccccucaaccaagcacuaaauggugguaacuacuauaugcaacagugauucuuacuucuuuuggggaaggguucacagaacccuuugagaaucugaagaaaacaaugaacucuccccauaaaaaugcagauucgaacaucuuuuuguuuauaauuucagaccugaaaccccagauuaaagucucuuaguauauguaaucaucagggaauguggaaauucaaaugcucaauaaagagagguucaaagagugaggaagaaaguguuuauuauuccaaccacccagcacucccagaaagcaagagauaaagguccucuacccuaauuccuuccccuaaugcugguuauuauaaucacccucacuuguugauagcacgaaagagaggcagcucuggguaugggagcaggaauuuuucuaucucugcuaacaauaauuuugcucauuaagugguuugcagauugcaagguagcaaguaggcaaggaugaacugauuuccaacacauguccccgugaauugucugcacugauuuaacugauaugguuggcuagauggaauguccuuucagugccaucagucuuuccugaagcuuugugaaaauagaagacuaucuucccacagggaggacaauaauugaucuuuggaucagcuaaauuguacuguucaucaaaaguuucugaacuagggaaugagaauaauucuuuaaucgcuaagugacccucucucagacacuaacacuuugcagauggguaaauuacucacugugaaaaaaugucuccaugggagcucugaugaccaucuuuuaauccuucuucaccauaaguaucguacuguuuccguuucucacuaucugacagaaccuggggauaaaagccaguggaggaaaagaucaugaguugguaauauccaguuaaggcacagucauauuuauguuuguuuuuacuuugacagugggucuaaaauuuuaauagaaugcaguuuccauuauguacuguauuaaggcauauuuacaaaguuauuuucucuaagacuaaauucuuugaugcacuguucauuccacauugcuccauucauguuuuuaauuuaaaguucucaaaacucguguagucacuaaaaaauaauaccugagauuagcaaugcagcugugaaggucaggguggugacaggaaagaguuaagacggauuccucagguuuacuucccaugcaguuugacuuuggugcuuaugcuguuaaccacuauacugccuucagaacaacuuggccccacaggucuauaacacccccuacccaaaacacacacacacagacacacacacacacacacacacacgcgcgcgcgcgcgcauguauuaggagauugucaagucaaggaaaucaaaugacaggcccuccagagaggccuacacugauaucuuuucauccuccuuuuuucauuuuuugguauaugcagaaauccauuuguggaagaauuuugccugccauauauauauauguuuaaguuuguaauguccugaguuugaaaugcagaaagaguaguaaguaaaaauacucuaugaagguuauucaaggucaauuucauugcuugaaauaauucuugaaguuuuaaguuucagagaacuacauacacaaucaugacuauaugcuuucucucuguauauuaaagaauguaacaacaaaauaagcuuccauccuuuucaaaauuugccuucaacaugcaaaaaaaaacuuucucuuuuauuuagagcaaucugauauauaugcacauauauacuugugaaaauuaaauggcuuuaaaaucuuccuuugauauuuauaaacuccuacuuagacaagagucugaaggagagaguuauuucaaaaccacacucaugguggcccagaaaaagagagguucaaaguagacggggcuuguugacuuaaaagaaaggcauauucacacaggacacauuuuuggcuuagggcccaaaugagguguaaggagucauggcaaaaauguauuaacauuuaagauauccuugaaaggauaaauagaaauugaguauacaagagagugaacauucuuaaaagcaaaggcaaauggguuauuccagaagugaccacaguacuugauuacagccacuaugaaagaaaaagggagaggaaagcauguuuucacaaguaucuuuagaaaauagguacuuuggggaagcagaaaugggcacaauuaacuugaaaaaaaaaaaaacccuuauuauuaacuggaucuccaauauuuucacuuuuagucuacuucucugaucugaucuucacaaauaaaugaacccugcauuugagacuauaaaaaacaccauuucaaaacccccaaagacuaguuuuaagucaguuucuuuuuagacaucagaggcuucuguaauaacccccuaaaaacuacucuugaagucauuaucauuuacuuccuccucacuuuucuuccaucaaggaaugcaauuuuauucuauggucuuggaaacuauuuuaaaagaaaaaagguuuuuaguugauuggccaaccaauacacagauucucaaguaauuaaaaugccagcagugauccuagcucuguagagaaaacaaauuuguauucacaaaagauucuucauaacuguacucggauucuaauuugugaacacuaauuuaccuaagacuaaaggcaaucaagcuugaaugauaaaaagaaaacagaaauuugaacuaguggcuaaaaggauuguuauaguuaaauaagccacgauuucaugacugaccuuuguauagccugccuaggucauugauaaagaacgugaagauucuuuagagagcaugguaaauucagcuucccuagaaaauguuuuugaguauuagguuccuagcaaacaaggggacuauucauggaaaauacagugcaaaauauagaaugcauauuaucaacaagaaacaaaauauuacauauaauuuaggaugggccauuaaccuucccaaguuuauugaugugccucagguuaagaauuucugucccuuggccaggcacgguggcucaugccuguaaucccagcacuuugggaagccgaggcggguggaucaugaggucaggagaucgagaccauccuggguaacacagugaaacccugucucuacuaaaaauacaaaaaauuagcugggcaugguggugcacagcuguagucccagcuacucaggaggcugaggcaggagaauggcguaaaacccaggaggcggagcuugcagugagccgagaucgugccacucuacuccagcuuggcagacagagcgagacucugucucaaaaaaaaauaaaaaagaauuucugccccauaggaucccugaagguguugaaagaugaaaggaccccaacagcucuuggguucaccuggguauaacucacuguuucaauuccauugcuucuuuaaucuagagaucuugggauuccuuccuuucaagguuugugucuuccuaaaauauuuuucaauuuguuuuuagccuucucaauauacaagaauuuaaacuuaaauucaggaguuuuagcucuaugacuuuuaguucaauuaauuuuuuucuguguccauuuagaaaaugagaauaaaaauaugccuagcucuaauauauuuccugguguccuagugaagauuaaaugagaugauacacaugagaguguuuugauccccagauuagagguugcaaaaucaaauuaaaacugugcucuguuugauuuauguaaaaaagaaauuuaacugaauuaguuaccaacacuuuuacaagcagaacucauauaaaaaaucuagauuuucaacuuuucuugaaaaauuaaaucauccaggaacauacuguuugcauuuguaugacaaaaacuggcugggguugaguaacagcugcucccuugaaauggggccagaaggcuucaguuugucaaaguccucaacaauccuuauugcuucccaauauggaggcagaauaucugcugccauguuuuaacuuauaccugcccugcauguuauuugucuaguucauaugaacaugcagguuugcaacucucaugaaggcuuucuuuuuauuuuugguucuagcucccaaacugauugaacgacagaccaaucaguugaucuacuuauuaaucuauaauaaguucaagacuagccuggccaacagggugaaacccugucucuacuaaaaauacaaaaauuagccaggugugguggcaugcaccuguaaucccagcuacuugggaggcugaggcgggagaacugcuugaacccaggagguggacguugcagugagcggagauugcaccacugcacuccagccuaggcaauagagacucagucucaaaauaaauaaauaaauaaauaaaugugagcugaaaggaguguuucucuguauuguauguuuuuucuagagcuacagauuuuauucguacuuuaucacuuuucccaacucaccucauaagcagcacccagauccuggaauuucuccugggcuuguggaucaucaggguuccggucgggaugaagcugcagggcuaguuuccuauaggccuuuuuaauauccuuuauagaggcacuucgaggcacccccaagaucuuauagaaaucucgucugggaaguagagggagagaauacuucauuaaagaguuacauguuacauuuuucaaaguaaaagauuuauuuuuccucuacauuuagguuuguaucugagcaaagagguauaaaaaugaagguuuaugugacacauacacacacaaagaaugacuaaagagagaacaccagaauuuguaaugaaucuuauauauugaaguaaucacaguaagaggcuauauacuucuuuucggauuauucaaaacaucuguggcacuuuucuuucagaaccaccuucggucaagaaaaccacuuccuuauuuuauggucucauguuaucuuuaggcaauaaccauauaaucaaauuaacucuuccccccuuucccuauacuggcuccaaaugauuuugacuuuucuaaaagucaaauaacacucucaaaggaugauuuuccuucuuuaaaaagauuaugccacauaaauguccuaacaguagcacugccagaauguuaaagaugaagcaacuuaagauaauaaauagcucaagaagcugggaaguacaagggcugucuaaagaucuucuuguucccaucccgcauccaauuucguucagucccaacucgggcuggcaucauccacccacuuuaaugucagccccagaauggcucuucgaaggcuuggcauagagcaucguccgcuucuccaccucagcggggcacagcaacucaccucuuugaucaaacaaacguccauccccucaaccucagccuggcacugucacuaucuuuccuuacagucaggcaucccucuuucuuccccagcucuacgugacacugcuucagcucgcaaccaccuucuuucccucaucccccaaaugccguuuggcaaugcauccaacucccacuccucugggcaaaucuagcucuaccuaagacccucucuggaccuaaggcccucucacuggugucacccacgguucuccucucaccccacuagccuggcccauacuaccccuuccuccgccaccccgccaacccacagcgaugccccucuccacuccgucagucuggcaaugccacuucccccacccccucccaccccccagcaaaggcugacccacaggccccguugucugcgagugucuguuccucacccggcaaucaccgccccgaugagguauagcagcaacaggcaaaaggugcucagguucugcggagccaugguuccucugucccggguccuguuccacacacuccucacagccuccuccgccgccgcgucggcucgccagcccacccggcccugugaggccgccucacaccgggggggcgcgggggucuccuugguccgcagagacagcuagcuagcccccucuucugccgguccacuucccgggagucccgagucccggugagagaagcccccgguaggcgagagccaaucguugccc

SEQ ID NO: 18071 - RNA, 8303 nt, Homo sapiens
augaccacauucagcuuagaaccuucuuuauuaaggaaggucuuucaggcacuuucauuaacaggcacauauaagcuuagcaagagcaccuuucaaagucacaguuccaaugguuuuuguaaggucaaccagaggcagagaacacaaucaugguggcuuaccgucaaaaucaugacaaguugucaaccuaaugccuucugucaaacauaaccaccacccacucugcuucuguccugugaggaaugacgggaaguagggagucaagacuugauauuaauguagaucgcaugugacacuugcguggccagcagacaaggccccccacccaugcccaggcuuggacaaaaugguggcuauguuuucugugccaaaccuccucaucucugccaugucuagccuagaccuugaagugucugauccuccccggacauggaggaaccacuggcccagcagcagcaccaacacuaggcugcaccacugugcguguuuuccgggggugcgacacuucuccugagggugaccccaaugagaccacacccaugaagguguggcgcaggucguagugcgcccggugcaacugguguccuggaggagcugccaguaacacaugggagucugggggugagccagcuggagggaguccaggugcgccaaguggaggggacggaggugcaucuggguccaccacggguguggggacugcuucauuggcaccuucugguuggggcugugagcucacgggcuggaaaaaggaccauuuccuucaguuaguuugcuuccuccucccaggcaagacaacccacaggcccagguggcacuggcacccaauuuccucacauuauacauuuuuauuugcaaagagucuagcaagaaaggaccuacccaaguacaagggauugucaucaagguuacaaggaggggugacuggccuauguuggccccggccucacuaggauugucuuugugaugguggacuuacacgcauauguccaaugaguaaaagcaccccaccuauggcucacccuugcccagcagugccacccucuuugucaucugaagcugcagccacugggagcuaacagguagaucuggccaccuggucucugcaacucagaaaaccacucccaccucccacaaauaaaaagguggcuuugucaacuacacaguaagaugguucuucccuguagucacuaguucgugggagggaaaggcauagcuaaaauauccuuccauuuguugaugauuccgcauaccccaguguuauuucauacugugagauucagaagcacaggagagcaaauguccugucaucacuacugcacugcauaaaugugaaggggucauuguauucugaagguguaggcaagaauauucacggagcuguuaccuguguuuggaacaccaugcaggucacugcaaccucugccccaccaagcuucucacugaguguugccuuacaaaagccauauugcugcccacagagaaagaggauuuauuuuaacuaauuucaaaaauggaucccccccaauuucauugacgcgccaaccuuaaauuaguuugaaaaaccauuuuucuuaaaguuauaguuucugcuugugggagguauaugauucuauauauaacauggaaauacagaaauacuuugagagugagagagauuacccauaaucccuuucuggugguggccuagaaagaaggacuguuaacauugaugcauuucuuucuuauuuuaaaauacuauuaaauaugauuuaaaaauugagaucauugugacuauacgauguuguauccuguguguuuucacuugccauaauagcauuuucucauaucauucauuauuccuugaaaacacaauuuuuagugucugcacaauuuucuauuuacugaugugcauggauuauucaaugacaccuuccuguuggacauacagaucucucuuuuuuggucucuuuauauccauaauaaaucauuuuuauagauauauucugucaaaugucacugaugaauucuuuuucuuuuucuuuuuuucuugagacagagucucguucuguugcccaggcuggagugcaguggcacgaucuuaguuuacugcaacaucugccuccuggguucacaccauucuccugccucagccucccgaguagcugggacuacaggcgcucaccaccaagccuggcuaauuuuuuuguauuuuuaguagagacgggguuucaccauguuagccaggauggucucgaucuccugaccucccgauccacccgucuuggccucccaaagugcuggaauuacaggcaugagccaucaugccuggccacugaugacuucuuuagacuaaaauccuagaaguguacauuauuggcucaaggacuugaaagcuuuuguaucagaguuauaugucuagaaaaugugcacuucacauucccagugggugggcgugacuuggcuucauuagcaaauagccucucucuuucuccuaacuucaugugcuuccagugggugagaugauuugaugacagcucuuaaagggaugaggugacacccuaaaagaaggcuugccgugauccacagggagaggggauuugcacuguuauucucugucugcagccccaagauacaaacuauccaaggauguucuguuccacaaacagcucuguccgagugguaacaccccaaggucccggcccacucaccuuuucugccagcagguuacacuuggcugccucuguggccucuuuagcaacacagucagugccagacacuguaaacuccacauagguagaaggugggaggggcugagaagaguacaugaaaaugcucuugaggaaagaugacuuacaaugaaaagggcagagaaggagagcgggaaguagccuccuucggggagcaccauucaugcagaccaugcgucggcccagaagacaugucccucaauggcuuacauagggcaguugcuaugggguuguguucucaagugcuugugcuuuagagguagggguugugucuuccuuguaggaggggcaaguauccaucaccgguccuucaggguggaggugaguuugcagauaggaaaccggaaucagaaggccagcauuagacugauaggagugggaacccugccuccccccagcccucacucuugggcugcacuugauacccaagguucagguuauuccaaaauagggugggaaagugaagagauuaauaccucuuccaccuguuucauagagcaggcucaaaugaaaagauuuagaugaaaguauggaagauaucacuugagcuuuucuuuuuuaaaguaguuggagcauauggacacaauaaaauaucuguuauuugguguagucugggguggggauguucugagaaucacauauucugauuaauagaauugccgucuauacuagcguauuuccaaguauggccauggcugauauccagaauacauuuucuuaaacauuugaauucuguugaauuccaaugugcuaaaccacccacaguacaaugagauguuuucuccagugacucgaaaggcauuuuaagaucuugccauuauaagcuugucagcacaagugaguauuaauuacgagucuguggcagauguucagcggagaugggugguacuggagcccagcaaauuuacagugagugcuucuggccgacgugggcaacucuaccagcugacacugagcuuugguuuuagcuggaacggagggaguggggauguaccugccggcagcuguggcugcuggacguuacaguggcucagcaugggggaggcgcugaggguguugggguccucaugacacucaggagccucauacccccuuaggaugcuuucuucccuuuccaaacaacccucuccuugcuuucucaucgcugccccugcgccuguucuucccugccucccgcuccaccacguacaguacauucccgaagugccaccgaacugcccaaccugucaaaagaaucucagucuuuaccacaagcugagcccgggaaauuuccuccagcugaaaauuggagccguuguucugagcguugaaggcggccagggcagcuuucgcggcgugcaccacccuggugucguucagcggggccagcagggggcagucuuggcacaccuugcgcacguccucggcugagucugcucggagagaggaaaccaggaugugggcagccauucucccuggcauggccccagcucugcugcguuagcaagggcuaaggcauuccccagauagcuucaggcacuuucucugcuucuuacuaaaccuucaaaaggcuuuugcuaugcugacauuucugcaggagcucuuaucaucacgaggcaauuuucacuuccaguaagaauaacuucuuauuuuuuugagacagggucucacucugugucacucaggcuggagugcaguggugcgaucucggcccacugccaccucugccucccagguucaagcgauucuccugccucagccucccuaguagcugggauuacaggcgagcaccaccacauuuuuguauuuuuaguagagauggggguuucacuauguuggccaggcuggucucgaacuucugacuucaggugauccaccugccucggguggguggauuacaggcgugagccaccgcaccaggccaagaguagcuucuuaaaacacaauuuuaaaaaucccagaacccaggaaauuuggcuucuccuuuuccucaccgacaaagcugcuagaacuacuuaaguugaaaauuauucagaucccuuccccacuuucucuacaaggaaaaaaugagaauaagaauagucaucuguaccuggacuggaaucacauuuugcguauaccacggaaaacuugccaucuaguuucaacagcuggaaaucacagucuccuucgacagccuggagaaagaaacccacgugaggauggcugcccuuccccuucgcaccccgggcaggcucccuccaggcacggcugucaaaggugacccuugcaaaaucgccuuugcuggguaauacugaaacauggcacucucugcuuucagggauacaacgauauaguuaaacgcuuguaaaaaucagccccagggcaaguggcaucaaauggcaauuuuauuuaugaugaugauuauuauuauuauuauuucgagauagagauucacuguuguugcccaggcuggagugcaauggcaggaucuuggcucacugcaaccuccaccucccggguucaagcgauucuccugccucagccucccgaggagcugggauuuacaggugcccgucaccacguccagcuaauuuuuguauuuuuaguagagaugggguuucaccauacuggccaggcuggucuugaacuccugaccucaggcgauccacuugccucagccucccaaagugcugagauuauaggcaugagccacugcgcucggccacaaauggcaauuuuagaaacugcacccuggcuagccaagaaggcaggcugagacgcugggugaaucgguggagcuggccgaagggccaccuacagucauccuaagaaggguacucacaugcuccuucagcugccucacgcugcaucuugccacaggggugggguccagcacauggcaggugguuuccagggugucuauuucaaucucaaacagcucuccggagggcugcuguggagacaaagagugaagccgugagcaaccuauuccccugauccuguggugcgguccacgguaugcgcccucauugggcuugagagcaccccgcuuuuggagaggugagggaaaugucauucuuacugucagucugcaacuccgucuagcucugaacuggccugugggcaggacaaugaccagggcuugucuggucuucgucuguugauuaaggaagcaccagaugaugcucgcaaagcagacgggguccugggcuugaacaagucgauggagccacagcccucacucugagcucuauuugaaaacuacaaauggguguuaacacuuauuuguauuuauuauuuauuuaauuuuuuaagauuucacucuucaagcagugcuuuggaaaaugcaaguuuggauuuuucucagacaagcugcaaaauaaggugguguaggguaauaucuuacugucuuuuuuuaaucuccucuaucccucccucuccuucuuucuuucuuccuuuucauuauuugcuuuccuuccuuccuccguuuucuuuucccuccuagagguuuuugcugcuguuguccuugguuuuuccuuugucuuggcuugugcagcaggugccggcaugcaacgaugcugcucucuacuucccccugcuggcgauaauggggaagggcaugucucccucugacaggaaacuggaugucacuaguguagacacgagggagcuugcaacaauccuuggagauauucuugugaguucaccuguuucuguaucuugucuucgaagccugaaaaauccagaagguacaaguaugccuuuucuccucucagcccagcucuguuugccucucauugguucugccugauucacuaguaccugaagccucagcauccccuccccugggagaagcuccgcauuuuaugauguccaggugugcccagagugacugccugaaagcguucacagcucuggcgaacaggaaccggguacaccuggguuucucaagggaaccaacucugaagcucugccuuuaguaaaagucacaaugcccauucaugauuaccuuuucccucagaugugcguguugcguguucauuuccccugacuugaucagcguuuccuccuaaccaccacugugcuuuaauauggcugcagcacucuuaaaauccauccggagcaauccugauuucaaauauuuugucucuuugugagacggauggcagucgucagucgguccaggcuuccuguuguugaccuuauuuuccaaccuagauuguaagcucuugugggcacauauugugccuuuuucaccacuguauuagguugaaccauuaaaacggccaauauuugguugcuuuugauauagaaaaauggcaguuuuauaugguucaaccuaauaucucugguucuuguccaaggaaggcuuguaauacauauuugcugaaagaauuguccuuaaucagaaauaaaucuaauuucaaaacaggcaguaggcagacagcuucuuuccaccucuccaaaucucuugacugauccccgaggcauauuuccagcuugauuuuucuugucacuggcuucaagcugcguugguuuccugucuagugugugaggaggugaauuguguuuaugccaagacuucucucugggauguggguaacucucuuugggaggcaguuuguguagaagaaggaacacagauauggaaucaaaucccagccugaagacuuaguaauuauaugauuuuggaccaaaaaaaaaaagacaaaaacaaaaaacaaaaaaacugcacacacacacacaacagagccuuggucuccucuuggguaagacaagaacaauauauguaccacacagcaccaggaggcaggaccgggaaagaguaaaugagauaaucuaugugaaugggccuggcauauaguaggcaucugccagaugcuaguuuuauucauucucagucuuuguuagagagaaaccaaaccaaagacagauacgugauuuucagccagugguaacuuggcaacuaggagcuggucucuuggguccuaguuuuuccagcaaguuacacuuucugucugugaucugcacacuaccauuugaagcacuuuuucuccugcacaccaccucacaccccacccagcucccuccugacacccaugacugccauacagaaugucuccucuccugcccucugccugccccuucccucacuccugggaagaaaucagagaauuuacuccucugugguuucauuugcacugggugauggugauuuuuugaggcaccugauugagcuccauguacacauuauuucagcucauagacagcagguccacuuaccugaggccacaccuuuacuucaucaaucugguucaagguguguuuguauccccaaggaagguuuugauugauguagucuauagccaccagagcugcuuccucaguuucuggaucaucgcaguucgguugucuauaaaucagcccugggccauguggggcugaguggcagccccagagcugagcaagacaaaggagcaggacgagggacuucauggcugccccagagaggcccuggcaggcgugcaggugguuggaggcuucgggaccaacccaggugcucugcugggaaagguagacccauggaggguggugggcuuuauuuaucuguug

SEQ ID NO: 18072 - RNA, 1067 nt, Homo sapiens
aucuucaucaugcugcugagccacuguccuugaucggugaaaacguggccauauauccuguucacuaucaggaaucauuucgucuucuucaacaucacccuuagguaggauaauaucuauaucugaguacuucaugccauucacuaacacaggaaucaaccugggaagaugccuuacgaauacaucuuugcauacuugcuguucagcuaaaguuagccaaaauucacaggcuucuaaagccacauuuucaucuugaucuugaguccucuguagcauauacucaacuauauuacgcaugugagggagcaggcgauccacucaaacuucgaacaacaucacaagugcucggcacacauuuuuccauaccucuggcucaccagccaaugcaaagagauuucucaauaaaagaaucaaugugcaacaucagagcuugaguccugaugauaaacugauugacacauacaacagcgugagaccuuauuuuuggacuacugugcuugaagaacuguaaaaauuugggaauccugauguugagaggacaaucuaaaacaucacuaucuaaaaucucaacagaaucuucacaaaucuucugaagggugccaaaugcucccucacaggugguguaaucgucagaauccaacaggcuacagaguuuugguaagaggucaggccaauucugcaauucucucuuggaggcuauagcugugaucgaaauaccaacaguggcucuaaucagaagagaggagucaccaauauuauuuaaacauucacuuuuaaugaaguuuguugcaccauuugggaaguucugaaagugugcuuucacauuauucuucaagaugagaccacgcaaugaacuuguggguucaucuucagauuuuaauuuuguaagaacaaaaaucaaguaguugcuaaagucuggauauugauuaaguuguuccaguuucuagaauuguugcacaguucucuggaugguggugucuggggacugggacuccuucaauagcugcaggauuugcugaagcccuugcuuaucagauuuccauucguacuccaccuugguuugcugg

SEQ ID NO: 18073 - RNA, 46152 nt, Homo sapiens
agauguucaauacaugaaaaucauuauuacgaacugagauauuuugcuaaaacacaugugauuugggaacagagucuugguuucuccucguaucuucccagggacuuaggaugggguuggacacagaagauaauugggugaagggcagccuaacuacucaugugcccacaugauacguauaugucuauuucucugaccuauccugaucucgccaugcccauguucuacucugagguuucuggagccagcaagucacuucuugcuguacuuggggcuguggggccagccauccucccagucuuguggcugugauccuuucaugagaccuguuucuaguuuccagccccugcauucuagcacucuucuucucugcccccacucugcuuuaucagcccaucugugcaggucugccucacagcaaucagcaggagccaucccugugugcuuaaauuagagaugcuguuauucucucucucucucuuuuaauaaagaaaaggaagucauuucuuauaguuauggaggcugaggaguccaaggucaauggacuguaucuggugagagcuuucaugcaaguggggagucugcagaguucuauaguggcacagggcaucacacggcaagggggcugagcaugcugcuauuuucuuucuacuuuuaaacuugaguucuacagacuuaguagacuagcugugaacauauauauauauauauauauauauauauauauauauauauauauauauauauauaaaaucauccauaaggcuggcagcacugaaagccaacauggugggcacaggcaaaccacaguucuuuuaggccccgaaccuauccucauauuagacaacauguacugaagaggagacgugauaugaagaggagagcugugagguuuauuuaaggaacuugaugaacaucuguaguggguggggaagaaagauuugggaggaaauuuucaacugcuuauugucuuuuuuuuuuccccucaugaaacaucaccuccaauucaagaguguuaugaacauauuauuugcaaguggauuguuguaaaugaaaauuauguguauuaauccguaagaugucugaaaugaugacugagcaaugcauuaccuaaaaauauuauauauuggcuaagguugaggucaaggguugggggagggauggggaauguguuagucuguuugggcugcuauaacaaaaacaccauaaaucggguggcuuguaaacaacaggaguuuauugcuuaugguuuuagaggcugguaaguccaacauuaaaauaauggcagacuugguguucagagaaggcucagucuccuggucauaagugguaccuucuagcugcagccucacauguuggaaggggcuagcuagcucucuggagucucuuuuauuuuacuuuuuaauauuuauuuauuuauuuacuuauuuuugagagagagucuugcucuguuugcccaggcuggagugcaguggcgugaucuuggcucacugcaaccucugccuuccggguucaagcaauucuccugccucagccucccgaguaccugggacuacaggugacugccaccacgcccaacuaauuuuuuguauuuuuaguagagaugaaguuucaccauguugaccaggcuagucucgaacucccgaccucaggugaucugcccgucucaaucucccaaaaugcugggauuacaggugugagccaccaugccugguccgggucucuuuuauaagggcgcuaguuccauuugugagggcucugcccucauaaccuaaucaccuccuccagaugccccaccuccaaauaccaucaucuuggggguuaggaauucauuguacgaauuuuggggggauacaacaugcagaccauagcaggaagcuguggguggagggcccagaacugagauacuguccagagggaaaguggguaucuguacuucucaaaaaaaccaaaaccaaccugucaaggcagggaccccagagaaaaugggaggagaagccucacauguauagacugggaggacaggaucaucuccaaaguaaugccccagccucugccucucacuuauaggucagaggguccuaagugauaagagagaaccuugguggaggcugcuccacaauggcccccauccuggaauuuuaccaggagcacccuugcuugcccacucaucugucucagacgcccaggaaauuuuugcacgugucauaucaucugugcuuaucucaguguugagauaaccuuuucccuuguuuucuccuuaauuugguuuuccaguucucugcaaaagagaacugcggaguggggacuggacaaccucugaaagagcgccuucugcuuuuguggagugcaguggcgugaucucggcucacuguaagcuccgccuccuggguucacaccauucuccggccucagccuccugaguggcugggacuacaggcgcccgucaucgcgugcccgccuaauuuuguuuuuguauuuuuaguagagauggaguuucaccauguuagccaggauggucuugaucuccugaccugugauccgcccgccucggccucccaaggugcugggauuacaggcgugagccaccacgcccagccccgguuaauuuguuuuguguuuuuaguagagacaagguuccacugugcuagccaagauggucuuggucuccugaccucaugauccgcccgccuaggccucccaaagugcugggauuacaggcgugaaccaccgcaccaggcuguucuuaguucuuaaguaauguugacauaugggugaugaugaaggagaugauuaaagcuuucaaagaaaguggaagaaugugucaaauucucucuucacuuccuagaugacuucaguuuccuaauccauaaaauaggacuaagaccauuacuuaucugaugaaaaggagagacaauguaauaaauaaggugcuuugaauccuguauuaguccauugucacacuacugagaaaauuauaaauuaccugagacuggguaauuuauaaacaaaagagguuuaauugacucacaguuccauauggcuggggaggccucaggaaacuuauaaucaugguggaaggugaaggggaagcagggcacaucuuacauggcggcaggugagagagagaaugcaggggaaaugccagacacuuaucaaacaaccagaucccgugagagcucccuaucacaaaaacaucaugggggaaaccgccccccacgauccaaucaccucccaggaggucccuccccugacacauguggauuacaauucaagaugagauuuuuggguggggacacagagccaaaccaugucagaucuccaaaugguagcuauuauuuagauguccuuuucuucugucuuguuacagucacugacacaguucaggcucuuauuauaucuccauugaugucagcuuccaaucuagucucuugcauucucugcuucugccaucuauuuuccaguguggugccagaggaauccuuguaaaauacaaagaugcaugucaugcuacugcacagaaucuuuuaauagccuccuuuuuuuuuuucccuuuuucgaauagggccuaaaaucuucaauguagcauccuuccagaaauagucuucugaacuuggcugcuucuauucauucacgcauacauacauuuuacugucaggagcaccuucuauaugccaaacacuaagcuacguguuucacguaggucauuucacaggauccugaaaacaacgcuuuccuuaauaucuccauuuugcagaagaggaaagggaggcucacaggauguggaacucacccaagaaggcacagcgaguuggucauaaagauuugaauucacucuggcuggcacucccuucaauuggagcucuuuguacugagcaaaaaugccucaggggcagcagggaagggaaugacaguaucagcagaagggagccaggaucaggacagggaggaagcaguguuuggaagaagggugcuggggacagggugcggauguaacuucccuuuccaagguuggugaugugggguaggcaccucauuuggagacagaacucugggccugggcuucaggcacuuuaagugugcacuggacuuuguguucccagaggacccccaaaccuuccaguaucuccuuccuuuccccuuucccacccagcacacagccuggugccuagugugcacucaguagacaacugggauaugacuauugccucugguagucacauccucucuuugggcuaugggaggcuggacuggaggccuuaaaggccccuuccgcccuccuguugggcaguuuuucuuucuuagggaaaucgccuuggggcuaucggggauggucaguacgcagcuugguuaauccucuuuccuuccccagcagccccaccgucguccgggugaaaagaaagaaccucgcucccuucaccauccaggcugaggcuucagucuuucagccugcagcuugggguggaagccucugggugcagggguucgaggacgcuccucuccuucuguauuugccauuugagagcgcccaguaggagucaugccucaauguuaggagguuaaugccaaacgcagugaaagauuuuguucuuuccuauucuagauaagagcaacacgagucuucggagagguuaagcgacuuccucagggucucgcagucagccgguagcagagaccggguguacagcacccgcauguuaggaccaaaagccggacacugcuggauugaccccucgcggccaagcggggaagaggcauuuagggguccuugcgcagccgcguggccccucccacucggcccucgauccacccuccuugagagcaggcaggauucuagcaucacccagugccuucaucaagagucuuuaaccccaagcccgcucgcuagcgaccuccaggccgguuuggggcgcgguguggccgguggcgagagguggagugggggcggagaccgacccagucuucgcaacucuauuugcauacggaggcgacucgcuuccuucccgccccuccgccgcgcucuucuuccuuccuucuccagucccuuccacugugcgucuucugucccccguucuuccccagcggaccccucuuucgagacucccuagugggguccccagcucccgggcgauccugcccuugccgagcgcguuuucuggagucaccugggggaggggaguccugggcagggccgggcuggggaagacgccuggggcacugcccggcguuaacaaagggagccgauaccgaccggcgugggcgcggagcgggcggccgccaccgagcgugcugagcaaccgcagccuccgcggccgagagugcagcgagugaguagggggugcggugggcggcggcgcggcccgggcuaucccgggaggagugugaugcaaaggggcgcgggaggauagcggaggcgcggggcccgcggcgcgcguagggcgcagggaaucucucuccagcuccgccucagcugccuuggcuccggggcuggccgccuuuugguugggggugugugcauuuuugucagggccaaagggccacccuggcuucucucuggcuccgcgagccugcggauccacaacaaacccacgugcgcacagccccggggaacacggauuucuccacggcaccgucaguauggggugggguggcgugggggcauugcgccuugcagagucuggguuuacggaucgacaaauugaggcccgcggcagcggagggggcacaggcaccauaacaaacgcacgugcgcccugcccggagagcuggacgcacugcauacccuuaggggccgcccugcggugccgggccauugucucagccucgggggagggaguggcucuagaggcgccacuugcuggaagagggcgagagagacauuuaaaagguaccgcuugggcaucagacuaaacugccagacuuaaaaagggaaaccaaaacaagaaagcagcuacaaaaagguuacuccaggcugagucgguccccggccguggcgcauucuuuugggugaaguggaccaccccucaccuucaccuccuggaggucucuuagagauguggguuggguuaagggucuaagggugccccucaaaaaaagagagugcugggugcacuauuguccccgcacuccggcgauugccucuguggggauauuuuggucgccuccucagccugcgggaagaauguacgagucgcccagugcggucuugcucuuugccucugaggcccguguccgugugcccagacaccccagaugucacuagccccuuuuggcuuguuaaugcauuuucgcaagcaaggccagccgagaccucguauucuagcuggggacguacaauuuucaguucugaguuuauuugaaagaaauuccgagguccggaaaaagagaacucuuguuuguuuugcuuuuucuuugcuuacauaugcucagcucagcuuugcagauguuaaucggacacgaucugcagcggggagaugguuucgcggugaauuggucucugaggcgaugguguuggugcagguugugggcgugcagugugagcaggaauggaggcgccgccgccccagugugugccugcugagcgggcgggcugcugccucaccuuggcuaguguggcugaagauuaaccuguccccggggggggaacuggagagccuccaauccuauuccgcuguuauugaaaaggucuagagagcaucuagggagccuucucauuuuacaggcaggaagcugaggccggagaguucagccacuuguccaaguuuaaaccgggugaaacgggccacagagagaacacuugagugugggucucccaacucccacugcaucgcucagcgggcaacuaaaggcaaaaccgggauucugugauuggccuaaaaggcaguggccuuaggcagaauagggugaaacaaagaguaauucaaauagaaagcugcacccuuccauuaucccuuucaagaauucuuuauucuguugagaaaaaauagauuuaguaauuccuuacucuccuucaagccuuucaaaagcuuaguuauuuuucucuccuggcugccccuuccccucaaauuggaauaaggccagcuacggagacucagauguuuugccucucauccuugugccaggaggccuuuguuugggcaaaagcaugggcuguugacaucagccccacggggaagaaagugugucuuagcaagcuacuccugagccacuugugggagaacaaagcauuguuuucacugaucuuauuaaaguuacuuuuuuuuuaacgagagucccauggaaguagcugcuuauuuuuguauuuggcagagaaguaggaaaaccaaaaaaacacugagaagccggauuuccccaaaguuaacauguuguuuugcacugugccuguuaucuccuaguuacacuuguuucuuuuccuuagaguuuccagcguguuucacuuucaaugugauucugguagcaacaggaggcagcuggaugccuaggcagauagggucagguacccggugaaacccccaccuccaggccaaagacaguuuaaagccugaaagccaagcuacgaguuaaauccucagaccagagugagaacuuguuuggcgugcuuuccccuaauugauuccuacauuucgccuguuuuacauauacccacuuuuuccuaauugguuuucuacgcugccgugcccaccuuugaguggugucuuugcuuucaucuuuuuugcauacucacaaaccggucagcaugcacucccuauucugaguccauaaaaggccccugacccagccacauuggggaacuuuuccgucuucagguaggggaccaacccgguguccccucucugcugaaagcuguuuucaacacucaauaaaauucuuaucugccuuccucucccuucaauguccaguguauccucauuauccuuugguguggugcacgagcucggaaccaccgaacgcggguacaagcuauaauacagugagcugggacacaccugcauggccgagcgagcacagguggggcauugcuggcccgaggaccaagaagaaaaauccuacaucaauuccucuuggcacugcaguauaguuuucucaccaggacgcugacccuguaaggaacuucagaaaucaugugacuggacccuuuuacuuuccagaugggaaaagugaggccuagagaagagaaauugcuugccuaaugauacacaacaaugcguggucuacuuuuagugcaccuuuuugcguaaaagggaaaugguugcaucaaaccaguaguuguugguacuccagagaaaagccaaaguuaugguuguuauaacaacacccuuuaagucagagaaccaauuccuuauggauuuaaauagguuugguuauuaagcaaagccagggaucccaguaguagguaugcugaauagugcaauuaucucuggggaucagcuuucuuuaguguuugcugaacgguucacuuuacucuugugcuggguuccuccaugucucugucuugugcuuccccauuuaggggcugcuuuguaugaaaucauaaggcaagaggcagugagaagacagaagagagaggcgccacuuagcuguucaugcuacuuaaccucuugggcuccaguuuccuucuuuguacagugaggguucuccuugcccagucucugcacaggcuguuccagcggagcggaagaugcucaggccauaggagggguuuggggucaucuuccugucucuaguauuacuuuaaaaccagcaggcugggccaggugugguggcucacuccaguaaucacagcacuucaggaggccgaggagggaagaguucgaauuccuugagcucaggaguuugagaccagccugagcaacauagugagacuaccucccccaccgccaucucuacaaaaaauaaaagaacaaaauuagcugggcaugguggcguacuccuguggucccagcuaccugggaggcugagacaggagaaucgcuggagccugggagguggagguugcagugagccgcgaucucaccacuguacuccagccuggggacauagcgagacccugucucaaaaacagaaaauaaaacaaaacaacaacaacagaaaaccagcaggcugccucugcguuguguaaagugaggggaguaaggcguaugaaucuccugggguuguugagggcauuaagucacaugaugcauucuuaugacuggucagaccucuuggcaggcuugagugcuuaccagcuuuuaaaaaauuuuauuuauuuauguauuuauuuauuuauuuauuuuuucagauggcgucucgcucugucacccaggcuggagugcaguggugcaaucucggcucacugcaagcuccgccucccggguucacgccauucuccugccucagccucccgaguagcugggacuacaggugcccgccaccacgcccggcuaauuuuuguauguuuaguaaagacgggguuucaccuuguuagccaggauggucucgaucaaaaauuuuauuuuuuuuaaacuuuuauuuuggguucagagguacaugugcagguuuguuauacagguaaacuugugucacggggguuugguguacagaguauuuagucacucagguacuaaaccuaguacccaguaaugauuuucccugcuccguuuccuccucccacccuccacccuucaagaaggcccuggugucugucguuuccccucuuuguguccacguguucucauuauuuagcucccacuuauaaguaagaacaugugguauugauuuucugcuccugcauuaguuugcuaaagauaaugaccuccagcuccaucccuguuccugcagaggauaugaucucauucuuuuuuauggcugcauaguauuccauaguauauauauauauguaccacauuuucuuuaucuaggcuacuguugauggguauuuagaucuuugcuguugugaauagugcugcagugaacauaugcgcgcaugugucuuuaugguagaacaauuuauauuccuucggguauuuacucaguaaugggauugcugggucaaugguaguucuauuuuuaguuuuucgagcaauccccacacugcuuucuacaaugguugaacuaauuuacacucccaccaacaguguaucagcauugccuuuucuuugcaaccuugccagcaucuguuacuuuuugacuuucugauaauauccauucugacuggugugagaccagcuuuuaaagugguagggaauguuagugggagaaugaccccguaggguaagcucaugugcucagauuagaagaccucaccugucacaaagagguguaaagcaaggccugccaaacuaucaagggaggcuuugagcaguugugaaguuugugugacucuaaggugacuagaacuaguaaaaaaaaaaagaaaaaaacccagaaccuucacacauaagugaguaauaucucaagucauucuauuuauguauucuguauuuaccgacaaacagguggugggaguggagggggucuugugcuuagccugggauuacaaagagcauggagacccacccauucuuuguccgagggaaguccagccuagcuccaccacccuugcuuaaaacacuuuuggcucucccuuagaaauugcccucaggagcucagagaaaauugaucuaauuugucucaguauugaccucugggguccccuucucuucaugaauaaagggaagagcaggugguaaaugacagaauacaagagggaaggcuucagagaaaaucuggcccuccauaaauaugaggacaugguugcauuaaaaauauacaggaauaauucauuaaugaaauucacaguaauuguucuggaccauuagauuccugagaauuuagacagggaauuaguugcucugauguaguaucagugauuuguuccauaagaacugaauuagaggcaaaugaauuuuuucuugcuugucugcagaaaacuauacgauggcagucugacuccuauagauguauuuuugauaggcuuauauguaacaguagcauugagcaguacaguuucaccauauuaaaauacugagaugauuuucuaaguaauuauuacaccagaaaggucagguuagccuucagaaucaauguagugauuuaaauuuuauuuauucugauuauaaaaauaaagcuaggggcugggcacagcggcucaugccuguaauuucagcacuuugggaggcugaagcagcuggaucaccugaggucaggaguucaagaccagccuggccaacaucgugaaaccccaucucuacuaaaaacacaaaaaucagccggacauggugggcaggugccuguaaucuuagcuacuuuggaggcugaggcaggagaaucguuugaacccuggaggcggagguugcagugagccaagauuguauuacuguacuccagccugggugacagagcaagacugucucaaaaaaaaaaaaaaaaaaaaaaagaaaaagcuugaccauugaggauaauuuggaaaguacuguacaaaaaaacauagagaaacagaaaaaaauuccgcuauccaaaggcaaccccucuuaacaguuggcaauuuuccuucuucuuuuuuuuuuaaauggauauauuuuuuguaaaugguugagaacauacuguaugugcaguuaugucucuugccuucuugcuuaaccuucccauauauacauuucaugguuaacauugcauuaaagcuguauucuuucauucgucacccauaucagcuguucggcgucuccaaggaugugugggccccugggaucugaucauuucagugagggccuauaaaauuucaggagccuccaacugccucugccuuucccaccauugccucagguguucagccaucacccgucgguucuuuagaagucuacagguacugacaguacaguggggagagaagaggccugcacauggccuugaguuccagucugcccuugugaccuucaaaaacuuaacuuuaauaccccagucuucaacgucugcauauguuaaaugagcaacuccaaggucacuuauuaauuuauucaccacauauuugagugcccacucuaaaccaaagacaaauaagaagagcuuaguuuuuuagaagcucauaguucaaaggaggaggcagggguaacaagagauuagugcaggaugccgugcgaccuugaggagggagucaccaaugacuggagcagugggaauggccuccugcaugaggccacacuggacagccaaccacaucuaacuuucucuuauuguaauugacacugugauuaaaauaucugugaagagccaggagugguggcucacuccuguaaucccagcacuuugggaggcugaugcaggcagaucaccugagaucaggaguucgagaccagccuggccaacauggugaaacccugucucuaccaaaaauacaaaaaaacagccaggcgugguggcgggugccuauaaucccaguuacucaggaggcugaggugggagaauugcuggaacccaguaggcggagguugcagugagcugagaucgcaccacugcacugcagacugggugacagagcaagacugucucaaaaugaaaugaaaugaaauaaaauaaaauauucaugaagaaaucucuguucauuuuccagaugauucccauaggguaguccuaaaguugaaauuacuggguuauacuuuaaaggguaugaccauuuuuaaaacuucauggauuuaguucaauuaccuauaaagucuuaaaguagcuaaauauauauugugggaaugggaaaaacuaacagcgcaagcaagucgggauuugcuuucuugcccacuauguaucgccuauguagacuuggacaagcuacuuaagcuuacuaagcuucaauuuccuucucuguaaaauggggauaacagaccuuaucucauagggugauuaugagcauuagaugaaaucgugggugaaaggcucaguacagugccagguauacaagaagcauucaguuaaguaauagcuguuauuguuauaacugagguuuucacaagccgcacacuuuugcuccugauauuuuuucuuaccaugacagcaggccauuguuugguuuucugugcugagggaagcagaaaguuaauuaaaauggaaacccccaccaagugacaaguugagagagaaaaaugaucguucacaugaugcauaaaaaaagaauaaaaggucuuuuuuauuagggaaaauuucaaacauacaaaagcacaaagaagaguguaaggaacccuauaucauaucccuuggcuucaacuaugacugaaacgcauggcugauccguaaccccauggucaaccccagauuacgugcaaguacaucccagacaucuuaucagccgagccauagcuauuucagucacaugauacauauuugaggcacugaguugugcuggcuaagagccugccucugcugucgcagucaugggacuguguguguguauguguguguagggaggauugggagucaggagagagacagaaagucaaccuaggaccuuuagggaggauugggagugaggagagagacagaaagucaaccugggaccuuuuuuuuuuuuuuuucuuuuuugagacagggucucgcacugucacccaggcuggagugcagugggaugaucaugacuugcugcagucucugaccucccaggcacaagcgauccuccugccucagccuccgaguagcugggacuacaggcaugcaccaccacacccaguuaauuuuauuuauuuuuuuuguagagaugggugucucaccguguugcccaggcuugaacuccugggcucaaccgauccuccugccuuggccucccaaagugcugggauuacaggcauaagccacugugcccagcuuccaaccugggcacuucuuaagcuuuacugcccaaguaaggaggccuugcugugucacaaauagacaggguggaaggagcacugaauucggagucaggaaaccugauuucaaauaagggccccaccccuuaauggauuuaugcuuuuagaaagugacuuuugaauuucuuggagcauauuuguaaacauuuugugaguauuaaaugagauaacccaugugacagcucaaguggcucaauaugaguuggaccuaaaucagacucgagcccagccuucccuuccugagaggcagccuccauaugcaguuuaggucccugacugccaccugcagccucaccagaaugcauucagggagcguugcugccggucucucaugccgaagauguggugguagcucagaugagcaccugacacacacaacgccccaugcuugcaaaucucccauccccucuguuaguuagccccuucccucugcuuuauggaugaggaugggggaccuagagaaggucccaguccuugguagcaggcccucucucacaccccaucuaugggaagacagggucccuuuucuaccucugacuuugaugauucuuggucuccucuaacuugcuguuacacccaaguaggaauuuuugacucaaauaaaauaggaaagucgauccgauuuaguaaucaagucaaaguccucuccuuaauccacugggacacccauuauuucaagaccuggacugugacuuguggucucuggcuguugguggcuagcucugugaccuuggacaaaugcaugccacccuggguaugccaccucagagaaucaacucucagcccugugcagccccuuccagcucugagauuaucaaaugaaacauacauguaagacugggaggcuucuucacauaaauaauaaaugaaaugguuuuuuuuuuagaguauucaaaugggguaaaaaauuaaccccucagcuuaugccauuccucccucauuccacuucucuuugcaaugacuacuguuugcaguuugaugucuguccuucuaaccccuuuguacacauuuauauauguauuuguggcuauaugcaaauacauuuuuaaaacucaguagauggauuacaaucaaacuuguucaacccguggcgugggggccgcauguagcccaggauggcuuugaaugcggcccaacacaaauucguaaacuuucuuuaaaaauuaugcguuuuuuuguguuuuucuuuuuucuuuaaucucaucagcuaucauuaguguuaguguauuuuauguguggcccaagauaauucuuccagugugggcccagggaagccaaaagaucggacauuccuggcauuauacuaguccauuuacaaacuugccuuguucauuuuacuguguguauuggaggucuucccaugucaguguuuuuuuuuuuuuuuuucauagcugcauugcauucuauauuuugaauguguuuaccuuaccaaucuucuguugauggacauuuauguauucccauaaaaauauauuucuaaguguuuuuagaccucaaacauauggagagaugguuguaaaugucaguggguuaaaugaaccuaguccaucaaguucuggaaaggauggugagagagugggcacagaaacacuggggucugcacucuggaaagcugaauugaagggcucucaggaagcuaccaagaggcuguuugcauggaagguuauuuuuggagauagccugccugguuugguguccucagcuucaagugcaaacacugagcugcgucaucacguuccccuccccuucccaccauccuugggccuuccaaguuuguuucuggucucagggucaggaacaggaccucgugggagaacuggcacuuaagugguagggagggaggagagagaacugaagaaaaggaguguuugaucucgggcucuggaggaggaauuguuacaguuauauuguacuuugucugguuguucaaaccuaccuggaguguuaugcuucccugggucccuccagagagugauaaaaugaugcacacccagaaauuggcuacuuggaugacaguggcuuaggacaacauaucggagguggaauaaauguggaaacuaggacuuucuagucugcaagagauaaaaauaagaggcauccuuuucaugcggaagaaaucacacuucauuacagucacacugaguggcugcugcagacgggagaagcaagaugggcggggggugaggaggggaaagaguugcaggaaaacaaauaaggaagaacugacuuaacggagcuacccaacaauggaacaagcuguguuacaaggaagccacugccguguuauaaagugauccaagcaaaaguugcaaguaggcugggcacgguggcucaugccuguaaucccagcacuuugggaggccgaggcaggcggaucaugaggucaggagauagagaccauccuagcuaacacagugaaaccccgucucuacuaaaaauacaaaaaauuagcccggcgugguuguggguggcuguagucccagcuacucgggaggcggaggcaggacaauggcgugaacccaggaggccgagcuugcagugagccgagaucaugccacugcacuccauccuaggcgacagagcaagacuccgucucaaaaaaaaaaaaaaaguugcaaguaaacuuguuugccaucagaggacuucugcauugcagagggguugaccucaauggccacuuaggcccccugcagcuuugagagucugugacuauggggcaagaagcagaaaggugcaaacuagaacuaaaggggugggacaaguuauagacaauguagugaaguaguuuucaccugcucugaaaagguggaauaagauggaagccaucaaaggaggcuuaagccuuguuucccuuggaucuuggcaacucucucccuguucuguccuuggcuucagcucccuuugaccuuguauucuuaaauuauuuccacaggaauaaauaccuuacguacacuuuagaugaucaggaaaucuggcaccuggaaaagaacugcaugucccaggaggaugguuguaaguuuuuucauugcagucuuuguaaaucugcauccgucuguugguugauggaguuuuccuuaguacagugccgagcuuccagcuuuaauuuuaggaaugcuguacccuuuacaaccucucgaugguccucugugcuggaaucgagggcacccaccguguuuaaggcugaucccuuucuuuccugcaagugaagaagaauguuuugacuuaagucuuaaccaagucuggugaaggaaacguggcaaaauuuaccaucuucugggcuuuugcugugugccuggcccugauuaggcauguuguguguucucucauccaaucaucacaggaagaucugcugugucgguaucauuagcuccauuuugcaaauaagaaaaccaagcuucagaaagggcuagaaacucaucuaaaguuucaggugcccaccacuacgcccagcuaauuuuuguauuuuuaguagagaugagguuucgccguguuggccaggcuggucucaaacugcucaccucaggugauccaccgaccucggccucccaaagugcugggaucacaggugugagccacugugccgggacugcagugcucauuuuuagaacauagauccaaauaauccccauagucuguugcuuccagagcuuaguugaaggcagauaugcacauauuaauuacaauauagugugauaaauauuaugauuugggugugcacagaugaugggaagaagauccaguaaguuugggaaagauuucuggaagaggcaacacacaagcugugucuuagaaaguaguagcuguuagccucugggaaaugagcauuuuugaggcaggggaaggcugcaggagcaaagauuugagggugagaaauggcucauuguauaugucagggaaacacuagcagguugauauuccuggagagaaaugcaugaggcaugaaguggcgggacuugaggcuggaaccauuacauguguuauuuaauagaauuuucauaacacugcauacacuauuauuaucucaauuuuuuauuuuauuuuauuuauuuauuuuuagacggagucucgcucuugcucaggcuggagugcaguggugcgaucucggcucacugcaaccuccgccucccggguucaagccauuccccugucucagccuccugaguagcugggauuacagguacacacuaccaugccuggcuaauuuuuguauuuuuaguagacaugggguuucaccauguuggucaggcuggucucaaacuccugaccucgugauccgcccgccucagccucccaaagugcugggauuacaggcaugagccaccaugcccggccuauuaucucagauuaauaggcgaggaaacaaagguugaaggagauucagugacuugcucaaagucagaccgugaguguguugaguugcguggucuugaacauaggccugcuugccuccagagcccaugucucagccuccacuucagugccugcagaggcaggcugugaaagucuggcuugcuggcuaagacgauuguucccucucuuuuaauguuucaaggacaacaucccuugccgaauccucuucuuucaaccugccucaugguguuacccaacuuuuuguuaaauugggacuagugggucugauguugacagguuuucugagucuugguucuaggguucaccuuccuuuuuauccagccaaucaguaauccagaagucuucaaauaaaaucuuuaugugcccaaccacgugugaagagggagaagauucaucucguuucucaaaagauccagguuuauuugugagcccagguagugccugcgaauccuuuaguuuggagaaacacuuuggggacuggaacaggaacaaucacagcuggcuggaggaacgugggguaaugggccuugagcugucccuuuaaggaugaguaggaguugggaagguggagggcauaacauaugagcaaaauuauugucucacuuaauggugaaugggacaucuuuugccuauucuccccauccuccaagauaauuccuggguuagaguuggcucucggguaggagaggcaguauggggaauucauucaugcaaaaucaagauuauugaaaacuaauuaauuggaucccaaagacaagaugaugaaacuacucaaugaaauaaaaaagguaauuacagagccaaggaagacauuggggauaaaaacaaugucauuacagaaaaaguuaccaggaaacauaacagaaucuguugaaaaugaaauugcuaacagagaaggaaggcuugaggaaaaucacagccuaugcugagaaaaaagauaacgcacuuaaaucagagaucuaaagaucauacaaaggugggccuucaaaaggguaauuggagagucugcggaggcacucgucgcuuuugcucauauuccauuggccaagacuuagucacauagauagacacaccuggcuguaaguaacucugggaaaaagucuccagcugagaggccauaugccuucuuaaaacucaguuuuggggaaagcuuucuacuacugaaaggaaaaccuggauauugggaucaacuaguaucugcuuuaagggaagucauguuggucucagacaugacugaacagguuuacagaggccaggugagguggcucaugccuaaaauccuagcacuuugggaggcagaagccugcggaucgcuugaggccagaaguuugagaccagcuugggcaacauagcgagacccuaaugaaaaucaucagcugggugugguagugcaugccuguaguccuagcuacuuggaagacugaugugggaggaucccuugcccaggagcucggggcugcagugagcuaugauugugccacugugcucugggcugggugaaagagcaagacccugucucuauuuaaaaaaaaaaaaaaaaaauuguuuacagaguucuggggcaaaggcaaugggacugaagaauuuuacacucaaauuacuuugcaaguaugucaggcagacauccucacacuugcaagaauuuagggaaucuagcacugaagaggccuucucaggaaacccacuugaggaagaaaaagauuaaucgacaaacauacuuagaaggcauaguggaaggucaauuggugaacucuuaauccguucaaauagagaagcaaagcuaagcaggggcagggaugggcagugaggacuaaggaacagaaugugaggaaguagaaagaauauaccagaaauaggggguuaggggagacgugaggagauguuaagugcuaacuuuaauuagaaguguaccuuuuccggcugggcacgguggcucaugccuguaaucucagcacuuugggaggccaaggcggguggaucacgagaucaggagaucgagaccauccuggcuaacacagugaaacccugucucuaccaaaaaaaaauacaaaaaaauuagccaggcgugguggugggcaccugcagucucagcuacuugggaggcugaggcaggagaauggugugaaccugggaggcggagcuugcagugagccgagaucgcgccacugcacuccagcuugggugacagagcaagacuccgucaaaaaaaaaaaaaaaaaaaagaaggguaccuuuucuggccgggcgcgguggcucaugccuguaaucccagcacuuugggaggccaagcggguggaucaccugaggucaggaguucgagcccagccuaaccaacauggugaaaccccgucucuacgaaaaauacaaaaauuauuuuguacugggcaugguggcgggcgccuguaaucucggcugcucgguggggcugaggcagaagaguggcuugaacccaggaagcggagguugcagugagcugaggucgugccacucuagccugggcgacagagugagauuccauuucaaaaaaaaaaaguguuccuuuuccuuauaaaauaaaauaauaaaauuagcuauuuuauuuuacuuuuaaaaaacuuauuauuauuauuuuuugagacagugucucauucugucaccuaggcuggagugcaguggcgcggucacugcucacuguagacucgaucucccggguucaagugauccucccgccggccuccgaaaguguugggauuacaggucugagccacugcuccugacccaaaacagcuauuguguaaagcaauccccaucuauccuuucacgcaugcuuucuuccaucuuucacacuucuauccauauacagauauagagacuugaggaaugauacuaauucauuuauuuuuuccuggauagagggcucuugggugauuuuuagcucuauauaguuuugcauauugauugacauuuuauaaauaaugaacuagucuuacuuaaaucagaccacugaagcuauucugaaaggcaccauuaaaaacugguuccuggggagugaagagugggaacggagauacagauggaugaacacugugggggauuugagagucaguuaugcaaacaccucacucuaggcagaacaaaauacguuaucaaucagauggacagcuggggauuggggcccacacgacaauggaaaagguuucacccaggagaccgauggaguuuugauagguggagaaugggagaaaggaccuuucuggccugggggcagcaggaacacaggccuggggaugaaggggcguuggcaugucugggguuacugggagcaguuuguuggugguucgugguuggagaagcaaggaugaaggaaaacauggcugcuguuaauacagugugcacagcacacuagauacuacacguagauaucucuagguugcccaacaacccuauagcacagguacaauuaucucuacuguacacaugagggaacugaaguuaagggugagagaucugugcuugcuucagcagcacauacacgaaaagugcaaugguacagagaaggugagcauuaaaaaauagugauguuuaucugcccagaggcgcaugguggugagacugauuugagcucccugugcugccugcacagccaugcccaugguuuuucuauugugcuaugauuuguggugcacagagaccggaaucagccaccuuuaugaaacacaaaauguaaaaauaauuguauagguaaauauuuuauaaguaagucuauuuuauacauuuacguuuauguuuagauugguauuuauuauuauuuacauuuaccuauaaaauaaaacaugguuuagauguaaauuuuguagguaaauuuuuagguaaauauaagagccuacaugaugguccagacuccaccauccagcagccguguggccccaggcuacuuaaucagaacccuaauuuccuugccuauagaaggggauaauaauugugccacugccuagccugagauuaguuuuuauguucaaauuagaucauagacguuaaggaugagacaguuugaaagaggcacacagaaggguuuguuauugcggacacaccccuugcucugcugagagcauacaucuguucaagcacccacaggugucugugaaaauguucacagucauagacacagccccuacaggguugacacaaacaaccuggucaacaggcaagaaacugcuucccugacucaguuaaccagcuggaggcuguaaugaaaggcagcagagagugagggagggaggaggcagggagugugucuggcucucucccugccugggugagaauccgcucuugccugccuuccugguugcuggggaauuucugggccagaguugcgucgggauggcugucaacagcuuggugaggguggaggaggcuguuccagacgugccaagcuacaggaaugaauguuggagcugccacgccggcaggcccugccaugucugguagacgccaguggucugaaagagggaccaggaaggauaggguugucaggggacuucgguggccagcuuuauucuccagaaguaccgaugaggacaaagcaaggcccugaccucaaagaaauugggcuucugacaacacuuaucaaacugggcgggcagccagaccucugcucugagcuaguguggcuggaggcaccugacguuugcuccgggaaggaucaggaugguuguagggugugggcuggggccugguaugcucuuggggguucagaaacucuagugugugugugugugugugugugugugugugugugugugugucuguguguguauguggucguuggagagagacccaggcuauuccauaucgcugaagagauccguuucuuccuuaucucacuggucucucugcuauaccaacaccuuuggcucagccucagcuccagccagccucaguuccggaggagcccccucaaauucauggcccacaaaggagagagaagaccuccgaucucuugugccaugcucacuaugcuaugugaaauuugcuauguuagaccuugacauccuggaugguggggaugaugacugguuucucugcacagcccugggcccaguauccugcccagcccuuaggaguccucauggaaugagcucagcucccgcgaugcuccuguuuguccacugagguaagaacacauccagccaccagugaguugaguggguguucucucgguaagaucaaggugugacagcaggcagugaauuugcaguagcccguggugggaagcccgugaggcuguagugggcccuccugcuccaccagagagucauuuuuccuaccugccaauucuagccuuggaaauaaaagccaagcaggcgggugaaagagggaaaauucucugggaugguucauggaucugagcccuggaggagagucaagcuugggaccuuguucuucuugucuuauuuugggaaccagggucauaggaauuuguuccaggugagagagggaagaaggcagcuagggagcugugacguggcagccaggcugaguuaucaguuaccuaagagucugccucagggauugccuuuguggacugcacagugcugguucugggaggaggcuggccuugggccugagcuggaggugguggcugacagugugaggaaugaauccccagaagaugauuccugccagagggcuugugacggcuccuuuuuugcuuuucacaaugaacaucuuauucugggcugcaaauuuggaugaggggaaaaaacuggccaggaggagaugaaccaaaggcgucucacagggaauccuucuguacuugaagaguccugcccuugucuccccagccagauccagugacucacaguaggagggcuuggaggcaacucacugccuucccuguuaacuaccguuugcaaugucaccuuccucagaaagaccuuaucauucggaaaaaaaaccacaugcuuuguagccagacagacuuggguuuaaauuccagauaugccacuucucaggugugcaagcuuggcagcuuggccucucugguccucaguuuccugucuuagucuauauucauccuuucugccuuguagcauuggugugaguccuagagguagugccuaaccuaguuuugggcacaugguuggagaccaauaaaucgugguuauuuucaauaucacagcacaugugaacgguuauucucaguuauuguccaccugaugggccacuuugcuaggggcugugaauagaaagagaaaugagauacagccucucccuggaggagcucuccaucuaggaggagagccaggccuguggaagggggcacaaaggaaagcaaguugcacaagcuguggagggagcuggaggcaggggcagagaaggccagaaaaagagaugauauccucaaaggcuuuaaaagaaugaagaagaaucugccaggcaguuggggcgggggcagcauuggauccacucauaagggagggcagagcuaacaguggaggcucccuggacaggugagcccucgggcuucccccucucugcuggcauuugauccuacucaguuugggucaggauagagucugcagucauuuuccagcaggugguuuuacaugggcaggaauccagccaggccugacugggggagaggguguugagguggcacuugucaucccagugaucucuccauagguaucugggcuccaggcuuagggcuaggagcaggagugggccuccucagagggagugggacagauuaccaggcaggaacugcaaaggcagagcucacuaaagugcaggcuccaggucauguggauggaggggcuucacaaaaugguacaaagcgguuguuaucaaauucagacagcagguaggugggaggaggggugaccugugacuucugugauuucugggaaguccacugacccuuuaugcagugcucagugucaaauaaaaagaaccggagaagaccaccuugauaguuaaggauauacauuugugguuuuaguuauucacaaaugacucuaaaguucugugauaugauaugauugggugaaucauuuggaugagauaaaaacaggauuuuauuugcugcaugcauguugugugucaccuagguggugauaaaaacaaacguagaagcuuucauuuacugaacucuuaccaugucugggcaugcuauaugcuuuacaaguaucucauuuagcccuggcuaaauccagcucuuugaacaccauaccuacuccacaaaucugagugugacuguagaaaagcauagugucauccugaauggucccacucuaauucuuuuuuguuuauuuuuuuugagacagaguuuuguuuuugucccccaggcugcagugcuauggcgugaucucgguucacugcgugcagccucugccuccuggguucaagcgauucuccugccucagcuucaggcaccugccaacgugacccgcucauuuuuuguauuuuuaguagagauaggguuucaccauguuggucaggcuggucucgaacuccugaccucaggcaauccgcccacaucggccucccaaagugcugggauuacaggcaugagccacugcgccaggccguaauucuuggccaugacucuuaaggggacauugguguuguaggccaugucgcuucauuuuguugguccauugguucucaacccuggcugucauuaguguuacuggugggaauuauaacacguauugcugccugaauuccucucaaacuaacgaaaucaaagucuuugugagguugaccugggcaccaguaucucuuuguuaaccugugcuguuaauuccaaugaaugauaguugagaagcaugaccauuccucugucaucuagaugacuguuucgcaccuuuuucucucucuucaagucucuaacaccuucccuauccauacucucaguugauaccuuguuuuaaacuuaccugaaaaaauaauggcagucggaggaaaacuuucauaccuuuugucuuaguccauucaggcugugauaacaaaauaccguaaacagggugguuuauaaacaaaagaaauguauugcucauaguucuggaggcugggaaguccaaguugaaggcaccagcagauucggcgucuggugagagcuugcuuccuaauuuauggauggugcuuuuucaccguguccucaugugcuaacagggcucacuaguucuccagagccucuuuuauaaggguacuacuguaugaguccauguugccuugcuauaaaggaaaaccugagacugaguaauuuauaaagaaaagagguuuauuuggcucaugauucugcaggcuguacaggcauggcacccacaucaucuucuggugaggcuucaggaagcuuuuacucacggcaggaggugaaaagggagggggugugccaauuuuuaugcuccuggagagaguugucugcauuugcacccugcacucccucuucucucauucucauuuaaacucaacaugaucagucuuuuguacccaucacaccaccaaaaccauaccggucaggcucaccaguauccucucuugccaaauccaguggucagaucucagucccuaucuugacugaucagcaacuuuugauacaauugaccauuccauccuccuugaaauaguuucuucucuuggcuucuggaacaucacugucuuugcuuuuccucuucucucacuagguucuccuucucaguuccuuuucuuggcucauuuucuuuucuuuucuuuucuuuuuuuauuuuuauugagauggagucucacucucuuacccaggcuggagugcaguggcgcgaucucagcucacugcaaccuccgccucccggguucaagcgcuucucuguuggcucauuuucacuuggucacuguggagugccucugggaguggcccuuggacuuggccucuucucugucuccucaugcccuggccaucucauaucaucaauuuccugacaacccucaauuuauauuuccaacccacaccuuuccccugaguuccaugcucagauauucaaccaucuacuugacaaguuuccuuagacaucuaauauacaucucaaauaugacaagcccaaaaucgaacugcugcuuuucucccuaaaagagccauccucauuucaguggacaacaauuucaucuuuccaucuuuuagggcuuaaacucuggagucauucuaaauucucuuucucucaugcugcacccacucuguuagcaaaccaugucagcugugcuuucacaauaaauuaagaaacaacuacuuaauucaucaaauucauguugguccaggacagaagaccuguucuuucucuuagaaucguuucacaacugagccuccugcuuguagucuugcuccugugguauguucucaaaacaguaaccagagugaucauuuuaaaagcuguagugaugugucauucuuccgcucaaaaaccaggaaaggcuuccucuuuuacucagagcuuagaaaggccuacaggauucugugugacccagccuucagacccugcagacuucaucuccugcucuuuuccaccgcuucauucugcuucaccucacugagccuacuccucagauauaaagcacacuuuggucucagagccuuuccacugcuuccuccaggcaggacaccuuccuucauguauccuauuguuuucgucucuucuucagguuucuauuuagaugucaccuugucaaacaggccauuugacagccuuauauaagauuauaaucuccugccugucuccucccaccgacuuggcucucucccuuuuauccuuccuuguugcuguucaauagcguagguggccaucugaguuacuacccugugucuuuucucacuaggaacuugcuuccaugagggcaaggauguuaucucuuuugcucacagcuauuucuuuaggacccagagcaaugccucagguaucauaggcauaauccacauuuguuggcugaauuuaacaaaauccucacaaugacauuucaaaauuaguuggaauaacccaaaauuuauacaugaagaaacugagacacagagagguuuuuuuuuuuuuuuuaauuuuauuuuauuuuaaguuccaggauacauguguaggaugugcagguuuguuacauagguaaacaugugccauggugguuugcugccccuaucaacccaucaccuagguauuaagccccacaugcauuagcuauuuauccugaugcucucccucccccaggcccccugacaggccccaguguguguuguuccccucccuguguccauguguucuuauuguuuagcucccacuuauaagugagaacauaugguguuugauuuucucuuccuguguuaguuugcugaggauaauggcuuccagcuccauccaugucccugcaaaggacaugaucucuuuccuuuuuauggcugcauaguauuccgugguguauauguaccacauuuucuuuauccaguguaucacugauggacguuuggguugauuccauaucuuugcuauugugaauagugcugcgaugaacauaugcgugcauguaucuuuauaauagaaggauuuauauuccuuugaguauauacucaguaaugggauugcuggguuacaugguauuucugguucuagaucuuugaggacucaccacacugucuuccacaaugguugaacuaauuuacauucccaccaacaguguaaaagcgaucuuauuucuucauagccucaccaacaucuguuguuucacggcuuuacuaauugccauucugacuggcaugagauaguaucuuuuugugguuuugauuugcauuuuucuaaugaugcaugguguugagcauuuuuucauauguuuguuggccacauaaaugucuuauuuugagaaaugucuguuuauguccuuugcccacuuuuuaauggguuuuuuuuuucuugcaaauuuguuuaaauuccuuguagauucuggauauuagagcuuugucaaauggauagauuagauugcaaaaauuuucucccguucuguaggcugucuguucacucuaaugauaguuucuuuuguugugcagaagcucuuuaguuuaaucagaucccauuugucaauuucugcuuuuguuguaauugcuuuugaugauuuuguccugaaaucuuugccugugcugauguccugaaugguauugccuacauuuucuucuaggguuuuuauaguuuuggguuuuacauuuaagucuuuaauccaucuugaguuaauuuuuggguaagguauaaggaauggguccaguuucaauuugcuguguauggauagccaauuuucccagcaccauuuauuaaauagggaauccuuuucccauugcuaguuuuugucagguguggcaaagaucagaugguuauagauguguggucuuauuucugagaucucugugcugucccauuggucugugugucuguuucuguacuaguaccaugcuguuuugguuacuguagcguuguaguauaguuugaacucagguggcuggaugccuccagcuuuguucuuuuugcuuaggauugucuuggcuauauggacucuuuuuugguuccaugugaauuuuaaaguaguuuuuuuucuaauucugugaagaaugucaaugguaguuuaaugggaauagcauuuaaucuauuaauuauuuugggugguauggccauuuucaugauauugauucuuccuauccacaagcacggaauguuuuuccauuuguuugugucuucucuuuuuuuuuucuuuucuuuugagauggagugucacucuugucacccaggcuggagugcaguggugugaucuuggcuuauugcaaccuccaccucccggguucaagcgauucucuugccucagccuccugaguaguugggacuacaggugcgugccaccaugcccagcuaauuuuuguauuuuuaguagagaugggauuucaccagguuggccaggauggucuugaucucuugaccuugugauccacccaccucagccucccaaagugcugggauuacaggcgugagccaccaugcccggccuguguccucucuuauuuccuugagcagugguuuguaguucuccuugaagagguccuucacuucccuuguuagggguauuccaagguauuuuauucucuuuguagcaauuguggaugggaguucauucaugauuucgcucucugcuuguguuuugcugguguauaggaaugcuugugauuuuugaggcgcagagagguuaaacaacuuuuucagaguaacacagcuugcuaguguagaacuaggacucaaaccugccaagugacugugucguuagaucgucucucuguggagccuggccuucccccugcacccacaucucaacugccucauuuuuuucaugucuuguugcaagcagccggucccacagagugagaaaaaucccugugaaaaaugucgcaagugugacuggaggugugggaaaugcauacacaaacaagcccuuaucugcaacuuucaaguccaaaaauuugugaaagucaagcuuuauucuuaacccauuugguggcaaaaccugauuuggacugaugugaggcuauuuauaaaucuaugccuguaaaauguuuguguuuguuuuuuuuucuuccugguaaauuaguauuuccuuuaaggcucuuuccaggaacaugcucaguuuuaagacccgauuaagaucaggcacagcaggccaggcuaagaggggcaugugugaaaugcaguucuauaccagagggaaugagggaaaguccacaugcucaccagcgaggccucucgcugcucccagcacuuuuucugcuucugucacacagugcuggauacuagagucaaauucugcuuucccuagucaugaggcuagaggagucuuucugcauaaacuuaagagcccaagagaaaaagccuauagauauugauauuuaggguguuccaaacaaaauuuacagcugacucacaaucacccucccguaagauccaccaguucagaagcacugaucaugcacacagaacauccggucaguuuuuagugucucacuuuucaauuuaaaaagacagcuaacgaucaccagauauuugagaaaaguuugaaacaugaaaggcagaaauuaaaagagacaacaacagcacuagaaacucacaagaaauagagaaaauauagggagcagaagaaaacuucacaaaaccuguaauuacuagucuaagagagauaagagaauauguugcauuaauaaaauaaaagcaaugugcaacaaagaggaguuucagagacuaagaaagaacuuuuggaaauuaaaagugugauagaagaauaaaucaguagaggguuuggaauauagaauugaagaaaacuuacagaaccuugcagaaagucaaagaaagaaagaaaaugugcugggcgcgguggcucaugccuguauucccagaacuuugggaggccaaggugaguggaucauuugaacccaagaguuugagaccagccuggccacauggcaaaaccccaccucuacucaaaaauacaaaaauuagccagacaugguggugcacgccuauaguuccagcaacuugggaggcugagaugggaggaucacuugagccaaggagguugagguugcagugagcugagguuguaccacugcacuccagccugggcaacagagugggacccugucccucccgccuaaaagaaaagaaaagaaaaauaagaaggauuauucuaagaagcccaacaucagaauaguaagacucgcagaaaaagagaauagagacaaugaaagggaaaauuuauuaaagaaauaauacaagaaaaacuuugagaacauugaaaggacauugaaaggcccacuugaguaccuggggcugugacuugaaaaaaagacauacaccagaagaaaagcuucuugacaggagaaaauccuccccccaaccaaauggauuauauauaacaauagaaauaugauugacaucaucuaucucuacagaagcuaggagacaaugaagccauuccuuaaauucugagaggcuaguauuuccaacugagaaauuauauccugacaaauuauuaaucaaauaugaggguggaauaauggcauuuucagguaugagaagucucaaugauuuuaucucccacacagccuuuuuugaggaaucuaugaugcauuuguuucuccaaaacuagacaguaaacuaagaauaaaugggaucuuccuuuaagcacagaaagcaaccacuucagguugaaggaggagaauggaagguuccagaagggagauuuuuaagaauuaaaaaaaaaaaaaagauuaguacauaaugguauauuuaguguacugugaugaguuuuauaguuuuguuggaauguugagggcugaauucgugacaaguacauagaaaguuaagcagacaaacaaaugagguaauaauggacucuacaaauggcaacuaagaaauauacaugaaaggaauuaauuguaacaccacacauggcucagcuaugaauaauaauuuaucugguuauaauaauguaacuuaauaauuacuugacaaaauaauguaacuuaauaauauagcuauuaguguugacuuaauaaaaaaugguauaacuauugggagaaugugggacaggagaggugguauauagaauggugguaaggagcuaaauccuuauuuucuauaauaggaaguuagugaauaauaucuaauauugaaaaaaauccagagccauauaagcgugcuauuuagauacacugagaugacucuggaaauagauacaggaguugaaagacagaauuagggauauggagggguggggcagggccugcuguuucuccuuacagccuugcaguaccacuggaccuuaaaaaucauugguguguguugcuuugauuuaaaaaagggcucaaugugccgggugcuguggcucaugccuguaaucccacuaauuugggaggccaaggcugguggaucacuugaggucaggaguucgagaccagccuggccaacauggugaaacccugucucuaccaaaaauaucaaaaauuagccaggugugguggcaugcaccuguaaucccagcuacucgggaggcugaggcaggagaaucgcuugaacgugggaggcggagguugcggugagcagagauugugccacugcacuccagucagggugacagagcgagacuccaucucaaaaaaaaaaaaaaauuaaauaaauaaauaaauaaauaaauaaaauaaaauaaguuaaaaagggcucagugucucccccuguauccagauuggcaccuaaaauaggcacccaaucaaagcugaaugauuguuugcuguagagaacauauuaacaacacaaucaaauaaaugugcagagguacccuccuuuggaaauuuugcauauggcaauggcagaagagcuucccuuuucugguucucuaaaugcagacaccuuuucucuuuuugucagagcucacccauguacucagugugcaacucauacuuaguuucagcucuuugcuggaaucucuuggccuagcacuaaagggaagauaaagaaaagccccugggaggcagcucugggaggcagcuuuguguguggaacucuggcuuagucacuuaccugcuuugugcccgugcugucaccaaagcucuugucaccucaucugaaaauggagaagacacuccucgcuucauaggcuugugugaagaauaaaugaauaacuuaguacauaaagcaccuggcacacaguaguugcuaacaaaaaaaaauugaaauuaaaaauaaaggaacauuuauggugaauauuauuaggucuaggacaggagccccguaauguuggaucugggcuccccauaugaaccaucaagaagggaugugagcccugggagaggaagagggggacagaaauaauccggaaagucuccuuaucuuagcagacguucuuacuguguuuugggugcagugucuucugauuugacugcuguguucagcagauuuguggagacccagauccuggaauguuuuaugcacaaggaucaauaaaagcucuuagcuuauuucacuuccauauucaaacauaaucaaaaccauugcucacaucucagacaauguggaagaauggcuccaggguuaaaaggguuaucucacgcugaggcuccugggugcugaguggggauggcuccuugaagccaggggcuuggggccacagccuuacugcugugacaggugaaccccuccucugagucaacacagagcacucgagcaaugguucugcuuugaggggcugggccaugaaauucuuggcucaauuuaugaacuucuuuggguuccuugguuccuggugagcucuccaaauccugguucugggucugugguuggugccucacacaugguacacuuacuugaaggaaacacuugcuggaggcaagaaggagucacugcgcccaaggcagccucucauuuagccacccucuuccuuagaaucaucuucugugucaucuagaugcuucugggucuaagggcagaggagaaaggggauuggcugagcugcugccaggggcucuagaguugggggacagugcaguaagggcugccccaagagauaaaacagagaacaggcccugaggagaaggaaggaguugagcacaaucuuggcuggcugggccucgagaggaaaguagagagaccaaaucuggguguuaggcccagugacccuugugggauaggagggaggucagagagcagaacuuguggugacagauuacagagcguuaugaauuaaguggaaacuauauuaaaauggccaggaagcacgugaguagauaggaggcuuggggacccuaugaucagcugaaucugcagugcugaguauggugauaggaggaaguuauauaaucuacuuaauagaaaaaaaaaacuuuagaauuuaagauagaagagucauccaacuacacuuuagcaaucuagcgugguccugucaguagauuuuuguuucguuuuguuuucuguuuuuuuuuuaaauuuuuuaaaucuuuuuuauuuugagaugguaccugccaacccuaguggcccgcggccacuagacucacuacauaccugcuguccugggccugcaugguguccugucuaccucucccagggccucugcccugcucucuuuguaggccagcuuccucuccuuccauagagucccuguagcuccaucauuugaucuuuuuuuuuuuuuuuuuuuagauagagucucacucugucacucaggcuggagugcagugauugaucucggcucacugcaaauuugcaaauuccaccuccuggguucaagcagcucuccugccuuggcuuccuagaaacugggauuacaggugcacgccaccaugccuggcuaauuuuuguguuuuuaguagagacaggguuucaccauguugaccaagcuggucuugaacuccugaccucagaugauccucccgccuuggccucccaaagugcugggauuacuggcaugagccacugcgcccggccccaucacuugaucuugugcauggcauuugcuugucaugguuccaccacuaccuuucccuucacucuagggucuaccaccagcugacuagagucuuuuuucacaguugcaguuuugaaagagugucagauuggcccagcuuccuuauguauggacgaauugucuuuaagucagaguucuacccuuuguccaucaggggaaguccagaugaaugagcaagugggguaggggcagggugggcagguagaaugacuugccuaaauauuggagaucugcaaaccauuuuccaaaggacuuaagaagcacaaaaggaaucccccauucccucaugaagcugcagauugcuauggcuggaguguagggugcaugagagugacagggcaugaggcuggucagcuggaaaggggcaugagacagguccccaaggcuuuugccugggucacagggcugagaaaccuaguuaucuguguaggugaauucuccaucucucacugaaaguuuggccuggagugaaaggaaggauacaagagcuggcuagggagagauggagaguggagucuuccuuccuguuaaggaggcagagcagucagcccagcagugcccacucuaccuccaccccaggagcacuuugcucuuguucccccaggagggcuccuuguggguggcuccuagcugaccacuagcucagcuguuugccuguaaagaccucuucccugacugcucucauuuccccacagugacccuggcuccugguguuuuguuggcauuaauuacaaacagcagcaaagugcccgaagccucaagcaacuuguucuuuuuccgucucaccagaugccuuuguuguucgcccuguucuguccugaaucuuugugaggucuugacguuaccacccaucgcauggcucacuucagcuucaguucugucuaucagcaucucccgucucaugggaugacucuuguuucucuuuguaucuaaggguuucuuuccccuggacaccguccuuguguaucuaucacuccccugucccuccacggguuucucuuucucuccuuacgaauugucauucauguaccccucuuucccaagcuugauuagcagaguucauuuagcauaaugggucuuaucuuaggcuggggcugagcugagugugagcaugaaaaaugaaaagucagacuuggagaacugcaccuucauuuccacuagaaaugguuacaccaggugaacgaggauaugugggugagggaggggcuugggggagagaggaguguuaggggaaugggcacauuucuccauugcugggagcaguuucuaugguaccaguaguccugaagguagcaugcuaagacuguucagaagccugaagaauuuggaagcucuuugacccagcacaguuuuauuccuaagacuguguccaaagaaaauaaucaugggacucccuggaagauuuuguuucaaacacuauuugccauuagccaaaaacaaaacaaaaggcugaagaugacuuaaguguccaggcuuggaggguuggguacaauuuaugguacagcucuguggggcacuauacauggcucauuggagauccuuggguacguauauauuaugcagccauuaaaaugaugcugcuggagauuacuuacugacacggcacuuacuaaaccaugccuagcuuuauuacaucuuuauaaaaaaucugaaaaauaaaaacaagaaacagguagaguauguuaucuguaguuaucuuggaugaagaaagaauggguacauuuugucuuuuucauuuaauuauauuuucuaaaauuuauagauugaacauacuuuuucugacacaaggaaacacaauuacuuuaaaaacaaaugcccucuauucaggcaacuauaauaauauauggguugaaaauuuaggaucaguuaaaaaugcuuccaaaaugaauuagaaauuaaauucacuuuaaaaaaaacuuuuuuuuugagacggaguuucgcucuuguuguccaggcuggagugcaguggcacgaucuuggcucacugcaaccuccgccucccggguucaagcgaugcuccugccucagccucccaaguagcugggguuacaggcaugaauucacauuuguaacagcauaaacaacauacuauaggucaaaggagacugugaacaagcuugauguaguuguugauugaaauccauuguccgcaggccuucucuaaacacgagacuugggcccgaucuguagcuuucuaacccuugcuuuuucuuaccacaaguagugaguagcacaaggauuccacgacuguagcagaguuugcuuugcccaaucugcaacuuacucucaaauuguacaaccccagagggaugagucugggugaacauguagcucguuuagguccuggaaaggaggcuggcugccccggagcuggcagugggaggagcaaagacucuuuccuccugaauguauuaacguaugugcuucuggugaaacuuugcuuuguuguuguuuuuuaacccucugcaggcaaggggagagccaguugcgcagagcccugcaaccagcaguccagggagaaguggugaaugucauggagcccagcugaaauggacuggcccccuugagccugucccaagcccuggugccagguguccauccccgugcugagguaagacccccugaagcccagccugaggaagagaggacacaaugccuuuuuugcaggggcaggaggcagagggccuucucaggaaagaaggagcaguuaguuguuucugguucagucaaaccaucugcuucagccucagcccguugggaggcaaggucaauugguggccaaagaggcuucugcuuugucagagcaggucuuuggaaucuugaugggaguuguauuuucucaguugcuggugaaauuugaauucccaagggaauacauuuauccuccagguaagacugcaccggauucaggugaaugcuuaaguauaccuccucugcucugcaagggagcucuugggaaacacacacacacgcacacacacacgcgcgugccacgcucucucucuuucaacccaagggugacagagugaaacauuaugcagagagguuauuccaaaacauucugggaagcucacuaaaaauugauuuuaauuaccuagauauguucugauuauaaagguaauaggugcucauagaaugauuggaaaaauucuguuguggaagaaaauacaauauaucugaaacccugccccuguuaacaauccuccaggugguauucuauuaagguuacucuuuaagcuuccacaggauguugauuuuuccuguguggagguagaaaggugaggcagaaggagaacuugucccuaaucuggaaacucuguuucccaauuuuuauauauucaagaauuuugcaaacugcuuguuaaaaacgauuaaaaacaauggguggcuugaaacugaccacgauggggaaacuuaugccauggaaaugggcaagugcuacaacccagggcuuuuuuguuuuggaaauuccgauuagauaagcaagcugcugguuucagggcuuacccuaccccaggcuguggggcauccggcaaaucaccuccccuaugcauuccuucauuuccucaccugugaacgguaggugcccaguaacaugaguugcgugaauaaaugaaagugagauuuccgucauuauuucauacaacaaucgugagggucccauaaaauaaugaaaacagaaauguuuugcguacagugagccucccugccccuguagagaggggcuuaguugacugggcaaccuuugguuuagugguagaaguuggcugcauuucccccuuuggcucuugcuccuuggggagccuucggauuacugacacccuuuuauaaaggcagaugaaaacccaccauuuacuggccaacaucuggggcacauuuccuucccggaaaagucacgaaguuggucagagaagugugaaaagggagccucagcaaugcaggacauaagagccagaacugaaaucagaguuuuugacucauaaucucuaaugcgggugugggggacuuccugccaaaugugaaauugcaacaaaagccucuuucuucaaagcccugcuguugcagcagauuagagcuaauaaauuagcauaaugaagucccagccucugucccccucccucugcuuccugaaucucuuccugugucccaaaggagggauagggagcgggugggacauccguuaagcaccaguuuauccuuguagaauuguagguucagaaaauuauaaaggugguaaggucuacagaguccaucuggucccacacccucauuuuaagaaccucaggccacugagcuggugauuaccagugacugaggcgaaaguacguacuccugggaggaagggagcucagguggagggguggaggauggagcacugcucaggaggccgccuccucacagagcuuacauauaacuggcagggaacgugguggguggucuccaggugccagcccugccucuucucuuccucguccuuccccuguaucugaagucccaguguacuuccugaggugccucucuaguguguuuggacuuaaggccaucagaggccugguuuucuggucagcaaaaucaacuaagaucuuauuuuuuauuuuuucgggacagagugucgcucuguugcgcaggcugcaguacaguggugcgaucucagcucacugcaaccuccgccucccagguuuaagugauucuccugccucagccucccgaguagcugggauucuaggcaugggccaccacgcuggcuaauuauuuuguauuuuuaguagagacgggguuuuaccauguuggucaggcuggucuugaacuccugaccucagguaauccgccugccuaggccucccaacgugcugggauuacaggugugagccaucgugcccgaccuaacugagaucuuauucugagaaucuuuagaucuauuuaugacaaagggaaggaagggaagaggcuguugauugagcucaugaugguucccggcacaguguuuuguaaucugucuacauuaucuuauuuaauucugcaaugagcuaacaagguaucuaucccaugucacggauguggaaauugggucucacagagguaaagagacuucugcaagauuucacagcucauaagcaaaagagauacacuaaggcugucugugaccuccacagcuucucaaagcuagugagugcucuuuauggcaagcacuugcccacgugguaguuccaaaaugcaguucccacacacagagucucucccgucggggaauaucauuccaucucggaagcucugugaacagcugcagcucaaagugcuuggagcuuugcaaaaugcuacacuguuccuuucaaaccccaaggucucuuccuuguaguguaagauagcaccagagcugggagcauuuauagagugcuauaguguaguccucucauucagcugaugccccaggaggugaggcccaguggugcugggcccccagaucuccccgccaguuagaagcaacaggcgugucagucccuggacucucagaacuguuucccggggagcgcacaaagacagauaugcuugcguuuccucugcaacucgggaagagauuauuccucuggcuagggggauuuaauucaguuccacagauacuuacugaaagccuacuaugugcccugccaaauaucucagcuuguuugggcaagaaacucuggcccacacuuggacauacagaucugacagggacaagaggaggagcuuccauacuucaaggcuguuuaguaccuucuuuuuccguccguucugucaccacucauguccagccuuuccuucaagaacucuaaaggagaaauuaugucucaaguagcuguguguccaggguuuccagacuccugaagagguguuuuuuuguuuguucguuuguuuuuuagacggugucuugcucuguugcccaggcuggagugcgguggcgcaaucucagcucacugcaaccuccgccuccuggguucaagcgagucuccuacuucagccucccaaguagcugagauuacaggcgccugccaccacacccagcuaauuuuuguauuuuuaguagagacgggguuuugccauguuggccaggcuggucucgagcuccugaccucaggugauccacaugacucagucucccaaagugccgggauuacaagugugagcgacugcgccuggcccgaacacagaguuuuaaguaccuaacuugcuaacuggggaacaaaccagcagaugggggagggagucagggucuuuggaagauaccuacugagggacagggcugaggggaggaggcagaguggcagagggagugauuuggggaggcacugcuacguggagguggugcccugccuucagcuuuggcucagcagggcacucagaacaugaauuacagccgaaagagcuccuuggaaggcuugaucguuagccaucacgucuuucacuuaaggaaauggaggcccagaaaggggaaggauguuauuugcagcaugagaggaauuggagucuguucugcugacugucuggucagguccuugacacaaaaccaccguggcaguagaggccaggguguccuggggagccggcacagcccacuuccugccuuagcccaucuggcccgggaugggcuggcuuuggcuguuggagguauuuguggcaguggcaauccaagagagagagggugucauuuuagugaugccagagaucuccugcagccccagccccucauucucauuuggagccuucuuugaggucuugcuuaggccggggaguuauggccuguggcuucagguugggaauuugccacuguagaaaggcaucacaguacggagaaaaguggcccagcuuugaagccauuugacuugggucugagccugaccugaccauagcugcaugaccucccggcuuucugauccaguuucaucaucuguaaaaugggccgaauaauaccuaccuugagugaagaugaauaauuauuuauauaaaguuuuuuccccacaaaguagaugccuauuagaugguacccauuaaucuuguuuuauauacccuuauugagguguaauugacagacaaaacccugcacauacuuaaauuguacaacuuggugaguuuugacauauguauacggucaugaaacuauccccacaauuaagcuaaugaacauaacgauuaccccuaaaaguguccuuccgagcuuuaucccuccuuccugcccccuuccaucuccugcccuccauccucaggcaaccacuggacuaagcugcuuucucacacuauagguucguuugcauuuucuggagcuuuauguaaauggaauuauacagcaugcauuuuuuuuucauucagcguaauuauuuugcuguucaucaauguuguguguaucaguaguccuaguuguggauauaccacaauuuauuuauccauuuacuuguugacacacauuuagguuguuucaaauuuuggacuauuaaaauaaagccauuagaaucauuuguggaaaaaaauguuguggggacauaaguauuuauuucucaugaguaaucuccuaagaguagaguggcugggucauguggugggcguuuguuuaacuuuuaaagaagcugccaaacuguugccuagagcacggguaccauuuuauaucaccaccagcuguguacuagaauuccaggcacuucacuuccuugccaacacuugguaugaucuaucuuuuucuuuuucuuuuuuucuuucuucucuuuuucuuuuuuuuuuuuuuuuuugagacagauucucacucugugggccaggcuggaaugcaguggcgcaaucucagcucacugcaaccucugccuccgggguucaagcgauucuccugccucagccuccugaguagcugggauuacaggcaccuggccaccaugccuggccuauuuuuguauuuuuaguagagacgggguuucaccauguuagccaggcugguguugaacuccugaccucaagugaucugcccgccucagccccacaaagugcugggauuacaggcgugagccacagcgcgcagcccaucuuuuucauuuuaauagguguauggugauaucucauuguguuuuuuugugcauucccguaaacacuaaugauauugagcuucauuuuuaugugcuuuguuugccaccuggauggcuccucuggugaaauguuuagauuuuuuuacccauuuaaagaaaauuggguuguuugucuucuuaugauugaguuguaagguuuccuuauauauucuacagauaaguccuuuauuggauaugcuuugcaaaauuguucuccaauucuguggcuuguacaugacaggagauggaagcaaguaagcuaauuauugcaauucaguugaauaagugcugugcacaggaagugcagaggaagagcggugaucucaggauggggagucaaggaagcuuccuuaaggagaagcuauaugaauuggaucuuaaaggaaaugaaaaguuaucuaggcgagggaaggguagccucaguagaaguucguaugugccaaggcauggaaacaggaaacgucgugguacacacaguacuaugaauaauuugaccugguuggaacaccaggauuuuggagcgaagagucugaacuggaaucccaguuuucuuacuggcugggugccuuuucuuuuuauuuaacuuuuuauuuggaaacgauuguagaugcacaggaaguugaaaagauaguacagagacuccugaugcauccuuccuuuaguuucuuguuucuucuuacauaauuauaguacaauaucaaaaccagccaucugagauugguacaacauguguauaguuugugucauuuucucuuguguguagguuaguauaggcaucccuagaaucaagauagagaacuauuucuuuuucuuuucuuuuucuuuuuuuuuuuuuuuuuaagacagaguugcacucugucacccaggcuggagugcaguggcgcgaucucagcucacugcaaccaccgccucccagguucaagcaguucuccugccucagccucccaaguagcuggguuuacaggugccugccaccacgcccggcaaauuuuuuuuuuuuuuuguauuuuuaguggagacaagguuucacuguguuagccaggauggucucugucuccugaucucaugcuccgccugccucagccucccaaagugcugggauuauagaugugagccacugcgcccgguggauacagaacuauuuuaucaucaaaaaggucuuccuugugcugacccuuuuuugucacccugcccccaccucuguuuuucacuucuauaauuuugccuuuggagaauauucucuaaauaggaucauacaauauacaaccuuuugagguuggcuuuuuugcacucaucauaaugcccuucaggucuacuaaaauuguugaauuuaucaauaguuugcucuuuuuguuaaauuaccgaauaguauuccaugguaugcauguaucacaguuuaauuguuugccuauggaagggcauuuugcuuaauuucaguuuuuggcuauuacaaguuaagcugcuaugaacaauuguguucugauuuuuguguggacauaaauuuuugcuucucugauauaaaugccgaggaguucaauugcuaaguugcauggugagcauauuauuuuguuuuugaagaaacggccaaaccauuuccuagaggggcuguaucacuuuacaugcccaccagcaacauaauccacuuccuccacaugcuugccagcauuugguguugucacuuuuucucaacuuuagcuguucccuuguuuuuggacacggaguuucacucuugucacccagccuggagugcaguggugcuaucuuggcucacugcaaccuccaccucccggguucaagcgauucuucugccucagccuccugaguagcugggauuacaggugugcgccaccaugccuggcuaauuuuuuuguaucuuuaguagagacgggguuuugccauguuggccaguggccagucuggucucgaacuccugaucucaggugauccacgugccucggccuccugaagugcugggauuauaggcgugagccacugugcccccccaacguuagcuguuuuaauagauguguagugauaucuuauuguggucuuaauuuguguuucccuaacagcugguugugugccucucuuucugcucccccagucuggcugucugaaucuagaccacagccuguacuccuuaaguguuggaagcaagaagauuuggugcugacaaacccccucccaucauuuucagagcugccccaggaaucugacuuccuuguucuucagcccaguucaccaguuauaggaaaucuuuagucauu

SEQ ID NO: 18074 - RNA, 1611 nt, Homo sapiens
ucuagcagacaaauuaaugagaauugcuauugucaaucaugacaaauguaaaccuaagaaaugucaacaggaaugcaaaaagaguuguccuguaguucaaaugggagaauuaugcauagaaguuacaccccagagcaaaauagcauggauuucugaaacucuuuguauugguugugguaucuguauuaagaaaugccccuuuggcgcccuaucaauugacaauuuaccaagcaacuuggaaaaagaaaccacacauugauauugugccaaugucaucuaaauuaacagguugccuaucccucguccagguaaaguuuugggauuaguuggaacuaaugguauuggaaagucaacugcuuuaaaaauuuuuagcaggaaaacaaaagccaaaccuuggaaaguacgaugauccuccugacuggcaagacauuuugacuuauuuccgugaaucugaauuacagaauuacuuuaccaagauucuagaagagaaccuaaaagccaucaucaaaucucaauauguagaccagauuccuaagccugcaaaggggacagugggaucuauuuuggacugaaaagaugaaacaaagacacaggcaauuguaugucagcagcuugaauuaacccaccuaacagaacgaaauguugaagaucuuucaggaggagaguugcagagauuugccugugcugucauuugcauacagaaagcugauauuuucauguuuggugagacuucucguuaccuagaugucaaacagcauuuaaagccugcuauuacuauacaaucucugauaaauccagauagauauaucguuguaguggaauaugaucuagguguauuagacuaucucucugauuucaucugcuguuuauaugguguaccaagcaccuauggaguugucacugugccuuuuaguguaagaaagggcauaaacauuuuuuuggauggcuauguuccaacagaaaaccugagauuccaagaugcaucacuuguuuuuaaaguggcugagacagcaaaugaagaagaagucaaaaugauguguauguauaaauauucaggaaugaauuaaaaaugggagaguuugagcuagcaauuguagcuggagaguuuacagauucugaaaucauggugaugaugcuaggggaaaauggaauggguaaaacgacauuuaucagaaugcuugcuggaagacuugaaccugaugaagaaggagaaguaccaguucuaaaugucaguuauaaguuacagaaaauuaguccuaaaucaacuggaaguguucgccaguuacuacgugaaaagauaagagaugcuuauacacauccacaauuugugacuaauguaaugaagccucugcaaauugaaaacaucaucgaucaagaggugcagacauuaucggguggugaacuacagcgaguagcuuuagcccuuuguuugggcaaaccugcugaugucuauuuaauugaugaaccaucugcauauuuggauucugagcaaagacugauggcagcucgaguugucaaacguuucauacuucaugcaaaaaagacagccuuuguuguggaacaugacuucaucauggccaccuaucuagcggaucaugucaucauuuucga

SEQ ID NO: 18075 - RNA, 3569 nt, Homo sapiens
aaugcacaaaagggagcgagagguuugaaccacugggaaaaguauguuauauauauaguaggguuagagaggcgaguaagagaaaaauaaaauaaaauaaacaucacagcucuuuccaacuagaauauuaggcaccacgagaaaaauauuugccaagcaguuuucgguggguucauuugcuuuauuuuuauuuaggacagggguuuuugcuguuguucuggguuuuuuucuuucuggugugguggcuugggauuuuugguuucuguauuuugaugguuuauggauuuuugcuucugauuuuuugccuuuugcaaguuugugguguuacguaaaucacaggaucggcaucgguuggauuuuuuuguacgugccuuuucuuucccuaucuaaucccucaagcguuuuaaagauguauuauuucaauacuaauacuauugaaagaagcuuaaauuuuuggccauauguaacaaucccagcccccacuuuuuuuuuuuuuuuuuccuuuggugcaauuuucuuuuucccccuuggacuuuugcugaagugugucucuccugcacuucagagaaauguucaaaggauuuguuuugguuugguuuguuucuuuccaggacagcaagugguggguuuaaucuguuauuguugacucuugggaaauuucuuguugcaagaaacgugugugugggggggaggguggggguggcggggugguauguguguguuuucuacaaaauucugugagccaaauaccuguuuguguuuuguuuucucuuaaggucuugagauuuuuguuuucgaggcucguuucaaggucguuguaaaaaaaucucuucagucuguguuuaagagaucagccggagggaauucuaaaggccugccgugccaguaucacagauacugccuguauuuagaacagacugccacaacuacaaugcacuacacgcagcacagucuucuuagcuuugaagcugaguugggggguggggugggggggggguagagaagaaggagaaauucuuuccuucucuuuuucucuauuacuuucuuuuuaaaggcaauugcagugcagaaucauuucauuguggguccuaguuuguuuguucagagcugcuaguuuccuuauuuaaauguugguucggguuuuuuccccuccuacucaucccugaauaagggagacucuuguuucuuuuaugucucucucuuaaaagaagggugugaggggaaaauaauauuucagauuccucaagaauuagcccaaaauguuuggaccagaagcagcuuucaaaggucaggcuguucugagccuuggcuaugagaguccuucaagcgacuuauuaaauuacagaugaauucuuaaagcuuccacaaaaucucgucacuuguuaauuucuaauaaagauaugucuaaaauaaucuaccuaucucaacccaaaauuuggguuuauaauggaggagugaucagagcugugaaagauugcuguuugcugggauauuuggaaaaucucuuucauugacagucccguaagaaguuccaucuaucaccgaaaauguuguuggcaaugcaccccccuaccccacaacacacacacauuuuuaaaggcuguauuuuagguuuuaaaacccagaaaggugcaaagagguugauuauuuuccacaagggcuggagcuuaggaaauaugcguuaaagugucugucccugugaaaucugaauauuuuaauacuuauugacagauggauuacugcagccucugcagaaaagccugucuugugaacgguuuuugaaaaauauacauaggccuaauccugucacuguuguugaaauguacguuuuacccccaaagacacaugauauugucaaguucagauuuauucugccagaaggcagacuaucugcuuuuucauuugaguccccuuccuucucauuuucaaagaaauuaaaaugaaucccgcuggaugcaaaaugacaccccgauuuuguggaagggauuuucuuuguguguuuauauguguaauuuuuucuuuuaugagcaauuagcacuuuaggauuucucagacguaucuauaugguuuggaaugugaauuguauggcucugccuuacuauugggcccucaaaagauuauuuuuaugauuuuuggucacuuuuuucuuugucaaaacugccauucagccucauccaccgccccccucaaccugaaacacagcuugucccuccuguguucccuuugccacuccacucuuagccccaugggggcgcugcagagcaaagggaaaucugcucucuaaggcaguaguagaaccagccagagugggggcugggaaggaauucacccuucucauaccucagcccucuuuaauucucugcagugagccccuagagggagaacccaccagggcugguucauauauaauuaaccucaucaccagggaccucaaaucuucccagcauauuauuucugggaccaagugccagagugccacauuuuccuacugcuuuuugccaaaucaauguguuuacacugaaagaaauugaccagaacagaagaccaguuagaaagaaagagaaaaucauuauugaaaauuuucuaaagauaggcacuuacuuuucggugagucucuuuuacuuugaacugaaugaauggugaggaaaauugugcacccgccucucaaucucuuuucaauuccuaggaaaguaacuuugucaaauauuauaccaguugaauuucuuccagaaugucauuucuucuuucauucuugaccucuccucaguauccaguuggcaucacuaugugggccucccucacucccgcagugccguguuacaggauuaaagaaagggcugacuugaacguauucugauucuuuuaaaucauccuuaagaagcucuaaagagugauuccaugucuggggucguaugaauaauuccugcagacuucggggcacuacauuucaacuagucccaugauuuaaugguuacuggcugcuaauacucaguagaggaccaggccaaccucuuugccucauggacugggcauaagaauaggucccugaucauugcugcuggguaaauauaagcuuuauuacaaaauaaaauagccugguccuaauauuacaucuauuugaggaaaagaacagacuucacauccaauucccccuugcaaaaccuuccccacaauucagucauagcugaaaaagaaccuauccuuggaauaaacacgguucuguccucuuucuaagggggcucacaagaggaaguugguuucaccugucaggaaccucuggcaccuugguaggucuuuaagauaccacaucauaggacuaaagauuuuaaaacugggaagacuuuuucaaaucaaucaccuucucuaggcuuucuucuuucaggauuauaggcugggucuucacuaggagcaugugugaccccaggaacacaacugaaaaugggucugcaugauuugcuggcccucugucauuuuagaggaucaguguaaucugacaacuugagucuguagguguauaucuuguguccuuguagaacugagggaagcaaggcugccauggucucuuugua

SEQ ID NO: 18076 - RNA, 998 nt, Homo sapiens
cagggagcgcccgucuuugcuggggcuggagcggcgcuuggaggccgacacucggucgcuguuggacucccucgccugccgcuucugccggaucaaggagcuggcuaucgccgcagccauagcugcucagcgagggccucaggccccagccucuacugcgcccuccggcuugcgcuccgccggggcgagggcaggaccugggcggccagggaaagggcagucgcggggaggcagugcuaaaauuugaggaggcugcaguaucgaaaacccggcgcucacaagguuagucaaagucugggcaguggcgacaaaaugugugaaaauccagauguaaacuuccccaaccucuggcggccggggggcggggcggggcggucccaggcccucuugcgaaguagacguuugcaccccaaacuugcaccccaaggcgaucggcguccaaggggcaguggggaguuuagucacacugcguucgggguaccaaguggaaggggaagaacgaugcccaaaauaacaagacgugccucuguuggagaggcgcaagcguuguaagguguccaaaguauaccuacacauacauacauagaaaacccguuuacaaagcagagucuggacccaggcggguagcgcgcccccgguagaaaauacuaaaaagugaauaaaacguuccuuuagaaaacaagccaccaaccgcacgagagaaggagaggaaggcagcaauuuaacucccugcggcccgcgguucugaagauuaggagguccgucccagcagggugaggucuacagaaugcaucgcgccggcugcggcuuuccaggggccggccacccgaguucuggaauuccgagaggcgcgaagugggagcgguuacccggagucuggguaggggcgcggggcgggggcagcuguuuccagcugcggugagagcaacucccggccagcagcacugcaaagagagcgggaggcgagggaggggggagggcgcgagggagggagggag

SEQ ID NO: 18077 - RNA, 998 nt, Homo sapiens
cucccucccucccucgcgcccuccccccucccucgccucccgcucucuuugcagugcugcuggccgggaguugcucucaccgcagcuggaaacagcugcccccgccccgcgccccuacccagacuccggguaaccgcucccacuucgcgccucucggaauuccagaacucggguggccggccccuggaaagccgcagccggcgcgaugcauucuguagaccucacccugcugggacggaccuccuaaucuucagaaccgcgggccgcagggaguuaaauugcugccuuccucuccuucucucgugcgguugguggcuuguuuucuaaaggaacguuuuauucacuuuuuaguauuuucuaccgggggcgcgcuacccgccuggguccagacucugcuuuguaaacggguuuucuauguauguauguguagguauacuuuggacaccuuacaacgcuugcgccucuccaacagaggcacgucuuguuauuuugggcaucguucuuccccuuccacuugguaccccgaacgcagugugacuaaacuccccacugccccuuggacgccgaucgccuuggggugcaaguuuggggugcaaacgucuacuucgcaagagggccugggaccgccccgccccgccccccggccgccagagguuggggaaguuuacaucuggauuuucacacauuuugucgccacugcccagacuuugacuaaccuugugagcgccggguuuucgauacugcagccuccucaaauuuuagcacugccuccccgcgacugcccuuucccuggccgcccagguccugcccucgccccggcggagcgcaagccggagggcgcaguagaggcuggggccugaggcccucgcugagcagcuauggcugcggcgauagccagcuccuugauccggcagaagcggcaggcgagggaguccaacagcgaccgagugucggccuccaagcgccgcuccagccccagcaaagacgggcgcucccug

SEQ ID NO: 18078 - RNA, 2025 nt, Homo sapiens
aacaacauccuauuacuuagcaagucuauaacuaguguuucagcuaaagaaagaaauguaaaucauuuaauacaccuuuccuaauugagcugugcaccaggggcacccuccuaaugguauuauggcaccaauuaccucaucagaagagaagagcugcuuuuaugacagguuuuggaaauuaaaauggcagagagaugucuuuuaggaggaguaauucugggcugggcugugcugagcaacgagcaggggcugaaagggcacguggggcccgggugcuaaaggcgggacggugaccccugucuggucugacccccaucuuggggaugagaucugaacuuagucuuuucauacugucuggucaagaaugugagccacaguggcucuuguacuucaguguguauaaaauccacuggggaagcuuguuagaaauuuagauuccagggccccacccugagauucugacccaggaagucugggcugggcuccagccaaaccauacuuguaauaagaccucugggaaacucccuugcagaaagcugaaagacacuguuucgagaaacauagcagagaaggucccaaugauuuccaccaaaacccaacuacgugucugcagguuccucuauuacuagggguuuuacccgucccaaagaccggauugaaugagacuuauuuugguuugcuucuucagacacagcacagcuaccuuccuccuuuucucucugcuuagccugcuuugguugguacaugggguagagcaguggggcaaacggggaugacuguuugcuuggguguucacucucugugugaugucgggcagggcauuguacgcuuggggcugcaguuuccgcaccucaaaaugugcauggucagguaaaggguaugaacacguuauugaucaagacacuuugucuuuuuugcgacucaguuuuccuuaucuauaagaugagaauguugcgcuuuaugaauuuggcgaguguaaauaggaacugagauucucuuucuggcagcuuuucaugguuuccuuucuguggcaaggaaaggaagaacuucaaccuccagauuuuguguaaauauugaaucuauagcaaugguuuuguggaguguuccaguuuccuaggcugaugauuaaugugguuuucucugugaguguugagccuucucaaaaggcuuuuccugcuauuccugugaaaugcacaaaggcaaaguguuaguccugcuuuuuucucuauugccauguggaagggggagcagaugcauucugcauuccucacagggcagaagacaugucagcugacagacguggggaggcaaaacuggccuuaaucugauaugaauuuccugacaauuacaaugaccucccugaucccagaccuuugcuggcuuuauauugccuaucacaucacacacagacuucccuguuuggccugccguguccccaucauuuggcuugagcaggcuuuguuaauccuauauccucgaaguaacuugaauuguggggcuuuaacucacuuuuauuuauuuauuuauuuauuuauuuauuuauuuauuuauuuauuuuuauuauacuuuaaguucuaggguacaugugcacaacgugcagguguguuacauauguauacaugugccauguuggugugcugcacccauuaacucgucauuuacauuagguauaucuccuaaugcuaucccucccccccuccccccuuaacucacuuuuuugaugcucgcucuccaauccacauuuccaacuagguccuauucuacauguucaacagcccgcagagcucccccaguggacuauguugucauuacuacaaaccuaaaacguccucaggcacauccaucaacucucccuuacccuuguugcucuucccauugaucucuaguuccaguugcagaagcauggucuaggguuaggaaaugaaacauagcuuggaagaucccaaaccuccucauuuuauuaaacacucuauagcuagaaucuauugcuuugaaauagcucagaguuuaauagucagaagaaau

SEQ ID NO: 18079 - RNA, 6984 nt, Homo sapiens
cuucaguuuuggcacuuagcacaucaaaccugggaugagucacgaggguguuuguggaucuccccggcuacacagggagcucggugcggcggaggcuggugggaauugggccugcugagcacucaguaggcgcucaggguuuucagaaaugaggauuuuuuuuuuaggcguccaggguugcugucugguggcaaggucuuuuuugggacggcucugugggcugggauggccucaccccgccgcucugcccacuccugccccggcguggccugccgccuggcagggcucugcgggccgcgagggccucuagugccccggcccuggccucggcccaguuuccccagcuacuaaaugcggcccggagcuaccgggggaacuggaaaaacacuggcaggcggccccacccccaggcccggcggggccgcgcggccgccuuccugcggccuaggccugcugcuugggaggcgcuggggcccggggcgggggaagcgggggcggcggccugccugucagcgggagcgggcgcgggcucgugugucagcgccgcccgcccgcccgcccgccgggccucccggccucccgccgccgccgccgccgccgcccgcuccccccgcggccuggcaggcugccggcugcacaggcggggguucgcgccguucucacgaccucucagguugccugagcucaucugggagcuauucauuuccugccagaaagcagccgggccugcuaagcgaaccaccuuggccgcagggccgccagggcuggcccggcguggccgcccuggccggcucccgcccgggcggagggccccgggcggccucccuggaacccccgggccgccccggcgggcgcgcggcgggggcagcccguccgcccaucugguugcacuuaggagccggggaggaagcuaggagcggguuguuaccggccaacgggugugggaaaaguuaauugacuuuaaugacagguuucccgggacgguggugacgacgaggggguccaacgaaaccccaggguccccauuccagaaacgcguggggugggacggggcgcgaggaggggcgagccuccggagucgcgcuucugcgcuuggagagggcucucguguugaccgaagagcacccccacccccuuccaguucggcgccuuucccgcuccggaugcugcuggagacggcggggggccggggccccggaagggcuccauugagaggcuaaugcgcgcggcagccggggcccgcggcccgcauccggacgcaguuuggagucgugccuuaucuccccgagcgaucagcacugcugggggccggcgagaggggcugcuggugugcccgaggccguauaauuaggccaggccugagggacccccagggaggcaacaucauugaagucguuuuugaaguuucgccucucccucagcuacuuacuccagaaacagccaaagugcaggaggguacagcgucuuagaaauaaguccauucauuuuccagacuuggaaaugacccagagaagggaaaugacuuauccaaggugacacagugaauuugguggcauagcugggcaggaacuggaaagugcccuuuccgguuuggagccuaguggggucuccaccuucuccccuuacuguaacaaagaaaaaauccucguggaauagucuaaaccuagcuuucagggggaaaaaaagugcucuuuucaaaucaccaauuaaaaaaaagaaaaaaacguauuuguguuuuuccuuugauuuaguccccucccuaggaagauaucuauguacuuucggugauauuaauacaaaugcacuuuuaaaauuguuccccuucaacauagggacauugaauuuucaacugguguugagauuuuuuuuuccugugaauuuuaaagacaucgauguaaaaggaauuccuuguguaaaaauaagacauugaggucugauuuuuucuaccaggacuguuaaggggcuccuaguggacccagaggacaggcuuaccaaaugaaacacuggugcuugaguugggugucuuaauggacgauuguuauuuuguuuguguuucaacaggagggaaaacguggaaaaaugauaaggguguguguguguuucuuuggcggaagguguguuggacaccuuucauguacacaaaguaaggcagguaggagacaaauucaaaaaggucucuuuuaaaucucucccucugggguggaagcuggguccgaagguaucuugaguggaaaacugcugucuccccgaucauuccuaugauagagccgcucuccacacuggccugugggaaaggccagagcagggcgggggagagguaaagcuuuugaaacaagacagaaaaucguuggcuuuaucuuuguuaggaaagcuucaaagauugaucucucccgccucauccuucuccucccagaagccggucuaagaaaagggggguuagaggaggcuggcgggaggggccgggggggaggaggacuggccggcggugggggaggagggcgcgcccgccagacccacagcgcggcugaugugucuggucucgcagggcucgugguuuucauuuccccaacaccuggaugcagucaaacaccuggccaaaucugacaaaaucugacaagccuuugugaugggauuuggaagaaauucccugcagauccuggcacaguuuaaagcuguccgcuuugaguuaggacuuguuaaggaggguuaugugagcugaaacccgagacaacccuuuugcuucuaucuggagcccacaucuugccuggaaauggggcaugaccaagcgaaggggucgcuugcuguuuguauuaaaaggggaagauggccugugugccugccagcacagcccccacaugcuuucucuauuagagccaagcacagaaacuuaucaaaaacacaugucugguguuaaucaucugggcucggccuccacuugggagucuaacuaacugucccuuggcagaaggaaucuguugaccuuuucagcuugcuuuaagagggugcggagaggaaacuuuugggugcuagggaacgucuuauuugaaccaaaggauuggcuaauuaaugaagaccccaagucuugaaggaggcgcagcaguuggaaguguuuuugcuuuggaugcuggugagcuacccugagaggagagcugcaggaaccacccuuaacgugcaaugggcaauaggauuggauccauuagcuucgugaauuuaguccuguucaaucuuccucaggaggagcuagaagaacaagggcugcagacuuacccgacugcaacuuaaaaacauuuuuuuuggaaauccuuuaagagacugaccacaaguuuaucagggaagccuuaccagauggcugcuuguaaaguaaauggaauuuagucuuuuuaguucauggaggauuggugaaaaguuugauggauuuuuacaaauguucuuuuaauaacaaaagagucaauuccugaauuaccaauuacauguaauucaaauuccaccaaaagccuuuuuacauauucuggaagaaucaguucgaagacauaaaagccuuuacuuuuuucuuuuauuauauuuucucaaauaaacuuccccaaaggaagauauuuuaagagcauuuucaaacaucuuuggcaucacauaaaaaagaaaucucguguaaaaaacgaaaugucaucugagcuuuuauaauacaaaggcgcaauccaauaugaacauauaaaauauauacaaauauagugcauggucagucacuuaauacagcucucucuacaaaaaguaacuucuuagaaauuaaaaaaacacaaaguaaccacuuaaucaaaaaaguccucuucucucccaguauucaaguuccuguuuagaguccggagggaagagagguggguuggggaguuuaggaggagggguggccugagcccccucaguuccgccacggccuccacauggaguccgccguaagcgaggggccgcuggaaggugacacugcguuggggcccacggaggugccgcuguugcugguguagacggggaugacagggccgcugugcgcgaaggccccguugggaaugaggaaagcaaacuggccaucgggagccgguaccaccuggaagccuccaaacaccuuagccgccucuccagccuggcugcccagcuugcagggggcgccgccgggagggggcgccgcgcccccggggaugggcacgaguggcggcggcggcgcgaacggcgcgugcugggggccgccgggucccggugggggcgguggcggcgccugcaaggcggggugcggcugcccgggguaggucauggcauugaucugggucaugcaguuggccagguggccgagcagccgagugcgcaccucgguauuaacgcccucgcacguggacaggaagcgggucaccucguucaugcacucgcugaagccggcucgguacuuccccagcacacuugggucugugcucagcgcagcugcgggccagaaagagacagacgggucaccgaacggcccuggccccguggccacugccuccgcccugggaggucccuguggcgcgccucccugaccaugcgcccgugaaacugccuccggcagggagggugagauggguuuagaaaaaaccagccaccucuccacacuagcguugcugccaaaagccgagccacuccuucccgauucccuguagcugcauuuaaaccuaucucagccccagaucugucacccccacccccgcgcgcgaugugaccuuggacaaugccucccaauccaucauccaagccucauuuccccuucugcaacgggaaggagugcuaaaccagugacccccaggcuccacgcaguuccaaaccgccacaguccuaaguccuuucgccccuacccggcgcccgccacccucgcggcugcaaccucuuucccucccuuuccggaacaguaacaacuuggaguuguggcuauaaauaagccccagaccgugggaacgcaagagugagccaaggcaguaaaauguagcugaaugccucucacaaccacgggcggaagucuggaagaaaucaccgcgaggcgagcgggacgcccgcacagggggacgcggcgagccgcccucacccgucaucugcgcccgcugcagguuccggaggugcuucacugucauuuccagaauguccgccuucuccagcuuggaaugccgcgagcucugcauagaguaggcaagaaaggaaagugagccccgugucagcugcuucagagugcugggggucccuccucccggccacggagcgcaagcauuaucucuggaccccagcgaauaaggccgggcccucccgccugggagaacgcaguaccagcgagugccagaccccgcagggcgggggguuucacucuuaguagcugagaaaguguuuguuuuuuaauuaaaagagcgagcagcauuuccccacuuacaucuuucuucagagcauccaaaaucaguguuuucagcuggcucagacuuucauuuauucuugcucuucgucuuuucuccauaauaggcuuugaugacugcaaauaaaaaaaagaguucuguguucccauggaaucugccaucccgggguuucaagacagaaagaagccccccaaccccuacuuaauuuugaggggcugcaaagagauacagguaccgcccuuaccuuucugugcucagaugcugucuuugguuuauccggugucguguugacacuggcugggguagcagccaccggggacgaggaauuuuucuccauuauaucagcuggcauuuuccuuuuuuuuuuuuuuuuaucucuagagaauuuuauuuuuggaguucuucacgaaaaagaauuuuuuguuugugucucuuuuacuugagacuuucacaaaacuacugagcaagugcugaggguuuauuauauuuuguggcuacuuggugaucaguagcgcuguuccaggaccaaggagagagguagacgggggauuccgcuguuaucagcaccagcuccggauccugugugaucccuaggcccuggcggccucuauauauaucugggacugcacgcgaacggcucgugugaaacuucccaaacuuucuuucccacaguaacuuucagccaaugggaggaggagacacgcggcaccgcucguggaccgcgcccccccauuggccgccaggcacaaggucuggcggccaauggcgcgcgccugagcccagggcaccggaggcuacaacgucaaucaaaaggauuuuaacccuuugcuacucucccucugggcuuugguuuagagauuuuuuuuuucuuuccgcuuuggucuugaucuugucuauuucuuuuggagccagggucuuugcucuuuaugcccucucucauauguaacagagcugcuuugacuguaguaaguucauuugaaacauauuuuuuuuaaagguauaaacaauaaagaaaaaaacagcagugguuaaaagggggcggggggagggggggacggguguaagaaugugaguuaccgacacaucuaaaguucccgcucagacuuuacauucaggagggugaaaguagaugguaaaggaaaagggccaaaaaaauuuuccuguuuccaugcagaaaaaggaaaaauugccuucuaccucacaaaugcagguuuuucggagcaagguaguucuugaaucccacccccaccccgucuuucagaaauuccucguuuggauuuggggccuuagaccccgggcuuccccaggaaacaaucagaauaauuuccaacuggguggaaggaaacgguauuucaaaugaaaaaaugaacaaggggggcuccgagggcaaugacucagggacucgcgcccuccuucaccacccuuucccuuuucauccguaggcuuuagguucugcggcgcguugagguggcgggcaaggaagcagccucucccuccucgccccgcgggcggccucggcccccggcgcccgcgggcccuuuaagagcuacaccagccgagcugcaguuugaca

SEQ ID NO: 18080 - RNA, 465 nt, Homo sapiens
cuuuuuuguccgacaucuuugcaaggcugcggugucugcugcuacucuccgagcuucgcaaugccgcccaaggacgacgagaagaaggacgcuggaaagucagccaagaaaaacaaagacccagugaacaaauccgggggcaaggccaaaaagaagaagugguccaaaggcaaaguucgggacaagcucaauaacuuagucuuguuugacaaagcuaccuaugacaaacucuguaaggaaguucccaacuauaaacuuauaaccccagcuguggucucugagagacugaagauucgaggcucccuggccagggcagcccuucaggagcuccuuaguaaaggacuuaucaaacugguuucaaagcacagagcucaaguaauuuacaccagaaauaccaaggguggagaugcuccagcugcuggugaagaugcaugaauagguccaaccagcuguacauuuggaaaa

SEQ ID NO: 18081 - RNA, 3084 nt, Homo sapiens
uaauguucaucuccagcuuuauuaaggaacccgggcaggaggagaauggagugccgggaccaucguuaucccaaagucugugagguggguggauuuaggagcaagcuagaugugugcacauugaggcaaggaagaaaagccagaggaaucagagaaaacacuguugaacaagggucucuuuugacgggggccuuuaggaaggacgcagcuccaggaaaaguaauccucuuagcaccgacuuauguguguguacaaaacagggaaaucaaaucugaauguccucauugcauuugcuaaaauaccuaaugaaaacacaaagauuccuuuuucugaucuucaccuuucauucagaagccggagaguggcagauguuugcuuauaaggcuguuuuuuuaaaaaauucaaacugggaguuuggggugggagaggagcugacccuacucucuuuccaagggguguggguugcagaacuuugagccuuuguaucucccccugggguuuuuuacacccuccugccuuguugccuuugaggcaguacaugugguuuuauuucuugaguuugugcucuguguucaccguuggaaugucucuccggaggccucagugaaagaaaucucaaauccuggccaacaaaugcagcuuccugaaaagaguggggaaguugguauaaaaagaaaugcacucccaaauuaguggcuguucugcaguuggggaucacugugcccuggccagggagcaccaggauagcccucacccauacccacauacuuacacacacccaacauacacccacacaccuacacccaggcauacacucccccaacuuauccacacacgcgcaucacacacucccccaacuuauccacacacgcgcaucacacaucuacgcccaggcauacacucccccuacuuauccacacacgcacauaacaguccacaccacucacccuccuguauacacacacacacacacacacguguccuuccaguuauagauacaccucuccggccaauauacucgacagcacacgcaucugcuuacucccagucugaauggucguacuuagucuuaugggcaggcauccuccuuccccaucccuguaacauaccgggcuuucgaucgcaugugucaguuauaacuuggcuuuaaaaugaaacaagaugcaagugaggcugagucaaacguuugggggauugccaagcagauuucaccuaagcuaaaauaggagggugcacuuuuauuuuuccuuuccuguguuacagggcuacuuuaaauucaaaacuauuguuugcuauuggguuacaaaaggaagagaaguggaggaggcagccguagaaaggcugauuauggcucuggguccagugugagcugcccaucugugggcuggcccugugguccuaggcugccagggcagguagugagaucccagguccucaaagcaguggcccaagcauccucuaucaucaucaguuggagggaauuccuaugcaaggugugcaguggagcugaaugagcucugauaucuuuugcaaacuuaacaauaauaauauugagugcuaauuaugugcuagucacuacucuaagggucuuaaauggauucucuaauuuucccagcucuaugauaugaaaucucucauuaugcacauuuuguagguaaggaaacaagccuagaguggcugggacauagguaguagugacagagcccguacugaaacccagauguacccaacaccaagcuuaggugauuuaccucgcacugcaagaccucuuaggagaaccugauguuaagugauuuucuguucccuucuuuccuuggucaguaggagaggauugggcuuacacccuuccugguucauccccuaaugcccuggcauugguccucccuauuccuuuggaauaaagacggagccugggaacaucucugguuggcuugucccugggaaggguuccauguccagccgccagaccccagauccacugagcggguggaaccuuguuccuugcugcagcaggaggcacucaagucagaggccccagccaugugcuuauagaacccuuucggcagucacucuaaggcuuggggaucauuggggagaauggcagcccuccagaugugugcauccaucugagaagcacaccuccucaaucuccaucccucaucuccaggcccccucuacugagaggagaacacagcccaccuagacgaagugcagcagacaccucugguccuuuucucuucaccaugccuaauguaccagggaucggggcgucauaaccacagaccuggaaccuugagagucacuggaucaaacuccuugugguggcucugaagaugugucuacaaauucauugacacuacaccccucaagaggcggagcuuaauuauccucuucuugaguguggacuggaguuggugacuaguccacuagagacuagaauauggcagaaaugauggaugucacuuggaaauagucacuuggauaauuccgaaauuagauuauggaaaggcaguagcuucugucuuggguucuccaucugucucugucucugucucugucucugucucugucucugucucuuucaucacuugcucuggggaaagccaguuuccaugucaugaggcaaccuagggggaggccucugucauaagaaacugaggccugccaacaaccacaugcaggagcuuggaaauggaucuucugagucugccaacagccaugcgugugauccuggaagcugaucuucccccacuguaaccucgggcugacuguggccccagagcacaucuugacugcagccucauaagagaucuugugccagaaccacccaacucagccacucccagauuccuaaccccaagaaacugugagaugguagauguuugucgcuuuaagcugccgcauuugggggccaucgugaugcagcaacagaucacucaugcccuccuguacuaugcaguugggagaagcgagggccugcuggggaaagucacuucccaauuucacaaaggacaagugagugcuugaaauuaacucaaauauuuugacuucuugucuagugcucuuuccacuacaucagacuuc

SEQ ID NO: 18082 - RNA, 14502 nt, Homo sapiens
agcccauguauacauguauauuauuuauuguugauucuguacaccaaauggauuacaagcagcauccagcagaagacagaccccccaacccugcccaccagggcucacacucuacaaaacccugagggccuagaaaucuguaaaugcaucgccaagcacuggggcugauuugcaguaauucucuaagcaaggcaaacaugaucuagcuuugaaggcagcaugaaggcagcggguuggugagaacaaucucuccuuaagagaagaagaaaccuggggcggaaggaguuuuccccggaaguggcuugccagcccacccucucugaaccacagccauggcuuccuucccaaggccacugcuggcuucccaacaacgcagauucaguucugacugugggaucugggggcugaaucuuugagugguuuauagcuaaaagcuaggauacaucuaacaucugucgaccaacucugggucccgaguuaucucuagcugucugcucucugcaaacuuccugaguuuggaaguucuuucccaauagcucuacaucagcaucugaaagguuguggaaauuguguccaugaaaaguucuaaguagaacucuuguaucucuaaauucuaaggaggaagaacaauauacauacagcccaauucccaugagagggacaaacuauucuauucuuuaagggauggaagaguuuauuuuuuccugugguuacaaagcuuuugaucuauaugguaccaagugagguucugaugaccaagacuaaggagagcaacaggggaauggcuuccauuuccuuugguuuaaugacgaaagcccaagacaagccaugagcucuuguacaaaguuugaagagauaaauaaaacucccagccuauugaacaccaugcagaagagcaagugccucuguaccccaucacaaguggguagaggcggcacuccuaccgcaggggugcugagggcuagagagagaauccacguccagugcuugaagaguaucugugcacaguaagcacuuuuuaaaaauagugguucuaauuggcuuuuguuguuucuucuccaacacugacucccagcucccacuccagaugggcgugggacugucaaggagcuguaaacagagaggaaaacugaacucuguaccccacuccagcuuucugggggaccagccggcucauuccagcccugagaauugagcaaaugcaucauccuguuggaaaggagacuccacucagcuuuucuaguagcuccucagccagacaacauggugcagagagguugaagggcccgcugaagaaaaggaggccaauggcuccauccaaccacucugaugggagaaaggaagaggcaagagguucacauaagggggcccucaccccucaccuagggugcuccuggguggugucaucugaggacaguggcccucaggucagccucuggcuggagaggaaggugcuccaaugucauggcuacugccaggaauaccuaaggguucuggguuaagauuggcagggcccaccggaugaugagguuucccaccucccuccagcccuggcccacuugugccuaugcacaaagacaucuggaggccacucacaggagcacccgacaggucugugggcaaacccaugcuuccugucuggagggguacgggccgggaugccccuguuggcaccaggcacagcaggccaccaucagcgggugaugcucaugugccaugcucugggcucacuuccuguuggcucuggcaagccuuggugcauguccuccaggugccaccaauaguguggaaaugccuuggagacccuggggggaugacaucucuugacucugacgggccucaucucuccuagauucccugggacagagggugaaaagcuacaaagugcacuaguguuugcaaacagcccucuggacacuuuuugugcaggaacuggaagggaaaacuggucagcacgugcuccuguggcccuggaggaugucacaggugucuuguggagcggggagcuaauaagagccgaucgggauuggugguagauuuccagaucacaggugucuuguggagcggggagcuaauaagagccgaucgggauuggugguggauuuccaaagcacaggugucuuguggagcggggagcuaauaagagccgaucgggauuggucguggauuuccagauccccguggagucagcugaaguucuuuccugggcagacguggagaccugaaauucuccauuucacuguaaacugggccaguuguccagagaaagacacacguugccaugagccuaacuucuugagcgccaugugaauauguguauagcaggaaagccagagaaggcagguauucgugugacugugacucgaggaggagaauaacccuggagcaaacaacucaacuccuaaccagaccacacgcaggaggagcuccagggagcccccagacccagugugacccaucgguguacccccgugucgccugcuguaagugagauucugaaguucagcugccagcugacugugauguugauggagaauuuuaccacauuagaaagacacuagauuccguuacacuucguuuucaauuaaaggaucucaucucugagcgauuucacuuccccuaagugaagaaugaaaauuaaaaacagauacaggcauaucacguccauagaaggcuccaggcggaggggccuccgaugagccgcagacagcuugcuggcagggaagaggguguggcugcacggaccucugcagucaggaugcuucugaccuggccagccauggugccccaggucucagggucucucagggucuccagauauaauaaaaucuccuguucaggccacagucucccauccuguccacacccacauauucuccuccaccccuggccacggggccuuugcacaggcugacuguggggggaccguccuggcucauggggggcaggucccagguaaguccaucuucagaagcccccaucuccucugggaaaagcccaggaugggggauauuugugaugcucugggucugggucuagaugcugauuacacagguauguucaguuugugaaaauccaccaagccauacacuaucauguucccacuuuucugcacguacacuucacaugcuucaauuaaaaauuuuaaaacaaacucuaggggugaacacagggacccccaggcaccagauuucuuucucuaucccguauuaauaagcugauuuuaauguuuuuagaaguccaaaauucuacaugauuucauuccuuaaagggcuaaacuuuucaaagcaaaguuugcaguuuggaaauauccuucucuaaaaggcugagcuugcugugcugggguguuucuuccuuuuccagauaaaaaucacaagugagacacugaugacggcucuucugucuccaggaacugagcggcaugauuuuccuucucucuuucauagcauccccaaaaccaggcugauugacggcucuuaagaaaccaguuaaaugguuugaagucuucuuugaggagagaacucacccugccuucaggagcagaaaaucaaggggagaacuuucauuugaggggacaugcugggucaagccguagcacaaacaagagaaacaaaagaagggaaaucaacuuacauaauacuuaggcgagaggggcuaucucagcggagaacuauucccacgaagugagcaggcuguggacuaacugagucuacagaggcccggagggggccugggcgcagggaaggcuguucuuggaggacagguggggaggauuuggaggaagagcccucucgaaggaagcccagggguaugaaucggaaauccccagggcuuuugccauggccaguuggaucuaucuuccugauuguaggaagguccggcacgaccugcuucucuacgggagaaucaggcaagucaggaagagguaggcucaccuuucucuggggccagaaagagcaaucacgggaaagcuccauggacccagggguggaggcagaaagaugaaauucccagguccuccagucccaucauuccccagcccugcuccagccugccucuuuaacacucauugggugccuucaucugcaucaggacagcuuggcuccucuucuugcagcagcaacagccgacgcaggcagccagggagcaggccagggcgacaaugccaauuacaauggcggcaauggccagcccgcucugggccugggucaugccccaaacgcugcggucaucagugaccugaaugguagucagaucaguguagucuuccacagggcugguuagcucagugguagaagagacggauguggugucaggguaacugggugugucuggguaccaugguguuucuggguaacuaggcaccucggggacauggacgcuuggaacagcaacguugacauugaugauaaugagggacuggccucggacauuggcugggcugaaacacacagguacaguguccgucccuaaccuaggcugguugagcaggagccaguugcggagcggaaggaugucugagucacaccuccagggauugucauacagccgcagcucacacaguuuccccaggugaucgaagaugccgaggggcaaguucuccagcugguuguucugcagcuggauggccaugaggccauugacguuggcgaagauauucccugggagcugucugaggcgguuguucugcagggagauguucugcagguuggccaacaugcggaagacguucccguccagguccugcagugcguugguguggagggacagcucccgaagcuccguuagcccguugaaggcacccggggagaugaagcugaucugauugcggcuaagaaucaggaccugcaacuggcggagguugcugaagacauugucggguagagaagagaugugguugucauagagccaaagcucccgcagguugggcaugggcccgaagauccccggagagagcuccuucagggaauucccaaagagaguaagacgguugagcuggggcagcugcaugaagacgcuggguggcagcugggagaugugguuguuggacagguagagucucuggagguugugguuguuguggaagagaccaggggagagcaguccaaucugguucugcugcagagccaguuccugcagguuaacaagcccaucaaaagugcccauggggauauccgugagccuguucucauacagccggaggaccuggagguugcccaggugcuggaagacccugggugagaugugggugaggcuauucuugcccagauugagcuucgugaguccuaccagguggucgaaggcuccgucagggauguauuccaggugguugccgugcaacugcagcuccuugagguugcugcacugggagaagugggccggcuggaucugcaacagcugguuacuggacagaaggagagacucgaggcuguccaggcccuggaagaggccgaugggcagaaccugcagcuuguuguuggcgaggcugagauagcgcagcgagcccagguuucggaaggccccaggcgugaugcgcgacagcucauucuucucaauccucagggcgaugagggcugagauauugaggaacggggacucauugaguucagugaugugcguguugaggaucugcaggcucauggcguuccagggcagaggggugggcacugccacaaugcgugccccggugcacuccaccugggaggcccuggagcagguacacucgcuagggcagccaugguaggccaacccugcaccccaggcuuggcagcccaccagcaaaaggagauaaugcuucaguggcauagccugugcaaggggagagagcacacguuagucaggguccucuaccugacacuggcaaguuuuaagccaacaucaacuccagugccaaugcuggcuuggcuuugaaccccaucaucacauacugaacacaugcucucucugcucugaacaggaagccucugcaccuuugcccugccuuucugcuuccaugccuuugcccaggcaauucucccuaccuggaaugucccuuguccuuauacaaaauuuucccaugcuuccacguccaacuccagugcaauaaccuuuaggacacuucccagauuccaugagucaaucaguuacccuuccaugaagucgucuucccagucuccaucauuggccacgguggccuuggaugucauucacuguguccccugucugucuccuuccccagucaauaagcuuuccacggacagggaguccaucuuucaucccuacaguuuccuuagggcgggaacuguaucuuauccaucucuguaucccucacaucaucugaaugugcugguuaagcacagcccugucaggaggaacacaaaggcaaugggaacaaauaaauagggcugaaccugggggaagauggugaggccacaaacacgguagccugccgggaggugcagcagcggcggcagaguuaggaccacagagcugggaucugccugaaugacuacaguggaagcagcucuuccucacccucgccugggccugcccugcccagcccaucaccaccaaccaucacuuagccaucugcuagcccuuucaccugugcuucaucuagcucgaauucaaaccacccucccaggaaaaggcaaugacgugucugcaccauguccugccucgcugggagaggcugcuguggcuuagcuggugcccgaagccagccuuguggguauaagucccaguuuccacaagaaacacuggggaguccuugaguaaguuccaggaaaccuacugagauguacuuugagcuaaaagaugguaggucagguguggcaauguucugaaaauggaggcaaguucauggaaauguugguguuugaaaucacugaugacaaugacauauauaacuguguguguguauguguguguguguguguguaaaauguagagauaugggacauaggugcuggucccuauaugaauauuuaaggaucacuaacaguuucaccuugcaugaagcuugaggccugcaagcuucagcucccucgugugugaagaggggaugguaacucccgccccguucuuggggcuguugugaggagcgaaugcggaaaggaugcagggucaucccggccagcgcugugcaaaugcgugccuuguuccaugcuuauccacagcauggacccuauagacuccucaagucaggagggcuucaaagugcuucuggucuuggcauucguagucaaggaacuaagaauuucuguguauaugugagaguauccgcaacuuccaccaaagguucaaagguccaaacuccuggaagaugcagcaaucacugccggucacucauucccaucacuuuuuggggaugcaagaagcaaggaaaggcuucugagcuuaaagcccaggucuccagaccccugaggaaguacuuugaguguuaaugcugugucucccuuuccaugagcaaaaauccugagucagaggaaggaauuucaaaugauggcacagaagccaucaaugguuggguaaagaagguauuucucuggucucugucuguggcucugaacucacggggucuggagccuggcccacgucucagaguaacccaggcuuccuaauuuggccucagccccgugcaccccuucccugcccccucaacaagcuuacucugagauaaaaaccuaagcccauuccccaaccacacagaccuugauuuuguuuuuuuuuuuuuuuuuuuugagauggagucucgcucugucccccaggcuggagugcaguggcaugaucucugcucacugcaaacuccaccucccagguucaagggauucuccugccucagccucccgaguagcuggaauuaaggcgcaugccaccaugccuggcuaacuuuuguauuuuuaguaaagacaggguuucaccauguuggucaggcuggucuugaucuccugaccucgugaucugcccaccucggucucccaaagugcugggauuacaggcaugagccaccgugcccggccaagaccuugauuuuuuuacuuguucacagcccauggaagcccugaccugcuauacuuuuacauuaagaacuugacuaagcauauagaacaauggaaacaagaaaggaaaaagaauaccuuguccaaaggcaucuagaugcaaaggaauggggccagguuaugcuagggacacaucugaaaaaaaguaaaaacuuauauagacaaaugucagguccagaacccagcaacagaaaacaagcugccuaaacagaauacaccaaaaaaaguggcucaauauucacccuaggagaagacuuaggacuuuuuacuaacgauaacaaaggaaggaggcugcccacaaaagcuaguguggucugagacuggauuaauagaagaaguaucacauguggaaaaaaggaggugauggucucacccugcaacugcccugacguggccacaccuguaaugcugggcucaguuccacucugaacuucaaaaaggcuaauggcaaacugacuuccuaaagaauucuagaggauggcaaggggaucuagaaaacagaacaucugagcauccauugaaggaacugugucagcacccuaagacauggugagaaaaaaauuaaauuaaaauuaaaaugaaggagcuguggaugaauaaauaaccagaggaggagaugcugugaggagucuacaaucacuuuccuagcaucccugaagggcugccacgggauacagaaagaaccuagcucaguguggcuucagaggucaagcgggugcagaaguuauagaguagcagauuucaguucacacugaaaaugggcaaccucacagagggaguaagcucacugucacuggaagcaaucaagcagaggcuaaagcaaucacuuggcaagcaagcuguagagaagacucccaugccugguaggguauuggacuggaagacaacugguguccuguccauuccuaagaccuuaggauucuaaggcugaguuucagggcaugagaaaacaaucuguccaccaagacaacggugccuguacucuuaggggucugcguggacaguguggguauuugcccaucucuuugguguaaguguacgugagauauuuacugccugggcugacgugcaaaagguggagcuugaauugcuccuggagacaagcuggcuggcacuuauauuuaauguacacucauauacccagcaugcuucaaaacggugucacagcccaagugucagagacuaaauuaagugcaugucaccuggccagcccagggcaaucuugaguuuccccaucuaugaaggacaguguaggaugaggcacccucugaggacccaucuuuauguggcuuucuaggagucugcacuccccagcuggggaggggcaucaagccagcccaggaagggcuugugccagggaaggugccccuugaccugagaggacugcacagauaauucccuaugggaacagggccaccacugucuaaaaugggccacacucagcaugacaaauauugcaagaauuugcagauuuuccucuguauaaauccucacaucugcaaagcccaucccagcaccacaugcagcaguuuccuguuuuccagcacuuuccacugcuguggcuggcggccagggcuccacagggccuccaaagugcuccccugaaacccggcugcaaagcccgcaggggagggaggggccacagaaccaggacugacagcugggcccuuggauucucagcaugugaugccagcuccugcaguggccacagccucuaggagcccagcaccuggaggccuaauagcccacgcugccuggugcugcuuggcagcucugacagauggcaguuaaagggccacaaagcugcccuaauuauaacuucucccccaggcagccgagagcgucgucaaucacuucagugacucaguccagccccuguccagcuccugggaagggggaauagccuggugucuaucacuggcccaugaagucagcaagccgagcagacaaaccgaaggacagccugacagcucuccugggcgcucugaugcauucccuccccgugagcagaagugcacgaaccagggcucucggcuuugggucucagcagaagcaccgugacucacgagcaaacgcguaauuagccucgaagcccugggcuuuguugguugguggguugggacguuuuugguuuaauaccaucguucacauucccugaacacgagguuuccuggaaggagacuccuccuuauuuuaaugacacagagcauaacuuuuggagggaggcuggaagaccagcguucuacucugguugacacuaaguugaagugugagcuuagggaaauucuccaggccucaguuuccccuucaguaaagacguccaagggcccuuggagcucugcuaucuucugaugugaggcaggaaggaaauuuggccugaagccccucauucuccucaucuucucuuccccagaggaccugcuggaccuccagcagggccgcccggcccggcuccagcuucaugcugaggccugaggaacucaugcccaucuuuucaggcccaccugccuccaaguuucccagccagggcaaucccacuuaguaaucagcauguccgcacacagccaauagccguuccauggaacccagggacugggaggggccucugggagcuucugguccugcccacucccagugcaccuggggaaacugagacccagagaggggcugucucucccuggcuucucccuucuccccacagagggcugcccagucauggccuugucugcagagagaugucacccaacaagccugagggcucccgaggaagaugucaggcuuggagcagccagggucuguccccacugcccacagcuggugcugaccucaaucacgcgcucaugggggcucaggccagugggucugccugagaggcuuggccugaagcucgggccuccgugccuccagaccuccccaucucaccaaacauccccucuccuggggcagcacauaaaaucgccuggcuuguuuaauagaacugaccucauagcguugcugcugugaggauuaaacgaguuaaugcaugugaagcacuugggugaguucuuggcacaaagugaggacccaauaaacguuugugacgauuguuauuuuuguuguuggguaaaaaucagaaucucuggagacuccacccgcagagauccugaucccuaggucucagcggggcccaggauucugcauguuuuacaaacuucccaagugacuccaaugcaggaguccacagaacaugcucagaaacaccacgugaggucuagacuagccgagaacccaggcucagaccuuuugucacugaccgcugagaacgagaggacccgggaugggggaggccgcagauccugccacaggccuggccccaucccucuaccaauauuucucucagcggccccuuccgcauccccaucaggaacugcaguuugugcugaguugaaccuggcaauagaagcugcuuccagaaacgguacuuagagccuggagcaucagaggugcaagagcuuucugagugcaccuagucaaaccgucugcucauuuuguaguugggaaagcugaggggguccccagggagcagagacuugcccaaggucacacaguccguuggggacuccugacacccgaucagggccccuaacuacagaguuuggcaaaucccugagccucaucaccgggauuugggaccuugucaaccacacgccuggcagggccugggauuggggaggagguggauuugcacccuccagcuuaaaucaacugaggcucauacaauccaccuucccccugcccagcaugauucgccaagggcaagugcuuauuucaacuaccaggcugcauggguucagggauuucuucuuuaaggcugcucugaugcugguguuuguucaauuccaccugagucuccuggaggacuguagggaagggacagaggguucaccagaagguguugaccccuguaaucucaacaacaaggcuggagauggagucaaggcugcagauggauuugugaugagggguguguggaucuuuauuuuuuuauuuuuauuuaucuauuuuuuuugagacggagucuugcucugucacccagacugaugugcaguggugugaucucugcuacugcaagcucugccucccggguucacaccacucuccugccucagccucccgaguagcugggacuacaggugcccgccaccacacccggcuaauuuuuuguauuuuuaguagagacaggguuucgucguguuagccaggauggucuugaucuccugaccucaugauccucccgccucggccucccaaagugcugagauuacaggcgugagccaccgcgcccggccaguguguggauuugaaacugggacagcugcaccuuuaccugugucucugcucaaauguagaggcaggaccuggggccaaggucacaggccccugauuugggaauacuccaccccaaacagaaaccuuccuugaacuccaaagcaagacuggccacacccucaccguccaccuugaucaagcggggacccgcgucucucaucucucauggcccuucaaagccaacauguugcuuauuguuugaaaacagaaaaucaguuaaaaagcgcaauuccuuuccagcccuucuguuggggauccucccaggucuggcuuccugcagaggccagagcaggacugucauuagccuggcaaggguggcaggagaaacugacaaaccgcccagcagaacaggagaacugccccaaaagggcucuuaugacagcagccacgggcuacaaacagcccccuucucaggcgggcaccugggaucccaaaguagagagaaauggaucagccccugaucaaagcaucuggaagcagguucuaauuucuguguccaaaagccaagacaggccauaaaucugaagcagcagugacuccuucguggucaggauucagggcagcaaauugccaugugugaucacagucugcuuacuggcaggacugagucgggacagcuccucccccaccccuuauucuccacggcuggaucuauucuaccucgccucaccaccccgccauuuacugagcgagcuaagggaguguucccuagcccugggaagaaccuuccaugaccugacugucugucgaaucuauccagaacuuacccuggccccgaacccucucacaugccugccucaucacugcugagcccgcccagcugacucaagaccacaggcaaauugggcugucuggcccugaauuuacuccagauguucagucucugcagaaugaaggaagugccagccguuagagcacuucuaaauuaaggagccaguggcagcaacacaucugagagcugcccaagguaaagugacgcaucccagauaaccccaaaggagaagcuggcacguggcagacaggcaccuggcaccugcgacuggagcacacgugucaucucagagagagugcagcugcaccgaggugaugcccugggcccgggagguggaauggcucuugcacuuuggcaggggugggagaguccugaaagcucugguuuuccacaguugguuucuuggccccagguccugccucuacguuugagcagagacacgggucaaggugcagccgucacaauuucaaauccacauaccaccucaucacaaauccaucuccugcccugacucccugcucaaagccuccaggcuccacagaggccgacgcuuccagcaggagagaggggaaacugccagcauaguguccccuaagccacacuguuagagccugaacaaugcugagcccauguccgaauuccaaauuggaacugcaaaccagggaccagcacaucugcugaaguuacacuugcaggaguuauccaucuaugcaaagcagacagcucucuugccugggaaacccccaugaaggaaggucuugggcagaaccaaaugcggggcagaccacugggagccaccagggcaagugccaggaaagauggcacaggcgcaaauaaucugaaccuuaaaaagagaaguucuucccccaguggaucuagauuccagaacggucaauccagugacaaggggggugauaauuuaguccacuuucagcccaacuugcuggucucagacaucucagcaccccagguugacaucaugagccgcucagggcaaggggcauaagaggcuguugaggcaucagcagaggggcuggugguccugguguccaggcagugagggagacaggcuugcaccccuccagcacaggcugcuucugucccugucccgagagcauccccaggcacaugucagcucugccccuucuggggucuccgaggggagcagguccagcagaaaugggaaggggcuggccgggcccucuaagcagagaggagggauggggguggcuugccuacuuaccagcagcucggcgcccgcccgccguggacaagagggagccugagaggaggacgagggacggcucaaggcugcagcaugag

SEQ ID NO: 18083 - RNA, 2143 nt, Homo sapiens
ggaagcagcccaggaggucuguuuucccgaagguugggcugugaguaaacguggucuuugguuugaugcagggaaagggcgggggagggguggcacauacccgcagcaauccgggggaauggcauugaacuggaaaagugugugugugcauguaagugugagugugagcaugagcaugagugugugugugccagagugugugagaaugugacuaguccggaagggcaagacauggagguggcauagggacaggcugugguuaugagacugucuucguucucucuuuuacucauccaaccuugccacgacuuagccugcugcuggauccccuccgaagcuucucacugaggagccacaguaaacuguuauucuucauuuaacuggguugguuccuguguaugcuuccuguacuucuggagaauuuguuuucaauuuagggagacagucccucucuaaaagagcccagcagcgccacugucugcacagcacgucuguccaucugagugcauaaagaggccgggugugguggcucaagccuguaaucccagcacuuugggaggccgagguggguggaucaugaggucaggaguucgagaccagccuggacaacauggcgaaacccugucucaacuaaaaauacaaaaaauuagcugggugugguggugggugccuguaaucucagcuacucaggaggcugaggcaggagaauugcuugaacccgggaggcagagguugcagugagccaagaucaugccacugcacuccagccugggcgguagagggagacucugucucagaagaaaaaaauaauaauaauaaaaaaagaaggucuugcaaaggcacucaagcagccgaggaugcgguuuuacuucucaaugugcuccuuucaggcuggccaaggcuuggagggggcaggcaggggaaagggcaucaaugugacgcaguccuaggaucccaggcauuuccucuccaccuccaagacccacagaugacgucuccaaggcagguugcagauuggauccaacagagguccugggaaucucuacgucaccucuauuaauuauuuccaugcaugucccaucccuuggaaaacccugucaguaaaagaaugagcgugguuccucaguuuccuccauguggaaugcagcuacuuccacagugacaucagcauuggagaugccugcagcucuggggcuggcaguuccccgaggguggggcccaugcccauccuguucacugcuggaccacagcaucuaacacaaugccuggcauauagcauaaaauauaaauucaauaugaauugagcaauaucugaaauuaaguggcagggaccagagaaagaauccgauuuuacagggaaaacgagauuaagagaguugaaggaggcguuucucaauuuuauuauugaaaguuucugguaaauuauuugauaugacacuuugacaggacacccuuaaguuaugggcagcuuugauugcuagaauguucuucuuuagaagcaagcaaacacuccuugauggaauacccgcuggauguucugcucuggaugaagccucagggcuacuauauauagaguauaauauauauuuauauauaauauauuuaauauauaaauauauauuuauauauaauguauuuuauauauauauauuuauauauauauauauuuagaggcaaguucuugcucugucauucaggcuggagugcaguggcaugauccuagcuugcugcagccuugaacuccuggucucaaguaauccucccaccucaggcuccugagcagcugggacuauaggugcacaccacuaugcccagcaacuuuuuucuuuuagagauggggucuugcuauguugcccaggcuggucuugagcuccugagcucaacugaugcucgcaccucgaccucccaaagugcugggaucacaggugugagccacccugccugacccagagcuaauauuuuggagcaucuucuccgagcugggcauuguuuuaggugcccuacuugcauuaccuuauuuaauucucauuguaguccuuugaaauaaauccccaguuagcagaaaaggaaucuaaaguuuagaagggcaaaugcuuuaagcaaaguaaauggccccgcuuucagcuggggaagcugcugagag

SEQ ID NO: 18084 - RNA, 2143 nt, Homo sapiens
cucucagcagcuuccccagcugaaagcggggccauuuacuuugcuuaaagcauuugcccuucuaaacuuuagauuccuuuucugcuaacuggggauuuauuucaaaggacuacaaugagaauuaaauaagguaaugcaaguagggcaccuaaaacaaugcccagcucggagaagaugcuccaaaauauuagcucugggucaggcaggguggcucacaccugugaucccagcacuuugggaggucgaggugcgagcaucaguugagcucaggagcucaagaccagccugggcaacauagcaagaccccaucucuaaaagaaaaaaguugcugggcauaguggugugcaccuauagucccagcugcucaggagccugaggugggaggauuacuugagaccaggaguucaaggcugcagcaagcuaggaucaugccacugcacuccagccugaaugacagagcaagaacuugccucuaaauauauauauauauaaauauauauauauaaaauacauuauauauaaauauauauuuauauauuaaauauauuauauauaaauauauauuauacucuauauauaguagcccugaggcuucauccagagcagaacauccagcggguauuccaucaaggaguguuugcuugcuucuaaagaagaacauucuagcaaucaaagcugcccauaacuuaaggguguccugucaaagugucauaucaaauaauuuaccagaaacuuucaauaauaaaauugagaaacgccuccuucaacucucuuaaucucguuuucccuguaaaaucggauucuuucucuggucccugccacuuaauuucagauauugcucaauucauauugaauuuauauuuuaugcuauaugccaggcauuguguuagaugcugugguccagcagugaacaggaugggcaugggccccacccucggggaacugccagccccagagcugcaggcaucuccaaugcugaugucacuguggaaguagcugcauuccacauggaggaaacugaggaaccacgcucauucuuuuacugacaggguuuuccaagggaugggacaugcauggaaauaauuaauagaggugacguagagauucccaggaccucuguuggauccaaucugcaaccugccuuggagacgucaucugugggucuuggagguggagaggaaaugccugggauccuaggacugcgucacauugaugcccuuuccccugccugcccccuccaagccuuggccagccugaaaggagcacauugagaaguaaaaccgcauccucggcugcuugagugccuuugcaagaccuucuuuuuuuauuauuauuauuuuuuucuucugagacagagucucccucuaccgcccaggcuggagugcaguggcaugaucuuggcucacugcaaccucugccucccggguucaagcaauucuccugccucagccuccugaguagcugagauuacaggcacccaccaccacacccagcuaauuuuuuguauuuuuaguugagacaggguuucgccauguuguccaggcuggucucgaacuccugaccucaugauccacccaccucggccucccaaagugcugggauuacaggcuugagccaccacacccggccucuuuaugcacucagauggacagacgugcugugcagacaguggcgcugcugggcucuuuuagagagggacugucucccuaaauugaaaacaaauucuccagaaguacaggaagcauacacaggaaccaacccaguuaaaugaagaauaacaguuuacuguggcuccucagugagaagcuucggaggggauccagcagcaggcuaagucguggcaagguuggaugaguaaaagagagaacgaagacagucucauaaccacagccugucccuaugccaccuccaugucuugcccuuccggacuagucacauucucacacacucuggcacacacacacucaugcucaugcucacacucacacuuacaugcacacacacacuuuuccaguucaaugccauucccccggauugcugcggguaugugccaccccucccccgcccuuucccugcaucaaaccaaagaccacguuuacucacagcccaaccuucgggaaaacagaccuccugggcugcuucc

SEQ ID NO: 18085 - RNA, 17055 nt, Homo sapiens
cacauacccacacacacacacacacacacacacgcgcgcgcgaaaacaauaucucauuucuucuucagggagcagcugugaaggaaaucgggggaggaggauggacacaacaucccaucuuuguguuucgauacagacuaagcuuuuaggccaacccuccugacuggaugggggcggcgggcguggcaugcaugaaaaguaaacaucagagaccugaagaagcuuauaaaauagcuugggagaggccagucaccaagacaggcaucucaaaucggcugauucugcaucuggaaacugccuucaucuugaaagaaaagguauguacuguaguuuuaagcuuuucauuuaugauaauaaugucuaaaauagaaacagucuagacucuccauugccccauuucagcuacauauaacuaccacugauugagagcuugugccgguagcuuuagacuuguucucauuuuuccucaaacaaauguacaagguagguaucaucagagccauuuuuccagugauaaagcugagguucagauacacuagcaacaugccuaagauaaaaccaaacccagugugaacucaucccagcgucuuuugcuuaccccuccaaacuggacaacgagguguuuccaugcacaaacaccguccuaggugaauucucagcaagcuguccaacggugcaucgcaguaaaauaaucuggaaacuggaauuaauggugugacuagaaaaugcauuugacaauauggcauaaaauauuguguuugggagauacgugucuuguuauauuuaauggcuaaaugagucuuugagaccuaaugacuuauuggaaccuauuuuauuuuaugaggugaaauuucaaaaucuaguccuucacguucugcagaucuuugaggucaggggcuguguccccaggcacuaagagcgcgggcuugugggagaccuaggcuuacauucuagccuguccccaggccuaggcuuacacuguggcuucguaguuuaccaggaaguaacccgggcaaauucaccucguugguaugaagagagugucagcagaggucgccuccagaggaggugcuguggagacugagcgcauagcacccuuaaaauccugggaccagggcuucuccacggguaagcuuaaugcaaguggagcagugauuuccagcuagugccaggcccaagguggaugcacugucaccuuaguuggauugcuuuuuaauuaccucauauucuguuaaaaaucauauuucuuuuuuuuuuuuuuugagacggagucucacucugucacccaggcuggagugcaguggcgcgaucucggcucacuacagccuccgccucccagguucaagccauucuugugccucagccucccaaguagcugggauuacaggacugcaccaccaugcccagcuaauuuuuguauuuuuuguuuguuuguuuuuguuuuguuuuuuugagauggaguuuuugcucuguugcccaagcuagagugcaauggugugaucuuggcuuacugcaaccucugccucccauguucaagcaauuauccugcaucagccucccgaguagcugugauuacagguacuugccaccacaccuggcuaauuuuuuguauuuuuaguagagacgggguuucgccauguuggccaggcuggucucaaacuccuaaccucaagugaucugcccaccucggccucccaaaguguugggauuacaggcauuagccaucaugcccggccaaaaauaauauuuaaauuauacuuauuuuguaaaguauuuaaacuccucauaagaacaaucuuccuauugauaucagaagaagaugcaaaaauauaugucguauauaauccauauguuacccaaagucuuaaguacacauuaauaacaugcucaauaaguaaugaguaaauuagaaugaaaggacauugaaaacuauaauggaugcuguccgcccuuucucucacaaggaguuuuuuuguuguuguuguuuguuugcuuguuuugagacggaguuuugcucuuguugcccaggcuggagugcaaugaugcaaucucagcucaccacaaccuccaccucccggguucaagcaauucuccugccucagccucccgauuacaggcaugcauguaauuacaggcagcaugggauuacaggcaugcaccaccaugcccagcuaauuuuuuuauuuuuaguagagauaggguuucuccauguuggucaggcuggucuugaacucccaaccucaggugcuccaccugccucggccucccaugggauuacaggcuugagccaccgcaccuggcaucacaaggaguuuuaaccacaggaauaaaacuaauguaaccaagaggcaucuuuggaagagggucagucaaagggguuguucugaaauccuccuacugagguaaagaaucuguuucagcucacaagagagcauuuugucagaguaagauguagaacugacuuuuguugcagugucaugugguggugagacucaucaggucacagaggugggggguuauugaaaggcccuauggcggugcacagaagaagcagauucggggugcugcagacaggagagggggagauggagcucgagucccagcucucugccccuuccaggccccagcuuccccaucuguacaccuuggaaguagagcuagaaagaugaccucuaagguccuauccaguguggggaccuuguggaaugugcauaguguguggccagucuuugagguuugauccucugggccaggcuuucagcuugggccuacuaaguagaauucaagaucucuuuaaaauggaugcaaauuuguguggguuuaggcugcauuucuauaaauucaucaucccccaaaagguuaaaagacagguuuuguuuauacagugguggagccgaugagaaacggaaccucagagaccagggaaaguggcccuguggcagacuugcucaaaggggccucagcaaccaucucccccugcagcaaccccagcuggcaagcugccacuccuuacauaacuguucuuuggaaaaccaggcaacaaaaccuccaggggaaaaaaagcuauugauuauuaaaggguauuuagagguuuagagacucacaauaaagcaguuauaauuauuccuguaaugacacauccuucgaaaugcucagaucugagaacauuuugcuugcauugcaucagucaucaucauuacagggagaaaugcagagagcuggaaauagcucgugugcaagcuacaggcaaggagucacaaggaaaggagcaaauugacagcgagucagugaaggaaacaggggagcuuccaaugcccagaaccugcacacaguccugcagccucugucucccugccuugcugccccgcuucaaagccagcuucugcugccaaaggacucuugggguugaaaugcuuguugcacaguuacacaucagcugacaguccuucucugauuuaaugaacuucaucuaugaaaaauacccucaacaggccgggugcgguggcucaggccuguaaucccagcacuuugggaggccaaggcggguggauccccugaggucaggaguuugagaccagcauggccaacauggugaaacccugucucuacuaaaaauaccaaaauuagccgggaguugugguggacaccuguaaucccagcuacucaggagucugaggcaggagaaucacuugaacccgggagacagagguugcagugagccgagauugugccacugcacuccagccugggugacagagugagacuccaucucaaaacaaaacaaaacaaaacaaaaacccucaacagaaugucaaaaaaaaaaaaagaagaaagaaagaagaaaagaaaagaaagaagaaaccugggaaauaccaucaucuuucugcuuuugauaauaacaauaacuagcauuuauugagcauuuacucuguaucagacacuccucuaaguacucucuguauauuaucucauuuaauucucacaaaaauucaugagcuaggaaugauaauuauucccauuuacuagacaaagaagcuaaggcauaaauuggacacaguuauacuuaguauggggcagagucacaauuugaaccuggcuggggugacccuggagcccccagcaggccgcucccuguuaagguuuccaagcgcacucuugggcugguagaacagccagcaagacgagggcagggggagggauggugucagagaggcaucucccugaagaaucucagaggacacuaaguguugggcaacauuugguuugguuucgugucuuucgugguucacuuggaggcuuuaaucccccacuuuacauagcccucuccacgcuguuucuguucauuugacaaguaucuacugagccgacacuuugagguccgugggugauucugaggagaacuagacacagugcccauccugggagaugcauaauuaggugggacaggggugaaaaucaauccaacaaaccagaauaccaggcagagagcgcccucguggaggugcagaggcucugaggaaggccucacagcaacaaggacaggcagguguuccccugcaggaugaggguucacaugggcuggggagagaagaggagggaccgcccacagaggggaccaugggcacagcacucuuacuucaugauuguguggccuuagaaggcucagaaugacaaccccagcugcuuugcguucccgcagcuccaggucccuucuccagccacccagccccaagauggugaugcugcugcugcugcuuuccgcacuggcuggccucuucggugcggcagagggacaagcauuucaucuugggaagugccccaauccuccggugcaggagaauuuugacgugaauaagguaaaaggcgaaccucccguuuguuuugcugccuccgcugugaauaagcguucuacaagguucaauguaauuaugcugcuuuaauuuccacugcacaccuugggacaaguauuuaucuuauuugggguuuccccaaagcagacaucugcugagauaaagacugcaggcagagagguuugggaugaucccgggacgcacgagagcaggugggaaggugagucggagacagcacagaagcaauaaagggugcguuccugagcugucgcccugggccgucagggucagucacacugggcacccucugaggacacguggagcaugccccuccgauugucccacagcugcugccagcaggucaugggagcauccguggcucuagcugagcccccuggcagaggagagacacagggucucaggugggaggcuggcagugucugggaauugccuaccguggcugcggugaacucagaggugggcugaggggaacaggaccagggaaccauaguagcugcuacagagcuauuauccuuguucuacagaugcagcaucggaaucucccuccccagcucacgcagcugguaaaugcaaguaggauucaaaaccaggcuucucagcagugcagggcacccaaaggucacucaaacagggcucaggaaagcccaaaauucuccagggggcuuucuugguaucugcaccaaaaugucaucaauacaacgagcuccuccauagauggucuuucuuccugggguuuagcgggaggggaaggaagagggcggcagaaagaggcagcuauuggaggacaggacucacaggcucccacuguugcuacucaagccuggaaucucacccuuaagacuuccucuccuuaggagaagguuuggaucucuuuuaagaauggcaacaguaacaucgaaguuguuaucauacacucgcaccucaaggugaaugaguguugggaccucugaggggacgcugggugggagaaggagcaccauccaugggaucaggagauacaggugugguaggaagaggccauagaguacacuaacgucuacacugacuugcuccacuuacaggcugaucccuuuauucagguaacucugauagaccacagagaggcuuuaaagaaaacauccaaggaaucugaguuauacuuucgcuuuuggauacaaaucccaaagcacuuuggaaaugauaacugaucuguauuuauagaaguccuuugagaauuaaagcaggauuuaaaaaauagcagcuuuauugagauauaauuuguauagcacguaauucacuuguuuaaaguagcuuuucacuuuccauuguuguuaguaucaucacagaguuacgcaaccaucaccaccaccaucgauuuagaacauuucacuguuccgaaaaggaaccucauacccauucacggagucuccaucuccccuccaacccuuccagccccaggcaaccacuaaucuacuuucugucuccgaauuugccuauucugcauauuugauaaaaaugaaaucauacuauauguggucuuuugugacugguuuacugaacguuuucaagguucauccacguuguagcauguaucaauacuauauccccuuuuauugccaaauaauauucuuguaggaaaucguuauaggaaaucaauugacuguauaugugagaguuuauuuuugcacucucaguucuauugaucuauaugucuauacuuaugccaguaccacacaguguugauuacuauagcuuuguaguaaucaaagccuugagguaagcuuugaaauaagaacacauguguccuccaacuuuguucuucugguuauuccgugucccuuacauuuuuauaugaauuuuaggaucagcgugucaauuucugcaaauaauccaauuggaauuugauacagauugcauuaaaucugaagaucaauuuggggaguacugccaucuuaacaauauuaagucuucuaacuugucaacauaguguaucuuuccauugaauuaggucaucuuuaauuucuuucaacaauacuuuguaguuuucagaguauaaguuuuauguuucuuugguuaaauuuauucccaaauauuuuauucuuuugauguuauuguaaauggaauuuucuucuuuuucuuuucuuuucuuuuuuuuuuugagacggagucucacuuugucacccaggguggagugcagcaucaccaucuuggcucacugcaaccuccgccucccggguucaagcaauucuccugccucagccucccaaguagcugggacuacagguacacgccaccacacccagcaaaguuuuuuuguauuuuaguaaagacgggguuucaccauguugcccaggcuggucucgaacuccugagcucaggcaauccauccgccucggccucccauagugcuaggauuacaggugugagcaagccaccgugcccggccuuuuaaauggaauuuucuuaauuucaucugcaaauuguucauugcaaguagagaaauauguuuauauauguauauauuuuugugugugugugacagagucuugcucugucacccaggcuggaguguaguggcaccaucucagcucacugcaaccucugccucccagguucaagagauuauccugccucagccucccgaguagcugguauuacaguugcgugccaccaugcccggcuaauuuuuaaauuuuuuauagagauggggccucgccauguuggcuaugcuggucuugaacuccugaccucaagugauccacccgccucggccucccaaaguccugggauuacaggcaugagccacugcgucuggcugagaaauauauuugauuuuugaauauuaaucuuguaucuuguaaccuugcuuaacucauuagauccaauaguuuuugguuuugucucuguuuuagauuucuuaggauauuuuauaugucaucugcaaacagauagaguuuuaccucuucuuuucuaggauuauuuuucaauacugaccagagaucugaaaagauuaagaagccuuugcaaaaauaauaugagaucauaaggaagcucugaguuuccucuuuucugaaaaaucaugcuuccuugguuuuuacuauggggcacuaaacucacuuuaacagaaauagaacagauuugaaugcaccauagaaaauggagcuucuuccgagaaugucuaugaaaccaguuaaccucuaaccuuauucuuugguacuuuaaaugaauguuaaguucaguggcuuuaauugaaagcugugcuuuaauaagugaguagaacuuuauggucaugaauguggcauacauuugagcggaaagccguggcugaagcaauacucaccugugugcagcauccucucuuuucaaguucugacucugaaggugagcgcaucucuuuuuguuuuuaaauuucuagaauaggccaggcgcgguggcucacgccuguaaucccagcacuuugggaggccgaggcagggggaucacuaggucaggagauugagaccauccuggccaacauggugaaaccccuucuccaguaaaaauacaaaaauuagccgggcaugguggcacgugccuguaaucccagcuacucgggaggcugaagcaggagaaucacuugcacccgggaggcagagguugcagugagcccagauugcacuacugcacuccacucuggugacauagugagacuccaucucaaaaaaacaaaauucuaauuaguauuuuaacuagauaaauauauuuacauuguucaaaauccuaaagguguaaaagaauacaccacauaaaguuucccucccaccucuguaccucaguuucccuccccaguagcaacuaguaaaaaccauguauuauguaauuuuacagauaauauauacauauacaagcaaauacuuaauaacugugguaagcagaagaguggcuuccaaagguguccacgcccuaaccuugugaauguuacuuugcaugggaaaagggcuuuugcaaaugugaucgaaguuaugagccuugagauggccagauuagccuugauuauccaggggaacucaaucuaaucacauaaauccuuaaaagcagagaaucuuucccagcugugauaagagagagagguuugaugauggcauaagagucagagagaugcaaugugagaaggaucugacuuccuuuugcuggcuuugaaaauagaggaagccucaagccaaggaauguaggcggccuguagaacuuggaaaaggcaaggaaacugauccuccccuagagcucccagagggaaacacagccaacacuuugaguucagcccagugagaccugucagacuucugacuuacacaacugcaagauaauaaaucugugcuguuugaagcuugugcuaauuuauuauagcagcaacagaaaaccaacguaauaaacauuuucuccauuuuuacacaaaaggugccuuaauagauacacuauuuuguaccugacucuuuugucauuaaauauuagaaaucacugcauaccacucuuuugaaagaggaaguaaaauuccauugucuggauaugccaucguuuacucacccagcccccuacuaaugcucacauaggcuguuuccuaucuuguauuauuacaaacgguacuguaaugaauaacuuuacacauacaucauuucuuauaucaggaggaugcauucccagaagugaaauugcugggccaaagaguauaauauguauuuuuagcuuugcuagauauugccaaacugcccuccgcagagguuguaaacugguauggucucccugcaacgcgugccaggcagccuaggagggccugguucccucgaccuuccccacacaguggcagcuuccuuuaaagcuaacuguauacaccugaagucuggacugagcgcaggccccuagagaaagcaugauacagaccuuucaaauccccaccaccucuccaaagccuugaugacuaaaucccuccucagggucagaugaggaaaguuccgugcgcucuggaguccuagcuccccacagcgaacacaucugacuuugcacaggauucaaagaugacuuguagaauugugcacuguuucagaugaaagguauuucccaucauccccuuuuuuuacagagucuagaaugucacagcgauuuuggcugaagugggcccugagaagagcccuuuacucagcauucacccccugcccgcacaucccauccuagucacagauucucauugcaaucaaucucuugcccaguugccacugggaacaaugaggcccauuuugucuggcuuccccaggacagggcucugcgucugcacgacaauggggaagaaguugcagguccccagagaaccacaggguuuugcucugcuuguugucucugcaguaucucggaagaugguacgaaauugagaagaucccaacaaccuuugagaauggacgcugcauccaggccaacuacucacuaauggaaaacggaaagaucaaaguguuaaaccaggaguugaggugaguggcugugggcguccggggccaggccugcggagugcugaugcagagugacuggguguccggcagccugggucagggaggaugggaaccuugcuggaucgggacugccugcuccuagcaggaauugagaggaaagcguuuggcaggcaaggauggcaaggacuaggauccacuuaugcauuuccaugaccaccugcggggcacaaacugacaggguuccugcacucacugcaaaauagauacucugguagcaaagaacaucaagaccaucucuucugaccuccagucugggagagaagccgcuucgacaccaucugcugacagaagcauccagcuuuguucaaacacuuccaggaacugggagcucaucgccuuccaggacaguucaucccaucucugggcagcuuaaucuaucagaaagcuccuuuucuuauuaagcaagaaucacauacacaacauucacacucuagguuauguaaacaggauauccuuuagaaguguacauuucuauuacugagggcuucuaacacaauaauuaauccaaaaagcuacgcuuuggaaagcaacuauaaacuuaaaaagagccccaggaagagcuccuuccuacccaccuuccacucuugaaaauacaaaugcaguuuuuccaugaacauguugugacuucauggucagagacugguguccugaaaaccguucuagagcaaaaugcaauugacggugaaaagggcagaaucugcugggaggagacugguuuguugcuaaguuaacguaugcagauagaaacagaccaucuuccccagcugucugagauccagaugagagaggagggcacggucuccagcuuuacauggugauaaacagagaaaguacuugggaacaucagagcacaguucccagaaucccuggccuguugcucauuguccuguuucuaggacauccgucaccacuaaccauagcauuaaccuacugacuuucuuuuuuuuuuuuaauuguauuuuaguagagacgggguuucacuguguuggccaggcuggucuugaucuccugaccuugugauccgcccccccuuggccucccaaagugcugggauuacaggcgugagccaccacgcccggccaaccuacugacuuucuaacacauacgacugcucuaauuucaguuggccucccugcucugccuugaggauugauaaacagacauccucuccucuguuggcuuccuaggaagagcacccugaugccuuagcacccucccuuuggugccuccaucuccacaccuuuccccuucucccaaguucauggggccauugggagucaucuagaaagcaggcucauucaaagaggugaaaguauugcauccaaucuaagcccccagcuuuuaagacacaccacugcguuauaugccacuaagaaaggaaugacacugcuaauugucaggugacaucaauugugagauaugcauuucuucacauuuaaugucucugaaaucugggcauaccugagaaucacugagauaaaguaaauguuucuucacugccuccuuuuacuuggccuacauugaaaucccccacacucacucagaggcuugcugaacuagagggagucucuggacucaggccccuugaugggacaggcgaugucacaugauaucacugaggcccaaagaaggggaacgcuuuuaugucuccuuguuuugaauuauuuucagugaucaaguccauccucaucuguaccuuuggcccuucucguuuuaaaaagaagugaaucugccaggcacggcggcucacgccuguaaucccagcacuuugggaggcugaggcagguagauugccugaggucaggaguuugagaccagccuggcuaacauggugaaaccccgucucuacuaaagauacaaaaaauuagccaggcgugguggugcaugccuguaaucucagcuccuggggaggcugagggaggagaauugcuugaaccggggaggcagagguugcaguaagccgagaucgcaccacugcacuccagccugggggacagagcaagacuccaucuccaaaaaaaaaaaaaagugaaucuucuuuguguguuggguuguuuuguuuguuuuuccauucucuuuucucccuuucuuuggagacugggagcaggaauuggucuuucaggccauagaagauagucagagauaguguugaagugcaagggccuaacauacugucccauccuggagcuugucaauugcggcuucuuaucaccccgcugcucucuuccccugcuuggccucagagacagucacaagggaaaggccaggccauggagcuagggucuagccugccuuugagagccucucuuaccagaaaucacgguguuggcugccacgguccuuaguggcacaaaucuugccuuucguugcuuauuggcuuucaaugaguuguuuuucuuuucucuuuucguuuuuuguauuuuuucuuuuuuuaacucacugcagagcugauggaacugugaaucaaaucgaaggugaagccaccccaguuaaccucacagagccugccaagcuggaaguuaaguuuuccugguguaaguauccacuuuucccaggaggauucagggacaggaaauaugcaaacugaaggcuagcgccccggcuuggagaauuccugagacaccugagugucaucuauaaucacucagcacauaauuaucugucaaacacuuacuacaugucacgcacuaggguugccaugaugagccggacagagcuggccuugguacuuauggagcucacaucccaguguggauacugacacgugaccccgcaauuuacuauaacuagcuagcguuucaacaggugaaacacaaguaggugcacaccgggugugggcugcagaagacacaacccagucuuguuucccaaaggaaacuggggcccgaaacauuagcagauauuagcagaacaaccugcacggcgcagaaacuaggaagcaagagaugacaagagugacggcaaguuugaauccugcuucugccacuuuccagucacauuguuggggauccugugagauaccuaaugacaggcauuugccucuggguucugagcuaacugaggaagggacacaggcaauagagaaagcaccaaauauuaguuuuauuuccgacgaagauacacuagagaguucaacccagaacugugaggcuuucuaacacgaagagugcuugaaagccccuuucccaccugcaggguagacacugaagucaucagcuacaaaaguuacucccugcacuuccuacuucucaucucugccacuccuccaccccacaccagucaagugccuagagcggggaggagaggaaguucuaauuuuauagaccaagaaaggaaugcugggaggagaaaacaguucuucucacacuaugaauauggacaacuaacuucacauguacaagccagaaauaacugcccagugucgugaaaauaaaccagauacacacgcucuguaaacuguaaagggcuuuauacacaguuucucuuguuauuuuuaucaagaagggagcuaaagugcaggugggcugagugacgcaggccaucacugaacucauuagaaguagaguugggaccuaaaccuaggucuccaaacucucaacugaguauuuuucccauagggaucagggacggggauuggagugaaagcuaacuauuacaugcauaacaaggauuagauguuugcguuaggccuuguaggauuaugggagauuauggaaaaggauuuccaagugaagggaacuggaacauagaagaaggccugaauacaggcauaucacgaagucaggaguucaagaccagccuggccgacauggugaaacccugucucuacuaaagauacaaaaaauuagcugggcaugguggcgugugccuguaaucccagcuacucaggaugcugaggcaggagaaucgcuugaacccaggagguggagguugcagugagcugagaucgcgccauugcacuccagccugggcgacaagagugaaacuccaucucaaaaaaaaaaaaaaaaaaaaaaaaaaaaaacgaagaagaagaaggccugaauaaagaggccuagagccugggaguguacaugaagaggggcaugagguuaggaagggccuugaaugccacauuaaaaggcuugaaguuucuuccauaaacaauaggagacugucaaaguuuucaaauaaggagagacaugugaaguuuucuguauuguaucuggguaaauuuauucuucggaacuggaccacgagaggaaggcagaaugugccagccugggugagugcaggugggccaugaugccgcugcuggcagaggugggagacagauuuuugcaaaaucacucugggcuuaagaguucucaguccaccugggaauacacagagcagcugaaaugugcagaugggugaugacuauaacgcugucucucucucucucucugucucucucucugggugagugaggcaggcaggcaggcagggcaccaacagugcuagaaaggguaagucagaaacacucagucuaggcuuucguccaaacuucuuuccagggucuuucuguuucuggauugauaaacaaaaucagagguggggggcuuggugggugguugucugggccagccuucuuguguuguccugagauuucucuugcccucucccuccaauaaugcugccucucucugguucucaguuaugccaucggcaccguacuggauccuggccaccgacuaugagaacuaugcccucguguauuccuguaccugcaucauccaacuuuuucacguggauuuugcuuggaucuuggcaagaaacccuaaucucccuccagaaacaguggacucucuaaaaaauauccugacuucuaauaacauugaugucaagaaaaugacggucacagaccaggugaacugccccaagcucucguaaccagguucuacagggaggcugcacccacuccauguuacuucugcuucgcuuuccccuaccccccccccauaaagacaaaccaaucaaccacgacaaaggaaguugaccugaacauguaaccaugcccuacccuguuaccuugcuagcugcaaaauaaacuuguugcugaccugcugugcucgcaguagauuccaaguuggauuaauuauuguggguuuuucauuauaagcuuaugcuuagaaauccuuaaacaggcugguuguggugccucaugccuguaaucccagcacuuugggaggcugaggcaggaggaucaccugaggccgggaguucaagaccagucugggcaacauagcaagaccucaucucuacaaaaauguuuuuaaaauuagcuggguaugguggugcacacccgugcuagcuacucaggaggugguggcaggaggaugacuugagcccaagaauucgaggguacagugagcuaugauggcaccacugcacuccagccugggcaacagagcaagacccugccucuaaaaagaaaaacagaaaaaaaaauccuuaagcaguuauguugaaaaaaaccaagcacugaauuguccucauuuaaagguaacaauccuguuucuggagugggggaagcugauggcaaaggcguauucugggugaccugaauccagaugcccccguucuggaguagaugcugcuuucagggugaauuacuugggcguucggagucccuguggggcaguuucuuugaaguguuuacuuucuccucgggucuucagagccaggcugaagaaugaacccaucuagggguuuauguaaggaagaggagaaucuaugaggaagaacauagggaguuucuuuuaaggaaaaaaauacauauauauauguugucuuucauucaacugauauuuacggaagcccaaucgcauuccaggcauugaaaaauacagaaucccuguccucccacagaagcucacagucuagugagggagaaacaaauaaagaugccguuauaauccaaggugaagaaugcaaaggcagaggcacacagagggugccagggagcuccaggaaagucccaaccccugccagacacaggugggcaguaggguugugcagcuacaccuaugagcacuccaauuucccaggaccaacaggucucaagaacgucuuuguggccgggcgcgguggcucaugccuguaauaccagcacuuugggaggccaaggcggguggaucaccugaggucaggaguucaagaccagccugcccaacauggugaaacccugucucaacuaaaaauacaaaacuuagccaggugugguggcgggcgccuuuagucccagcuacucagaaggccgaggcaggagaaucgcuugaacccgggaggcggagguugcagugagccgagauugcgccacugcacuccagcauggaugacagagcgagacuccauuucaaaaacaaaaaaaaccuccuugaguuuguuuuuuaacauugugacuuguaaaaccagaaagaccucagaaugaucgcccuguaauuuaacuuagcucacauaacugacaauuuacuaauguuuugggaaaugaauagaaaauucagccauuucauuagauuuuugcuuucuuagcaugaauaugaaauguucauuuucuggagcacucgagucucuuugaugcuuuaaugauuacaaaaaucccaaggauuuuaauauauacaauuuucauuuaacuaaauaaauacgaccuc

SEQ ID NO: 18086 - RNA, 2574 nt, Homo sapiens
uccacacccagauggacuugguuaagagaaucccaaucccagaagggacacuaauggaaaugacagaauguugagucaagcugggaccccacagaucuucuggcagcauuucaacccuuucugugccgugugccccuuugacagcuuggcaaaaaaauauccauaaauacauaaaauaaaagacaugagaucacaaaggaauucaauuaucuugaaaaacaauucuacccaacuuccuauggacauccauggauuucagaugaucaacaccugacagccaaaccucuugcugaaaacuuaggaaacucuccaaggucacucagcgaagaagugagaggccuuggacaggaaccccaucuccuuauuccugcaccugugcuuuuguguuuuuuacuaauuuaauauuucaggaaacuaagaaaaacaaaacagaaaucuugcugccucugcuuugaaaacugaauuucauccaugugggaagguguggaggaaacccugcuggcccucagaguauucauaagaacugaccuugcuuuauccaggauugcaacaccaggcaaauauuauuucucgguaaacaucuggaaaagcuuagggucacaguaaauugguggaggauuuggccagggcacuggugacugguugagacgcccaacuccuaaacguggugggcagcacuguuggauuguggacugaguagaugggucaauuccucugcuuucaggaggucagggucagggagucuggaacacuggccucugagccugcuaccgacgucucggcccucaacucuuguuaggaauuagugagcaguuggugcccccuuguucugcugggaagacuggcagguauuuaaccugagagcauuaaccccuggcccaucucccagcugagcccuuucacuccuuucucucccugcugggguaagagaauguaauggauaaaagcaugaguuuggucaggguuuaaauucucacuucaucgcuucagaaaaguugcauggccaucucccccuccccucuguuuguuuguuuguuuuuugaacuggagucucacucugucacucaggcuggaguacaguggcaccaucucggcucacugcaaccuccgccucccggguucaagugauucuccugccucagccucccgaggagcugggauuacaggcgcccgccaccacccccugcuaauuuuuguauuuuuaguagagacggaguuucaucauguuggccaggcuggucuggaacuccugaccucaagugauccaccugccuccgccucccaaagugcugggauuauaggcgugagccacugcaccuggcccucucuguguuuuuaucccucuaaugggaauaguagucaugccugccuuuuaggguguagcaacaauuagagcuaagguacagaaagcaccuacacaggaccugauguguugcauucugcauucugugguuaggagucauuauucuaauaagcucuggguugcaccuuccacacuguugugggaagucagggacccugaauggagggaccagcuggagcugcagcagaggaacauaaauugugaagauuucauggacauuuaucaguucccaaauaauacuuuucuaauuucuuaugccugucuuuacuuuaaucucuuaauccuguuaucuucauaagcugaggauauacgucaccucaggaccacugugauaauuguguuaacuguacaaauugauuguaaaacauguguguuugaaaaauaugaaaucagugcaccuugaaaaagaacagaauaacagugauuuuuagggaacaagggaagacaaccauaaggucugacugccugcgggguugggcaaaaagagccacauuuuucgucuugcagagagccuauaaauggacgugcaaguaagaaagauaucgcugaauucuuuuccuagcaaggaauauuaauauuaauacccugggaaaggaaugcauuccuggggggagaucuauaaacagccgcuaugggaaugucugucuuaugcgguugagauaaggacugagauaugcccuggucuccugcaguacccucaggcuuauuaggguggggaaaagcucugccuugguaaauuuguggucagacugguucucugcucuugaacccuguuuucuguuguuuaagauguuuaucaagacaauaugugcacugcugaacauagacccuuaucugugguucugcuuuugcccuuuguccuguucccucagaggcaugugaucuuuguuagacccuuauuaguaguucugcuuuuugccuuuugaagcaugugaucuuuguaccuacucccugcuuuacauccccuccccuuuugaaacccuuaauaaaaaacuugcugguuugaggcucgggugggcaucacguuccuacugauaugugaugucacccccagcagcccagcuguaaaauuccucucuuuguacucuuucucuuuauuucucagcuggcugacacuuauggaaaauagaaagaaccugcauugaaauauugggggcggguucccccgauaccacacugugucccuuacaaauaaagcaggugcuaaggca

SEQ ID NO: 18087 - RNA, 19390 nt, Homo sapiens
aguucucaaagaagucagauggacacauuaaagaccaaaggcuggggggaagagcaaaaucacggagucaaaacaacucaguuuguuccaaaacaaugugaguucccagauuuagccuugucuuaauauauugaccuuaguucaugcuacaguguucauaugagguagaaaauugacauucaaguguagaugguguaccaaaauacugucaaaucucacagcauugggccgggcgcgguggcuuacgccugcaaucccagcacuuugggaggccaaggcagauggaucaccugaggucaggaguucaagaccagccuggcgaacaugguaaaaccccaucucuacuaaaaauacaaaaauuagccaggcaugguggcacuugccuguaaucccagcuacucaggaggcugaggaaguagaauugccugaaccugggagguggagguugcagugagccaagaucacgccacugcacuccagccugggugacagugagacucugucucaaaaaaaaaaaaaaaaccucacagcauugacuggggcuuaucuaggaauuuaguagaaaagcuguuucagggugaaguagauucauaacauggcucuggauuauuauuccuaagcugcuagauaguagcaacuauuuugugagcugaaauuuuauuauauuccuuauauaacaauuuccuuauacuucuccacuuacuguccacuaaaugacagcuuaccagauaagcagauaucacucaguuuauaguaaagauuauauuuaaacagcaaagauauguaugcauuuuuuuaggcaacuuaguauauagggaggcuagugucuuuggaauucacuguagcauuucaauguagaggaaugucuugauguuguggaaacucuguaagcugaaauucuaacuauauuauucaucgaugaaggaaacauuuaaucuuuucuuuaccauccucacagauagacuuguugaaacaaggggaccucuauguucauugagaagugaaaagagguacguacauucaguucauucuacacuuucuuuuaauauauauuuucuuacuuuauaagcuguauuuaugaguaagcaguucugaggaauugugaacucucuugaguucugguaguuggucagcauauaggguagauagguagcuagcuguugugucagaugcccacccuagccugguggguugaggggggugccccuuaucucccaggcgucagggguugggagaaacacaugcuucuuagaugggaguuugguuggaguggggaugucuagugucagugucuuuaggauaggaacaguaaaggcagcucugcaugcuuuaggauuuugggaugaugguuuauagcagaguuuguaaacuauggcccaugggccaaaucuggucuacuugccuauuuuuguauaguaaauuucuauuggaacaugcgaauucauuuacauacugucuggcugcuuuuaaauuacaguggcagaguugccacgaugugcccaagaccauaaaaccugcaaagccuaaaauacugucuguuccuuuucagaaaaguucguugacuccugguuuagaguauuauguaaacucaacacaauuuuuauguacaaauuacgaaaucuuauuucuaaaacuaggauguacuagguuugaaucaucuagcagaagucuaucaucucucaauuuuuuuccuuagguguucaaaggggaaaauuacugauacagagacgauggucggaaucagauuugaaaaugaaaguguaaguaaaaauccuaguuacauuugauaccuguuuacuuauguaacuuauguuuuggugcccaugaaaagcaagaaaaaguauauauauauaacuuugauuguuaauucuguuguuuuucuuuaaaaaagcagcaagccagccagucacaguggcucaugccuguaaucccagaacuuuaggaggccaaggcagaaggaucacuugagcccaggaguuugagaccagccugggcaacauagugagacugucuccacaaaaaaauuuaaaaguuagccaggcaugguggcaugucuguagucccagcuacuugggaagcuaaggugggaggauugcuugagcccaggaggucaaggcugcagugagcugugaucacaccauagcacuccagccuaggugacagaaugagacucugucucaaaaaaaaaaaaaaaaaaaaaggcaggaagcauugaaaauacacaacuuuuuucuuccuucugaguuguuggaguuuugccucuguacaguagccaccuuuguuuaugagagaccaaucugccuccauaccaacauguuaccuacauuuuauggcuucuuagggagaauuucuuaaaaaucauacaucucuggaaagagaugauauguucuggguugcuggcagaauucuauuuguuuacuacaauugugguuauauagguguucauucaaauuaagugguacauuaauguuuugugcauuuucuguaauaucaaaugacuuuuuucaaggauaaacuagaaccaaguugaguuacuauaaagauaguagggauuuauucugagugaugggauugugggucauauuuuuugcuguuuaaaacuuucauaauaucuuuuaaacauacuaauuuuaauugugauaggagaacugaaaauacuuuucuugcuacuuccagggaagguggugaguguucuguuugaugguucauaacugaggguccugugaggccuaggucuggagcuuuuuuugcucccccuugcagggacagacagauaggguaaaucuacucacuugggggauuugcuaauucucuuuucuuucacauuaguggcaguuuuauauuucauguguaaucuguguuuauauuugcaaguaucaaacaugucaguagaauuuagauaauuuuuugaucagaggaggggauaccaacuggagccugaccuaucagaagaagugucggcccgacuccgccugggcaguggaagcaauggcuuacucaggaggaaagugucaauaauugagacaaaggaaaagaauugcucaggcaaagagagggacagaagaacggacgaucuccuugaacuuacagagguauuguucuuuguauugauccuaaaaagaggcaugucuuuaaauaaccucaguuauucuaacuugaauguuuuguuuugaggacuuucuccaggcuaggggugaauauaugaaaacaugucagguccauggucuguugauucacuuugacuacauugaucuuuagugaggcaugaucauuaguggccuaagggaucagauugauauucagcaaauggggagucgacacagucaucucauaucuuggaauacaacagauucuuuguaaauucuaaccuucaaauauguugaguuauauaguauggguuuggcauuaagaauaaguucauugcauuuuuuuuuugaaaguuauuauaguuuacuaaaaugcccccuuuguugauuauugcauuugaaaauaguaaaaacuuacagaacauaaagaaugaagguaguuaaaauucuuauuuuaaagaugugcccacaucuuggcuuccuccacaauguugcccuaguaggcaaaucucuugaauacuuacuguuauauugggcauguagguggagagagagauccauaaaauggugaagcugugugcagugggaagcagcauauauuuagaagaaaauaauuucuuuuuuuugagacagaguuucgcucuuguugcccaggcuggagugcaauggcgcgaucuuggcucacugcaaccucugcauccuggguucaagugauucuccuggcucagccucccuaguagcugggauuacaggcaccugccaccaugcccagcuaauuuuuguauuuuuaguagagaccggguuucaccauguuggcuaggcuggucucgaacuccugaccuuagaugaucuacccaccucggccucccaaagugcugggauuauaggcgcaagccacugcccccggccuagaggaaaauaauuucuauuggguuuauagauuuaguuuuguaucuuaaauaaugcauuuaucugcauaauucuuuaguaugaugaagccauuuauuccauaaggagucaauugcuagacugcugggugguuuccaaguuucugccuguuugcuuauucucuucaugucaaaaaggauggugugaccccuuagauguccuaaucuuauuuugauguuuuauuuauuuauuuauuuuugagauagagucucgcucuguuggcaggcuggagugcaguggcacaaucucagcuuacugcaaccucugccucccagguucaagugauucuucugccucagccuccugcguagcugggacuacaggcgcgugccaccacgcccagcuaauuuuuguauuuuuaguagagaugggguuucaccaugcuggccaggcuggucucgaacuccugaccucaugauccgcccgucuuggcuucccaaagugcugggauuacaggcgugagccaccacacccagccuuuuuugauguuuuaaaaguuuaaaggcgagaaugggcgugguggcucacgccuguaaucccagcacuuugggaagccaagaugggcggaucaugaagucaggaguucgagaccagccuggccagcauggugaaaccccgucucuaccaaaaauacaaaaaaauagcuggcaugguggugugcaccuguaauuccagcuaaucaggagacugaggcaugaaaauugcuugaaccugggaggcagagguugcagugaacugagaucaugcagcugcaugcacuccagccugggugacaaagugagaaucugucucaaaaaaaaaaaaaaaagaagggccaggcugguggcucacaccuguaaucccagcacuuugggaggccgagaugggcagaucacgaggucaggagaucgagaccauccuggcuaacacagugaaaccccgucucuacuaaaaauacaaaaaauuagccgggcgugguggcgggcgccugucaucccagcuacucgggaggcugaggcaggagaauggcgugaccccgggaggcggagcuugcaguaagccgagauggcgccacugcacuccggccugggagacugagcgagacuccgucuccaaaaaaaaaaaaaaacguuuaaaguggaaaucaggaguuuacuauuaugaagggagcaaaguccaggaaauuagaugcaccuggguucaaaucuucuucuaccuuuuaauaauuauaugacuuugaauauguaaaauaaauucucuggguuucaauuuucuucucuauaaaaugauaauaaugucuuccucacuaauauggaucaaugaugugcuucaagcaucuaacaccauguuugacucauagugguuaauacguaguaguaggaaaauugagacuauacuuuagauguaaauauuauuauuaaauuauuguuuccacaagcuaauaagugaaccaggauuuguuguaaguauuacuuacaacaauuaaguaaggcugcuuuguaguuauaaguuaaaauauuuucagggcuggugcaguggcucaugccuauaaucucagcacuuugggaggccaaggcagguauugcuugagcccaggaguuugcaaccaacuugggcaauauaaugaggccccaucucuaucacuaaaaauaagaaaaaaauguuuuccuacuguaguuuaguaggucuuugauaguauauuuuucucaagagucagguguugccgagaugaaaaacuuuuuucagucucggaguuuucaauaacugauaaugaaugguucuauauuaaaauagcaacuucugaacuuucuaauucaggacauggaaaaggaaaucaguaaugcccuaggccauggcccacaggaugaaauccuaaguagugcuuucaaauugcgaauuacucgaggagauauucagacauuaaagaacuaucacuggcucaaugaugaaguaaguuguauucccucccccuuuuggcuaucauuaaguuuauuuauuuauuaucuauaaucaaagugacuccuacccaguuauaauggguugguaaugcaacucuuaguuauaauuaaaacaaaaacauuuuaaaucuuaaaaagaugguuaguucugauuuucugccuuugauuagcgauguuucccuuuucugcgucuguauuuuauugcauccaccacuucauuuacuggucuucaauaaacccuggguacagcugauaaacgggaggaagcagcaagugauacuguauuuuaggugaauucuuauaguagcuauuuuuuuguuuuuguuuuuugguuuuguuuuugagacagaguuuugcucuuguuguccaggcuggagugcaauggcgcaaucuuggcucagcgcaaccuccaccuccuggguucaagcaauucuccuaccucagccucccaaguagcugggauuacaggcaugcgccaccaugcccggcuaauuuuguauuuuuaguagagacaggguuucuccauguuggucagguuggucucaaacucuggaccucaggugauccgcccgccuuggccucccaaagugcugggauuacaggcgugagccaccgugccuggccuguuuuauuuuuugaguaauaaagggauauauugaucacuauauacuauguguauuuuucuuugagugauagcugaaaaauuuugccuaacuugucaucuuguauccuuaauacauuuagcaaaagcuaacucuuaaguucuuugacaauuuucugguggguucuuccccgaacugcuuagccccugcauguucucucuuugagggaaguccccuaugacuaguuacuuauaaacacauucuuugaaaacaggaauguuuuguuuuacauuauaaauguaauuuguuuaucguagaauauuuggaaaauacaggaaaaguaaaaaauauuacuguucaaaaguaccaccacucggccgggcgcgguggcucacgccuguaaucccagcacuuuggaaggcugaggcgggcggaucacgaggucaggagaccgagaccacccugacuaacacggugaaaccccgucucuacuaaaaauacaaaaaaauuagccaggcaugguggcggguaccuguagucccagcuacucgggaggcugaggcaggagaauggugugaacccgggaggcagagcuugcagugagccgagaucacgccaguggacuccagccugggcgacagggcaagacuccgucucaaaaaaaaaguaucaccacucagagauaaauaaaauauuauuuugguguauguccuucaaguuaauauuuuaaaauugaagucuaauuuauauguaguaaaauucacuuacuguuaauauuucugcguauuuuuggugugauacaguuauguagaucuuuccauuauugcacagacuuucuuccuggauuccuucuucuggcuguuaaguguuacucacaugccuuaaaaguacaguuucauuucauuuucaugugucccauuuugcacugaucacuuuuuucccugucuucuacuauagacagucuuuuuauccucuucuuuaguaccuuaccuucgaauucauccuuauucagguagaaauuuaguuuugauaauauguuugccauguuccagcuuuugcucccuugguauuuuguaggucauuaauuuuuacaugaaucuucugguggaaagaaauaaaaagcaaggcuauccagcacuucauguauucaguacuuucuucuauccuaaauuaaagucuggggguuaccaagcagugaaacgauggaccaaagggguaaaucucuuugaacaagaaauuauucuggugccuauucaucggaagguacauuggagccugguggugaguagagaggguuaaugguuaauuguuggacuuggauaaaggccauuuuuuaaaaauaaugcugccuuuuucugcccuguguauagaggccaauaguauauauuauaagcauacucugcagagucucuuuuuaguuuuuuuuuuaaugucccauccuucacccaacccuuuuaguucuuuuuauuuauuuauucuuuaaaaaauuuuauguuuauuuuauuuuacuauuuuuuaaaauuacagaccaggucucgcucuguugcccaggcuggagugaacuggugugaucauagcucauugcagccuggaaguccuggacucaggugauccuccugccucagccuccugagugacuaggacuacaggcaugguccaccaugcuugccuaauuuuauuuauuuauauauuuggaaagauggagucuugcuauguugcccugguugguauccaacgccuggccucaagugguucuccugccucaguuuuucaaaguguugguauuacaggugugagccaccaugccuggccuuuuuuucuuuuucuuuuucuuuuuuuuuuuuaaauuuuuauuuuuagagacagggucucauucugccacccaagcuggcaugcaguggcacaaccauagcucacuguaaccuccaccuccugggcacaagugauccuuucacuuuagccucccagguagcugggacuacagacaugcaccacuaugccuggcuaauuuuuuuuaauuuauuuuaauuuuuuuguagagacaagagucuuguuuuuuugcccaagcuagucuugagcuccuggcuuuaagcaguccucccaccucagccucucagaaugaugggugagaugccgcaccuggccuccuuuuuaguucuugaguugaacaacuuuuagaaggcuacaggacgaaguccuuguacuugaggagcuuuuuuuuguuuguuuguauguuuuugagauggagucuugcucuguuucccaggcuggagugcaauggcacgaucucggcucacugcagccuccgccuccuggguucaagcaauucuccugcaucagccuccugaguagcugggauuacaggcacgugccaccaccauaccuggcuaauuuuuguauuuucaguagaaaugggguuuuaccauguuggucaggcucgucuugaacuccugaccucgugauccgccaccucagccucccaaagugcugggauuauaggcgggagccaccgcaccuggccgaggagcuuucauuuuuaacaggaaagagucuuaguaugcauaaggguuauuuauauuuauuuaguuuuguuuacaagauaguacagguuuauugcagaaaaaugcauuuauaaggccaggugugguggcucaugccuauaaucccagacuuugggaggcugaggcaggagggguugcuugagcccaagaguuugagaccagccugggcaacauggaaagacccugucuauacaaauuuaaaaauuugcugggcgugguggugcacaccuguggucccagcuuugugggcaugguggugcacaccugugagaggcugagguggaagauucccugagcccaggaggucgaggcugcagugagccgugaucacaccacugcacuccagccugggucacagagugagaucuugucucaaaaaaaaaaaaaaaaaaaaagagagagagaaagaaagaaaagaaggaaagaaagauacagauauaaagaaagcaaaaaaaaaaaaaaaagucucaucacucugagaggaccacuaauuuuuuaacuuaaaaacacacuuuuuuuacuaaagauacguaagacacauuuuuaacuaaaaaaaaaaaaauacauguaccaauauaaguggauaucguuuuucuuuuuuuucuuuuuuuuuuuuuuuuuuuuuuugagacagagucucgcuaucacccaggcuagagugcagugacacaaucucggcucacugcaaccucugccucccggguucaagugauucuucugccucagccuccugagcagcuaggauuacaggcgcgugccaucaugcccgacuaauuuuuguauuuuuaguagagacgggguuucgccauguuggucaggcuggucucgaacuccugaccucaugauccgcccgccucagccucccaaagugcugggauuacaggugugagccaccaugcauggcccauaaauggauuucuaagauacauaaaaaauuuauauugguacauguauuuuuuaaaagaugcuuuuauuuuuggaaguaaaauucucacuccucuuacauuuaagauguuucuggauguuaucuuuuuccauuauaggugauugaccuaagaaaaaagugucuuaaauaucuggauucuaugggacaaaagggccacaggaucugugagauucuccuguaaguaaagguugaaaaccucacuacccccuguugaggugaucucucuuuuaucucauccuaggaagcuguguggaugguagucuaauguguaguuaaggcuauuucaggacuuagcaugcauuuuauuuuuaaaauaauagcugauuucaacugagaaaacguguuuaguagcaucacuggaaacaaguuugucauguauuaugauguaaaauagaucuuauuagaauccugugacuugcauuagauuucuuuggcaucgauacguuauucugaauguucuuaggaacuguuaguuggggagugcuaguccucucaauucuuaagcccauuuguaucuuuaugcuuuccaugagaguuggguuuaucucagaacccaggggcaguguuuaaagugugugguuugaggagacuguuucaaauaguaauugcuauaauagaaaccaaucuuuaaagcauaccuacuucuuagcuagguaaaguagugacaugaguugagugagaaaacgcaucaguaagauggguccauuuuuccuuuucugcucacuagaagcaaugaaguuccuucuuuuaacuuuacuaaggacaaaugaaucuugugaagaaaaguuguugcuaacaauaauauuguuuuaguauaaaauauuauuuuuauuuaugguuguuuaucuugaauaaaaagcauagagaagaaaauucuaaaaaucauaagauacaccaauuguuuauaaaaugguucucuucuagucuuuucuuuguaagauguguauaaauugugcgcacauacauuugcauucauauguauacauauauuaucccauguauagaaauguucuuacugggaucauacaguauaguuugaugugcugcuuauaccaggauuugaaaauucauacuuuauuacauucaugcuuuuuuuuuuuuuuuuuuuuuuuugagauggagucucauugugucaccccaugcaguggugcagucucagcucacugcaaccucugccuccuggguucaagugaugcucguuccucggccucccaagaagcugggaguacaggcuuccgucacuaugcccggcuaauuuuugaauuuuuaguagagacaggguuucuccauguugaucaugcuggucuugaacucccaaccucaggugauccgcccgccccagccucccaaagugcugggauuacaggcgugagccaccgugcccgguggucuuuggcuuuuuauguuauuuauuuauuuguuuguuuuuugagauggaguuucacucuugcugcccaggcuggagugcaauggcgugaucucggcucaccgcaaccucugucucccggguucaagagauucuccugccucagcucccaaguagcugguauuaaaggcuugugccaccacgcccggcuaauuuuguauuuuuaguagagaugagguuucuccauuuuggucaggcuggucgcaaacucccgaccucaggugauccauccgccuuggccucccaaaguguugauauacaggcgugagccaccgcacccggccuauguuauuuuuuguaucuuaauuuuggugggggcaucuaaugcuuaucaaccugauauauauuucaacuuuuaaaaacaagcauguacaauuuuuauaagcagaccuccccaaauuaaauaaaaaauccagaaagccacuuugggaggcugaggcaggcgggaucacaggcucaggagaucgagaccauccuggcuaacacggugaaaccccaucucuacuaagaaaaauacaaaaaauuagcagggcgugguggcgugcuccuguggucccagcuacuugggaggcuaagucaggagaauggcgugaacccgggaggcagagguugcagugagccgagaucgcgccacugcacuccagccugggcgacagagcgagacucugucucaaaaaaaaaaaaaaaaaaaaaaaauccagaaagcagucacguuuuuaaaaagcuaaugaauauggauuugagaauggcauaucuguuuaacaucagaaagcccuauguaaccauaaugguuaauuucuuuagggauuuauugauguauuccuucuuuguuuugcuuuuuagucaguauuuacaggaugaaaguaagaccaaaagaaauagugaucugaaucuuuuagaguggacccaucacagcaugaaaccacacgugagugacgaucaucuacaugugacauacuugguugcauuuacuaauaguauauuaucuagauuuggcucccuuccugcccuuccucccucccugcaugcuuuuaaaguacacaucuuuuuuuuucuuucuuucuuuuuuguagagaugggaucuugcuuuguugcccaggcuagucucgggccucccaaaacaaagugcugggauuacaggugugagccaccaugccuggccagagucuacaucuuaagaaugaucugcuucuaaaucucuagcaauuaaucuaacuaaaaugggugcuuagcuuucaucuucuugucuaaauguaaauauuaacauaugcuugcaugucucucacagaauugggaagaaacccaauacauugaaguuggcuaauuucccgguuggugcuaaugaaaguuuacauuucuuuuccaaaauuugggaguuuguuuaagucuuaggaucccaugccaaaaaaagcauuuuaauuucuaaacugaaaaguuugggccaggcgcgguggcucacacuuguaaucccagcacuuugggaggccgaggugggcagaucaccugaggucaggaauuugagaccagccuggccaacaugacaaaaccuugucaccacuaaaaauuaacugggucugguggcacgugcuuauaauccuagcuauucaggaggcugaagcaggagaaucacuugaacccgguaggcagagguugcagugagccgagaucgcaccacugcacuccagccugggcaacagagcgagacugucucaaaaaaaaaaaaaagaaaaagaaaaauuugaaggauaagcuuugaaauuuccuaaggagagcacagauacaaggaagagucuguuaggaugaauacuguguucugguaugggaaauggaauaaagaaaacaaacugccuuucuuuguauauuguagucucuaguuuuguccauucugugagagaugcuaggcuugagagaaaagugugagguauaugcguauguaugggugguauguauuuaagcaaauuuuuuuuuuuuuuuugagacggagucucgcucugucgccuaggcuggagugcaguggcgcaaucuuggcucacugcaagcuccgccucccggguucauaccauucuccugccucagccucccgaguagcugggaccacaggcgccugccaccacgccuggcuaauuuuuuguauuuuuaguagagacggaguuucaccauguuagccaggauggucuugaucuccugaccucgugauccgcccgccucugccucccaaagugcugggauuacaggcgugagccaccguacccggccacuaggcaaacuuuaaaaaucauaaucaacuucauuucuuugaguaaaaauugagcuauugucaucuaguguguuuuccagcaauaacuugcgcuaauugugacugacagccagagugugucagggacugccaagauuagggcaacacaggccuggagaaggugugagcucagugggguuagaauccaccaccuuuggcuuauuaugcucuuagugcugcuuguaccaaguguuuuugccuuacggcagaacugauccaucaaggcaagauccuaauugguuaaagccuauccagaacuucucucuguccaccuugaagcuguaggguccaaagcaguagucuuauuuucuuagcuagagaaguuacauuuccgauugaccacacuuggcccuuuuuaaaauugauaaaugcuucugaaauaauucugacuagcaucccugguaguaaaccuccuuucaguuugguuucuuggaaugggagcugagagaugcaacucucacuuuguguuuuucucuucugaaaagcauuuccuguggggucgggucaugcacuccaucucauaguuaggguuuccaaucaaaugcagagccauggagaauuaaacagaagaacagaacagaaaggaaaagcaguauucacaaguuacaucuuagaccuguggcuucaguucucacaaggccuguuuuucccuugcuaugaucuauguuuuauaccacauagaguaagaauaauuguguuuuuuguauaugacuguguguuuagguaauaccugauuuaauauuuaccuuuauaauauuguuuacagcaauauuuagaaaaaguccaaggaauuuguauuuaaugauguuuuacccuuuccucucuucuuuuuucuuuguaauuuuaggagauuccucaacagcugaaugggagugauuguggaauguuuacuuguaaauaugcagauuauauuucuagggacaaaccuaucacauuuacucaggugagugaagacccucuucauccauuuacuuguuacuaagcaagauaaggcacuuggccagugccuggcacacauucagcucucaauaguaguagcuggccaggcgugguggcucacaccuguaaucccagcacuuugggaggccgaggcggguggaccaccugaggucaggaguucaagaccagccuggccaacauggugaaaccccaucucuacuaaaaauacaaaaauuagccaggcgugguggugcaugccuauaaucccagcuacucaggagacugaggcaggagaaucacuugaacccaggagguggagguugcagugagccgaggucgcaccagugcacuccagccugggugacagagcgagacucugucucaaaaauaaauaaauaaaauaaauaguaguagcugggcucaugccuguaaucccagcacuuugggaggccgaggcagguggaucaccugaggucaggaguucgagaccagccugaccaacauggagaaaccaugucucuacuaaaaauacaaaaaauuagccacgugguggugcaugccuguaaucccagcuacuagggaggcaggcugaggcaggagaauugcuugaacccgggagguggagguuguggugagccgagaucgugccauugcacuucagccgccuggggcaacaggagagaaacccugucucaaaaaaaaaaaaaaaaaaaaaaaauaguaguagcugugcuauucuuauugcuguaaaucuugguuuuagcccuacuccugccagaaucaggguuauuuuaucugcucucagguuuauccuagucuuuggugacacaaugggcacaauuugcaaaucucugaacuguggcauucauugguuccuguguauuauuauuucuagccaaagaaagagguaugucaguguuuaauagcaagggaaaaaucggccugugagaacugaagccacaggucuaagauguaacuugugaauacugcuuuuccuuucuguucugcucuuuuguguuuguuuuguuuuguuuuguuuuugagauggagucucgcuuuguugcccaggcuggagugcaguggcacgaucucagcucacuacaaccucugccuucuggguucaagcaauacuccugccucagccuccccaguagcugggacuacaggcaugcgccaccaugcccagcuaauuuuuguauuuuuagcagagaugggguuucaccguguuggccaggcuggucucgaacuccugaccucgugauccaccugccucagccucccaaagugcugggauuacaggcgugagccaccgcgccuggccuguucugcucuuuuguuuaauucuccauggcuuugcauuugauuggaaacucaaguauguugggaauucuugagaauuuguaacaguggauucucaaccuuuuuacaacugaggacaaccucauuaaagaauauuuuucauccacagaccuuauuuugauagauguugucuaccaagcaaacuguauguauuccaugaauacaaacuguaauacaaacucuauuacgugaaguaacuaggacucccgugcugaauuaauauaauuccaguaaaaaauaaaggcauuuauugcuuagucucagcaguuuuacuaagagcaaaugugcaguuuuuacuagauguuuugaacuauuuaaaauaauuuaagaaucauguguuaagacuuuuuagcccccaccccuagggaggacaucacuaguuuauuauuauuauuauuauuauuuugagauggagucuugcucuguugcccaggcuggagugcaguguggugugaucuuggcucacugcaaccucccucucagguucaagcgauucuucugccucagccuccccaguagcugggacuacaggcauguaccaccaugccuggcuaauuuuuguauuuuuaguagagacaggguuucaccauauuggccaggcuggucuugaacuccugaccucaggugauccaccugccuuggccuuccaaagugcugggauuacaggcaugugccaccacgcccggugacaucacuaguuuauaguaagggacauccaacuauuuauaaugauacaucaggagugccucaauaaugugaacuucuuuuuuuguuugagacggaguuucguucuuguugcccaggcuggagugcaauggcgcaaucucagcucacugcaaccuccgccucccggguucaagcaagucuuccgcuucagccucccaaguaaccgugauuacaggaaugcgccaccaccccuggcuaauuuuguauuuuuaguagagacgggguuucuccauguuggucaggcugguuucgaacuccuggccucaggugauaugcccaccuuggccucccaaagugcugggauuacaggcgugagccaccgcgccuggccaagaaugugaacuuccguauacacuagaaggacuaguuguacuacggguaauuuuggaguugcuuuuuguguugcugcuuugcaaauugcccauguagugauucucaguuaaagcagaaucauuuauuaagcaaaacaucucauuguuucauguugccaaauagcaaagcaguuggcuguucucugaaccuaauaagaugagauuuuaaagggagaaguugcuguuugaacagaauuggcaauguacaacgccugguagagcagaaagaaacuuguagauuuuguuguuuuuuauuuaaauaaauacguuuuucucauaaaaaaacagaauauguucauuuuagaauguuuugaaaauucauauaaguagaaaaguugccuauugugccaccacguggauauuugcaggacugugaaguuguacuauacuguauaauucuacauccugcuuugguuuuccuuaacauauaaaaaugcuuaugguaggccgccugugguggcuuuugccuauaaauaaucucagcacuuugggaugcugaggcgggcggaucaccugcaguuaggaggucaagaccagccuggccaacauggugaaacccugucucuacuaaaaauauaaaaaauaagccgggugugcuggcacauaccuguagucccagcuacgcuggagacugagggacaagaaucgcucgaacccaggaggcagagguugcagugagcagaucgcgccacugcacuccagccugggugacacagcaagacuccaucucaaaaaaaaaaaaaaagugcuuaugguacauaucauguaauuaugaacuguuaaaaaugguuuuauaaguauguuccaugauguaaaaaugucaacacuuagaaaaagcacauggacauccugcuuuauuacaugauuacaccugaagguugugcugccaugcacauuaauauguaaugcgggcguuguuuaugggguucuuugcagcaccagaugccucucuuccggaagaagauggugugggaaauccuucaucagcaguugcugugagaaaacuuugccuggucccucuagcugcuggugguucuuucacagacauuuccauauaccucaugcauuguggguuaaaaagucccugcaucacuucuguucucacagguacugagcugucaaaagugcaugaaggccucucacuguacucuaguccugacuuggggugcagagggcugcuugcaauccuguuuguaaggcugugccugcucagagcuuuggacuguucaacccacacaagaacaaacgcuaacuaauauuuuuuuuaagagauucuuuucccuaugaaugugggaaaugcaggauuuauucugugaauuguuuguuucuguguguuuguucagcguauucauucacucacucguuugcaaacauaaugggcaguggucauuuacugcugcucuuuuacaguuagcucuaaauuacuuguuugaacuauuuauuucugaaaggaauguuacucaagcugccacucccugcugaagagcaggagggaacucucacugggggcggaaggaaguggagcuggagcaguaacugccaacaugaagcuggaggguuugggauuuuuuuuguuuuuguuuuuuugaggcucaaaaaaugcugggagaaaugaaaaugcugugggauagggcuccuguugccuuucagaggaagucugacacuacagcguuggcacagugccgugaacaguggaacugugcccaagggacucugauuauccaagcaucuuccgaagaguguuguggucaccuuaaagagacuuccccuucuggaaauguggugacuuggcuuagucuucaaacuggauucauggauuugaaguaacuguaaacccuaaaucuucauuuucaucccagaucugguugaguauaaaccucagaauuguaggggcuggccugagcuguuuauuucaaaagauacuauucaauuuaaagcuauuuuuccucagaguuuuuguuuucuauauauuaagucuaaauuaaguuuucuacucauuaagacuaacaucuccccacuccauccccacugaaauuuguggaagaaaauuuaguacuuggcucugagguugccaguuauacaauaaucuauuuugcauaugaaaguuuguauuuaacuuuuuuguucauuaaaaaccuuacugauaugguuauaacuucagacaguuuagaguuggucagaacauauuuugca

SEQ ID NO: 18088 - RNA, 3196 nt, Homo sapiens
augccuaauguucugaaacaccgucacuggagcaaauccaggcuugagucuaucugugaaacgggaacagaaaacuaagugcauccucccuuccugauucucccagucuucaaggcuguaugugccaggagcuggggauaaaggagauagccuuagcucuccagaagcucacagaauggacagacagagccaacaguuuuauuuguuuguuuguuuuuugagacagucucccacuguugcccaggcuggaaugcaguggcaccaucucagcucacugcaaccucugccucccaggcuuaagcaauucuucugccucagccucccaccuagcugggauuacaagcauccacuacgaagggcaggguuucaccacauuggccaggcuggucucaaacuccuggccuaaagugauccacccgccucagccuccuacagugcugggauuauaggcgugagccaccgcacccggucuacaguuuucuuuaaaucuucaucaugccaguacuucccuccuccuguuuucaucuuccuguauuugcaaguuucauucauucucuucauucuauucauuccuucucuguacuuuaccuaaacauaguugugaacccccaaaaucugagccagaucaauuuaggaaguuuauuuucccaaaguuaagaaugcacgcaagugaaauggccucaggaaguccugacaugugccuaaggugguugggacacagcucgguuuuauacauuuuagggagacaugagacaucaaucaacauauguaagaugaacauuggcucagucuggaaaggugggacaacucgaagcaaggagggagcccccagguuauagguagaugagagacaaauggucgcauucuuucgaguuucugaugagccucuccaaagggggaaucagauaugcauuuaucucagugagcagggggugauuuugaguagaaugggggcagguuggcccuaagccguucccagcuugacuuuccccuuuagccuagugauuugggggccccaagguuuauuuuccuuucgcguagcuucgccacuaauguguccuggugucuucucuccucagccuguuucucauccuggaaacugaggugugcuggcgcagggcgauagcgcaguggggugggguugggaggaaacccuuaucuguggccgauggcccuccguuguucuauuauuaaaacucugggaaacugcuauucuuaauuuauuuuuaaagacccugagaagcaaaucuuuaauuuuuuuguuuuugugagacggagcacucugucgcccaggcuagagugcaauggugcaaucucggcucacuggaaccuccgccuccuggguucaagcgauucuccugccucagccucccgaguagcugggauuacaggcgugcgccaccgcgcccugcuaacuuuuguauuuuuaguagagacugguuuucaccauguuggccaggcuggucucgaacuccugaccccaagugauccaccugccucagccucccaaagugcuggaauuacaggcgugagccaccgcccccggccuuuaaauaaauucaucugaucaaaagaaauuuaaaaaccaaccaacccuaaugagcucuaaagacagcaacacgcacaggaccuggaaagagccucuuccucaccggaguuuuccucacuucaaggagcggcgccuucacccuccggccucagcccgcgaggcugcaacccuuuccgcaccuggcuccaucucccuggcccucgcccccgcccagcggucggggagcgagaaggcggcgggggaucuggcgcccggcuuaggggcgagacggccgcaccgggagccuagcgaucagggcaccuugggcgggaggagcgccagccgggcacccagcgcggaggaggcggcucggcggccccccgacagccacgccgccgugagccccgcccagcguagccccagcgcgcgcuucgcguguagaagcguccggguggcggaggccgcaggccgcaggagugcugguggaggggcuuccagaaagacccugcggcagcgcccccccucggcucuccccgcaggagagcgggcaccugcgcggcgccgggugaaggcgagagccucggcgagcccucugcagcggagcccccugcccauuugguuuuggguaagaggagggguccgcgucucugcagcucgggcgggauucccuggcgcccucuacucgguuugguucggccucacguguuccuuuagcuccgaagccgggauacggguggggaaggggggcucgcgcccuacaggccgagcccugcggccgcagcgggguaaggguaggauggccgaucgcgcccagaccccagggagucucccucucggcuuuucugccggcgucuccagcagcaugaucuggcauuuauuauucggaauaaugugccaggcaggaggaggcccuggguuaaacacgcggcccugcagcucccaggugaaacgacucaucguuuccugccggcgcaucuuacugaaggggacccaggccccacgaagggaaggaaccguccucaaggucacgucguagucaaaggccgagcccagaccgaagccagguguccugccuucuagccccgggcucuaggcccuguccccuucccgaccgaaucucccagucccguccgcgucccuccuccuccuccuccuccgggguccuccgcaaggcucuguucccgggguuuggggaguccucccuccgcgccacagcgcccuggggaagaaugcuggacagcaggcaggccacagggccggggaaggaggaggagccgcggggacaggcuggggaugccagagugguggugggcccgggacuggccagggugggaguccaggcggcgcacccgcgcgaggacaagggggcuuuggcugggcggugcugucucaaccaaugggaagcguggcucuggccgagccccccucucuccccgcccuccggccggccguuggggagcgcugcucugggauuggcugcgccgccgucucgggcguucucgcgcucugcuuacgugcugacgcgcgccugauagauacccuguggguuugagcgcuccggucggucccuagcggcccaggcgccuugggcgugcguccugcgcgcggccgccuccaggcugcgcccuucuggggaaguguuuggugcugcgcgcggcgucgaacucc

SEQ ID NO: 18089 - RNA, 6910 nt, Homo sapiens
gcggaaaacgcgcgccgagacccgcuccugcaguauuaguucuugcagcuggugguggcggcugaggcggcauggaucucagcgagcuggagagagacaauacaggccgcugucgccugaguucgccugugcccgcggugugccgcaaggagccuugcguccugggcgucgaugaggcgggcaggggccccgugcugggugcgccccuagggccagggaggggaggggcgugguacggaggaugcgggaaacgggagucgggauugcacugcaccaagggaggggauguggucguggugauggcaccuaaagaagcagugaugauagaacagggaugaauggcaacuuucacgggcucagugauuggaccccggcugccagaaaacugacaccccuucuccccaggccccauggucuacgccaucuguuauuguccccugccucgccuggcagaucuggaggcgcugaaaguggcaggugagcccgaggugugcgucuggggaagggauuccuggguaugugcaggggcaggugagaacugaaaggggagggcaggaacugggagaaccagcuguuccccuucucuuccaaaccuccucccagacucaaagacccuauuggagagcgagcgggaaaggcuguuugcgaaaauggaggacacggacuuugucggcugggcgcuggaugugcugucuccaaaccucaucucuaccagcaugcuugggcggugagggguccccgggaggggcagccagcaugggcugaccaagcuuuguuccuagaaugagauuaacugggcucuguuccccaccacagggucaaauacaaccugaacucccugucacaugauacagccacugggcuuauacaguaugcauuggaccagggcgugaacgucacccaggugaguuaacuguaaguuguccccauuuggucaucucaggauaaaauggggacaaaacaggaguucgagacugcagugagccaugaucaugccacagcacuccauccugggugacaaaggaagccccccaacucaaaaauggaggcagggcgcaguggcucacgccuauaaucgcagcacuuugggaagccgcggcggguagaucaccggaggucaagaguucgagaccagccugaccaacauggugaaaccccgucucuacuaaaaauacaaaaauuagcuggacgugguggcaggcgccuguaauccuagcuacucaggaggcugagacaggagaaucgcuugaacccaggaggcagaaguugcagugagccaagauugugccauugcacuccaacccgggcaacagagcaagacccugucucaaaaaaauaaaaaauaaaaaauaaacuaaaaaugggagaccaggcgcaguggcucacggcuguaaucccagcguuucaggaggcugaggcaggcagaucaccugaggucaggaguugaagaccauccuggccaacauggugaaaccucaucucuacugaaaauacaaaaaauuagcccagcaugguggcgggugccuguaaucccaccuauuggugaggccgaggcagaagaauugcucgaacccgggaggcggagguugcagugaggugagaucgcgccauugcacuccagccugggggacagagcgaaaaauaaaaauaaaaauaaaauaaaaaauaaaugugggcaaaaaugugcagugugcagauucagcaucagauacgucuggagugccucgggcauauucauugcuacuguugauuucgugcuccuguuucugcccuaaaugugugccacacugacgaccacaguguagccccuagucccgucuccaucuaaucucucccucauccuaaaggcucagucuccagaacaaauccuacauugucuaccugucaccucuguccuagcccaggacaccccccacucccuggacaccugcugagugucgucucucgucccucacccuccuauccccuccaaucuguuccccaagcagcaacagaagguagucuuuuugaaaugcacaucucgacauuuaguuuuccgaucacaguggaaauuaaaucaggaaaauucacagucgaguggggcagaauuacauuaaauuaccagagaaaaacauaaaucagcauugccucgaaugcucucaaugaaagaauggaccguucugagagaauaacaaggcaaaauaaccuugacguaggaauuguaugcuggguaugguggcucacgccuguaaucccagcacuuugggaagcugaggugagcaaauugguugaggcuaggaguuccagaccagccugggcaacauagcgagacuccaucuccacaaaaagaagaagaaagaaaggaauuauagcaagguagacccugcugaggagggaccugaggaccaggcccaaaugcagagcuggcgauacaguaacugguguagacagacaagggcccuacccguaggcguucagggccuagccugggcagaaagauggucagcuggagguugggcgcaguagcucacgccuguaaucccagcacuuugggaggccgaggcgggcggaucaucaggucaggaguucgagaccagccugaccaacauggugaaaccccaucucuacuaaaaauaaaaaauaaaaaaauaaaacaugaaagauggucagcugguaaacaaaaaauaaagguuguuucugaaaacaguagugcuguggagauaccacuuucucccagcagcucuuggacccucucuucggugcugcagccaaaggcccccaugcaugggcccagcaucaugaaccuggucccagcucagggccuuuguacuggcuguucucacaccuagagcccucuuccccagaucucugcacaguucacuuccucaccuccuucaagccuuuauucaccacuacaccuagcuaacuuuuuauuuuuuguagaaacagggucuccauauguugcccagguuggucucaaccaccugcccucaagcgauccucccacuucggcuuccuaaaguguugggauuacaggcuugugcuaacgcacucuaccaauuuuuuucuaguguuuucugccaccucaguuccuagaacaguauguggcaugcaguaggugcuaaauaaguuagaguaaaagcagcgugauagagaaagccucuucaggaggugaguuuuuucuuuauuuuauuguauuuauuuuauguuuuuauaaagauggggucucacuguguugccaagccuggccucaaacucccaggaucaagcgauccucccgccucagccucccaaagugcugggaucacaggccugaacaacuuugccuggucuaggaggagauguucgaguugaaaucccugauugauccauccuggggacgugcuggagaagaggauucuggguagcaggaagaacgugccagggcugugaggcuagagcauugguacaguuguuuguucaauuaauaugugucuguugcuguggcagguauucguggacaccguagggaugccagagacauaccaggcgcggcugcagcaaaguuuucccgggauugaggugacggucaaggccaaagcagaugcccucuacccggugguuagugcugccagcaucugugccaaggucaguacccuacuagccauggcuggcuuccaccaucccacuauauaggggccaggcauggccaccaaagggaaggagggagauuccaggugccuguuuugcccacagguggcccgggaccaggccgugaagaaauggcaguucguggagaaacugcaggacuuggauacugauuauggcucaggcuaccccaauggugagcagacacgugaccaugguacuaauguugaaauggccagggcugagcacacuucugagguuuucuuuuuuuccuuucugucauuuaucauuuuauuuugcuuauuuuuuguuuuuauuuguuauuuuuguuuauuuuuugagacggaguuucgcucuuuuugcccaggcuggaguguaauggugcgaucucggcucaccgcaaccuccaccuccuggcuucaagcgauucuccugccucagccucgcgaguagcugggauuacaggcaugugccaccacacccagcuaauuuuguguuuuuaguagagacuaguuuucuccauguuggucaggcuggucuugaacuccugaccucaggugaucugccuggcucagccucccaaagugcugggauuacaggcaugagccaccgugcccagccuauuuuuuguuuuuauagagauggggucuugucauguugcccaggcuggucucaaauuccuggagucaagcaguccucccaccuuggucuuucaaagugcugggauuacagccaugagccaccaccccuggcccuuuuuuucuucuuuuuuuaaagagauggggucucccuauguugcccagccuggucuugaauuccugggcuuaagugauccuccugccuuggacucccaaauagcuaggauuacaggugugaacuacugugccuggcuggagguuuucuaaauugcucuggucacccuacuccacagugaaagaggccaaguguuagacaguggugccauuuguuuauggccacacagccagugagugauagagcugaauuccaggccauaggauugcugcugucuuccccgcuucccacuuugcugucuuucuggagccccagugauggacugagacccaaggugggcauuugucccuuuguuaaggggaaggggaccaggcgugguggcucaugccuguaaucccagcacuuugggaagcugagguaggagaaccgcuugaguccucgaguucaagaccagccugggcaacauagcgagacccccaucucuauaaaaaauuuaaaaaauuagccgguuauaguggugcccaccuguagucccagcuacucuggaggaggaggcuaagguggguggguugcuugagcccaggaguuggaggcugcagugagcuaugauuaugccacugcacuccagccuuggugacaagaugagaucuugugucaaaaaaaaaaauaauguuagccaggcgugguggcucacaccuguaaucccaggacuuugggaggcugaggcagguggauccuuugaggucaggaguucuagaccagccugaccaacguggugaaaccccaucucuacuaaaaauacaaaauuagcuggacgugguggcacacgcccguaaucccagcaacucgggaggcugaggcaggagaauuacuuaaaccugggagguggagguugcagugagccgagaucgcauaauugcacuccagccugggaaaugagcaaaauuccaucucaaaauaauaauaauaauaauaauaauaauauuuaaugacaggcugggccagguggcucaugcccguaauccuagcauuuuaagagacagaggcagguagaucaugugaacucaggaauucacaaccagccugggcaauaugacaagaccccaucucuacaaaaaauacaaaaauuaggugugguggugcgcaccuguagucccagcuacuugggaggcugaggugagaggauggcuugagccugggaggcagagguugcauugagcugugauaaugucacugcacuccagccuggguaauagagcgagacccuaucucaaaaaaauaaaaaggcugggugugguguuuacaccuguaaucccagcacuuugggaggcugagguggguggaucaccugaggucaggaguuugagaccagccugccuguccaauauggugaaaccccgucucuacuaaaaauacaaaaauuagccagguauggugguggguggcuguagucccagcuacuugggaggcugaggcaggagaaucgcuugaaccugggaggcggagguugcagugagccgagaucgcaccauugcacuacagccugggugacagagcaagacuccauuucaaaaaauaaguaaauaaaauaaaaauguuuaaugacuuguucuuggaggucaaggagaugucucagaggcagucucccugcacugcccuuuuagcagcucuuggccagguaaagguccuguggcaagaaggugcuucagaccauaggaggugccccagguacucaggaggaagccuuagaagagcggcaaggaggccgggcgugguggcucaugccuguaaucccagcacuuugggaggccgagggggguagaucacgaggucaagcaauugagaccauccuggccaacauggugaaaccucgucacuacuaaaaacacaaaauuuagcugggcaugguggcaugcgccuguagucccagcuacuugggaggcugaggcaggagaaucgcuugaauccgggagguggagguugcagugagcugagaucgcgccacugcacuccagccuggcuacagagugggacuccaucucaaagaaaaaaaaaagaguggcagggagcuugaauguuauggugcaacuuggacugucaccauugcccacccuaccccagaucccaagacaaaagcgugguugaaggagcacguggagccuguguucggcuucccccaguuuguccgguucagcuggcgcacggcccagaccauccuggagaaagaggcggaagauguuauauggugggugucauggauguccugggggugcuauagggaaggaaggagggaggccagcguucagcccugccugagaggguugcucccuguguaaguggucacugucaucaccucucucccacagggaggacucagcauccgagaaucaggagggacucaggaagaucacauccuacuuccucaaugaagggucccaagcccguccccguucuucccaccgauauuuccuggaacgcggccuggagucagcaaccagccucuagcagcugccucuacgcgcucuaccugcuuccccaacccagacauuaa

SEQ ID NO: 18090 - RNA, 6910 nt, Homo sapiens
uuaaugucuggguuggggaagcagguagagcgcguagaggcagcugcuagaggcugguugcugacuccaggccgcguuccaggaaauaucggugggaagaacggggacgggcuugggacccuucauugaggaaguaggaugugaucuuccugagucccuccugauucucggaugcugaguccucccugugggagagaggugaugacagugaccacuuacacagggagcaacccucucaggcagggcugaacgcuggccucccuccuuccuucccuauagcacccccaggacauccaugacacccaccauauaacaucuuccgccucuuucuccaggauggucugggccgugcgccagcugaaccggacaaacugggggaagccgaacacaggcuccacgugcuccuucaaccacgcuuuugucuugggaucugggguagggugggcaauggugacaguccaaguugcaccauaacauucaagcucccugccacucuuuuuuuuuucuuugagauggagucccacucuguagccaggcuggagugcaguggcgcgaucucagcucacugcaaccuccaccucccggauucaagcgauucuccugccucagccucccaaguagcugggacuacaggcgcaugccaccaugcccagcuaaauuuuguguuuuuaguagugacgagguuucaccauguuggccaggauggucucaauugcuugaccucgugaucuaccccccucggccucccaaagugcugggauuacaggcaugagccaccacgcccggccuccuugccgcucuucuaaggcuuccuccugaguaccuggggcaccuccuauggucugaagcaccuucuugccacaggaccuuuaccuggccaagagcugcuaaaagggcagugcagggagacugccucugagacaucuccuugaccuccaagaacaagucauuaaacauuuuuauuuuauuuacuuauuuuuugaaauggagucuugcucugucacccaggcuguagugcaauggugcgaucucggcucacugcaaccuccgccucccagguucaagcgauucuccugccucagccucccaaguagcugggacuacagccacccaccaccauaccuggcuaauuuuuguauuuuuaguagagacgggguuucaccauauuggacaggcaggcuggucucaaacuccugaccucaggugauccacccaccucagccucccaaagugcugggauuacagguguaaacaccacacccagccuuuuuauuuuuuugagauagggucucgcucuauuacccaggcuggagugcagugacauuaucacagcucaaugcaaccucugccucccaggcucaagccauccucucaccucagccucccaaguagcugggacuacaggugcgcaccaccacaccuaauuuuuguauuuuuuguagagauggggucuugucauauugcccaggcugguugugaauuccugaguucacaugaucuaccugccucugucucuuaaaaugcuaggauuacgggcaugagccaccuggcccagccugucauuaaauauuauuauuauuauuauuauuauuauuuugagauggaauuuugcucauuucccaggcuggagugcaauuaugcgaucucggcucacugcaaccuccaccucccagguuuaaguaauucuccugccucagccucccgaguugcugggauuacgggcgugugccaccacguccagcuaauuuuguauuuuuaguagagaugggguuucaccacguuggucaggcuggucuagaacuccugaccucaaaggauccaccugccucagccucccaaaguccugggauuacaggugugagccaccacgccuggcuaacauuauuuuuuuuuuugacacaagaucucaucuugucaccaaggcuggagugcaguggcauaaucauagcucacugcagccuccaacuccugggcucaagcaacccacccaccuuagccuccuccuccagaguagcugggacuacaggugggcaccacuauaaccggcuaauuuuuuaaauuuuuuauagagaugggggucucgcuauguugcccaggcuggucuugaacucgaggacucaagcgguucuccuaccucagcuucccaaagugcugggauuacaggcaugagccaccacgccugguccccuuccccuuaacaaagggacaaaugcccaccuugggucucaguccaucacuggggcuccagaaagacagcaaagugggaagcggggaagacagcagcaauccuauggccuggaauucagcucuaucacucacuggcuguguggccauaaacaaauggcaccacugucuaacacuuggccucuuucacuguggaguagggugaccagagcaauuuagaaaaccuccagccaggcacaguaguucacaccuguaauccuagcuauuugggaguccaaggcaggaggaucacuuaagcccaggaauucaagaccaggcugggcaacauagggagaccccaucucuuuaaaaaaagaagaaaaaaagggccaggggugguggcucauggcuguaaucccagcacuuugaaagaccaaggugggaggacugcuugacuccaggaauuugagaccagccugggcaacaugacaagaccccaucucuauaaaaacaaaaaauaggcugggcacgguggcucaugccuguaaucccagcacuuugggaggcugagccaggcagaucaccugaggucaggaguucaagaccagccugaccaacauggagaaaacuagucucuacuaaaaacacaaaauuagcugggugugguggcacaugccuguaaucccagcuacucgcgaggcugaggcaggagaaucgcuugaagccaggagguggagguugcggugagccgagaucgcaccauuacacuccagccugggcaaaaagagcgaaacuccgucucaaaaaauaaacaaaaauaacaaauaaaaacaaaaaauaagcaaaauaaaaugauaaaugacagaaaggaaaaaaagaaaaccucagaagugugcucagcccuggccauuucaacauuaguaccauggucacgugucugcucaccauugggguagccugagccauaaucaguauccaaguccugcaguuucuccacgaacugccauuucuucacggccuggucccgggccaccugugggcaaaacaggcaccuggaaucucccuccuucccuuugguggccaugccuggccccuauauagugggaugguggaagccagccauggcuaguaggguacugaccuuggcacagaugcuggcagcacuaaccaccggguagagggcaucugcuuuggccuugaccgucaccucaaucccgggaaaacuuugcugcagccgcgccugguaugucucuggcaucccuacgguguccacgaauaccugccacagcaacagacacauauuaauugaacaaacaacuguaccaaugcucuagccucacagcccuggcacguucuuccugcuacccagaauccucuucuccagcacguccccaggauggaucaaucagggauuucaacucgaacaucuccuccuagaccaggcaaaguuguucaggccugugaucccagcacuuugggaggcugaggcgggaggaucgcuugauccugggaguuugaggccaggcuuggcaacacagugagaccccaucuuuauaaaaacauaaaauaaauacaauaaaauaaagaaaaaacucaccuccugaagaggcuuucucuaucacgcugcuuuuacucuaacuuauuuagcaccuacugcaugccacauacuguucuaggaacugagguggcagaaaacacuagaaaaaaauugguagagugcguuagcacaagccuguaaucccaacacuuuaggaagccgaagugggaggaucgcuugagggcaggugguugagaccaaccugggcaacauauggagacccuguuucuacaaaaaauaaaaaguuagcuagguguaguggugaauaaaggcuugaaggaggugaggaagugaacugugcagagaucuggggaagagggcucuaggugugagaacagccaguacaaaggcccugagcugggaccagguucaugaugcugggcccaugcaugggggccuuuggcugcagcaccgaagagaggguccaagagcugcugggagaaagugguaucuccacagcacuacuguuuucagaaacaaccuuuauuuuuuguuuaccagcugaccaucuuucauguuuuauuuuuuuauuuuuuauuuuuaguagagaugggguuucaccauguuggucaggcuggucucgaacuccugaccugaugauccgcccgccucggccucccaaagugcugggauuacaggcgugagcuacugcgcccaaccuccagcugaccaucuuucugcccaggcuaggcccugaacgccuacggguagggcccuugucugucuacaccaguuacuguaucgccagcucugcauuugggccugguccucaggucccuccucagcagggucuaccuugcuauaauuccuuucuuucuucuucuuuuuguggagauggagucucgcuauguugcccaggcuggucuggaacuccuagccucaaccaauuugcucaccucagcuucccaaagugcugggauuacaggcgugagccaccauacccagcauacaauuccuacgucaagguuauuuugccuuguuauucucucagaacgguccauucuuucauugagagcauucgaggcaaugcugauuuauguuuuucucugguaauuuaauguaauucugccccacucgacugugaauuuuccugauuuaauuuccacugugaucggaaaacuaaaugucgagaugugcauuucaaaaagacuaccuucuguugcugcuuggggaacagauuggaggggauaggagggugagggacgagagacgacacucagcagguguccagggagugggggguguccugggcuaggacagaggugacagguagacaauguaggauuuguucuggagacugagccuuuaggaugagggagagauuagauggagacgggacuaggggcuacacuguggucgucaguguggcacacauuuagggcagaaacaggagcacgaaaucaacaguagcaaugaauaugcccgaggcacuccagacguaucugaugcugaaucugcacacugcacauuuuugcccacauuuauuuuuuauuuuauuuuuauuuuuauuuuucgcucugucccccaggcuggagugcaauggcgcgaucucaccucacugcaaccuccgccucccggguucgagcaauucuucugccucggccucaccaauaggugggauuacaggcacccgccaccaugcugggcuaauuuuuuguauuuucaguagagaugagguuucaccauguuggccaggauggucuucaacuccugaccucaggugaucugccugccucagccuccugaaacgcugggauuacagccgugagccacugcgccuggucucccauuuuuaguuuauuuuuuauuuuuuauuuuuuugagacagggucuugcucuguugcccggguuggagugcaauggcacaaucuuggcucacugcaacuucugccuccuggguucaagcgauucuccugucucagccuccugaguagcuaggauuacaggcgccugccaccacguccagcuaauuuuuguauuuuuaguagagacgggguuucaccauguuggucaggcuggucucgaacucuugaccuccggugaucuacccgccgcggcuucccaaagugcugcgauuauaggcgugagccacugcgcccugccuccauuuuugaguuggggggcuuccuuugucacccaggauggagugcuguggcaugaucauggcucacugcagucucgaacuccuguuuuguccccauuuuauccugagaugaccaaauggggacaacuuacaguuaacucaccugggugacguucacgcccugguccaaugcauacuguauaagcccaguggcuguaucaugugacagggaguucagguuguauuugacccugugguggggaacagagcccaguuaaucucauucuaggaacaaagcuuggucagcccaugcuggcugccccucccggggaccccucaccgcccaagcaugcugguagagaugagguuuggagacagcacauccagcgcccagccgacaaaguccguguccuccauuuucgcaaacagccuuucccgcucgcucuccaauagggucuuugagucugggaggagguuuggaagagaaggggaacagcugguucucccaguuccugcccuccccuuucaguucucaccugccccugcacauacccaggaaucccuuccccagacgcacaccucgggcucaccugccacuuucagcgccuccagaucugccaggcgaggcaggggacaauaacagauggcguagaccauggggccuggggagaaggggugucaguuuucuggcagccgggguccaaucacugagcccgugaaaguugccauucaucccuguucuaucaucacugcuucuuuaggugccaucaccacgaccacauccccucccuuggugcagugcaaucccgacucccguuucccgcauccuccguaccacgccccuccccucccuggcccuaggggcgcacccagcacggggccccugcccgccucaucgacgcccaggacgcaaggcuccuugcggcacaccgcgggcacaggcgaacucaggcgacagcggccuguauugucucucuccagcucgcugagauccaugccgccucagccgccaccaccagcugcaagaacuaauacugcaggagcgggucucggcgcgcguuuuccgc

SEQ ID NO: 18091 - RNA, 2457 nt, Homo sapiens
cauagacguccgggucgggcgccgcggggcggaagacgagggcggcgaggucggguuccgggcgcuuggagaagauggugcugcggcggcugcuggccgcccugcugcacagcccgcagcugguggaacgucugucagagucgcggccuauccgacgugcggcgcagcucacggccuucgcacugcugcaggcccagcugcggggccaggacgcggcccgccgccugcaggaccucgcggcugggcccgugggcucccugugccgccgcgcugagcgauuuagagacgccuucacccaggagcuacgccgcggccuccgaggccgcucggggccaccaccagguagccagaggggcccuggcgcaaacauuuaauccugggcugugcggggccgaggccgcuugcuuuuccuuccgggcucuacaguggcaucaauguggaggggucauuccgggcacugcgcgcggcuucgaaucccgacugggauuguuggccugcagacaucccacgcauaagagccuaggccagaccgcccgcuccguugaagucuugugauuggacaagacacaguguggagacagcccuaagccuaacagagaugaagguaggcuggguccagacacggcaccuacggagagccacggaccgaagccagagagccuuuccucugcaagugggacugaaacucuugacagaugcugcucaaucugacugguauagcaggacaguuaauuccagggacgauauggaugaaaagacaacccuacagcugccaaauuccuuugauuaaaugugugagcugguugauaggcaugagugugauacuucucaggcaagauguguuaagaauaccggggacuguaggccuaugguaauaauaaacacguauuuuaugaaaugagucuucugugcugggacuugcucauugcacucuauguguuaucucacuccuuacaacgacauucacaugaggaagcagauuacuuuuuggauuuuuuuguagagaugggguggucucgaacucuugggcgcaagugauccucccgccucagccucccaaagugcugggauuauaggcaagagccacugcgauggaaacagaggcugcugcuuaaguugcccaaagucuugcagagugggaugugagcagaggcauuugacuccagggccuaaguccuuaacacagcucugcagcauuuacccugauacucaaccccuuccuuccccaaccccccaccaucaggcauuaagacuacugccuaggggcagggccugguggcaguugugucuuaucccagccacugcagaggcaggaggaucgcaugagccugagaugagaccagccuggguagcauagcgagaaccuuucucaaaaaaaaaaaaaaaaaaaaaaaagacuacugccugccauggaacaaguuaccuggacuccuauccuguggggaaaagagagaucagauuguuacugugucuguguagaaagaaguagacauaggagacuccauuuuguucuguacugagaaaaauucuucugccuugagaugcuguuaaucuguaaccccacccccaacccccugcucucugaaacaugugcuguguccacucaggguuaaauggauuaagggcggugcaagaugugcuuuguuaaacagaugcuugaaggcagcaugcucguuaagagucaucaccacucccuaaucucaaguaccgagggacacaaacacugcggaagcccacagggaccucugccuaggaaagccagguauuguccaagguuucuccccaugugauagucugaaauauggccucgugggaagggaaagaccugaccgucccucacagcgugacacccguaaagggucugugcugagaaggauuagugaaagaagaaggaacgccucuuugccguugaaacaagaggaaggcaucugucuccugcccgucccugggcaaugguguaaaacccgauuguauguuccaucuacugaguuaggggaaaaccgccuuagggcuggaggugggacaugggggcagcaauacugcucuguaaggcauugagauguuuauguguaugcauaucuaaagcacagcacuuaguucuuuaccuugucuaugacacagagaccuuuguucacguguuuaucugcugaccuucucuccacuauuaucuuaugacccugacacaucccccucuccgagaaacacccaagaaugaugaauaaauacuaagggaacucagaggccggcgggauccucgucugcugaaugccggcccccugggcucccuuuuuucuuucucuauacuuugugucucuuucuuuuccaagucucuccuuccaccuaacgagaaacacccacagguguggaggggcaacccaccccuucacuaccccucauuuuagagggucagggauacagacagacuacgauccagccaguuagcagaccugcgauuag

SEQ ID NO: 18092 - RNA, 18658 nt, Homo sapiens
auuccuuguaugaaaagauuuaaugaauuaugagccauugaucauuacaaacuuuaagccuuaauauuucuucuuuccuauguaaaaccagguaauuaaaacagccugucucaguaugacagaagaccauaguagggauaauaguaacgucugcuuccacaucugcaugcuucguuaaccaaccaaagaaagugcuccagguuucccaagucaacaaaguauacucaguuacacuuucccugaucauacuaugaauugaaacagaacacuccuuugacuuuuaauagcacuuuucauccacggcacaagcacuuucccauuauuuucuccuuuacccucaauauccuugugagguagugaagggagggagcaaggauuuuuuuuuuucuauuuugcagaugagaaaacucaaggugaauuuuacaacagugguucucaaccuuggcagcauauugaaaugaccagaaaguuuuuaaaaauccuuaugaccagcucauauuccagaccaacaucagaaucuuggcauacggaacccaagcaucgaugugucuuccaacauuccaaagugacuacaaaguguauacagccaacacugagaaccacugguuugaaugauuuacacucaaucuucaggcgcaacugucuucuaccgaaaugcucuccucagcaccaaugacaaagauauuccaucuccuugagcacugcagcaguuuaagauuuuguagagcuacuacuggguuuuagugacaaauuuacguaaaugaaggcccucaugacccagaugcucaugcugcucacuucaauugcauaugauuugcgaaugggacauucgggaauuuaaaucuuugagauaagaauggcuuguuguuaaauauugaggcaauuauuucauucuagguccaauacgcaauaaccauguguuucgguuuuccacucagcaccuucaaaacuguugcaaaugaauguuuacuaacaagacaaaagagacaauuauaaaccaaacucucaacaaaauucggaauggccacaucacaaccugaaaaagaaacaaguacuuaaaggacuugaucacuuccuaacaaguccaucuucaaccugaaccacuucucuuguuuaaucaaauuuuaaacuuugccgaacugaguuguucuacaccaagaaaaaucaauuucuauaccaccuacauucucuaauacauuuaacauauaauuucacucaauacaaggagguuucuucuuaaccuggacaucgaaaagaaucuuuaacagauuucaucuuuucaagcaauguaucaaauacacaauaaauacuuguaaacuuuucagguggcaacaauaaaucuuuguucuauggcugaaaucccuugcuucacaggaguauugacaaucuuaacucccaaggagcaauccaagaaucccggccagcugcugggugucccuaaucagauuuaaaacaaaacauacauacagcaagaacucagaaguacaaagauuucgcucgcuuuugucaauucuuauguaucuaaaaccauacaauuuauacuuucauacagaaagaugucuguuucuuuucuaacaaaagaaaaacucucagcucauguggguuggauuauuaauucaaaagcauuuuagugaugagaaacaagauuuguaagucaaaauaggaguuaauguuaaacucuucuacaacgaaaccuucaaauauugccaaccugaaguuuucagcacaagguguuguauuucaagucccaugggggcaauuaucuauaaugagauuaagaauauucuuaaccuguuucagcuggguaaguaaacguuuucuuuauagccccaauaacgaguuugaggcuuagauuaguugcaugauguaaacaauaugaaauuaaaauuuuuuugauaauaucuacagcauuuauaagguuacaaaauaaaaggaccauuaaucaauucuuuuuuuccuaggcucuaugacuaauagcuuucauauuugaggccuacaagagcaaauggcaauguucuguguuaugagacacuuucuuagaaggccaaaaauaaaacuggauaccaaaagauacacauuacuauuauguugagaucauccuuacugauauauguauaauuagaaauagauuugccuuccuucaaucuuuagccaggagacugagagaucuuuacuaugauuuugagaguaaaaacaaaaacaaaccagacucuaacagcuaugggaacuguaagccaaaaauaauacaaaaugagucaauacaacacaucuccucuuaaaauccucuucuuuguaguuaacccaguuguccccaaauguuauuccaauuuuguaaccauguagugguuuuuaagaaauuagaacuagaacaaaacaaccuguuuguccuuucuuuuuuacaguuuuuuuuuuuuacacacauauuauauacaacuuuuaaaauagcugcacaauuuuauaucucacuuuuagagaagugcaguccaggcagaccaugcuucucaauauauuaaaaauauuaaauaaaacccaaccaguuucauacuuuucuaauagucaagcuggcuggaaaaaaaaggacuggagaaagaacaggcaguuguaaaaugggaucagucuucacaaacacacuacuuaaaaaucuugcuauuuccuuaucccuuugacagcaucucuacaaucucaccuuuaaagcuggaaauaacacauugcuaacuuagagacaacaucgggugcaacaugcauaugucaacugcccacucaaccaacugcaacccugaggauuuuucuggcccaguagaaagaggaaacacgaagauaaucucugcuguagagcugcuucuccaguuuacgacuucauguguuuucaggauguuucuuggacaugcaugugugacagucacuucaugguucuacuucccauaagcagaucucuccuccauucugucugucaucacaagaaagccacugucauccguccaaagguuuuccaagguaaaccaaagucacuucuguguugccauauacagcagaaacugcuggguauaagcagaccuuuggaaguccucuaaaagcaacccccaggaacucauauccacguucaaaagcuaaagucuuaucuuccauguccaagaugacucgaauucuuucuccuaucugcaaacagauaucaaaagguuagaagaaaaucugccaaggguguagcuagaagaaacaagacacaaaucaagaaguugaaaauauuaagaauauuauccugaaagcuaucuagaaaaaucagaagggaagcuuucuagucaggaagaaacaucuauaaaaaaaggacauacaucuggccgggcauaguggcucaugccuauaaucccagcacuuugggaggcugaggcgggcggauugcuugagcccaggaguucaagaccagccugggcaacauggugaaaacccaucucuauuaaaaauacaaaaauuagcugggugugguggcgcaaagcugguaucgcaccacugcccacugcacuccagccuagguaacacaucacaaaugcuuacuuugauaguuuuguuuuuaagacucacauggaaucuacacuuaauuacuuacaauuuaaauguuccaccugaacacuaccuagauugauuuuauuuacucuuuguuuaaagguuuuucuuaagguuaacacuaaaaucuauaacuuggcauauuuuaccaaaaagagcaaucuaaaucagcuucucaaauuacuauacuauacauacaacggaacuuuuuuuuuuuuuuuuuuugagacggagucuugcucugucgcccaggcuggagugcaguggugcaaucucagcucacugcaagcuccgccucccggguucaugccauucuccugccucagccuccccaguagcugggacuacaggugcccgccaccacgcccggcuaauuuuuuguauuuuuaguagagacggguuucaccguguuagccaggauggucuccaucuccugaccucgugauccaccugccucagccucccaaagugcugggauuacaggcaugagccaucgcgcccggccguacaauggaauauuauucagccauaaacagaaaugaaauuuugauauaugcuacaacauagauagacccugaaaauauuaugcuaagugaaaugagccagacacaaaaggcuaaaugguaugauuccaccuauauaaaguaucuagaauacucaaauauauauaguuguagagcagaguuuaccagggguggggagugaaggaaauagggaaugaacauaauagagauuauguuggggugaggaaaaaguuuuggguauagagagaggugugugaauguauuuaaugccacugaauuguauacuuacaaaugguuaaaauaauaaauauguauguuucaccacaauuuuaaaaaucaccuuaguaagacacacagcuuuuaaaguuuacaaagcaguuccacauguaauguggaaucaugaauaauccaaucuggcuacaaauucuaauguagaauauagaauaggcuuauuaaacaauuugugguucacaacucugaaacaccuguuuguuauaaaaaacagcagcacugauuauuaaacgaaacuggaagcagaauauauccaguuuuuucccauuuggaaaaguaagcaaaaaaaaaaaaaggauguuucaucuuuuuaguuugccuuuauaaaaagauguugcaucuacaaaauuggaaacagaaaguccuaauguuugcaaucaaaauuuaauucuaccugauuauaaccccuacuauugucauuuacuuuccuucacuguauuuccuguuaacaguaacugccaacaucugcuuuuuuccucccuuugcccaccucacagauuaacccacaccucauuuuauggaucuaagaaccuccaaaucaucaucaccaccacuccuaccaacaaaauauuaacaaaguagaaaugaaaagcuaauuuuguuggguauuuguguugugucguauuuguauuaucccauuuaauccucacacuaauccuaggaacuaucccuauuuuacagaaguugaaacuaaguaacgauuacuccuggugaaaucugcaaaucugcuucaccuuugagcacacagcacgcacaaagcccaggguggagaaagcgaagucuuaccaucuuuaggugcugggguaaaacguggggagauggcagagcaacuggaaacuuagaggaggaacuccagaagcaacagaaccacagaaaggaugaaccccaaaaucugagaauuaacuucccaaaucccugagugaccacuauauuacaaaggcacaggguaaaccuccaggacuaaaaaagcagcaaagcugaaaaaacugagcagacauuagcugccacacaucacaugagacagaguuuauaguuugaguauaggcaaguuaacugccuacuaaaacaagaaaaccuauacuuuucagagaauaaagcaguuucuagaaacaaaacauucaggaguuacuacuacauauuaucuacacaucuagguuucaguuaaaaaaauuacuagauaugaaaagaaacaggaaagcgugauucauauuuaggggaaaaaagcaaucaacagaagcugaauccaagugguccuaaguguuggauuugguaaagacuucaaagcagcuguuaugaauauguccaaagauuuuuuuacaaauauaguauaaguaaauaaauaaggaaucucgaaaaggaaauuuacucuaaaaaagaaccaggcccagugugguggcucacgccuguaaucccaguacuuucacuuugggaggccgaggcgggcggaucacgaggucaagagaucgagaccauccuggccaacauggugaaaccucaucucuacuaaaaauacaaaaauuagcugggcaugguggcacacaccuguagucccagcuacucaggaggcugaggcagaagaaucacuugaacccgggagucgguggcugcagugagcccagaucgugccacugcacuccagccugacgacagagugagacugucucaaaaaaaaaaaaaaaaaaaaaaaaaaaaggaaaaagaaaaaaaaggaaauucuaaagcugaaguguacaauaagcaaaauuuacuagcccaguucaauagcagaggugagauggcaaaagaaaaaaauuuauaaccuugaagacagaacagaaauuaucuaauuuaggucaagcccagugguucaugccuauaaucccagcacuuugggagacugaggcaggcagcugcuugagcucaggaguuugaaaccagccugggcaaaauggcaaaacccugucucuacaaaaaauacaaauauuagccaggcauugguggggagcaccuguagucccagcuacucuggaggcugaggugggaugaucacuugagccugggaggcagagguuucagugagccaagaucaucacgccacugcaccacugcaccacuccagccgaggugucagagcgagacccuaucucaaaaaaaaaaaggaaaagaaauuaucuaaugcaaagauuagagagaaacaagguugggggaaaaaacaagaacauaguuuuagaggcagagauaaggacaacaucaagcaauccaacacuuacauuaaagguaaaugaacuaaacacuuaaaagucagagaccgaagcugggcgcaguggcucacaaccuguaaucccagcaacugggaggccaaggcagguggaucacuugagguugggaguucgagaccagccugaccaacauggagaaaccccgucucgccaggcaugguggcucaugccuguaauccgagcacuuugggaggcugaggcaggcggaucacgaggucaggaguucgagaccagccuggccaacguggugaaaccccgucucuacuaaaaauacaaaaauuagcugggugugguggcgcaugccuguaaucccagcuacccaagaggcugagguaggagaacugcuugaaccgggacccgggaggcagagguugcggugagcugagaucaugccauugcacuccagcaugggcaacaagagugaaacucugucucaaaaggagaaaaaaaaaaaaaagaaaccccuucucuacuaaaaaaauauaaaauuaaauuagccgggcgugguuuagaggcgcaugccucuaaucccagcuacucgggaggcugaggcaggagaaucacuugaaccugggagguggagguugcggugagccgagauugcgccauugcacuuccagccugggcaacaagaguaaaacuccgucucaaaaaaaaaaagucagagacagagacuggguuagauaaaaaucaagauccaacuaugugcuguguaggagcuccacuuuaaauacaaagacagauugacagaggauuacuagagucaaaggaagucauuucauaauaaaagaauaaaucaggcagggagauaaaacaauuagaaauguauaugcaccaguaguaacagagcuccaaaauacaugaagcaaacacugagagaacuaaaagaagaaagacaaauuagcaaggauagauggagauuucaauacuccucuuaguaaauaauagaaggguagaaaaaaaucaguaacacuauguaagacuugaacauuaucaaucgacuuugccuaauucucauuuacagaauauuccauucagcaaaagaauauacauuuuuucaagcacacaugggacacucauccagacagaccacauauuagaauaaaacaaaucucaauaaauuuaaaaggacuaaaaccauagagcauguucucugaaaaacagacuuaaggacuuucacuuacaaaaucauuacaaggguggcgacaggacuucguuuuuagugauaaagucuacacacccuucuccuuauaguauccgcagagccuaaaaggauagugaggaaacauuccaugaaaaaaauccuuccagcuuuuauaccucagaaaaugggauguauuuuugguucuucugcuuuaguaugccugacuugaggucauuacugaggcuggaacuuucacgccacagguggcucugaaauaugcaaucuauaguucuuuaaagacuuccaauuucuuaucagauuauuguauauuacacccuguuaagucuguaguaauaaauacggcuuuuacaaauaggaacuauaauuuuaacuugagucaaaugaguaugccuuaagccuaagaugaaaagaauaaaaaauacagcaguuugccugaauuugccugucucugcagaacucacugaugccuccaggggcuuugaauccacaaacaugugcaugcacagagcuguauuuacugggguaaggagccuagaaaaagauuuggaugugccgugauacaggaaagaugaccaucuagagcagggguauucaauccuuuggcuucccugggccacacuggaagaauuguuuugggccacacauaaaauacacuaacacuaaagauagcuaaucagcuuuaaaaaaaaaaauugcaaaaaaaucucauaauguuuuaagaaaguuuaugaauuugcauugggucacaaucaaagccaucuugggcugcaugcaggcuguggguuggacaagcuugauauagagcaugaacuggcaaacuacagccccuggaccaaaucuguccugcagcccauaaauaaggucuauggaauacagccauguucguucauuuacguauuaucgaugacugcuuuuguacuauaaauagaguugaaacucgugauagauccuuaccuugaaaaugacauuaaaaaaaaaaaguugugacagagaccauauggacugcaaagacuuaaagauuuacuacguggcccuuacaaaaaguuugccaaccccugaucuggagcaaaaauaggcugcuuaaaguuguauuaggaaacaaauauugagauagaucauuuauacauuuauuuaaaaauggucaaaaaaucuccuugaggcugggcaugguggcucacgccuguaaucccagcacuuugggaggccaaggcaggugaaucacgagguuaggaguucaagaccagccuggccaagauggugaaacccugucucuacuaaaaauacaaaaauuagccaggcaugguggugggcgccuguaaucccaacuacugaggcugaggcagagaauugcuugaaccugggaggugcagguugcagugagccgaguuggcgccacugcacucuagccugggcaacggagugagauucugucuaaaaaaaaaaaaagaauauuuuucugcauagccaaaaucaaaauauaacacccaacaaaauuaacuauaacccccuaacauuaaaaaaaaaaaaucuccuugaagucuggguaucugaaaaaauaaaaaaauaauaaaaauaaaaauuaccaaaaagacaaaaacugcuauauaaaaauuuguaaauuuaaaacaaauuaaggcgugauuugacaaaggcccauacuugagaaaaaccccaguuucucaccugauauuuuggugcguuguugcacuguggaaaacugccauugacuucuccauuauguaguagauuauuguccaccagauuccagccccagcucuggucaucacugcccagcaaugccacauaaccuuggcacugcaugggggcccguuuuguggcaauuccaaucacugccacagugcccagagggcccucccaccacacuucccaugcauggcggcccucacugaaaccaaucuugguccuugcaccaucagugcucugagcaaugggguuucgauguaaaguaaagccauucuucuuaauguagacauuccuggagcagucauuagugcugaaggcauguugaaaagcacguaucuaaaaagaugaaaaacagaccaaauaaauaacaauuuuauuuuucuuaaauauuaaaaauuacccaaacuucacgcuguauguuuuuaaauaacgaaguuauauauuuuaaaauaacacaaguauuuccaaauaauggcugaaguuucaggauggaauacuaacagaauaaauaacauuaaaaaauaaaugccaaccguuucaucacugaccaaaauuuuaaauuguaguauuuccucaaacagacuucuuaaaacaucaaaagauacaaaaaagaaaaauccuuauaucuuacagauaauacugaaacguuuauggauaaaauaaugguaucugggaauugcuuugaaauauccagagauggagugggagagugugcaauagaaacaugaaacuagacuggccauaaauuaaucauuggcaaagcuuggugauggguauaaggaaguucaucaaacuauuuucucuacuuuuguuuauauuugauauuuuuauaccaaaaaguugagauguacaguuuucauaugggcaaugcugucaucaaaaagaauuauauuuuacauaaaacagaaacuuuaauccuagcagcucuaaaguuuaugaaaaauuuuaguaaacacaaacuaccuuagauccucagccuacuugcuggauaugacuuacacaauaaaaaaaucaccaaucucauuuuaccaaaucaaauaaucccuuagauagcaucuagguucaacuacuagaauuuaugaagagaagcuaucaauaagacaaguuaguugacucuucaguaaauacaaagguuuacacuuccaaaauaaagaggguaugaaaauagcucuucuauacaaacaauaacaauuucucauaaacaauuuuaaacuuuuaguuuguguauuuuaaauuuuuuuuagacaacgucucacucugucacccagacugcagugcaguggcacaaucguagcgcacugcagccuugaacuccuuggcucaagugauacucccaucucagucuuccgaguagcugggguuacagguucgagucacuacgccugccuggcuaguauguuuuuaaaaaaucccuucucuacuuuagucaaacuacccaaagcaguggaaggcugggaccuaugcuucagcuaaccugagaaaaaucaacuccagaggcauagaaugucagcauuuaggaagacccuuaaaggucaccuaguccuucucagggauuucaaccgcgaguuagugcaagaggcccaaagagagaucaaggauccaguccccucaccaccuguucguuuaccauucgcuggcacucuaccguuucagugagcugcagagcgcagauuuaaaaacagagaacuauuuguuuccaguaucccaugcauucacaauaaaacugaggcauucccaauguuuuuccuaucugcucguauuauaaaauacuuuaaggcacuuauaagaccaaaacguaagauucaaugaaggggccgggcgcgguggcucaccccugcaaucccagcacuuugggaaggcaaggugggcaaaucgccugaacucggaguucaagacuagccugggcaacauggcgaaaccccaacucuaguaaaaauacaaaaaauuagcugggcguggcagugcacgcuuguaaucccagcuacuugggaggcugaggcagaaggaaugcuugagcccaggaggcagaggaugcagugagccaaaaucacaccacugcacuccagccugggugacaaagugagacccugucucaaaaaaaaaaaaagaaacaaagaaaagaaaggaaaagaagauuaaauggggaaggaacauguccccaaaauagcaaauacugucuaaauaacucaagagaauaauaucaauaauucacuauaaaauauuuaauuaauauuucccuaugccuacuccccaauucuuauaaauuccaauuucacauugacacuauugacaaccucuuccuuaaacuuccuuuucuuuuuuuuuuuuuuugagacagagucucacucugucacccaagcuggagugcaguggcucaaucucagcucacugcaaccucugccuccuggguucaagcgauucuccugucucagccucccccgaguagcugggauuacagacgugcaccaccacacccggcuaauuuuugaauuuugaauagagacaggguuucaccauguuggccaggcuggucucaaacuccugaccucaggugauccgccugccuuggccuccgcaagugcugggauuacaggcgugagccaccacgcccggcccucucuuccucaaacuucuaugacaucuuccuauuucccugaacugauccuguaucauuuccuuuuuuggugaccacccuuccucugccccaaccaaauucuccaaacucaguccucaacucucuaucugaauuauuuccaaaccugucuuucuaaaacagcaccuuuacuacauaucucaucccaguucuauaaccucugguaguuccauacuuaguagcaucaccaacugcaaauucuucugccuggcuuucacagcccuccaaaucugauucuuccuauuucccuuucuaccuugaugauguucuucuugcugaaaguauuauaugugcuuucuucucccacacauucucuaagaucaccucuauuaagcuauucuuaaccagggccacccaauucccuugaugucucucucugccgggugcuugcccaccacuuucugugccacguaacaauuuagcagcucuuauuuucuaacacacuuuuaaccacugagucuaguacaaaauaacuugcaaaaaaaaucuaaucuaaucuaaauugaucacaccucaguaggaaauagaggacagaagaacaugucaagcaacacgaugauaaugaaauccgcaaaaucgagcugagaguaaaccaccuuguuuccucaacaaauaaggugggagguuggggagauggugagugaauauguagacuaaaauagccuuaagagacauaucaaccuuugccaugggacccuuauauagaucuugauuauauaaaauauaacuuuaaaaugcaacauuuaacauuuaugagacaacuggcaauuugaacacugcauuuuugauauuaaggaauuaauguacauuuauauuuagaugugauaaccauauugugauuacauuaagugucuuuacuuuuuagaaacagauacuggaaacuucauaugaaaugggaaaauaggccgggcaugguggcucacaccuauaaucccagcacuucaggaggccgaggcaggcggaucacgaggucaagaaaucgagaccguccuggccaacauggugaaagccugucucuacuaaaaauacaaaaauuagcuggacguaguggcaggcuccuguaauccaagcuacuugggaggcugaggcagaaucacuugaacccaggaagcagagguugcagugagcugaaauugugccacugcgcuccagccugggcaacagagcaagacucugucucaaaaaaaaaaaaaaaaaggaaaauaaagaccaaauuaauaaauuaaaaacaacccauagccucacauucccaugcacaaccugaauuuuguuauggcaaaagcagcaugaagaccuagcuuaaaaucuaagucugaacuuuagagaauucucaucagaugccaaguaugacuuaaauaauuaaugcuacggggugauauguaaaauaugaacuuaaaaaaaaaacaacugaacagauuaauaaacuccacuuuccuguucuaugcuaucccuaaaccuuuuccuaucauucucuguuauccaggcuccugggaaaauccauuugacacauccaucuuccucaucccauucacccagucagcugucuaccuauguauauuguuuucuacgacagcucuccagccauccccuucucuccucgauguaccuguuccagucuuaaguaucucugguauaggcacuaaccgcugcccucuccaacucaucuauggccuagucuuuuugaaguagagccuuugucacucugcuguucaaacuucuaugguuuacaacuguaguacaaaacccaaacuauagacugaaggcuauauuucaaagcccuccaugauauaucuagucccauaauauagcuuuauaauauuucccacuacuuccuuucauucaaucuaacuauauuauuuuauaucuuuagcgcagaucucuccucuaagcuccaaccuccaacagcugccuauuggaaaucucugucucaaaaauacuguaaaugcugcucucccaaaacugaacucacugccauuucuucgaaaccuagcccaccagccugggcaacauaaugagacaucucuacaaaaaaaaauaauaauaaaaauuagcugggcaugguggcacaugccuguagucccagccacacagaaggcugaagugggaggaucgcuugagcccaggaguucaaggcugcagugagcuaugaucauuccacugcacuccagccagggcaacagagcaagaccucaucucaaaaaaaaaaucuagaucaacugaucucuacauuaugugagccaaauacuaggagucauccuuaccacuucccucuuccucaucccuauuucaaaucuauugccaauucuauagauuuuacuuacuaaaucugcccauuucuaucuccuccacuaccuauuuccuaauugaucuaccauauuucuaagguccucuuccaaccaacaauuuaguucuccauacuaaagucagaaauaaucucuuaaaaugcaaaauaaucauaucaccaauccccacaccucaaauccuucuugcuuacaacucaaaauggcuucccuacgcuuuggucccaguccacuucuuccaucuuaucucaaaccagcaucaccuuugcucucugugcuccagccacauugacauauuuuccaucccucacacucauaagguucccuccuggaaggcuguucucucuccccuuugccuacuuaucauccuucaggucucaguacauggaucugagaaagccuucccucaccucuccaccagguuaaauccuccacuacugacaaucagagcacuagguauuuuuccuucauacuacuuaccagaugcgguuuuacaucugugugauuauuugauuaauauccauuuccccuacuagacuguaagcuccauaaggcaagacauccauuaagagacuguguuuguuuuauuugccauugcaucugcaaaugagcauagugccuggcacucauuuuuuuaaauaaaaauauauguuguacaaacccuuuacuuuccucuuguccugcuucugcucagaguacuuccucuuccuaaaauacuaaacuccuccucaucuuuaaaauucagcucaaauauaagcucaaccucaaaucuccuccaauccuccacucaguuuguaaauuccuccuuucacugaacuucuaguauacuuuuuuaugucuguaacaguaaggagcaauuucuaccacacauuagcaguucuuucuauacauuuuucucuccucuacuagacugaaagauuuccuacuagacuauuugacuccuuuugaauuaaucuuuuauccucaaaauauucaagggaaguccuacaaugugugaaugaacagugauugguacaagucuacaacaucuauaaugcacauagcagaaaagcaaaguauuaaaaaccucagaaaccuaaaauaucucuggaaggauacaaaagaaaaaguaagacagguugcauacauggagaggaaccggguagcugagcgacaaggaugaaaggaaaacauuuugcuugauaucauuuugcuucuauugaagcuugacucacacgaacacauuaucuauuacauauuauaauaugaaucuugaaucaugugaacauuucuauuacaagucaauuaucaaaacaacaacuccuaauuuaggcugggugcaguggcuaaugccuguaaccccagcacuuugggaggcugaggcaagaagaucgcuugaguccaggaguuugagaccagcuuaggcaacaaggugagaccccgugucucuaaaaaauaaaaaauuagccagugugguggcacaugacugaagugccagcuacucgggaggcuaagcuaaggaggaucccuugagcucaggaggucgaggaugcagugagcuaugauugugccacugcacugcagccugggcgacagaguuuuguuguuuuguugucucaaaaacaacaacaaaaacuccuaguuuaaaauaaguaaaaacaauaaacuuuacagaaaaauaaaaacuaaauaaaauuuaugaaaccgacacauuuaucaaaguaggacaaaauuccaaucgucuguacucaccuauauaaauuacaaccaguauccacugaauagccaccacgcacaaacaguccuaguaaauuauuguuauuucgcuuaauagaaaaacaacuugaggccgggcgcaugagcucacgccuguaaucccagcacuuugggaggccaaggcgacggaucacgaggucaggagauugagaccaugcugguuaacacggugaaacccugucucuacugaaaguacaaaaaauuagccgggcgugguggcgggcgccuguaaucccagcuacucaggaggcugaggcaggagaauggcgugaacccgggaggcggagguugcagugagcugagaucccgccacugcacuccagccugggugacagagcgagacuccgucucaaaaaaaaaaaaaaaaagaaaaaagaaaagagaaacaacuugauaguuuacauauuuaauggcaauguucccuaucuucuauaacuaaaaccgguuuuacuacauaaguauaaauuuuacaugcuucacaugaaaaaaaaauuuuuacuucuuacuccgaccccuguuggcaagcuagcauuaaaaaggggguguuaucgcgcgguggcucacgccucuaaucccagcacucugggaggccgaggagggcggaucaccugaggucgggaguucgaggccagccuaaccaacaagaagaaaccacaacucuacuaaaaauacaaaauuagccgggcaugguggcgcaugccuguaaucccagcuacucgggaggcugaggcaagacaauugcuugaaccuggaaggcggagguugcggugagccgagaucacgccauugcacuccgucucaaaaaaaaaaaaaaagggggggauguuaucguuuuaguuacuaaugcauucauuauguuuaacacauugcaaucagacuuuaucuucucuuauauaugaucuugauugacugcuauacugaauagcuguuaaccauucaacucaacucaagaccaagacccuuuguuuauucggccugagaguccuuucagccguaccacaacuuguuccuugacauuuuuauuuuguauaugaaggcgggcggaauaugcaggaaggaugcagcgaaacuguaaucagcacguuagaugacaaauagaaaaagagagacaccaucaauguggaacuauuaaaaaguuagcaaggaaacagccaauaacagcaggacaaagcaguauguuagguggugcccguggacguucuauaaaagccuguaucuuguaagugagcaggaugacuagaacuacacucacuuguaagccuccaauauaguggagggaacuaaagagaacuugggggaaaauaaugaaaacaaaugguuaaaaaucagagcuuggaaaagaugagauaaacguggagugaaagcaaacuagaaacuuagaaacuuagaaacuaagcccauguuaagguggccgggauuauuuaauauaaugaagucuaucuggaggccggggagaaaaguaggaugagggcauuaaaagguacaagagugguggucugucuuuaacggggaaaacugucaaaaguugaaugagugaggcaaacuaccuaguuguuugaaaaguggaucacggaagugggauggguuaaggagcagaacuucgauccaaagaaaagagaaucuuuaucuuggggggaggugaggaagauacugacuggagccguggaaaggcgggcuggugaggcgaagcuucugacucagaagcucggaugagaaacaccgcgaacgacgccggggagcgggacugggggcagcgguguggcccggggcucucucaccuuggccuuguagcugggcagguugcacaggauguccgugcgcagagccucuucugccaggcugcgggcgcacaggcuccgccacaccucgcuguucucaucgccgugcaggcagcgguaccagugcuugcacaccagggcgcagcuccgcagcucggacagcuccagguaagagaacaccaacuccagcacccggcugggcagccggcccccggcccccgcggccccagagcccgagcccgcgcccgcgcccgcgccgccgccgcuacagccagcgccgcccgaggcugccccagcccccggggccggcgccgccaucgccucaccagccggcccuagggccgccgcugccgccgccgcuucccgccgucucugcucggaaggccaagccucgcccggagaccggagcggcucgcucaccgccccugucagugccaaccgccggcgccuccaccacucccgccccugcccgggggcguccgccgcgcgccccgccucacugagggcagacgcaccggcugcaggggcguccuccgccccuccuccgcggcucagcgcgggcgccgaaaccgcccgacucgcccggccucuccgcggcgcgccagcggcuccgccaugcggguugagggcacgaagcaagggcgcacgcccagcucguucgcgguuccucuc

SEQ ID NO: 18093 - RNA, 269 nt, Homo sapiens
acguuuugaacuucucaccaacuuuccucgaaggaaauuaucucaucuggacuaugauauuacauugcaagaggcaggccuuuguccucaagagacugucuuuguacaggaaagaaauuaacaccauggcuugaccucucucagcuuaccccuuuuuucccuuuuccugugagauacaugucacuaaguaugcauuuuggcucauaggaccacagagccaaaguugggcaagcaagucaccuuccuucucuuauuucuugaucucuccu

SEQ ID NO: 18094 - RNA, 2243 nt, Homo sapiens
uucuucuuaaucucugguuucucgucugaaaaaugagauaauuggacuagauuaauaguucucagccuuuucuagaacaacaaauuagauuaucucugaaguccuuuuccaaaauuucaugcuuccagucucuccccgugauugcguauuaucccuaggcuaauuaaaagugugcugguuaaucaguuucuuuacuuuuuuuuucucucuuuuuuuuauucuguguucagguaucauuugaccaacaacuugcucuuaaucuuacugcgaugacugaaaucuccaaagaggagaguauaguaguuauaggucuaguaauaauaaucuuguaaacaauucauuauuuuuuaaaacuuaaugcugugugccuaaucaguguugaguaugacuaaaauguaaaugagaaccaaauaugacacuaacgcuggcacuaaauuuuauuuuuacuuguguacuuaaaguacuuuacuggccuguugggaaauugauuuguauaagauucacaccugguuuuggcagaaacagcuuuuuaaagauacaauuaggcugacuuaaaaauguuuuuuauuccacagaauguaucuuuauuaugucauucuuaccgucucucugccuuuuuugaccaucauguaacuacgcaguaguaaaucauggggugcaggcugaugaauuaguagucuuuguaaaacuaaaauguaaugagcauaggaagagacagcucuucuggugaacauggcaguuuuccgguaauaccagccuugaugaauaggcuaaagacagcuguguacuauggacauucaacuucacuggauugccuggcuuagcuuuucaguuauugucuugccgugaaacaugguguugcacuguacacauuuuagaauaguggcaagaauguucuuuagaacugcagauaacccaacagagaauaccauaccaauauaucgguuucuccuguuacauagagauuugguauuucagugaugguuaugguuuuugacucaccugugugucaguccugcuagagagacaguauagaaucaagaauuucuugaugucuuuuuaaaaauagagauuauaauggccuugcuaguuguccugugaagugacagacccuuaauuagaaaucuuuuaauccugcuuuccauuuuacuucuccaccauuuauuuuuaacauucauucucugaaaauaguuaugauuuuuaguguaauuggcuauguuuaagaaauuccauuucaaagucuuaauauguaacaaucuucauuuuuuauaaaauugaaggacauuuuugaggcaaacuuacuuuuauagcucauuuucucccuaguuaaggagaauucucugguuucauauagagaauggcuagcucugugauaccccacccucuuuguggccuaccaguugcuguuguguugcuuaaaauugcagauauucucauaaacaugaugauuuuuggcacaggccuuucuuugcuauugauuucaaaauaaaguugggcaauccaauuugaacuacuuuaauaaacauaauuuagcauuccuguaaugagaaaguauuuucaaaagauaaccagauuuauuucuaggauuagagauggcaaauaccaaugauaguauuuuucccaagagcaaucacagauuaaucuauaaauaugagaagucgcauuauuguacuuaauucuuuggcaacaaacagcaaguuuuuauuguuuaauuguauuuccucucuagagaucacaauacucuggguauuuuauaucccuucuaaaggucauuuggguuuucaaaugggaagaauagucaagcuaagcuggacuaaaccuaaguaauauuuuuucucaucaaaagaaguuauuaaucuaacuggguuagcaugagucauucauuuuuuagacaugauaaaugggaaacauaucaaaucauuagauaaauucugaccuggaauugaauucccccuuucuuaaaaucuuuuuaauuugcuuuuuucauagacucaguauggaacucuuaacugauaagggagagauucuugaucuggaaccguucccugccauucuccuuuuuucucucuaucuagguagcugguuccauagugcccgucacgaggguccauuucaguuugaugacauuagacugcuuacacucagcuggaugccuugcuguuugcagcaacaugauuuuacaguaugcuuuucucaaagcuuugcauucuuaauggagauaucaaaugguguaauuccaaaua

SEQ ID NO: 18095 - RNA, 1349 nt, Homo sapiens
uuguuguuguuguuguuaacaaauucuaaacauccaguguuacuuuuuguuuuguuuguuuuguuuuguuuuguuuuguuuuguuugcccuucaggaaaguccuuuuucgaguagguauugauuguucccuggaaacucucagcagugucugugcaggcucugugcaugcuuuguaugaguucggcuugaacaaugcauuugaagucaccugggauguccaguucuggcaugucuucauugauuguguuuuuaaacauguuucauguuucaugucauuuuccaaaccucacuuuacaucuuacucagagaaguuaaucaaggaaugaaauuucuagggggauagggaugaugaggguggguugggggcuugagugaagucaacuugggguauuugcuuuaaaguguuuucuaaagcaguuccuaacaguauuuagagauucccugggauguuuguggcucaacuuauucuggacaaaguguguguggggguggucuuacugagauuugcauucuuaaugcaggacaggcucuaaauuucaucuguacucuaaauuugugauugaauccaagaagauaacagagacagugcuccuguuguaauguuucuggcaagugcucccuaaaaugcacaucgaauucuguuuucugggccuuuucuccaauggugcuaggagauaccguugauuucugcagcucuucucaguggugggaagaagucuuugggauuguugagcaaggggcagcuggaccauccacuaaauuuuuuuguucaagacacauuagagacccuccuguauaucuaguaagucauaauaaaggugcuugggaaagccuuaaauuugaagacacauggaggcgguagaaaauuaaacuuguaagaggagaaaaacaugccauuagguaacgcagaguuguaacuacuggcuaagacucaauggaacuuccacuugcucuaaaaccagggaaaucuuagauaacugggugugaucuaccuauagaucuaccuagucuauagguaauaauuuccagaaggaggaucuugcugucaguuggggauccucugguuuggucuguaccaaauugugaauacucuugcuguguuguacccaguugcuuuauauuaauacugcaacuugaaacggggaggguggggggacaauggggugggggagggaagggagugggacgauaagucuuuugaagacaucagcucacugugcugagagagggaccaaacucaaggaaaccucugaucuauacauucaacugcugcauuuuuuuauaaauacauguaaauguccuguuguaauauuugaucuuggaaauaaaaacaaaaacuuuucaguau

SEQ ID NO: 18096 - RNA, 2332 nt, Homo sapiens
cagauggaauccaacaccccagggucagucacucagucccaccccgcuggguccaccuggugauccccggcuucggcuuccagauagguccugguuuugccaaacugucaguggggcagccuggcuggaggcccacacuccguccagggcacacccccaaacaugaacccaaagccugaugcuggccucaaggagggugccagaaagagaccgacaggcaugcagccuguggcugagcggccccacacccagcuguguggagagggagggcaccgcccagccaaggucggagucuccucccaguccugccccacccucccuuccugcacccgccaccccgcagacuccagcccuaacccgcaucgauggagccgcaggggcccuccacagacaccuccuuguccauuuuuagcccuggccccuucucuggccugaccauuuggugcugucugucuccacccucaccagggagucggcugcccuucauccugcccaggggagaggauaauuuuagucugagguugaaccgugagugugugugugguucagaugaagcuaguccuugcugggaaggggccugggaagacagcugggucucuggaggggcgccuagagcugagggcugagacggaaggaaaaguggaggagacucggaggccaggguggacagggaggagccgaaggucaagggacagaagaaaggaggccaugagggucaaagcuggccacgucggucugacucggccuccacugaggcacccacagccuuggcuccagauugcagauucuugccagcuugggucucacgcccccagagcugguggauccuuauccgucugggcuagggugccucaaaucugagggccucuucuggccucugcccugugcuuccucccaguaacuagaauuccuuauguuugcaagcaauguucagguuacaagacccucuacagccauuaucuccggugccuccugcagccccgggaggugagcugggcaguggggaccgguaucauuucacugaagacacaacaaaaaucuggaggccacugaccgcccagggaccuaucaggagccaguggcagauccaagaccccuaaaucucagcaaaccacgcugcucucuucuccugccuccaccaucccgacacuacucauccuucccuaaaacccgggcaaaggaccaggacaguguuuccaggaaaagccaaaggaucccaagagacagccccuuugccggauugcagccaggaaaaucucugcugcccaaucccacugcagcuguucggcccugcccaccccccaacccagcccugaagccagaaguggggaggaaagaccacggcuggcucacuuccucucucauugucuuccagacaaugggcaaaguuccacugagucagaccagggacucacuacaccacagacccaaauuaggacaagguguggggagagguggggacaggcuguggggaaggaagcugucagcagggacagaugaccagagaaacccagagauuagagagggucagggaggagggaagccaagcaaagacguucuggguccagacagguccaccaccccacgcuggacacuggccccaacgcucagacacagcagggcuaaguuaaggcacacuugucaaugagguccuguuccaggcgugccgagaggggcugugaaggccucaccgcacacaggcugcucacguguccguaucuggcggagacagacacuuagcccagcagcucuacaagugcccugcccgauaagacccuggacgaggggguccuguacaaagugccggcagaacggcgagauucgaccugccggggagcuggggaagguucccaggaccagaagcggaggggggcguucgaggcugccccccucccaccuccucacccaccuccucacccaccuuacucauccacgacuugcguuugcacaaggccuuccuccucuucacagccucccacagccgccgcuggccugcagggagagcggggaaccgcgugcugugaaggccgccguagcccgagagaggcugcugccugugguccccuugggggugagccugucacuagacaccgcccacccgaugauagcaaugaaaucaaccccaacuaacccggagccucaacugaccgacggucucugcacuccacuuccuggcacuggcucucaaacugggugaagguguuuaaccaaaaacuugaagcgaugggcuucucccaguucucaggaaaaaucaagguaaugaacagaauuuucucaauguugagguuuuuuucccuccguaaaauuuuuuuaugcuacuggcaucagacac

SEQ ID NO: 18097 - RNA, 10263 nt, Homo sapiens
ugaugccugcugccacguggcugguccuccuccuccugcuguggcugagccuuggggugaagacaggugaggagcuaggcuggcaucugugcuacaggucaaagagaccccaaucucugcucucucauucauucaaucaauuaaucuguuuugucucuggcaugacccaccuccugugacccagcauucauuaauucauuaaucaaauaauucauguauucagacacuuauuaaguaccgacuauaugguugauguggcuucuuuguguauccaguuuuauaucuggauaagaugucuuuggaugaucagcuugggagggucuaguauccagaggaugcucccucggauagaggcagcgugggcacuguggguggcugggguggacgggacaggagggaagguaggugugauaaacccagauccagauuaacaggcagacucacugggcaauuuccaggcaccagucuacuggguuuauucaaacaucccuggaaauacaacagggugaauacaguugcauuuacuagaacuucucucucucucuccucucucucucuuuuuaauuuuuuuuuuuccagacagagucugcucugucccccgccaggcuggagugcagugguacgaucucggcucacugcaaccuccaccuucuggguucaagccauucuccugccucagccucccgaguagcugggauuauaggcaugcaccaccaugccuggcuaauuuuuggcauuuuaaauagagacaggguuucgccauguuagccaggcuagucuugaacuucugacuucaggugaucugcccaccuccgccucccaaaguguugggauuacaggugugagccaccgugccuggcccuagaacuucucuugggagaaaacuagaugucauugguaggaacacagucagcuguugcuuaaugauggagacacauucugagaaaugcaucaucagaugauuucuuuguuguaugaauaucauagaguucacacaacaaugaaaucgagaguuuacauaaaccuagaugguuuauauauauauuuauuuacauguuuguuuuccacauggaaagccacaugucccagcacaugucccauuacugaacaucagucauuuccccugcuugauccucaaggccaauaucgagcaccauauaucggguuucugcauaugcccuauuauaaucuuauggggccaccgucauauauaugguccaucaucggucuaaacaucgugauguggcacaaggcuguacuucuuggcugggugcgguggcucacgccuguaaucccagcacuuugagaggccgagacggguggaucacuugaggucaggaguucaagaccagccuggguaacauggugaaauaccaucgcuauuaaaauacaaaaauuagccaggugugguggugggugccuguaaucccagcuacuugggaggcugaggcaggagaaucacuugaaccugggagacagagguugcagugacccgagauugcgccacugcgcucuagccugggugacagagggagacuccaucucaggaaaaaaaaaaaaaaaaaacccaaagcuauuuauuguggaaaaauucaaacacaugcaaaaguaaagagaauaggaugaugaacccaagguaccaguuggccaccuucaauauuaucaacauuaugcucaagcucuuaucccccauauuuaaaaaauauaaccacaauaccuuaucagagccaaaacaaauauggucgcacaccuguaaucccaacacuuugagagacugaggcgggcagaucgccugaggccagaaguucaagaccagccuggccaacauggugaaaccccugugucuacuaaaaauacaaaaauuagcuaggcaugguggcggguaccuguaaucccagcuacucgggaggcugaggcaggagaaucacuugaaccagggagguggagguugcagugagccgagauugcgccacugcacuccagccugggcaacagagcaagacucugucuuuaaaaaaaaaauuaauuaauuaauuaauuuaaaaaacuacuuacuaucguuuaauaccuaucaguguucauauuucccccacuugucaaaaauaucuuguuauucagcagcaaagcagaagagaaaaagaaaaaauaagaucagaugugguggcugaugccuguagucccagcacuuugggaggccaaggugggaggaucacuggagcucaggaguuugagaccagccuggguacaauagcgagacucagucucuacaaaaaaaaaauuuguuuaaaaauuagcaagguguguugauguucaccuauagucccagcuauucagaaggcugaagugagaaaauugcuugagccccagaaguugcggcugcagcgagcugugaccauaccacugcauuccagucugcugcaccgagugagaccaugucucaaaaaaaaaaaaaaaaaaaaaaaaaaaagaaagaaagaaaaaugccuuuuuacagcugguuuauucaagucaagauccaaaaaagauacgcacacauguuuaacuagcauauuucuuaaaugucuuuaaaucuauaccuagaucagugccauuuuuucaugucauuuagcuguugaacgaaccagguacuguguccugcggcauauccuaccuucuggguuugacugauugaaucuuuguggaugucccucugccucugucuuuccugaacucugguaguugagaucaggacuggagauuucuuaggcaggaagaauccauagguggguacuuccuaucgcaccucgaaggagacacaaaguguccagcugucccacuuuuacugguguuaaacuucauccaccagauagugcacccauuauaaaauucuguccacuaaugauuugugcugagauccacuucucauuaggggcugccaaguagugcuuuucuaucauucuuucugcacuuguuagccgaagguucucugucgugaagauauuucccuugucaacuauuuggcuuggauggaaaggcuggaucaauguuugauucuuuauuuuucaucuucauaauaaugagcuagcuccucggcaccccgggggaaguugucuucaaaugcugccuugaagcauagaauauuuaauucuaauggauaugggagggaagggccuuccaagccgagggaagagcuugagcaaaggcucagaggcaggagaaugcaggguguuuagagaacagcagagcuccguagcacgugcaacaagaggcuuuuugagugaggacccugagcacgauauggugggaaagcaggggagaggucaggauugcugguuugacucccagccaugggcaaaagguucuccccuugucuauacaaugaggacaucucucuagaucaguggcuuuccaacguuucuggccccaguucacuuuaauaaauacauuuuauacucugacccaguaagugcaucuguguguauaaaaaccaacagaaauuucaaaaagaacucaguugacuuuuacauacaauguaugugggucuauucuauucuauuucauucagugucauccuguugaaauaaauguugguuaugaccacugaauugaacucagucucacagauugucggcaaccuuagucuggguggcuccuggggcucuauuuccacuccagcccuuucugguugaucccuggucuuggugacaaccugacgcagcaccaggcucuggagaagagggacaacaugagaagagaagcugaucacuugcaggaggcuccugagcugaacaugaggcaaaagccaggccaaacucagaggcuguggccccagccaggccacccucaccuucagagucuugaccccccagaccacacuaccggacaccugcuggcccuguuuccacaacagacuggcucagccacacccaggcccacagggcucagaggccugcucccuguugaucgugucaacuuugaaaggccuucaaguuuaucccuaaacaaagcccuccaguuuagcccuaaagagccagguguuaaccuaacaggaagcaauuuggaaggucaaagucaaguagacggagaagaguguugagaguccuggggugacaacaccuggguccccugcucaccugagccacagacucgccagguaacugggccagcgucccuccugcccacgccuugcuugccgcacucuuaaagaagaugcauccccuucucuuggagggaaugacaaugaccagaucacaacugagcugagcaauuuggggaaauuugggcaggggguagaguuggcagaacugguuuguaaacagggcucuggaagaccuuccucuaacuguggggagugggggagggguuucucucccucuuaggcacucucuucucugcuguuuucucuauuucucucuucgcugucacucccauuaccguccucaucuuaucucccccuuuucucuccuucucucucucucuguuuaauaacagcuuuauugagagauaauuuacaggaugugagauuuacccuuuuguacaauucaccauguguacauuucaguguuguucaguguauucacaggguugcagaaccaucacugcugucuuauuuuauuuuuuuggcacuuuuugguagagacaggguuuugccacguuggccaggcuagucucaaacuccugaccucaaaugaucugcccgccucggccucccaaagugcugggauuacaggugugagccacugcgccuggccaccucugucuaauuucagaacauguuuguuaugccccaaauaaacucugacccaucagcagucacugccugguccacacaucucaccagccccuggcaaccacuaauauacuuucugucuugauggauuugucuauucuaaacauuucauauaaauggaaucauacaauacacggccuuuugugaguggcuucuuucacuuagcauguuuucaaguuucauuguuguuguggcaugcaucuguacuucauuccuuuuuauggcugaguaauaucccauuauauggauauaccagauuuaguuuuagccauucaucaguugaagggcauuugaauuguuucuacuauuuggcuauuaugaauaacacugcuaugaauauucauugauagguuuuugugugaacauguguuuuuaauucuccuaacuacaggcucagaaguaggguuucugggucauauggcaacucuauguuuacauucugagaaacugucaaauuguuuuucuuuuuuuucuuuuuuuuuuuuauucuuuucugcugccaccucaucuccccaaauugauuuucaaaguggcugcaccauuuugcaauuccaccagcaguguaugaggguuccaauuucuccacacccucagcaacacuucaacacuugcuuuuuuuuuuuuuuuuuuugagauggggucucgcucugucgccaggcuggagugcaguggcgugaucucagcucacugcgaccucugccuccuggguucaagagauucucgugccucagccuccugaguagcugggacuacaggugcaugccaccacacccagcuaauuuuuguauuuuuaguagagacggguuucacuaugcuggccaggauggucucaaacuccugaacucgucauccacccaucucaguguucccaagugccgugauuacaggugugagccaccccacccagccaacacuugcuguuuuauuuuuuaucuuagccguccuacuggauguggggugguaucucauugugguuuggauuugcauuuccuuaugauuaaugauguugaguaucuuucaugcucacuggccacuuguguaucuucuuuggagaaaugucuauuuaaauccuuuguccaguuuuaaauuugauugacuuauuuuuauuuauuuauuuauuuuggaggcagagucuugcucuguugcccaggcuggagugcaguugugcaaucuuggcucacugcaaccuccaccuccuggguucaagcaauucuccugccucagccuccugaguagcugggacuauaggugcaugcuaccaagcccagcuaauuuuuguguuuuuaguagagacggguuucaccauguuggccaggcugguguugaacuccuggccucaagugaucugccugccuuggucucccaaagugcugggauuacaggcaugagccaccgcacccagccaguuucagcucuuacauuuaggucuaugguccauuuugaguuaauauuuguauaugguuugagguaggaguccaaaugcauucuuuugcaugugcuuauccaguugucuaagcaccauuuguuaaaucuaucuuuucuuuuccuuuuuuuuuuuuuuuuuuuuuuuuugagacagggucuugcucugucacccaggcugaagugcgcuggugugaucauggcucacuucagcuuccugcgucugggcucaagugaucuccugucucagccuccuggguagcugggacuacaggcgugcaccaccauaccuggcuaauuuuaaucuuuuuuuuuuuuuuuaauguuccuuuuucuccaggcagcugcucccaaccccagaaccuuugcugucuugggacggaucaccgcugcaagaggggaaguugcuacugugaugaauucugccauguggcaccagacugccacccagaccacaguguccucugcaacccugguaacucacauacaggcccgauuccaccuacagcaaagcuggaugcgauggcuggcagaggcaaacccuuugccugcacuucaggccaaagccgggauguggccuagaugguuccuaaggucccugacaauccugagaucuugcaucuugucuauuucaggucaaaggugccuacaugcuccuucuagcuuuguuucccugauguuccuugccaccugcuacuccucucugagcuacuuuuccagguuccacagggagagguucagcuguccgugguagacaugaggguagagaaugaggugguuggguuccacuuaccuuucuaucaucuugcaguauggaugucucuugacugguaccguguagacuuuugagggcacacaggagucugcagagagauacuggggacauugagcagcagcagugggguugggaggcagaaaugaggacaggaacauuuaccuuguguuucucucagcuucucagaugaccaagauggugcugcagauggugcugaggauggagaacccaccaagccccgcuaggagccaccuagacuggaugcagagcauggugagcucccugcagguucucugagaagggguggauggcagccugcuccuugccuuugugcccuccaggccccaaagucagggaaccaaaagaagaaaggggccguagcuagggcagagcuccacugcaaugauuguuuuagggguaggagccaggauugccgucuguggacacugaaauuugaaucucauauacuuuugugacaaaacauucuuccucuuuuguucuucuccuaccaucuaaaaauguagaaaacauucuuagccuaugaguugcacaaaaacaggcaguggccagauuuggcccauagaccauaguuugcugacuucugcccuaaaucauccuccauuucuuuccuucuguguccuuguuacugacaaagccacuuucccuaaaauggggucuuucccuguuuggugccaugaagccaauaugcaaaaccgaaagugagccucaagcagugcaggcuuuauuugguggccauggaauugagaagugagagcuuggcucacaaaucaacuuuucugcucgugagacccaggaagucacagauacagggcaucuuuagugaaggggcugagcauuaaaagcaaggggaggaguggccaggugcaauggcucacucccauaaacccagaacuuugggaggccaaaaugagaggauugcugagaccaggaguucgagaccauccuggucaacauagugauacacccccaucucuacaaaaauaaaaaugaaaaaagcaaggggaggaaucauguguuuucugggucuggguggagaaauuuucaaaaccagagugccaccuuccuauuuguuuuuuuauguuauuuuuucccaucauugucauguugguuguugacuguuacgguguuagugggacugucauuuaacauggaaauuagauuauaaugaaguuagaggucaaaugagcugccaucuuggauuccaucagucuuagcugguuugaucaccagggagaaguuuggaccucaggcauccugcuuccuaaagauaaacaguguuaaggcaggguagauauucacggaggucauguggguauugcacuggaugacaucuuggcuucagcccugaucuguucagagcccucagcacgguacuggaggagaggccuugggccgcaucguggcauauuguggcuuuggggagaaagaaaagcagauagugcaauggaaagagcguggacuugagagucagacuugacuucaacuccuagcucuaccacuuaccaccuaggugaccucaagccacuuucucagccuuucugagacucuguauccucauguguauccuagaguuugucugauagggcuauagugagaauuaauugaauuaaguauagugagaauuaagccaggucuggagaggccuggcuacuggugagugagguaacugagaucagguauggagaggacuggcuccuggugagugaguuaauugagaugagguauggagggaccugucuccuggugacugaguuaauugagaugagguguggagggaccuggcuccuggugagugaguuaauugagauccauuagggagggaccuggcuccuggcgagugaguuaauugacacccgguauggagggaccuggcuccuggcgagugauuuaauugagacccgguguggagggacuuggcuccuggugagugagugaauugagaugagguauggagggaccugucuccuggugagugaguuaauugagaugagguguggagggaccugucuccuggugagugaguuaauugagaugagguguggagggacccggcuccuggugagugaguuaauugagacucgguguggagggacuuggcuccuggugagugagugaauugagaugagguauggagggaccuggcuccuggugagugagugaauugagaugagguguggagggaccugucuccuggugagugaguuaauugagaugagguauggagggaccugucuccuggugagugaguuaauugagaucagguauggagggacuuggcuccuggugagugaguuaauugagacucuguguggagggaccuggcuccuggugagugaguuaauugagaugagguauggagggaccuggcuccuggugagugaguuaauugagaucagguauggagggaccuggcuccuggugagugaguuaauugagaugagguguggagggaccuggcuccuggugagugaguuaauugagaugagguauggagggaccuggcuccuggugagugaguuaauugagaucagguauggagggaccuggcuccuggugagugaguuaauugagaugagguauggagggaccuggcuccuggugagugagugaauugagaucagguauggagggacuuggcuccuggugagugaguuaauugagacucuguguggagggaccuggcuccuggugagugaguuaauugagaugagguauggagggaccuggcugcuggugagugagguauggagggaccuggcuccuggugagugaguuaauugaggucagguauggagggaccuggcuccuggugagugaguuaauugagaucaguuauggagggaccuggcuccuggugagugaguuaauugagaugagguauggagggaccuggcuccuggugagucuccuggaggcagcugcuaucugggaacacaggcacaggugggaacagaccuucacuuccugcucacuuagguucagugaguucuccaaaccagccucccaggaaugccauucaacauggcugugaggagaauaaagaagagagccugacuccucuccugaggccccuuccccacccugagccagcaggauccacggagcagaggucaucuguccccagcuuggcccacugaggccagcauggcugggcccaggaugcuugucucucagcucccauccuguguacuuccacauugguuuaaccagaggaaaaccgaaaucuacaauugucauaaacacauuuaaaugugcguagaaucagccauacaaauug

SEQ ID NO: 18098 - RNA, 5750 nt, Homo sapiens
ccuuguacuccaaaaaugcugagcaaccucuaucauuuuaagcauguagcaaaucaauuuaagguaguaaguuuuuuaauccacuuaaaaauacaagagcacaaauccacauuuauuuauugauuuuucguuaguuuaaauccuugagggguacagcaucugcagggaaaaaagaacacaaaacauuaggugaauguuauauauacgucuacaaaucaagaaccguaauacggauaaaucucugaaaggcuaccaauuacauguucuagugguaaggaaaguuuuuauagccuucagucucuacgugaacauaccguaagaaccggcacucauaaaaaacauguacuggccaggugcuguggcucacaccuguaaucccaucacuuugggaggccuaggcgggcagauccuaaggucaagagauagagaccauccuggccaacaugguaaaacccugucucuacuaaaaaauacaaaaaucagcugggcauggugguacgugccuauagucccagcuacgcaggaggcugaggcaggagaaucgcuugaaccugggagcuugcagugaggcaagaucccaccacugcacuccagccuggugacagaaugagacucuggucucaaaaaaaaaaaaagaaaaagaaaaacauguacugaagguacauuuaauuuugcuucuucuaaagacagaguaaaagccuccucuguugauaaacccuaaugaaccacuuagcaggguucaacaguacccccuggccccaagaauacaugguaugcauauauucuuggucccaagaauauacagucuacauuccaaaauggacccuaaagaaaaaguacgaacuauuugagaaaaauuacaggagaaaauugagaaaaauuuagaguccaaggcuggcaccaaagaccugagaccuaggaacaugagagucuguuuucuucauguacaaaauaaagcuacuaacaccuguucuaacaagacugacaugauggaaauggcaaaauauuaacaauuaugccaggcguaacuguugaauuguugcuuucuaacaauuacuucagugcccaauaaauaucuucaccagaaaacuauuuauucaaggcuggcugugguggcucaagcauauaaucccagcacucugggaggccaaggugggcagaucacuugggcucaggaguucaagaccagccugggcaacauggagaaacaaaauacaaaaauacaaaaaauuaucugggcauggugguauauacgccuguaauuccagcuacucgggaggcugaggcacaagaaucacaugaacuuuggaggcaaagguagcagcaagcugagaucaugccacugcacuccagccugcgugacaaagugagaccuugucucaaaaaaacacaacaaaaaccccaaaaauuagcugggugugguggcacacgccuauggucccagcuacuuggggggcugagguggaaggauugcuugaacccaggaggucgaggcugcaauaagcugugauuaugccacugcaccccagccugggugacaaagugagacccugucuccccccaaaaaaaaaacaaaaaacaaacaaccaaacaccuaauucuuucaauuacuaucucuccaguguucugcaauacacaaauuuugcagcauaauuuacuggugucaauuucacaaccacagaaguccucagaagucaaagcacaacaccuugaaccuagucugauucaucagacguccauuuugcuaaaaaccauacucaccacucggauucuguguccaauggccuuagcaggaagauugcuucggaauuuggcacgaaccaugccacuguuuccaugggcccgaguuacuuuuccccagaugacucugguuuuguuugguuugccgccaggagugacuguguugcugauuuuaaaaagggaaagaagaggaauacaagcugauauaguuggauacaaauucaaggugaccucuacacgaguggcucucaacccugguuacccacuucaucaccugagaaacuuuaaaugccuagaacaccauucauucaacagauacuuaucgaguaacuauuguaugccaggcccuucuguaaaauacagcagcuauaaaacaaaaaucuuucacaugauaaccaaguaaguuuaaggaaaauacauaggucagaugauaacagaggcaauauugaaaaaauagcaaaaaaggacaagugugaggauauuuguguguacagaaaggaggaauuaccugccauuuuaaauagccaaggaaggucucacugaggugaccauggaacaaagacuggaaagggaggggaaaugccaugaagugaucacgggaugacuagcgcaggcacuggggccaaggaguguguguccuggccggaagaaagacugaagacaccaagggguuaaucccagcugagauaaagagaauuauggagcucuuaaugacgggcuuuuacugaaugagagaaacuacugugguucgagcaauguacaaaggauaugacuuuauauauauuuccuuuaaagaccacgggguugucuugucacccaggcugcaguacaguggcccaaucauagcucacugcagccucuaucuccuggcaucaagcaauccucccaccuagggcucucaaaugcuggggcuacaagugugagccacugcaccugacuuaaaauuuuaaaggaacacauuggcuguagaagaaaagguggggcaaugauuaaaacacuuucccagagauuuuaauuggcuuggagugggugaagacaauaggauuugcucuuguuguccaggcuaaggugcaauggcacgauggcucacgccuguaaucccagcacuuugggaggcuggggcggguggaucacgaggucaggaguucgagaccagccuggccaacauggugaaacccugucucuacuaaaaauacaaaaguuagccgggugugguggugcgcgccuguaaucccagcuacuggggaagcugagguugcagugagcugagaucacaccacugcacuccagccugggcaacagagcaacacuuugucucaaaaaaaaaaaaaagucuacagcauaaacaucuuuaggcaugcauaaaaacuaauuuuggccuggugcagugacuugcgcuauaaucccagcacucugggaggccgaggcagguggauuacuugaggucaggaguucaagaccagagugaccaacacugugaaaccccguuucuacuaaaaacauaaaauuagcugggugugguggcacacgccuguaaucccaccucacucggaggcugaggcaggauaaucgcuugaacccgggaagcagagauuacagugagcugagauugugccauugcacuuuagccuggauaacaagagcaaaacucugucucaaaaaagaaagaaaaaaagaaaagaaagaaaagaaaaaacaaggggcggggcaccguggcuccugccuguaaucccagcacuuugggaggcugagguggguggaucacaaguucaggaguuuaagaccagccuggccaaaauggugaaaccccaucucuacuaaauauacaaaaauuagacaggcaugguggcggccgccuguaaucccagcuacucaggaggcuaaggcaggagaaucccuugaacccgggaggcggagguugcggugagccgauauugugcuacugcacuccagccuaggugacagugagacuccgucuccaaaaaaaaaaaaaaaaaaaaaaaaaacccauaauuuuaaggcauuaacaaaaugcauuaagcacaaguguucuaaaaauccuuaaauucuggcaaaaggagccgagaaaaaaaauuagaaaccuuaaaaggaucacaauauaaggaauuaccuccuuuauugcuuacaagugcaaaagguaccuaaauccaacaccacccucagaaguaacguccuucuaaaacuccccauuaaguuccuuaaugacgcaaaauagaagccacagcaauaccaauccagccuggccaacauggggaaacccauucucuaguaaaaauacaaaaauuagccgggcgugguggcacaccccuguaagcccagcuacucaggaggcugaggcaggagaaucgcuugagccaggaggcagaggcugcagcgagccaagaucgcgcuacugcccuccaaccugggcaacagagacucuugucacaaaaacaaaaaaacaauaccaaguacuucagcuaaaucuuuuguuuauuauuucaauaggauaaugaggccaggcgcgguggcucaagccuguaaucucagcacuuugggaggccgaggugggcggaucaccuaaggucaggaguuugggaccagccuggccaacauggcaauacccugucucuacuaauaauacaaaaacuagccgggcgugguggccggcgccuguaaucccagcuacucgggaggcugagacaggacacuugcuugaacccgggaggcggagguuucggugagggagaccaagucacugcauuccagccucggcaacagagcaagacuccguuauauaaaaaagaaaaugaggcagaucucaaaaacccaaaaccuaccagugucauaaacuuacuucuuugcuuuauauacauaagcgcaucucuugcccaaauagaauucuguuucaucucgggcguaaacaccuucaauuuuaagaagagcugugugcucccuuugguuccggagaccccgcuuauagccagcaaaaauggccuuggaccacagccuaagacacaaaagauacacaacaugaaacauaagcuucaaaaaaccaaucugacuuguaaucacccccacccaaaaguuacucagagcaaacaucuaaguuuuuucuugccaauuuuaagcucgcauuuacguucacgucuaacacacaaaaauaaagaacuauauuuaaaacgcguaccuuccagacauaguuccuuuuagaagucccguucccagcaggccuuaaaacaaacaaaaagauuaguuuaaaaccaagccacacaaguuucccaccucguccccucucguuuaagccccuaaagcaaauuccuuuuggaugggaguuucauguaggaguucggggacaacaaugccagaacauccauaugaaacgcaggguccggcaagacauucaaaccucagagaacagcugguaucuaagcaaacuucagaaugaagacaaaacuaagggacaggagucacaaaaaugacucucagaaaagccugagaaaaugcaugccguuaucaguaggcaacacucaggaaaagaaaugaagccuuaaagagaaacacacacguaagacuuuuaugcaauggcugggggagaaaagcugaggaaagagacuggucagacaagccaaggaagguauggacugggaggaaacggaugaaggaagcacugccucauggacaacugcacacgaacaaaaacaucguuucacuccguucaggcccaggaauuuaacugggauaacccgggcagccguucuccgggugucaggggaccaaacaccaucagcccaacaucuccuccauccuguucucccucuucuugaaacccguagaaaucaauggcuggcagagacuccgauacgcaccggcgacucgccaaggcacaggaacaaaccuacuccgguuauuugcccccaaauuucagcagcagacccuucacucaccuccacaggagccaagauggcgguaagagaaggacgaggccccgccgcguggccuugugggau

SEQ ID NO: 18099 - RNA, 1751 nt, Homo sapiens
gauuuaugaacaacuuagcacuugaagauuauaaaugagcugagguuuuaggaaugaaugaaaauuugcucccaggacagauaaagcauuccaggaagagaaaauuguguguuacagcuugaaauaacuaagugggcagaaaaauguuucuguacuugaaaaauugagacccgacuuuguauagaaaguacuucaagguaccacaaucuguuaccaccagugagcauuucccauccgguugccauagugaaagcuugucaaggaagcagguuuggaaaauuuuaaaaagggauguuuguagaaaauuaucagaggucuccagggcuucaugaaacacuuacaacagaacucaagcccugcuucaacagaacgcuucacuuuccucaaaaccuugcaaaggccaggcgcaguggcucacgccuguaaucccagcacuuugguaggccgaggugagcggaucacaaggucaggaguugcagaccaggcuggccaaaauggugaaaccccgucucuacuaaaaauacaaaauaaauaaauaaauaaauaaauaaaaauuagccgggcgugguggcgggcgccuguaaucccagcuacuccggaggcugagacaggaggaucgcuugaaccugggagacggagguugcggugaccugagaucgcgccacugcacgccagccugggcaacaagagggaaacuccgucucaaaaagaaaaaaaaaaaacuugcaaguauuaccuuuugcugaauguguuacucaaccugcugaaaguuaacaauuuauagagcucugaucuuuccgggagaaaacagacccaauaauaacuggcaaggcagaggcccagaaggagcaggucagacuacgccuccaauuucuuuugaguuucguuggcuuuaggaucgccgugccuacuucaaguguucacuuuccccuugccuuucucuuugucucucucuucaccagcugccccugcuuccugggucuccuggcuuaagcagcugaccagguccuccgcgggcuugcguguccucccacccccgguuccgccuccagcugcagcuccgggagcccucuagguugacaagaggggcgaggcgauggcuagcggaggggcgggcgucgcuagcugagagacugguuggccgcgggcgcggcggcggcgcaggcgcacuggguucgccgcgccgaacugcagccauggagcaggcaccuccggaccccgagcggcagcuccagccggcgcccuuggagccgcugggcuccccagacgcugggcugggggcugcggucggcaaggaagcggagggggccggagaagagagcucuggggucgacacggugaggagaaggggcggcagagcccucauggccugugugguggccuagcgggccgggcugggcugggcugggcugggcugggccgggccgggccagugggcucggccgaggaggcccagcagugagggggagcgagguggaaaggcgggguccgcaggugcagugagaggaggcucaguggaaaaacagggugcuggguguggggcgagcgccaggcgcugcgggugacugagggaagugucgagacugcgaaggggagggaaagggacccgggggggcgcccccgcaggcgugggggucugggccccggaugggcgaggcuggaggaggggguuuucaguggucgcguagcugggagaucuggaccgugagaagaacgcugauguuucagccaguugcuaagggguuuugcug

SEQ ID NO: 18100 - RNA, 1751 nt, Homo sapiens
cagcaaaaccccuuagcaacuggcugaaacaucagcguucuucucacgguccagaucucccagcuacgcgaccacugaaaacccccuccuccagccucgcccauccggggcccagacccccacgccugcgggggcgcccccccgggucccuuucccuccccuucgcagucucgacacuucccucagucacccgcagcgccuggcgcucgccccacacccagcacccuguuuuuccacugagccuccucucacugcaccugcggaccccgccuuuccaccucgcucccccucacugcugggccuccucggccgagcccacuggcccggcccggcccagcccagcccagcccagcccagcccggcccgcuaggccaccacacaggccaugagggcucugccgccccuucuccucaccgugucgaccccagagcucucuucuccggcccccuccgcuuccuugccgaccgcagcccccagcccagcgucuggggagcccagcggcuccaagggcgccggcuggagcugccgcucgggguccggaggugccugcuccauggcugcaguucggcgcggcgaacccagugcgccugcgccgccgccgcgcccgcggccaaccagucucucagcuagcgacgcccgccccuccgcuagccaucgccucgccccucuugucaaccuagagggcucccggagcugcagcuggaggcggaaccgggggugggaggacacgcaagcccgcggaggaccuggucagcugcuuaagccaggagacccaggaagcaggggcagcuggugaagagagagacaaagagaaaggcaaggggaaagugaacacuugaaguaggcacggcgauccuaaagccaacgaaacucaaaagaaauuggaggcguagucugaccugcuccuucugggccucugccuugccaguuauuauugggucuguuuucucccggaaagaucagagcucuauaaauuguuaacuuucagcagguugaguaacacauucagcaaaagguaauacuugcaaguuuuuuuuuuuucuuuuugagacggaguuucccucuuguugcccaggcuggcgugcaguggcgcgaucucaggucaccgcaaccuccgucucccagguucaagcgauccuccugucucagccuccggaguagcugggauuacaggcgcccgccaccacgcccggcuaauuuuuauuuauuuauuuauuuauuuauuuuguauuuuuaguagagacgggguuucaccauuuuggccagccuggucugcaacuccugaccuugugauccgcucaccucggccuaccaaagugcugggauuacaggcgugagccacugcgccuggccuuugcaagguuuugaggaaagugaagcguucuguugaagcagggcuugaguucuguuguaaguguuucaugaagcccuggagaccucugauaauuuucuacaaacaucccuuuuuaaaauuuuccaaaccugcuuccuugacaagcuuucacuauggcaaccggaugggaaaugcucacuggugguaacagauugugguaccuugaaguacuuucuauacaaagucgggucucaauuuuucaaguacagaaacauuuuucugcccacuuaguuauuucaagcuguaacacacaauuuucucuuccuggaaugcuuuaucuguccugggagcaaauuuucauucauuccuaaaaccucagcucauuuauaaucuucaagugcuaaguuguucauaaauc

SEQ ID NO: 18101 - RNA, 2512 nt, Homo sapiens
cccugucuuugauaacuuauauucuauuuggagaaacaugggggguaaaucuuggcuaauaacuagcaaauauaacauguuaggccaaggaguagagauaauuaagagaacuagucgagaaggcauuggcuauuaaaaaauggacaggauuuaugcaaacucucaugaaaggugggacuucaugauccuacagucaaucuagcuguucugggcuuugaaccccagcgaccccauccagaagaaaccaggagaagcacaaacuggcgcuagguucgcuaccauccaccugacccuugagcccggggaaacccacgggugcagcaagccgggaaagcugcagacgaggcaggcggaagaggcgggacuucgcgggugacgucaucggggcgccggaggcccggggcgccugggaauuugaagcaaacaggcagcgcgcgacaauggcggucgcucgugcagcuuuggggccauuggugacgggucuguacgacgugcaggcuuucaaguuuggggacuucgugcugaagagcgggcuuuccucccccaucuacaucgaucugcggggcaucgugucucgaccgcgucuucugagucaggugcuggccuaggaagggaaaggacagggcuugguggcgggaaggaggacaaggaaauggaagagggugacaggaguugggccgugagugagagcaaaagagccaagcaggcagaccgacccuacucuugguuuggggaguaagcaugagaagcacagaggccagggguugggcuccucgagagucgucuguucuuucacccacacgcuuagacacguguuuugcaaaagucgggaaacccaguuuggaacgcuuucuggcacugaagcacacuugaaugaauucuguauauuuaacucuuuaagaaaauuagacuugcggccgggcguggugccucaugagaguaauaccagcacuuugggaugccuaagugggcagaucaccugagccccaggaguucgagaccagccugggcaacaugacgagaccccgucucuacaaaaaauuagcugggugugguggcgcacgccugggacgcugaggugggaggaucaccugagccugggaggucaaggcugcaaugagcugucauugcgccacugcacuccagccugggcgacaagugagacccugcccucaaaaaacaaacaaauagaccgggaaaacguggguaggcagagaauucaguagcugggaaauuacuggugagaaaaggaaaauagaacaaccagaacucugugauguauacaaaauuuaucagagcccagagagacuucaaccauacuccccuaugcagccccgggacaauuauuuaaaggaauuuugucccugacuagcugccucucccauuaucuuaauguaccuggaaugugugauacaaagaacaauguauagcuaaucaaucgcuuguguuauuauuuuauuuauuuauuuuuuagaugggaucucucuuacgucacccaggcuggagugcagcucugugaucauagcucacugcagccuggaacuccugggcuuaagagaucuucuugccucgggugagcacaggggcucaugccuguagucccaacuuugggaggcuuucuuugggaggcugaggcggguggaucacuuaaggucuggaguucgagaccagccuggccaacauggugaaacccugucucuacugaaaaugcaaaaauuagcugggcaugguggugcacaccuguaaucccagcuacucaggaggcugaggcagaagaaucaggagguugcaguuagccgaaauugagccacugcacuccagccugggcaacagagggagacugucucagaaaaaaaaaaaaaaaagagauccucuuaccucaaccucugaguagcuggaacuacaggcaugugccaucaugcccaccaaauuaaaaauuuuuuuuuuuuguagagaggaggucucaccauacugcccaggcucgucucaaacuccuggccucaaaagauccucuugccuuggcggcuucccaaguagcugggacuacaaaugccuggugccacccccgggcuaccuccuguuauuucaaugcaaauucuuggugaauauaggaacugccccuucuuuugcuuuaaaaauccacuuguaacuacuguaaucgaagccuauagucagggcaacuacucauauuaauuuugccucagccucuuccuguuagguccacacuuggaagggcuguuuggaaaggggaguugaauuuugcacugugcggccagaagcaauaauuaagacuagaagguggacauauugggaaagcagguuuuuagucaauauaaggaaaauuuuuguacaaauuagagguuucuaauacagugcuucucaacuuugaguauauaugaauuaccugggaauuuuguuaaaaugcagaauccauuucuguagcucugagacuagaccugagguugugcauuucuaacaaagugccagcugaaacugcagaccacacugagua

SEQ ID NO: 18102 - RNA, 4268 nt, Homo sapiens
caggaucaacuggggagaaauuaggaggagcucuccuagagucuuggugggaagugaaagggcaugaaggagguugggcaggggagguagauaggagcucagaugagaugugcaacaccacccaggcuggagacaggcuggagagagcacugggauggggugagaaaaggccacuggcucuguuauugggaguucacugggcacuucagggugugggcagacaucagacuuccagggauucaggcaagagugagugaccagaaagugggggcucugaggcugcccucaguccccggggugccugccccugccucugccucugccuggugaagcugggcgaguacucacucucaguuccuagcacgggaggaagagagcucuugggccuccgggauuucaucucuggggccuugguguucucacuggcuggagcaucuggaaugaaacagguaacaauaaauguuagcagcugcugaggaaaugagcaaagggggucucucagucaaaaucccaccucagccaaacuccuccccaacucugagggcccuuugugcccgcugggcagaacagcgccuguguccaggcaaccuauuucacucuccaugagagcaucaaagaaggaccguccacuacccugggccugauuaauccaguggggacagcaccgucaccuuggcaagaugagcgcacaggcugcccagggagcuugggaugcucccccggaaugccauugcuggcagagucaccccuugcucaccuucccuggcuuucuccuccaucaggccuugucucccucaugcuagaaaucuugggucuccucuccaacaggggcgggaggggacaggguccccgcccuugggaucauggacuagagguggcgcacagcuucugauuucucugacuuucuucugcagaccaaacuuugcagugacaaaccaaacggaggccucugagcacacagccagcaugccucccaccucugagacggggucuaggccccacuguggggcuucugcuagaccucccccaacaggcccagugaagcugggcacagcugccugcugggcggaccuaaagaugcugggcggugccugcccucaggcucuguuccacacucccucugccagaggaaacccuuccucauggagggcaagcagggcgacaucacuuggcugggcugggcugggcuggguggaaaggcccucacuggcccccaggacacuauggggaaaccauccaggaacugggauaaggaggagcugguugaguggcuaucacugggccccagcacuuucacuggccuuccuuuccccacaaggagcacucuuuggggacggcgcugagagagucucccccuugaagcccccucccugggcauccuuuuccugcuccugaggagaggaagcuaaguggggguggggguggguggggggacuuuccagcagaggcuccgccacauuccugaggcuuggcuggggaggaagugcccucucaugguccgccuccaggacuggcagucagggcugaucuugccuagacugggcuccuggggcucugaggggugggcgcagggagcagaacugggggcugggaacauacuucucccagcaaguggacucugagcugccucuggaugcauuucuccuucugggaggcauuuaggccccucgccuucuccagaacauggaucugccugcaugagucccucugcucaucaucaccccgauaggcuuucuucccaaccuagugccugccuccucucugcuauggguaauccagggaggaggcccugugcggguguugcaggcucauggcagcucagaagcagacaggccuccgggggcugugggggcaaucccccaccaaagacagccgaaagcccugcaugcaccauugugggccuuaaguaggacuacuuagcaguaugugacgggguguuggggggagcagacagccaaagcaacccuuucaaguagcacuugacaccaaaacgcucccuugccuccacuccccacugcaagcugaacuccugccaccucccauacgggcaaaggagccccagauggcacaucaggggucccugcuaucuggaguggacacucuuaagcuccucaggaggcugccuguaacccagcaugccaguuccaugaggacacagagaagcagaaagccauggggcagggaugauuucauuuucuuacacuggacauuuuccccaaggaucguggucauucucagcuacagaaaaauccucuggacauaguuauuugucagccucgguggaucucagccucagcuguauguuagaagcacgugugccaggguaucacaccccacagguccugguuucauuggucuggguuggggucugggcacgauaugauccagaagcuccauggaugacugauauuuggccaacagaaaacuccucgucucuccucaagcacagggagugcgcagggaguggcuccaggacuauuccaagaggcagaaaaaccuagcagagccuccccuugauaucuggggaugagggugccauaaaccaggggcauggagucagucuaagcuucccuuguccgggccucucccuucuucccuuccuugaagaccagcauuucuaacagucaccaaugacaauguaaagaaagguguacccaguaauuguuuuguuuggccccuuuuuuuuuuugaaauggaaucucacucugucacccaggcuggacugcagugacaugaucucggcucacugcaaccucugccucccagguucaagugauucucaugccucagccuccugaguagccuccugaguacacgccugacuaauuuuucguauuuucaguagagaugggguuucgccauguuggccaggcuggucuugaauuccuggccucaggugaucugccugcgucagccucccaaaguacugggauuacuggcgugagccacggcacccggcccuucuuaaggaagaggaguacagggcagacuauguaugcaguucugcacuccuuggcuucagcacucauucuccuggugagucuuggagcauagaggagggagaagaagaaggaucagguuugcuuuuuuaacugaugaguaagcugaggcacaagaaagcaaaguaugagaggcccaguuuuccugggcuccugaaagaagggcagcagguacugagacuccuuucguccucaugggguuguguugggcuuuacuuccaagcaucaccacaguagaggccaagagaguacagcucuagcuuuggcuuugucaucagcaaccuugggaacuugggcaaauaauuuaaacugucccaucucuguuuccacaucuguacaagggaaucacuuauuuucucuaccucaugguguuuugacgcccaaaggagagaacacaugcaacgguguuuuggaaagcaggaaaugaucauuuaucagcccagcgugguggcucacgccuguaaucccaggacuuugggaggccaaggcaguuggaucacuuggacccagaaguucaagaccagcgugggcaacauggugaaaccccgucucuacaaaauuuacaaaaauuagccaggcacuguggcaugugcuuguagucccagcugcuuuggaggcugaggugggaggaucaccugagcccacagagcuugaggcugcaaugaucgugccgcugcagugaucaugccacuuaacuccagcauggaugacagagugagacccugucuccaaaaaaugaaaaaaaaaaaaaaaaaaagaaaaugaaaaugaucacuuaugaauuaauuccucuugauagccacauucccuuaccuccuucugaaucagcuuuaaaauuuuccaccuucagaaaacacucccugcccugccccaucugccucugccuccguccucggcccuagggugcuggguuuucacuggacgugucaguacacuacccuguaaugugcuuugagucuuauuuuuagaaguuucugcagcacuuuaucuuuccaucuggccaugaggaaaggggcugaagucccccuuucaaacuaggcacaccccagacucggagccccaggggguggccgcgcuccacuugaagugucagcacgguggggcugugcaugcaccacggggcccugccagggaugcggagccagcagaccuccaugcgaacugcagcaaggagugggcucgaagggccaugugccuaaucaaaaccagcuuugugcucacauggcugcccaggggauaaaaauaauaguaauauaaguuuaagagcag

SEQ ID NO: 18103 - RNA, 73691 nt, Homo sapiens
cacguuggacgcgccgcagcgucgccgaaaggucccucccaggccccacaaugcacuucggggcgcgucacucggagcggcgggucccgucucgacagguacuccccggccccucccaguccucuucuuccuuucuuaggggucguucgaaucccugccggccucuccccucccgcucccugccucucgccacagccucggccuucgcccucgggauugaagaccuaccccacgggcaggagccaaguccgugccuuugggaugggagucggggccgcggagcucuggagggacgggcaagcggggaccccguccccuucgacuugaggguucucuggggccaggcgggcggcgguugcgccucgucugagccgccucggguguugggcagccaggaaaggaguguuugaaggggagggacagucgcacuuggcugucagcauggugguggggauucccuggcgcccaggugucagaaacacggugaucuaccuguguagguggcccaugagagcuugagguggcauuuccuauuucuuuuaggcagaaugggacuugaaccagugucuuacuuuacguuuuguggggauggagugagcccugagcccagauauuugcccgcguuggcucacggaaaucucuugagacccugucucaagagucacuuugggaacgauguggcagaagggagaccugagcaauuggcucggcaaguggaggaggcuuccaaaagaaaaggacaagccccagcuggcuugaaucucucugccagugaagacagcuuaagauaauuuuucccugcugcuuaguuuccuggaucauccaccuggggcagggggcgagcuugagaaccagucccuccuaugccuauucagccaaggcaaagccuagcccagagcaaaaguaucagccaccagacuggagauguugggaucuucagucaggggaacagccacuuuucaaacucugaaucacuuuccauguuacugauauuugcuuacaugcuaagauuguaaggaaucaggcaaugccuuaaacgguaccuacaauuucugauauauuaagguucauucaguauuugacucugacaccugugaccauauccuaaaguaaugggacauucggguauuuccuauguugaaaaccaucacaucuguuuagugccuuuuuuuuuuuuuuuuuuuuuuuuuuuuuuuuuugcgugcaacugguuaaaaucgaaguauaucuuauguugguauaugaaagaggccuaggucuuaucacaggggugccugugaccuuccuugagugucucacagaguuguuagaauugggccugaguuuaaaucccuacuuugucaccuacucguuuagggauuaaaaaaaauuccucaagcuuucugggcuugaauuuccucaaagguaaaauggaacuaauaauaccuaucucacagguuuuuggaacgcuuaaaugagguaauguguauaaagugcgugguccauggagaguaaucaauaaauaauacagcaaauauuuaauguagugcuuuuagcauguuacaaggcaauguuucaggcacuuuacaugauccuaugagauagauacuauugucaucuuuaaaacaagccuaugagauagaugcuauuaguagccacaauauauagauguggaaauugagauauagaaaggcaaagcuuguccaaauuuacauggcugguagaugguggagccaggauuagaacccaggcagcaagugaauagauaguuucuauaucccugguuucuugugucuuguugguuuugggagacugaugaagcauagugauguagagauacuagaaacuuagaccgaaguaccaguucugcuauauacuagcagugugacauugagaaagugagccuuaguuuccucaucuguaaaauggugguuuuaccuacccaaccgugaacuauguggcacuauaaaaauguugggauugacacauuugagcauguauugggggcccuguccuagauguggguaaaaucuguugugaagccugaggucuuauacauacugugcagugcaagcacccauaauaggaaugucgaacacugcuagugagguagaaggcauaggcaaaauggcggaaauuccauccccuuuaucacccacucuaucccccacccucagcgagcacuuuuaauaaaauaauauguaccauauugguauuguuucccaaacuuugguacugucacauaugcaagauaauuugauaagcaaaugaacauuaaaaaauucuccccaaauuuucacacacauacauauuugaaugaaacaaguucauuuaauuuaaauuaggagaaaaacuuaacaucucaaaacugauuucacagauauuauugcuaaaaaauaaaggacaagaaaaguaagucaauucaaagaccaauauuagguaaauaguacagguggaugaagauaauucugaaagugguacuuggaugacugaagacugggaaguuaugaacuaaaauaaauaugagugcuuuugcccccaguauaaaauguuuuuaucuuaaaaguggcauuugugaaagcauuugguuagaacguauauacaaaauccacuuacauguugggcuuuguuuauuaccuuuugagagauaacuuccugagacauugagccuguagucauuaccccuacaagguucugaagaagaggggugucuuauuaucuuggguccaggaacuugcuaaccacuacuauaguaguuuggcauugugggaauuuauuuuccucagccuuuacauaaaaguuuacccagauuuaccuagauucuagcuugugcuuuuuccuccaacaguugcugauggggagaggaaaaaauagccacuauucagguucccugugaguuaacugcugcuguacaaaggcagguguaauauuuucucuguauuaaaggugaggagaaauggcccagugcccuaaacauuuaucuauggccccgauaagcuaaaaacuccuaaaucuucccaugcaauuguuguaaucucuugcuuuccacaguuccacugguucuuccuugggauuuucccaaccacaacccuccuuaagaccuuaaagauacuuuaaccuagcuuaggccugacauggacagauuuccuuuucugcuagcacaguccagauaagauuaguuuaaaaaaaaacaaacuauauuaugaauccgugguaaaaagaaaaaaaguagggguauguuuauugaauugauggagagacagcuuagccuaaggugguuggaaucugucuacaaauuaguuaagccugacguugaucauuggacauucauccccguuugucaggcuuaaauucaagugcuuuggaugcugaaucaaauuacugugguagaaagagguuuaauuuuuucccuaagaaaaaucuuaucuauggauaaguagaaaccauucucugacaaccuuguaauaauuuugacagggaauguaacuacuguguucugcuuuugguuaaaggcuaaaguacauauuaggaaaauuugaggcugggcgcaguggcucacaccuguaaucccagcacuuugugaggccgacgcagguggaucacuugaggucagaauuugagaccagccuggccaacacaguuaagccccaucucuacuaaaaauacaaaaauuagccaggcaugguggcgggcaccuguaaucccagcuacuuggcaggaugaggcaggggaaucgcuugaaccugggaggcagagguugcagugagccauugcacuccagccugggcaacagagugagacccuguuucaaaacaaaacaaaacaaaacaaaaaaacaacaaaaaaaggaguauuugaaauguaaguuuguccaacuuuaguuuuccaguuagugaaguggugggcaacacaccugcauuguuugcucuuuucaacugaguuucucuaauugaggagugauguuucuugaugguaggacucuucauuccugcuaucuggcauaauucaugggacacauuagauauucaguaaauguuugguaaacgaauggaacuuacaaauuguauucuuuuuacaguauguguuuuagaaagcauggaucauauauuuauugaucuguccuccaagucacuaaagaauaacuuugaagacuacaugaaauuuggcaaccuauuaaugaagucuauucauaauauuucuauuaggauccuagagaggccagacauaaaauaauacagucuacuuuuauuuuacuuuuugagacaggaucucucucaucacccagguuggacugcaguggcacaaucauagcucaccauugccuugaacuccugggccugcuucagccuccccaaagcaaguacuauaggcgugugccaccaugcccagcugauuuuuaauuuuuuuuauagagacagagccucaccauguuucuagguuggucuugaacuccuggccucaagcaguguugggauuauggguauaagccauggcaccccauccaaucugcuuuuaaauacuaaaauguggguauuuagaacugcaaguuacaacucacccucaaauuaauucccagaaugguuauuguguugcaguguacuucuggaaagacaacaguuuuauaguuaaauaauaaacgcuuaaggggauagaguaagacauuuuccuacuuucuuacacuuaggcuaaauguuacaauugugauuuaauaauuaaguaaaacaugguaaaaaaaaaauuaaagagggguuuauaguauagauaucucuucagggaucccaacuuuuucaugcuacugcuuuuaggagagaaaaaaacuagaugaauggaaaaaaacaccaauugggauaugucacacugggacuucaguuugaagacuccacuguaguaaaaagacuaauuugcuucuggauauuuuucucuuuaaaugaauggagaggcugggcgugguagcucaugccuguaauccuaguacuuugggaggcugagguggacagaucacuucaggccaggaguuugagaccagccuggccaacauggcgaaaccucaucucuacugaaaauacaaaaaugagcuggguguuguggcgcaugccuguaauccuagcuacucgcgaggcugaggcaugagaauugcuugaaucugggagguggagguugcagugaacugagaucgcaccacuacacucgucugggugacacagugagacccugucucugaaggagaaaaauauuaaaggguaaugacacaguaacaccuagagauuucuccuuuuuccucaugaaaagaggaaaaagggauagugaacuuaaugcauuagauuuauuaguuggguuaauuuuuauugucagaucaguuaucaccaugaaugggaagucauauuuugacuucacacagcagugaaaacuaucagcuccugauuuacaagcuuuguaacaacugguuuucugugguauuuuuuuuuauauauauuacucauuuuuuccuuuuuggaaugagauaauauugaccuagauuaagugggcagguaaggauuaauuuagucucuaagauacaauauuuuuggaaaaaugccugugagauuuuuaucagauuuuugaauuuucaccaguugccucaccacuagugaggaagccuuuagugacauugugcuuugauggccugacagagaagaguuaucacuuaaucuuagauagugaacauguuuuaauuuaauguuuuaaaaaguaugggccuuagacaauaagcaaauugucaagcccuaucccacagucagugguucagaauuuugagggcagagcucagaaaucugcauuuuuaacuaaacuuucaacuucuuaugcaagcuaaaguuugagagccacuguguauuuuaugaaagguugagugacuguugaccugaguuccuucagacucaggccugugaaguccuuucaucuguuuuuguaaagcaagaagagaauccaauaaaauaggccauuaagauuuacuuucugguaaaaagauugagaacaacauuaaaaccaauauuccuuuagcuuuaggauuuauuuuaaauaauuuuuuucugauuauaaaaguaguauaugucuacugugaauauugagaacauuuaggaaauuauaaaauaauaauaaccaauaauaccauuucuuagaggugagcauauucuuaauuuggcaucuuuuucugcauccguuuuucaaucccuuuuuccuucucuuuaucuucgucucuuuauccuuauguuuguguaaaacaacauuugcaauuuuuauccuacuuuuuucuccuuaacauguaagcauuuuaccacauuauuaaacuuucuccacaaacauaacuuuuaguugcugcauuauauucuguuauaugaauauacuauaauuuacuuaaccaucaccauuuuauaggauauuuagauugcuuucaguuauuugaguggaagaaugucuuucuguuuaaaauuuugccuggauuucugauuauuuuucucaagacagguauauauuuaaauuuauugagguuaaaagguaugccuucagacucuuguugaaauugccaaaucauuuugagaacuguuuguaccaguuuuuacuuccaucuguacuuaugagaaugccagacagaaguauuauuuuuuaaaaagcuaauguggcugggugugguggcucaugccuguaaucccagcacuguggcaggcgccuauagucccagccacauccuaugcuguggcaugggaacccaggcugaggcaugagaauugcuugaacccuggaugggggauguugcagucagccaagauggcgccacugcacuccagccugggugacagagcaagaugcugucucaaaaaaaaaaacaaaaaacaaaaaacaaaagcuauauguuaagugaagcauaguauguuguuuuaauuaguuuuuuguuuuuuuuuuccuccugagacggagucucacucugucgcccaggcuggagcucagugacgcgauuucggcucacugcaaccucugccucccggguucaagcaauucuccugccucggccuccugaguagcugggauuacaggugugcaccaccacgccuggcuaauuuuuguauuuuuaguagagaagggguuucaucauguuggccaggcuggucucaaacuccugaucuugugauccacccuccucagccacccaaagugcugggauuacaggugugagccaccacaccuggccauuuuaauuacuauucuuauauuacuaguaaguugaacauuuuuacauaugcuuaucaaguuuggcuuuaauuuuuauguaacccaaauuguucauuuuguuuuaggucuucucuguugguugaaaugucuaugauuuuaucugccucagucauucgugucagagauggacugccacuuucugcuucuacugauuaugaacaaagcacaggaaugcaggagugcagaaaguauuuuaaaaugcuuucgaggaaacuugcucaacuuccugauagauguacacugaaaacuggacauuauaacauuaaguaagacuucaguuugcuucauuugacucauuugcccaguaguugucauuuuaaugaaguuuaagugguugcaauagaaaggagugauuaggaaaaccuguucaagucgagcaucauauuguucugaacuuauacuaaauagucaucaugucagcagcagccuuuuuguaguuucuuuguaucuggcucugggaaauuuuauaguugugcagaucauagauaucccucuuuuaaguugaucacuaaauauuuauuugcauucuuacauaccuaggguuguaguaagcaaacuauaauuggaaauaaaaauuuuuuaccugauaucugcccucaaagaacugaagcaacuuacgucuagugggaggggguagcacuuaucacugagucacauacaaaucaaguaaaacugggcaaugggauagagagugacuauuuauuguggucaagacacucucugagagggugacauuugagcagagaccuaaaagaugagagaggagguaauuauaugaaggaugcuguggaugaagagcaaggcagagguagcagccaguggagaagcccuuuuuuacaugccaagagacagaaagaaaaccagugauccugaagaauuauggacaauuaauagaguugcagaaagugaggccagaaagguaggaauggggcaaguuauguagugaguuuggagucuauuagucuguuuagucuaaugcaguaggaagccauuggguaguuuuaagcuauagaguuacaugauuucauuuggcuuagaguagaucauucugccugcacugugaagaauaaaggaggaaguggaagcagagaggucagauggaagacucagagaaguucagguggaggugcugauuguaacgagcuaggguaguaaugaauagaaguaguuagauuggggcuauauuuugggauuaauaccagcaaaucuuccuacuggauugaaauaggaugugaagguaaaagaagaauaaucaccuguaguuuuuuggccugaggaacuggaugaauaauguagcugaaaugagcaagaaaggagaggauaagugcgucuccuugguaaaaaguaagaguucuguuuggacauguuaaaucugagaugcccauuagacauccaaggggcacugcuagguaagcagcuggauauaugagucugaagcuuagugaagaggacaaguauagacauuuagauuuggaagucagcuuacaguuugugauuaaaaccaugggaauggaugagaccaccuuggaaagcuuagacgugaaacaauuagagaacaauuaaugucugauaucaagcuggauauugauuaugcauacagaaggaaauaagguaaaaacacaguccauauaggauauaauaagcagagggcuucguuguugagaugagacaugagccauguccugaagaauuaauaagaguuggcuaaggcagggaggagggcauuccagguguacggaggagaggcagaauaagcaaagaaugugacuuagcaugguagguguauuaacaugcuuauccugggucaguggauggugauuuauggauaguugugagacaugcgugauaaucauuguggggccagauccuggaucgcccugaaaguucagauugaaggacgugacuuugauguaauauguuauaggaagcugugcugcagguucaagggaagugacuugauaaaaacaauccugagacaguggaacuuagggugaguggacaguccaagaggagagagauaaggcagagaggccaacuuauuagggccugaaguaagaaaauaaacgugcaaaugaaaauuagaacaccaaaagaacuagaaugauaaugagaaauaguuugauuggggaucacuuugaaguuggaucacuucaaaagaagugaccaagcuggauaggauggaauaccagagaugaaaagaaggaaggggcaaagaugacugaagccuuggaauuggacagaauguuggugucauugccagaaaugagaucuuuggaacagacuguuuaugaggugugaggcagaagagaaagauaaugaagcuccauuuugaucauuuuuuuaagacacuggggcuugcucuguuaccuaggcuggaaugcaguggcaugaugacagcucacugagccucaaccucuuggacucaagugauccucccacuucagccucuugaguagcugggacuacaggugcacaccaccacacccagcuaauuuuuuuauuuuuaguagggaugaggucucaccauguugccuagguugaccucaaacaccugggcucaagugauccuccugcuuggccucccaaaguacugggauuacagacaugagccacugcaccuggcccacuuuaauuauuuaacuugagguuuuaggccaagcacaguggcucacaccuguaaucucagcacuuugagaggccgaggcaggcagaucacuugagcccaggaguuugagaucagcaugggcaacauggggagacccugucucuacaaaaaacuaaaaaauuagccaggcgugacauagucccagcuacuguggcgacauacgugggaggaucgcuugagccuaggagguugaggcugcagugagccaugaucucaccccugcauuccagggugacagagcaagacccugucucaaaaaauauauauaaauaaaauaaauaaauugagguuuugacaagguaguucaguggagaugggauagagauuuuggaaucauucacguagaugugguugauauugugaggggagaagugccuacuggguuuagagagagggcccagguuagaaccuuggagaauguccacaauuucuuagaucaccuggauaaugguaagauguuauauuuaauugggguuucugaggguuuaauuagaaaauauugugauuauggugauuaaaauauauguaaaaugaugucucaaccuacuucuauuuuuuuagaggaaaaacuugaaauauuucaauauuuuauuuaauaggcucuguuaguguccugggucauuauucugaguuuuauuugugaauguauagugguauaaacaaauaucaaaguuuuaggagauuggcuugaauguauauuaauucugguaggugugcuggacuuaaacuuuugcaauuuuuuuucuuuugacucucuuuuaaaauuaaaaaaauuuauuuugacuuuucuuaaaaguaaaguaaaauguaacguuuuaacaucccuucauucuauuuaacugaaaauucuagauuuuguaucauuuaguuuuaguuaguuguacuccagcuuauuccacacaaaggauuugaggcaauuuaggaaaaaaaaaauucaaggggccaaguaagggagucaaaagaaggaaaauagagauaggagaauaauaaacugagguaacauuuccuucuggagaugcaaacuagauaguccauccauuuguuagaaaaagguugcagauauuaccguugaguuuccuuguggccaaagcaaaggggguaauccauaggauuuaguguccauuggauaaaaacauuguuuuuccuguuauugagaccagaaguacauaaagaggacagcauuuggauaacauucuuccagcaacuauaauuaugagaguuuaggagugggauaaaucagcagaagucuaaucuggucuaguucaagaauacaauucagauaaaugcauuucagagccaugcauagaaaaaugucuaugcauguuuuuuuguaccaaaccuucaauaaggauuggaaaacagaaguucuaguucuaguuccugacaaggaccuggauuucauauguuuucuaucauugauaagagaucuugugguuuaguuucuguuuaaugagguuguuaccuuauaugacauugagcuuagacugaaaugcguaaaauugagaauuuguguguguuaccugacuuaaaauucucacaccacaacuguuuuucuaacaacuaugaguuugcuagauaaaacucacaggucugcuguagcaacaucauagcacagccugaaauugccaccaugcugucccucuuuucuccuagccauauuaaaugcuucuuuccuucaaacccuacuucuuuugaaucaccuucuuucucauuacuauuuuaugucucuaaugaucucacuccuuucacagaucaccuguagaacucgguugacugccuuuuucaucacuuauuaaaauuucuuauuuuuaauuuaauuuuauuucuccauccucucuuuauaacaggguuguaacucauugagggaauugaucugccauggcuuauacuauuuuugauuccucaacucuuggcauugugguuuucaaauuuguguagaaauugagauacucuuucuuuacagaaucucaaaaucacuaaguauauaauuaugugccaaaucaguugauaccucacauuaaauucuaguugaauaggcaagggaagaccagaguuugaaggaaaaaaaaaucaggggaguaacauuuaaaauugagauaauuaggcugggucugguggcucacgccuguaaucccagcacuuugggaggccaaggcuggcagaucaccugaggucaggaguuugagaccauccuggacaacauggugaaacccugucucuacuaaaaauaaaaaaaauaaaaaauaaaaagccggguguggugauggacaucucuaauccaagcuacucaggaggcugaggcaagagaaucacuugaacccaggaagcggaggcugcagugagcugagaucgugccacugcacuccagccugggcaacagagugagacucugccucaaaauaaauaaauaaauaaaauuuaaaaauaaaauaaaauugagaaaauuccuuuaguuuucuucuccucuguauugggaaaaugaugaauuucaaaugaauguaguagcuggauacuucuguuucgccaaugaaggacauucuguggagcauggcuugugcuagcacaguuccuugugcaugucguaguagcuacuaaaugagggaugguuguuuuaggaauaugacagcauucagagugccagagaaaccuuguugauugggcaggaugguguguagugugggguguucaguuuugugauuucuucucacauucuauagugauauuccaauucucucuauauaaaauuuuaaggaauucaucuguuuuauaagucgaaggguacuuuccuuagacuguaaugaauuuuuaaugaauaaacuuauguuaccacuuaagaaaaaaacauggcuaaaguaaguaugaaccauauggaaauuagguugggucaucugagaucuuuaaaacuuugcaguuggcuuuagagauuuaaaaaucauaguuguacauuuugaaaucucuuuauuuaaacaguaagaugcugaaaagacaaauaccuuuugggaagccaaucauauccuauugugaauuuuagugcaagaaguaaaauuuuuuaguucuuucacugugaauucauuugaagccguauaaucgcugugagccuccuaauguuuuuuccuugccugaggguucacuuucucccuacacugcuaccuccagccaggaauacuguuuuaggcuuaccugcauuuuggcuuuagugucuagcaguguuucccuuucacucuuucgggaaauuuucugauuacuagaguaacaacuuaaacuauaacccaauuauugaguacuugcuauugccagguacuuuacugacauuaucauuaagcuuucuaacagcucugugaagggcuauuaaauagagcucuuuuccauugccaggggcagacacacaacucacauuagcuuaaggaaaaauggguauuuugaaggguagugguggagcuggcuucacagauguuaucaggaaucuuucucauuucuacagucucucaccuuuugcagauagauacucucuacgacuugaaagcacuacacagacagcuccaggcuuacuucaguccaacugagcaacuccucuccaugucucaagaacaagacauugucuuugcuuguauaauugaccauuucuagacugauuaaucauuguagucagaggggaugagguacucuuauuuggcuaagacugcaucacauguccuuaccccuuugagcuuuaccaaagccauacagaauggcgcugaagguaauuccccaaagggaaagagggaagggaugcugggcagguagaugcuggguagugcuaucacuacccuauuuuacagauaagguaaaugagacuuaggaauguaaaggagcuccuucaacgucacaaaaauaguaaaugauauauaugaaccacaaucuuuuggauucaggcaucgcauuauuaucugguaaaaaauggcugcugcucuuuacccuuaaccccuuucuuggcagcauguguuccuaauucucccaauucuuuucacuuuuuauggagagagaaaugaaccagggaagagaaugaagggaaauaccaccccccucuuuuuuuggucaauaauaaugaggaacagaguaugugugaauccuaaaauugaugggacagcauugucucauuguagacuagguguuuggcagggagaggguguggcagggaaaugcaaccaaccuauaacuacuaaaccaguugggggaaggagauaaccuggguauucaauuuuccuauuuugucucauuacuaguaucacauuccuuuucuccugcuuauuauggcaaaauguacagcuuuucagcaccauguauguuaaauaggcucuugugaacuggccuaggaaccuaauuacuguuauaguacaguuucugugggaaaaugagaucuagaugcaauaagcuuugggaaauauacccaauauguaaguuagggauuaucugaucaguuaucuaaaaaagucaggaucuucauucucuggaguguggcuguguuagggaagugagaaagggugaauugggagauuaacucugaagaaaaggaaauaaagaugucaaaggcaaacuuugcuuguucuguguuuuauccaagucucucaugguguaauuaccauugacuucuuaaaaugaucucagauucuccuuuagguuacuguuguaaguuaccaucaucuggcauauuucauauuaauaaauauuuucauuuuuaaugauguuaaaauuuauggcuaaaaugggucuuuuauucauaggaugauuuauucaugauguggcgcuucaccauuggaggguaauugaaaguuggccauguaagaaaggaguaagugagaaaauagaaaguuccugguaaaaugcuacauguaauggacacucaguguuacugagcccucauucuuaucuccuuacuguuccacuaguggcagagucuuuuguuuucaucuuguuuucuaugagacauauuuggugauaauacaauucauaagauaugcucacuuuguuaauguugagccccucuauucaauauuuuauuuuuauuuuuagagaugggguuuugcucuguugcccaggcaggaguacaguggcacaaucagcucauagcacccuugaacuccuggguucacgugauccuccugccucagccuccugaguagcugugacuaugggugugcaucaccacaccuggcuaauuuaaaacaauuuuuuguagagauggcaucucacuuuguugucuaggcuggucucuaacuccugggcucaaguaguccuucugccucagccucccaaaacauugggauuacaggugugagccgcugcaccuggcccuauuuaauauuuuaaaguuucaacacuuuauuuuagagaauggaauucaauguggaaggcucuauuccaaaacauuuuuuuuuuuugagauggagucucgcucugucgcccaggcuggagugcaauggcacgaucuuggcucacugcaagcuccgccuccuggguucaggccauucuccugccucagccuccugaguggcugggacuacaggugcccgccaccacacccggcuaauuuuuuuuguauuuuuuuauuuuuuuuuuuaguggagaugggguuucaccguguuagccaggauggucuugaucuccugaccucaugaucugcccuccucggccucccaaagugcugggauuacaggcgugagccaccgcacccggcccaaaacauuuuuuuauacuuggcaaauuuaacaguagauuagagaugguauguccuauuaaagaacuuuucugcacccaggaaagcuauucacugggcaaaugugacuacaaaggauaagcagaguuucuauguauaguggcacaauuauagcaugaaaauuacauguuauauguaauacaaauaauauaucaguucauaaaucaguuuguaauacuaaaucauuugcuaucuauguaccuugucauuuagcaugcuacauuuuauguauauaucuugguuuguaaaucacugugauaagcacauccccaguaguaguaugguaagcuccuggcaggcagggacuauaucuuugacaucagagccuaugaaguagaaugcuggcccuaugcuagguguucugucugcugagaggaagauauuugcuauuacuaauuauuuaguuuggugcaacaggccagaauuguccuaauaaugucaguguuuaauuggugauauguaaaauuucuucgacaguuuguaaaucaaauuagauacuagaaaaaaguuuaauguguaaaaccauuuauucauuuuguugaacauaggaaucacuuguggaauggcuuggacacauuauagaauuagcuuuuuagcaaagugauuagaagggguaaaucuccuaugucugguauuuggacuucugccagucuuaccuguuagguuauacuugacccuaaagaaguuccuagugggugugccagggaggagaaccaaaaauauaaugaaauuggauaaauuccucagguaaaagaaaagcaguaccaguaaagaccaaaccccacuggcaccaaagcccagaaauggaauggagcuaaacaauauaaaggaaauuagagcaaaguaggaaaaaaccuuggcaauuuaaaaauugugcccaagauagagaaaagaggagagaguguguguuuguaugugugucugucugugugugaguaaugacagugauaaagggagagcagacaagucuuugagaccugcauagccauucucgggguacucacugugaaggugaguaauucuaccuggcucuugagaacaucccucucuuaaggacaugucgaagauucacugaccugaacccucaauaaagccuucuggagaacaguaacuagaagacaagugaaguucuacucucuucugucauuuagucaaguauuuauugagcugcugcuuuguguagauacuacuaagcuguacaauuacuggugcaugauauacucaacaaauuaguguauaaaugaguaaaggaaugaugccaccuuugcacucauuuauuuacugagcacuuaugguauacuagacacaaaauauucuaagugcuaagaauauaauggugagcaauacagaaaucaucccugcucucauggaguguguauauuagugagagagacauugcaacaaaaauauauuaauauacaauuacaaauuggguuaguuugugaagaaaacuaacagcugcuaugauauacuguaggagugggaucaguuuagauuguguguucugggaaggacuuucagucuaagaacugaaggauauguaggaauuagccaguucagaauuggagcauugcaaguggggaagacaaaaucaugaaguuucucaguuuggaagugggagggcuggaaguggguuggcauccuuggggaucugaaauaaggccaguggguggcuggaauguagagagggaggaguaaagauguacaaaaugaaguggaguguuugggagggcuuccagaagauaacuguaauacagguuccaaaacucagaaguuucauuacucuuaauuucgggaauaaaauagagauugauuuguggcuuggaaaaagugaaaaaacauuggugaauuagggauaauugguuaaucuauacuacauggaaguugguauuguauuguggaaagaaugugggccuuggaaucaacuaacuucauccuaucuuugcuucuuaauggugugugaccuuggauaaguuacuaagccucucugaguuucuuuucuuucauuuguaaaauggagauaauagugccccuuuauugagagaaugaaacuaaauauguaaaauacuuagcaaagggccuagcucauacuaagcggucaguaaacuacguggugcuauuacucuuacuacuauuucucuucuuucuccucaaggcagauagacauccgccagauugucuauaaaauauuagcuaggugaaccugaugaacacagcaaaagcaugcacaaacuggcaugccuguaaugacuuuagacuauuuuaugaguaguccucagugaaguggugggaguauuucaaucugucccaugauuguugaaaaagcagaauuuuuuucaucacaaacauaaauggaacuguauauacuuugggaaaacuagcuuugcauuucaaauaaagcauuauaaaacuaaauuuacuaugaaaagccauaauguuauagaacacacuauagccuuuucagagagaaucuugcaacuguaguaaaauaaagacucccugaaaaugcucacaugccauguuaaagacauaggguuuccuuuauuucacauacaauugucuaguuacauuuagcacaaguaagauagaccauuugggauaaacugucauguaggugucuguggcugacucuguuauuaauauggaaauacaguaagacucugacauaauacaaaaaauggguuccaaaaacuucagucauauuaauggaggauaaucaaauaacuccuagcuagccaauugggaguuccuaggauguggaagccaauuaccaauugucuucagguuauugagguuauuaugggguauauuugaaugcuaaugacaugucaaagaacuuugauaaugacagugaagauuuuuuuuggaaagaaaaucauuugacaaagcauauuuugaccuuugauuuagauauuaauuuguagaaaaaggcaauaugcuauggcuaaauuaauuugauuaugauccuuaagagauacauuuuacuuugugaaugcuguauauacacauauaggaaacuaaaaaguuuuaugaaacaauauuccaauauuuucuguuauauuuuauuucaauuucuggaaaaugcuguaguucacuaaacuaguuuuaugacauagugguuuacaacuugcacuuugaaaaacauugcacuaaaugacuguguauuaagugaugcuucagaaaggaacaaccagguuacucuagaaccauaagaucagcacuauuucaccacuaguauaucccauaccacuaguaauagacgacuaguagguggcaagcccauuuggcugccuaggauggucuuuaaaaaaggucucauauauauauauacauauauauauauauaugucacauguauauauucacacacauauuuacuuacaagcucucacaggaaggauacauaagaaauuauuacuaaccugaauugcccaagggaaggagaacuggguaucugggcaagagugauaagacacuuuaagugcaguauacccuuuuauuuuucauucuuguuaaauuugaauccugugaacauauuuauucuaaacauuaauaaauucugcuucuauguuauucgagaaagaaaauaguaaggugaccaguauggaucagaauuuuacaguaaaaauuacuguguaggccgggcguggugacuuagaccuguaaucccaccacuuugggaggccaaggugggcagaucacuugaggucaggaauuugagaccacccuggucaacaugguaaaaccccaucucuacuaaaaauauaaaaauuagccaggugugguggugugugccuguaaucccagcuacucaggaggcugagacaggagaaucgcuugaacccgggaggcggagguugcagugagccgagauugugccacugcacuccagccugggugacagagcaagaguccaucucaaaaaaaaaaaaaaaaaaaaaaaagauuacuguguaguuuagcagaguccagcauaggaguggugaauuacauccugcaugcuguuuacugccccugaucuagaccagcuauauugacagugcuaugcaaugauguuuaggugacucauuaaaaaggguuacuuuguguuuugugcucugcuuauuuauuauagugggguauauacuagauucuagaaagcuuuuuuuccaauagaauaugguuaauuuucauguuucagugcuuauuuuuucauuuuuaauuucugaauuuauuuagaaguaauuucaaacuuacagaaaaguuguaugaauaagaaaaguucaaauaacaccuguucccauagucaccuuuggucaacauuuuaccacauuuguuuucucauuuuaucuaccuaccuacuuaacuaucugauuuauuuuuuuuuuccugaaccauuugagagaaacuuauaaauaccaugccccuuucuucauaacuacuucagaguauauuuucuaaaauuagggauauucucuuacuuaaccacaguacacauaucagccucaguaaauuuaauguuccuaccauacuuuaucuacucuacugccaacuuuccuuuuuuugucgguugacccaggaauaugcuuuauagcauuuuuuuuuuuuuauugcuuuuuggcacaggauuuggacuaguguuagguauuguauuuagucgucauaucucuuuagcuucuuuuuuuuuagacagagucucucucuugucacccaggcuggagugcaauggcgcaaucucggcucuuugcaaccuccaccuccuggguucaaacgauucuccugccucagccuccugaauagcugggauuacaggcaugcaccaccaugcccaguuaauuuuuguauuuuuaguagagacgggguuucaccauguuggccaggcuggucucaaguuccugaccucagaugauccgcccaccucggccucccaaagugcugggauuacaggcccccaccaugcccggccucuuuagcuucuuuugauuggcaacauuuccacauccuuuauuucuuuuuuacaacccuggcacuuuuaaagaauacacuuuuuccuuuucaaaaauagaauguugaucauuuugguguuuucuuaaugauuaaauucaaauuaugcauucucagaauauuauauagcugaugugucuuucucaggauauaacaucuggagacacacaauguccaucuaacaugaaugauguuagagaguacuuggugaaggaguuaccuaguuucuacuguauaauauuuuccccuugcaacuaagaaacaauccauggaaagacauuuuaaaaccaugcaaauauacuaacccguaaaaauuucccccuagauuuaacauccaugauuguccuugccugauccaaucuuuacuauguugguugcaaaaugcugauuuuuccauugcuagcacuuccucuacguuuaccagucaacacucagcauucugcuuuaagccauagcccucauuucuccuuuuguuuuuuauauaaacucauaaauuccccccucccaugguucauaauuaauuacuguguaaaguagaggauuugauucuggggugugucaaugauaacuucaagaggucagugaucaccuugaaauugugugcaaucuucuguguucuggcaucuuucuagggagaguguuccugucaucagaaucuugaaaggguucuggacucaaaaguggaaaacauauugaaggguuagacuuuaagcuaucuguaauacuuacaauacauuuguauauccauuccccugcuuuuuaccccaagugauaacugaaauguuagaaccguauugugugucccucuguaguacauucuauuuuuugucuucuguuuuuaaaccacaacuuaaaauagugcuguauuuugguuccuuuaaauuuuuuccuagaauauauaauaaauguuaagaucuucauugccaccguaguagcaguuuaugguguauagaaccagucuugugaagcagugaauuaccuugauuuaauuugaaauuuuaaaaccaauguuuuuuacacuguaguuuuauuagcucucugggagugagcuacaugauguugugcacugaaaauuacccaaauguucucgccuucucuuuccuggaugagcuucagaaggaguucauuacuacuuauaacaugaugaagacaaauacugcugucagaccauacuguuucauugaauuugguaagggccugauuuuuuuuuccuuuuuauucugucugcauccaaucauaagcaauuuuaaaucuaauauuggguggaggggggacuucugcuaucuugcuuuugauauaauaauuugguaaaugaucuauaaauuaugguaacuuuuuacuuagaugcuuauuagaaaaaaauuguguuugagcugugaaggggauugugaguauugguccgaagaauuaaugccagaggauaacuucucaaugagaaauuuauaagccagagauucagacuuuugcguuucuguaauaaucuuuuauagucugcuucauguagaauaggggauggcaaacauuugcuggaaaggaccagauaguacauauuuuagacuuuaaggaucauauagucccugucacaacuauucagcccugccguuguagcucgaaagcagccauaggcaguacguaaaugagugcaguuauauucuaauaaaacuuuacagaauagucagcaggcuagauuuggccugugggcaguaguuugcucaacuucugauguagaagaaaaaaaaaaaacaccauguuguaaauaguaaaaauaaaauuccacuuggaaaauauuuaggaaaugucuuauguuaguuuuauucaauuuauucuuuaaaaccuacauucuaaugguguaagcaauaaaaaacagauuuauaaaaacaugcaacuucuaguguguguucuuauguaauugcagcugguaaaucugacagauuuaauauuucaugagauaggaaucucuauaaaaaucaagacuuugggccaggugugguguggcucaugccuuuuaucccagcacuuugggaggccgaggcaguaggaucacuuaaggccaggaguucgagaccacccugggcaacauagacccugucuguacaaaaauaaauaaauaaacugggcaugguggcucacaccaguagccccagcugcuugggagacugaggcagaaggaucacuugagcacaggaguuugagguuacagugagcuaugauuguaccacugcaccccagucuaggugacagagcaagacccugucucaaaaaaaaaaauucaagacuuugguuuaaaguuaaagcuguuuuuuguuuuuguaauuucuugaaguggauguaauacacuuagguaguguuaaauccuuaguuuauuuaaaauuacugauuucuagaggguaaaacugaugauuccaugauacauuaaucauuaaacacaaguaauauuggacuauuucaugacgaauugaacaauuuugaauaauaaacuaccuguaauauuuacuauccauaaacaucauauucugaaaugauuaauugacaagugacugcaaggaaauuuauuuuuuauuuuacauagauaacuucauucagaggaccaagcagcgauauaauaaucccaggucucuuucaacaaagauaaaucuuucugacaugcagacggaaaucaagcugaggccuccuuaucaaauuuccaugugcgaacuggggucagccaauggagucacaucagcauuuucuguugacuguaaaggugcugguaagauuucuucuggugaguucuggaucucaguuauuuuauuuuaaaaaaauccuugggaaaaacugagaaacucuugaaaaugaauuacuuuauucuaauauuuuaaaucaaguacaugagagaauauagaaguucaaagcaauccuuucagugauuuauaaaguaagcuaccagaugugugacuaaucgggaaaauacuuucaaauagcaaccucagaggaucucuuugcuagaaaaacauuuuuuuaaauuuaaaauuaaaaaaaguuaauuuucauggguacauauucgguguguaauauauuuaugggguacaugagauauuuugauacagguaugcaauguguaauaaucacauuaggguaaaugggguauucaucaccucaagcauuuauuauuucuuuguguuauaaacaugucaguugugcucuguuaauuuuuaaauguacaauaaauuauuguugacuguagucacccuauugugguaucaaguacuaaaucuuauucauuuuagcuaacuauauuauguacccauuaaccaucacccuuucucccacccccacuacccuucccauccuccaguaaccaaaauucuacucucuuaucuccaugaguucaguuguuuuaaacuuuagcucccacaaaugagugagaauauguaaacuuuucuuuucugugucuaguuuauuucaguuaauaaaauguccuccaguucauccgugcuguugcaaaugauaggaucucauucuuuuuuuauggcugaauaauacucuguuguguaugugugccacauuuuguuaauccguuugucugaugaugggcacuuagguugcuuccaggucuuaccuguugugaauauacugcaguaaacaugagaaugcagaugucucuucgauaugcugauuuccuuucuuuuggguauauagcuagcagugggguugcuggauuauaugauaguucucuuuuuaguuuuugaggaaccucaaaacuacuacuguucuccauagugguuguacuaauuuacauccccaccaacaguguucccuuucuuccacgucaucaccagcauucauuauugccugucuuuuggauaaaacccaguuuaacugaggugaaaugaugucucguuguaguuuuguuuugcauuucucugaugaucggugauguugagcaccuuuucauauaccuguuuaccauuuguaugucucuuuugagaaaugucuauucagaucuuuugcccauuuuuuaauuggcuuguuagauuuuuucauauagaguuguuugagcucauuguguauucuaguuauuaaucccuugucagaugaauauagggauucacauucccuucucaguuugcaaauauuuucuaucauucuguggguugucucuucacuuuguuguuuccuuugcugagcagaagcuuuuaaacucaauauaaugcaauuuguccacuuuugcauugguugccuguacuugugggguauuacucaagagaucuuugcccaggccaauguccuggagaguuuccccaauguuaucuuuuaguaacuucaugguuugaggucuuagauuuaagucuaauccauuuugauuugaucuuuguauauggcuaggaaaacauuuaagguuucuuuguaaacauuuuucuagaaaugaaaaauagguucuuuguacugcauauuuauaggcauguaaagugcuuugcauuuuguuaaaauggcuacauucaaggccaguguucuugacugucacggaagguguaaauacuuuagugaucgucugcucaaaccucccaucccaaagaaggaauacuaucgucaacaguugugaaaugauauaaacuuuugcuuaaaaugaacaccucauuauuuuauaagguagcauaugccauugucagacuauuuguuuaagaaaauuauuccaaccuaaggcuuuaggaaaaaaaaaaaacuuccuuauauaauugagcuaaagucagcuucccuaugucuacuaguuuguuuugugaucuguuccucccuuccuucagcagaaccagaauaacaguuaagucagcaacuguguguccuuuccauccucuuagacuagucuacuucauauaaauaucuccaauucaccaaugagaacacauggacacagggaggggaacaucacacacgggggccugucaagggguugggggcaaggggagggauagcauuaggagaaauaccuaauauagaugauggguugauggauguggcaaaccaccauggcacauguauacuuauguaacaaaccugcacguuuugcacauguaucucagaacuuaaaguauaauaaaaaaagaaauaaaaauguaagacaauaucaacuauagaauacaaagcaaacacauuuaucauuguauauugacaaagggcaaaauuuucaauuaaacugcaacaaacaugcaccuuuuugaaucacgaggucaggaguucaagaccagccuggccaagauggugaaacccugucucuacuaaaaauacaaaaauuagcugagugugguggcaggcaccuguaaucccaguuacucgggagacugaggcagagaauugcuugaauccaggaggcagagguugcaaugagcugagaucguaccacugcacuccagccugggugacaaagcgagcuccaucagaaaaaaaaaaaaaaaacuccaguucacuuagccuuuucauuuauggcauuucaaguucuccccauccuagaagcuuccucuagacaugcuuuaguuuguuaauauucuuuaaauuuggacugaauacaacacuucacauacaaaugugggagaagaggguaacaaauuucauuaaaauaauccagucaguuaguaaacaagcagauaacaauaacaagcccaguuggucaggggugguagggggagagugggcuaguacccacauuguuacaauauguuaucuaaaauguccaauuuccaguaaauuauaagacaugcaaagaaacaggaaaauauggccagguguggaggcucacaccuauaaucccagcauuugggaggccaaggcgggcggaucuccugggguugggaguucacgaccagccugaccaacauggagaaaucccgucucuacuaaaaaaaaaaaaaaaaaaaaaaauuaguugggcaggguggcacaugccuguaaucccagcuacacgagaggcugaggcaggggaauugcuugaacccaggaggcggagguggcagugagcugagauugcaccauugcacucuagccugggcaacgagagcgaaaacuccaucucaaaaaaaaaaaaaaaaaagaaagaaaauaugacccacacacugugggcaugggguagaggggacagaauguagguaacagaaacugccucugagagcaaucagcugucagauuuaacagacagaggcuucaaaguagucauuauaaucauguucaaagacuaaaggaaacuauuaaaggaguaaagggggagguaugauaauguugcaucaaauagacaauaccaauaaagagaaauuauuuuuaaaaaacacaguggaaauucuggaauuaaguaaaauuacuaaaaugaaaaauucacuagaagggcguaacaauagauuugaacuggcagaagaguuagcaauuugaagauagauugauagagauuaucuaaucugaaaaacagaaaaaagaaugaagaaaaaugaauggaaccucaaaaaaauggggcaugcuaacauaggugugauaggauaccgaagaagaagggggagaaaaagcagaaaaaauauuugaggaaauaauggcugaaaaguucccagauuuacugaagaacauuagucugcucuugcaggaagcucagugaacuccaaaugggauacacacgagauccacaaauagaugaaucauaguaaaaugcugaaaacuaaagacaaggagaaagucuugaaaucagcaagagaaaaagaacuugucacuuacaugaguuuaccuguauaacaaaccugucccugaaccuaaaauaaaaguuaaaaggaaaccaaaacucaucacuuacagugaaccucaauaagauuaacagcugacuucuuagcagaaccaauagagacuaguaggcaauggaaugacauacaaauugcugaaagaaagaaaauaaaaacuaccaguaaccaagaaucuuauaucuagcaaaguuaucuuuuaaaaaaaugaaggcaaaguaaagauauuuacagauaaaugaaagauaagagaauucguuacuagcagaaacaccuuauaagaaauaauaaaggaaauucuuggcugcauguuguggcuuacgccuguaaucccaacacuuugggaggcugaggcgggcagaucacgaggucaggaguucaagaccagccuggccaacauggugaaaccccgucucuaccuaaaauacaaaaauuagcugagcauggugccacacgccuguaaucccagcuacucaggaggcugaggcaggagaauugcuugaacccgggaggcggagauugccgugagccgagaucgcgccacugugcuccagccugggcaacagagcaagacuucaucucaaaaaaaaaaaauaaauaauaauaauaauggaaauucuuuaggaugaaaacaagugacccuagaaaauaauuugaauccauuugaaaaaaagcaaagaacaaggguaaauguaauuaaguaauuaaaaaagacaguaaaggcccggugugguggcucaugccuguaaucuuaauacuuugggaggccaaagugggaggaucccaugagcccaggaauuugagguugcagugagguaggcugcccuccagccugggcaguagagcaagacucugacucguaaaaauacauuaaugcauuuuucuucuacucucuacucuuaacugauuuaaaaagugaucauauaaaacaguguauauauaaugucauuugggccuauaacauauagaaauguaauauguuuucgcauacagcaaaaaggacaugggugguauuaaaguuguacugggauaaggaaauuacuccagaugauaauucaaaucaacaggaacuaaugaaggaagccagaaagauaagauaaauauuaacaagagcuauaaacauauaauuacuauccuuucuuagcauuuuuggaagacauaaaauuauagaaggucauaauuuauaacaaugcauuauggaguuugugauguuuauugauauguauaacagcaauaccacaaaaaggagauaaagggaauagagcuauauaggaguaauguuucuguggcucauuagaauauaguauaaauucuugcaguuaagauguacaugguaagcuuagagcaaccacaaagcaaauaaaaaguagugaaaaauuauuaaaguaaaauaccguacuaccaaauauucacuucaugcaaaaaaaaaaaaaaaaaaaaaagugaaggagggauagagccaaaaaaggcaugagauggauaagaaaaaagggaaaaaauggcagauguaaaucuauaucaguaauaauguuauauaugaauggauuuaaaaaguguuaauauauuaaauaauccagucaaaagauggagauuguaagauuggaguaaaaauaaaaacacaagaugcaacuauauguugucuucaggagacauaccuuagauucaaauauacaaauagauugaaagucaaaggauaaaaaaagauaaaugaagaggaaaagagagcuggaguaccaauacuaauaucagacaaaauggacuuuacgacaaacauugguaugagagguaaagcaugacauuuuauaaugauaaaagggugaaucaauuaagauagagcuauaaacauacaugcauuuaacaacagagccccaaaguacauuaaguaaaaccugccagaagugaauacagaaauagacaauugaacaaugguaguuggagacuuaaauacacaacuuucaaucauggauagaacaauuaggcagaagauaagaaaauagaagacuugaacaccugcaccaccauaugccagugagacauaacagacaucuauuaggauacuccauuuaacaacagaauuuauguucuucucaagugcaugugaacuauucuccaggauagaccuuaugcuaagcuaaacaaaacaaaaagaaaaacaaaaccuucauaaauuuaaaaggauagaaauaguacaaaguauguucuccagcuacauuagaugaaauuagaagugaaaacagaaagaaauuugggaaacucacaaauauguggaaguuagacaguacauuccuaaauagugaaugggucagagacuaaaucaaaagggaaaugcguacuuugagaugaaugaaaaugaagauucagcauaccaaaacuuacaggauguaguagcaaaagcuaaauuuagaggaaaauuuaucgcuguaaaugccuauguuuaaaaaaacaaaaaccagauuugaagacaacuuuccacuuaaagauaauggaaaaagaaaagcaaauuaaaccuaaagcaaacagaaggaaggaaauaacgauuagaacagaaacaaaugaaauagaggauaggaaaacaguagagaaaaaucaacaaaaccaaaaguugguucuuugaaaaaacugacaaacccuuagcuagauugacccagaaaauaauuacucaaauuagaaaugaaggggccaggcacgguggcucaugccugcaaccccaacacuuuggaaggcugagguggaugcaucacuugaagccaggaguucaagacuagccuggccaacauagcaaaaccccauuucuacuaaaaauacaaaaaauuagcugagcaugguggcacgugccuguaauccgagcugcucaggaggcugaggacgagaauugcuuaaaacgugggagguggagguugcagugagcugagaucacaccacugcacuccacccugggugauagagcgaggcucugucuaaaagaaaaaagaaaugaaaaggauggcauuucuacugaccuucuagaaauaaaaaggauuauaaagaauacuauaaacaacugucucccauuaaauucaauaacuuugaugaaauggauaaauuccuagaaaaacaccaacuacugguaaugaugcaagaagauaauaugaauagaucuguaaaagcaaaaagauucaauuaguaauaaaaacuacccacaaagaaaacuccaggcccagauacauuuacuggugauuuuuaccaaacaguuaaugaagaguuaauaaccaguuauuuacaaacaguuccaaaaaaacaguaaagggccagaugcuguggcucacaccuguaaucccaccacuuugggaggccgaagcagguagauggcuugagcucaggaguucaagaccagccuggacaauguagugcaacacugucucuacaaaaaauacuuccguauucugugaggccgguaucauacuaauaccaaaaccaggcaaagucaucacaaagaaaguaaaaugcagaccaauauaucuuaugaauauggacacaaaaguccucagcaaaauacaagcaaacccaauccagcaacguauuuaaaaaauuaggccaggcgcugugguucaugccuauaaucccagcacuuugggagacugaggcaggaggaucacuugugcccaggaguuugagaccagccuggacaacauaggcagaccccaucucuacaaaaaauuuuuaaaaauuagcgugaugguaugcauguguagucccggcaacucaggaggcugaggugggagaaucauuugagcccaggaguuugaggcugcagugaguaaugaugacaccacugcacuccagccugggugacagagcaagaccaugucucuaaaagaaaaaauuacaguuaugugcuacauaacaacauuuugucagugauagacugaauauaugguggugauuucaaaagauuauaauagcauauuuuuacugcaccuuuucuauguuuagauacacaaauacuauuguguuacaguagucuacaguagccaguacgauaacaugcugcacagguuuguaacccaggagcaauaggcuauaccauauagccuagguauguauuaggguauacuaucuagguuuguguaaauacacucuaugacguuugcacagcaauaucaccuaaugacacauuguucagaauguauccccauuguuaaaggaugcaugaccugcauaaauccugaccaagugggauuuaucucaggugugcaagguugcuuuaacauccaaaaaucaauuaauguaauauauugauagaauaagaaaugaaaaacacaugauuaucucaauacaugcagaaaaagcauuugacaaaauucaacagccuuucauggcaaaaaaacaaacaaacaaaaaaaaacacucaacaaacuaggaauagaagggaaguuccucaacuugauaaaagucccuuauggaaaacccacaacuaacauuauaucuaauggugaaagacaggaugcuuuuuccuaagauccagggacaagacaaagaugucugcuuacacuacuucuagucaacauuauacuggaaguucaaggcacagcaggccguuggacaaggacaauaaauaaaaaggcauguagauugcaaaggaagaaauaaaauaacaccauucacauaugacguaaucuuuuauauagaacauucuaaggaauccacugaaaaacuauuugagaacuaauaaaugaguucagugagguugcaggauacaagauuaauauaaaaaacaauuguauucuauacacuaacaaugaacaaucugaaaaugaaauuaagaaaacccuauauacugaaaacuuuaaaacauaauugaaagaaacaacaccuacauuaaugacaaauagucucauguucauggauugaaagacaguauuauuuacaugguuguacuucccaaauuaauagagagauucagcacauucuuuauaaaaaucccggcuuuuuuuguagaaauugacaaggugauccuaaaauucauauggaaaugcaagggauggagcauagccaaaauaaucuuggaaaaucuuggaaaaguacaaaguuggaggacucacacuuccaaacuuauuaccaaccuacaauuaucaugacugugugguucuaguuuaaggauagacacauagaucaauggaguagaauugagaguacagaaguaaacucacuaugguuaacuaauuuucaacagugaugccaagacaauggugaaagaauagucuuuuugacaaauggugcuaggacaacuagauaccacaugcaaaagaaugaaguuggaccccuaccucaaaaaaaauauauaaauuaauuaaaauguaucaaaaacuuaacaacaaaacuauaaaacuuuuaggagaaaacauacauauaaaucuuuguauaaucuuauauuagguuuuuaagacuuaacaccaaaaucacaaugaaaaaagaaaaaauaggcugggcucaguggcucacgccuguaaucccagcacuuugggaggccaagacaggcagaucgcuuggucccaugaguucgagaccagccugggcaacauggcgaaaccucaucucuacaaaaaauacaaaaauuauccaggcgugguggcgcacgccuguagucccagcuacucgggaggcugaggugggaggacggcuugagccuaggaggcggagguuacagugagcugagaucgugccacugcacuccagccugggcaacagccagaccuugucucaaaaaaaaaaaaaaaaauagauaagguggacaucaucaaagcuaaaaacuuuuuuggagacaaguucuuacaauguugcccaggcuggucucgcacucgucggcucaaacaauccucccaccucaggcucuagaguagucuggauuacaggcauguacuaccucacccaauucaaaauuaaaaacuuuguucuucgaacgacacuauuaagaaaaugaaaaggcaaccgacacaaugggagaaaauacuuguaaaucauaugucugaugaggaacuaguaucuagaauauguaaauaacuguuacaacuaaacgauaaaaagacauaauccaguuuaaaaauggagaaaggauuggacuaggcauuuuugcaaagaaguuguacaacuggacaauuaacacaugaaaagauguucaacgucauagucauuagggaaauacaaagcaaaauuacaaguagaugccacuucauauguauuaggaugguuaaaauuaaaaagauagacaauaacaaguguggaugaggauauagagaaauuggaaucuccauacuuugccagugggguuguaaaauuaugcagucacuuuggaaaacaguuuggaaguuccucaaaaaguuaaaaagagucaccauauggcccaggaauucuacucuuagguguaccccggagaaaugcaaacauauguccacacaaaaauauguguaugaauguagcauuaugcaaaauaauuuaugaauagcagcauuauucaaagccaaaaaguguagacacccaacuguccaucagcugaugaguggauaaauaaaaugugguauauccauauaguguauuauuauucagccauaaaaaggaauaaaguacugauacauauaacaacaucugugaaccuuaaaaacauuaugcuaaauaaaagaagucaaucacaagaaggucacauauuaaucauucucuuuauauggaauguccagaauaggcaaauccagagagacaggaaguagauuaaugauugauggagcuagaggaauggagggaaauaggcagugacuacuaauagguauaagauuucuuuugggggugaugaaaauauggaauuagguauuuaugauuguuguacaacucugaguauacgaaaaacuccugaauuguguguuuuaaaaguauuaauuuuauugaauguggauuauauuucaauuuuuaaaaucacuaauaaguucgauuauuacuuugaagacuuccagcucuaguagugauggaguagguaauucagaccacuagucccacugaguacauguagaaaagcugaaugaaauguauauauucuauagaauauauaugucugaucuaauauagaauuuaaucaacuauaaucuuccugauaucucuggagauccaacaagauuacuaagaauuagugggaugcagaggaggauggaggcccagagagaugagcccaguguucagagcuacuuuuuccuuuggugcuuuuacccauuuuggagagcgucucuccagcuuugguuuacuaccucagauuuuugcacccuaggaauaugggugaacuuaguuuugaaucauauuguucucuaaaauuggagugaggugauuccacugugcuaaugcuccaaagguccugguagaagcaaucaaauaucuuucuuggaagaagauagugucauaagcuucaaauuaugucuacaacaagauuuugaaaauaaaauguuuggcaaacaaucauagauaauuaagcaccuuaagagacuacacuacaugaacauagaccauaagaaacacgcacacacacacacacgcacacauaugcacgaucugauagaaacaaugaaagccagaagacaacuuaaugauaacuuugaaaggaugaaagaaaauaacugcaaauguagaauucugugcuuuacaaaaugaaugaagugaacaaaaagaaugaaguggcaagaauagauauccuuguauuuuugcugauccugguauuagcagcgaaaacuuucggucucuagguuuugcaggucauauggccucuguuaguauaacacaugaaaguagccauagauguuauauaaaagaaugagcgaggcuguguugcaauaaaacuuuauuuacaaaaauagauggugggcuaaauuuagucugugggucauaguuugccagccuuugcugucugcuaaucuuuggcacaaaguugacauagccuugugaaaauaugguaaauauacugauaucuuuaucagguaaaaguaaaaugcuucugauuuucucuauuuauuaggauagagaaaaauguguuaccaaauuaguaccuacaacaggucagagaaugaauugcuuuguuccauaagaagacugcauuugaaaaagcacaugcaguugaaaccuacaaucugucauccuccaagacacauccauuuuggagacuuauacuggacaguuaaaugggaauauaauaggaauugcuaccuauacaucuuuuaagacuuggaugguggcacugaucucuguaauuaccuugaugauauuuggauugggggagcucaaaaacuuccauuggaccuuccuucucuaauaguucuaauuccaugggucuggcagucaauauugcaaaauauauccguucguuaauagacacucaggauucagguauauaaccuaaauuagggguggggguccaacuugacuuaccaggagguagacucuguuagaaacuccacguaucaccugacuuccauaaguccccacccugaccuguagcuggcaguggcauccuggaucaccaaacguuagacacuuggaaaauggggagagucugguauuuguuauuguuuuaaggaagaggggcaagaugcagugguucacgccuguaaucccagcacuugaggaggccagggugggaggaugguuugagccuagguguuugagaccagccuggacaacaaagugagacccugucucuacaaaaaaaauuaaaagauuagcuagacaugguggcacgugacuguagucccagcuacuagaaaggcugaggcaggaggauugcuugagccugggagguugaggcugcagugagccuugaucaugccacuguacuccagccugggugacagagugagacccugucucaaaaaaaaaguuuuaaaaguaacucacaacuagaauuuauuuuauuuuauuuuuauuuuugagauggagucuugcucugucacccagcaggcuugagugcaguggcgcaaucucagcccacugcaaccuccaccuccuggguuaaagcaauucuucugccucagccucccgaguaguugggauacaggugcaugccaccaugcauggcuaauuuuuguauuuuuaguagagacaggguuucaccauguuggccaggcuggccucgaacuccugaccucgugaucugcccacuuuggccucccaaagugcugggauuacagacgugcgccaccacgcccagccuagaacuuauuuuaauauaacuuuaaauuuacuuuuaauucagaccaagccuacauaauauuuucuaugguccccaaguuaaaauauauuuuuauguuuuggaacuucuaaauaaaacuauucaguuuauuuuagaaucuguuuaauaguuacuugauaaacaucauuuuucaggguuuuccucccucuguuacaguaucuuacucucaguaucuuuuuuguauuucuugacuuuuuucucuuucuaaucuuuugauccucuccccacagucuggcaugaauguuuuuaucuugccauacuuauuuucugaagucuacagauguuguucaugggguuaaaauauuaaaugaaggguacuguguucugcuuuuacuucuuuuaaaacuguuuauuauggaaauuuucaaaguaaacagaauaguauaaauaaacagaaugguauaauuaacucucauguacucaacuauaacaacgauaucaacauuuugccauucuuuuuucaucuguacuucuaccuacuccccacucauccacucacuaauuuauuucuauauuuuuuucuuguuuaagggagauuuacguauauuaaaaugcacaaaucuuugcuguguccaccccguuuuaaaguauauguuucauuauuacucagguauggugaggaggagaugacugucauagaaaagauaguuuguuauacucacugaucccuaaagggagcacacaaggauguaccaaugugggucaggaggcagagggagcaggaggaaaaugugggcaaaaacuuuuauuuuuuuuccacuguuuuuuauuuuauuauuauuuaaguuuuaggguacaugugcacaaugugcagguuaguuacguauauauacaugugcuaugcuggugugcugcacccauuaacucgucauuuagcauuagguauaucuccuaaugcuaucccuccccccuccacccaccccacaacaguccccagagugugauguuccccuuccuguguccauguguccauguguucucauucuaacuggugugagaugguaucucauugugguuuugauuugcauuucucugauggccagugauggugagcauuuuuucauguguuuuuuggcugcauaaaugucuucuuuugagaaguguauguucauauccuucgcccacuuuuugaugggguuguuuguuuuuuucuuguaaauuugguugaguucauuguagauucuggauauuagcccuuugucagaugaguagguugcgaaaauuuucucccauuuuguagguugccuguucacucugaugguagugucuuuugcugugcagaagcucuuuaguuuaauuagaucccauuugucaauuuuggcuuuugcugccauugcaugcaagaacuuuuauugugguuuuggugguaaggaaugggugaggcaggguaaggagguuuuaagauuggcuaguuugaauaauuucaauggacucuggggcauagguucuaucucugguugucugacauguggcccugggaugauugggauagggaaauaauggcccuggcugugagagccuuguagaggaguugguugguagugugagucuggauugauuggaaugcguaugaaagguggacucagacaaguuguuugccaucacuaggaauuagcuaucccugggagaggcaguucuuccauggucagcaaggcccaagaggucaaagcaucaaaaauacagaauaaaaagacaugauuacuaaacacccuuaucacaauauaggacauuuccaucucccccgaaaaguuucuuugugucccuuuucagucaauuuccaccauccucuagacaacgacuguuuuuauuuuuuuccacuugaacuuuguuuuguuccagaacuuuauauaaaagaagacuacauugugugacuauuguguucagcuucuuuugcacagcaugaugucauacauacauguugccugucucaguaauuuguuccuuuuuauuccugagcgguauuccauuguaugaauguaccacaauuuguuuauuuauucucuugcugauggacguaaacuuguuucaguuuuuguuauugcacauaaagcuacgaugaacauucauccuuuuguugacauauauuuucauuucccuugaguaaauauuaggaguggaauugauaggucaaaagguugccuguuuaagaaacugccaguuuucugaaguaguuguaagauuuuacuuucccaacaagcaauuugugagcauuuugauuacucaacaucuucaccgacauuuaguguuguuagucuuuuuacuuuuauguugugcuuuaaaaaaaaaacuucacaaaacccuaaauuuaggguuuaaacugauagaaacacuucugucaguuucuuugacacuuguauauuuuucaucuauuuuaucauuuucuagaaaauuugucaguugccugaaaaugcugcucuguuuuggcuggugcccacaagccaaauagauuuacuaaucucucuuucuuacacacacacacacacacacacacacacacacacacacacauccccuucauaauccaacagguauuuaucauuuuuuuucucuaaaguauuaugcuaaauuuuguggaggcauuuuuuagaaauacaguaaacacauuaacuguacucagaaugagaaagggaaauacaauccaauaaguaaaacacaaaguagaaugugauacaugcuccaaaagagguaagaaggaagacucaggucuuggagccuugaaggauaugcaugauuuuuacagguggugaugauaaagaagggccucacugaugaaaagaauaguguguuuuugugccagacuguuagucucauucagucacacuucaguaauaaauuaggcucauuuagauggaacugacuugaaauuucucucuuaucuuccacagucuguuucccuaggcauugugggcaucuuugagauuucgaaugguaccaucucuuugaaucgucauaaggacuauucugggacuuugcuucaucaauuauuuuuccuuuuucuugauucuucuauuucaucuucacugaauuauuucauuccaccuauguauguauucaagucuuccucccucccuccaacacuguaagagaaaaaagaauuauuuucucaauccuauuaucucuguuaagcuuucauccuguuuuucucuccuuuaacuucaguaguauucacuuaaugcuuccaccucuuaacaucgccaguuguucaaccucuugcaaucugaauuugauaaggaaaaugugguucauauacacaauggaguacuguucauccaugaaaaagaugagauccagucauucgcaacagcauggagggaacuggagaucauuaaguaaaauaagccaggcacagaaagacaaacauugcauguucucacuuauuugugagaucuaaaaagcccucaaccacuuuucuggaaaaaaaaaaaaaaauuuuaaggagaauccuagcaucuccuguucaauaagucuaauacuuuuuacuuuaaggucagauuuuuuuuggccuaucuauaggcacuguuagccauaucuuucuucuugauggucucuccuuccuagguuucacuugauucuccugcaucugccuucccugacucuucuuccaucccuuacugacaguguuuaccaaggauuucccuuggccugcuucuuucuuugacgcucauuuaaaccuuucccuucaguugcagaccucgucugcuucucccagcuauuccauucuucaguugcuuguuaaacacggcccaccaucaccucaaauaugauguuaaaauguccccauuuuuuaucaaacuuaaguuucuuccuguggaucuguugcucaguacucucaucuuuccgaucaccuagagguaaaaccucaacauuucuuugaauuuuuuucccccuuuuguuugccacaucuaauuaguugccaagucuaauaauuuuaaccuccaugacaucuuacuucuuuuuccccauuucuuuuuuuuuuuuaauuuuagcuuuauucuuuaaugaacucccaagcacucagauucccauuucuacugugacuauucugauucaggcccugauuucagucagucuuuugcagugacucucccacaaacuuccuaauguagaacuguagaaagagcaugggcucugcagucagauagaccuaagugcuaauugugaagauggcccuucuggcugucugacuuauagaaaauaauuuaaucuuaauugacagaugagaaaguuuaggcacagaaaaguuagucauuccaguucagucacagagaaguuagucauuucuaccucaugaaguaugccauucugaaggguaaaugagacaaugggugcuuagugagaagguacucagaaaaauauuauuucucccucccuuacuuuugaucucuuuacaacccauuaauagauuaaucuucuuuaaguauaaccuucaucauaugagaaucuuguucuucagugguuccccauugucuaauuuuccauaauucuuagccuagaauuguauacuaucaauuuguguccaccucccuuucugaccuuauuucuccccacuugucacaaacaucgcuuugagccaaaccaaaccacuagcaaugcccuauagcagaauggcugagaacaugaauuccagaaucaucuaaaucccaguucacguacuuacuuugugcccaugagcaaauuauuuaaugucccuaaaccuuuccuauucugggagggguggggagggggcgggguggggcagaaaaccaggauaauuauagugccuacugcauuggguuguuggaaggauacagugagaccaaguauauaaagcacuuggugccuggcguguugagagcagucacuguugguagaaguaguaguuguugaugcuguuguuacucguuucucccauuuccaucuccaucacauucacauucuuuucucugcguggaaugcauuucuuccccuuuguaccugacuacauuuuaucuaucuucaaagcucuuuccugguucuagaccacccucccccuacuuuaucuuuccacuucaucauuccuugccucuuuuagcuuagaaugcuuauuacuuucauauacuuaucuguuuuaucucuuuuauaaaagacuagaagugccuugagggcagaauauguaauucaauuuuuguaucuucgaaagcauagcaucuuacacagaaccaugccagaaaguauuuacugaauaaauauauuaauuuacuguaaccaauagcucuuugguuccuuugguucuaagggguuuauucuuacuucuuuaggaacuuuugcagagucuccauaaaccauugguacauuuucagaaacauuuaauuuuguuaucaacaugccauccuuggguucaagaagacuaaagaaaagacuuuauaggagaaggcaauaauaacaaaagcaaaacaaaaacugaccagaugacacugcuuuggauucagcaaaauuauuguuuuucuacacugccucuuauuuguuauuguuacaaacauucuacaccaaauauuauaguaccuagaauggugccaaauuaagcauuuuuggauaauaguggaucuaaaaucuguuuuacugaaguaaaaaaaauaacaaauaguuaauacauuaaaaugugauuaaauaucuaguucaguuuguuaaaaugagaaauuauuaagaagugucaccuucuuauguugugggcagauggaguauucucuugauaacuucucaaggaacaagccacagaaccugggaagugggugggggcggaagugggggaaucucuagaauuucuuccccacagugauuuggcacaacgccagcuguccuucagcaaagguguacuguguucuuguuaaaggagacuuaugcuuuuuaaaggcuuuuaugccuuuaaauguauagacgaauuagauagauuuuuaaaucgugaauuuuuuuuucuuuacugauauaacacuuggaagcaauauugaauagugacauuuaauuuucuguugucauauuacaauaucaaggaaauugauugagagcaggcagcuugggcaccagagaaguuuaagaaaauguuauauaagcacuuucugcugaacuuggggaauaaauacuuuuuugugauauguagauucuuguguuuuuauaacuguuuagggaagauguucugcuauaauggcugaauauaaguugcagagauuuaaacccgcccuuauauuaauguuccaccucauuaacuuaauuguuagggcguuuacacuucagugauuuaaauaaaauacucuaaaugugguucuguugucuuucccucugucuccuguuugaggucuagaugauuauguauuuaguuauguguuuucauguagacccuguuguuaauucuauuaagcguaagaugaugaugaagggaagcuauuguauaacuuuugugcugcugcagcccuggaagauaagggaauguauuuaugaaacuaaaauggucacuuauucagcugguguuuugucauuuuuaccuuccaguguuauucagaggaccaggaacuucauagcuauaagacuccauucuguuuuggaguucagauugcugauuauauaugagcuuucacauguauccagugauauuuauagcccuagaacccagauaaggcaaaguuuugcuuaaaaguaagcuauguuuguacuuuaaaauguuuccuaagcauuuucagaaaaaguaggauuaugcaaugaauuuccaagcaaagucaccuuuacaaauacuuucaccuaccugcaaauaguagacauauuuaugcaguaagguuuuuucuaaaugauuuacugccgguugugagcaucccuuagcacugucuaucccaaaugcaaguuacaugucuuuguuaaaaacauagagaaaggccagaugcaaugucucaugccuguaauaccagcacuuugggaggccaaggucagaggaucacuugaggccgggaguucaagaccagcuugggcaacauagugagacucugucucuauaaacaauucaagaaaaaauuagccaggcaugguggcacgugccuguaaucguagauagucgggaaucugaggcacgagggucgcuugagcccuugaguuugaggcuuguagcgagcugugauugugacccugucucaaaaaaaaaggaaaaagagaaaaauaaguuaauuuuucagggaaaugaagcuuuuauguugucaagcauuuuucauuuuauaacaguauuuaauugugaauauaugguguuaaauaauucuaugaaguaucugcuugacccauuuaaguugagcagugaauuucuguuuuaccuaaguucaucuuugugagguauugguguucauuucuaacuauuucuuuuauuuuccagcucaccagcgacuggaaccagcaacucugucagggauuguaggauuuauccuuagucuuuuauguggagcucugaauuuaauucgaggcuuucaugcuauagaaagucuccugcagguacugugcuauuuuugcaauuucaggugacugugccucuucauucuacugguuacauaauugauuugaauuggauuggguauuaguauaauuuacagugcauacucaaaaucuauguuuuuuuauaucugcuuuagccuccuucuaaaaacacugguuggcuucuuugauuccauuggcacauguuuaucaucugcucuuuaggaggcacuauuuauaggcacccuggggaccccaagaugugugugacauaggccuugcagucucauaacugaaaguugaacuggggaggcaagaaaguaauugccaaauacacagaguugggaagggggagaggucaguauaaucaggauuggagaaggaagguuuuguggaggagaguugaacugguccuggaaagaucugaucagacagagagcaguggaagaaugaagagggcacacgugggcuguguuuauuccacuucuguguauucccuacuuaguucaucugcuucuuuuucuuuuuuuguuaguggcuucuuaaaacuugagcuuccuagaaaaccacaaauuuauucagauauugcuaacuauuacauuuucaaguggaguuccuuucagaagcuauagcuaucagaauauacuaauuuuuucucuuaugcuuuuuguaaacuuuuugaaauuuuuuuuuaaguuuagcacauuugagacugcacagcuuuccuuucccuuauuucuauucacuuucucugaagaacucuugacacucucacauuaugaaucaguccucuuuuuuuggucagcauuaagugcagaauaccauuuguaaaaauccacugagcacacuuuauauucuguuuuuaaauugcuguuaguuuggggaacccucagaggguaucuuucugcaucuguuuagccauguaaagccaacagcagaugacaucacagguuccagcagcagagcuguucguaaaggagauggacaggacuucuuaugacuucuuaguuccucuuccaaacacccuuugcccucagguuaaagcucgucuccccuuuuaugcacaggacagcuggcugcugucccucggccuuucuguuuccuguccccaugccagaucagauuuauuccagcagaaggaguucaguuuucagcuguuuagaugaccuaacaaaaagaagaaacaaagacaauuuggagacugcugauagaaaaagcuuacaaauaagauacucuuuuuuuuuguacucaacauaguagaaauaacaguaguauagggguaugaagaguuguuggugaagcaggcuugggcuuggguagagaaaaucuugacccccacagaguuucacuaucuuugacuuauaaaacaguauacaaguuauggaaccuggggcuuagacugcauuaacuuuaaguuaaaauucagacaaggcuauuguauucacaaaaccaguuuaagggaacaguacuuuauuucaggcacucagauauuauaucccuccucuugggcugauuucuuuuuuucuccucugauuuaaaacuuaaaaacuaaggaaaguaguauaaauuacagcuuucuugcuuuugagauacugcaacaggcuaaaaccuaccugguuuccuaauuguuccuugucuucccucugaucaguaaugucucuggcucauugcaguugauagaguuuuagguuucagaagaacaauaaucuuauuaaacuaauuaccacuuaaguguaacugacugauagcucugagauuucucagccuauuauacauuuuaaaaagacaacuuuacagaccaugaauauugauacaaaauccucaacaaaauacuaucaaauuguauccaacacugcagaaauaauuaacaccacaaccagguggaauuuaucccagguaugcgggggccagucacccuuagaagccaauuaauccaucacaucaacaggcuaaagaagaaaaaucgcgugaucauaucaguagguacagaaaaagcauuugacaaaauccaaaccccauccaucauaaaaacuuggagcgaacuaggaauaaagggaaacauccucaauuugauaaagaacaucuauugaaagaacguacagcuaacaucaucuuuaaugaugagaaacuagaugcuucccccuaagaccaggaacagggcaaggauguccccacuuaccacucuguccaacaucauacuggaaguucuaauugaugcaauaagaugagaauaggaaauaaaagauauacagauuaggaaggaaaaaauaaagcugucuuuguucacagaugacaugacuaaguaggauauuguuaauucucuuucuauguagaauauguccaaaaucaacaacaauagcaaaaaccugggauuaauaaguaauuauagcaagauugcaggauaugagguuaauauacaaaacucaauugcuuuacuauauaccuacaaagaauuaaaauuugaaauuaaaaauauaauaccauuuauagugacaccaaacaaaaagagacacuucagaguaaaucuaaaauguauauacaagaucuuuaugaggaaaaugauaaaacucugaucaaauaaaucaaagaagaucuaaauaaauggagagauauuccauguuuauagacaggaagacucaauauuguuuagguaucauuucuucccaacuuggucuauagauucaauacagucccaaucaaaauuucaaguuauuugauggauauuaacagugauucuaaaguucauauggaaaagcaaggaugcguuguauagggaaaaacaggcuguuugcuucuguacucucacgauucucaauacuuccagagcuucauuuuugacaccagaugugugggagguuuucucauaucaacauauuccccaguaccagcuaggugucccuuaauucaaaucacuuuuaacacuaucugccuggaguuaacccagaugucacagguaaagaguucagucccacaagaaugcccccaccucagaugcuaguugcaaguucagguugucaccaauuggaaguucccacaacccccuccuuggauucaauaaucuacuagaaugguucacagaacucacggaaauauguuuacugguuuauuauaaaggaaauuacaaagaauaaaggugaauagccaugaagagguacauaggggaaggucugaaagaguccugagcacaggaacuucuguccucauggaguuggaguuugucaccuuccuggcacauggcacccacccagaagcucugugaaccccaucuuuuagggauuuuuauggaggguucuucauguaggcaugauugauuauuaauucauucucuaguuucucuccccuccccggagggugggaguaggacuuaaaguuauuagcuucuaaucauggcuuggucuuugugguaaccagcccccaucuaggaucucaccaagaauugccugauuagaauaaaagaugcucuuauuaccugggaaauuccaagugauuuaggaguucugugucagauacuguuuuuuaucauauauauauauauguauauauguauuugagauggagucucauccugucgcccaggcuggagugcaauggcaugguuucggcucacugcagccucugccucccagguucaagcgauucuccugccucagccuccugaguagcugggauuacagaugugcaucaccaugcccagcuaauuuuguauuuuuaguagagaugggguuucaccauguuggucaggcuggucucgaacuccugaccucuagugauccgcccaccuuggccucccaaagugcugggauuacaggugugagccaccucgcccagccucagaugcucuuaucacucaagaaauuacaaagguuucaguagcucugugucaacaccaggguccaugaccaaauauagggaacaaaacaaaaaagaccaaauauggaaacaagagucuccuagcauguuuauuuacaaggguuuuauuuuaggagcucugugucaggaaucaggggcagaggagagaagaaaaauauguggaacucucugcuuaauuuucuguagaccuaaaacugcucuuaaaaagucuauuuuaaaaauccaucauuaaaacacagacuuucuccauaauaagaaguuggaggggcugggcacgguggcucgcaccuguaaucccaguacuuugggaggccgaggcagauggaucacgaggucaagagcucgagaccauccuggccaacauggugaaaccccgucucuacuaaaaauacaaaaauuagcugggugugguggcgcacgccuauagucccagcuauucgggaggcugaggcaggagaauugcuugaaccuggaagguggagguugcagugagccaagaucgugccacugcacucucagccuggcgacaaagugagacuccgucucaaaaaaaaaauaaaaaaauaagaaguuggaggaaaacuggaaagggaggaauguucucacucugggcuuugauauucuuuaguuagguguugcuccauuuggcaguuacaguagaaccuguugugcccagcccacucuuaggaagcaguggauugggccuucucuuccuauggagggacgagucuuccucuacacacaggccaggugaggauaguagauccccagccauaauggagccugaaaucaggaauucauguuucaagguuacauguacaaauguaugcccucucagaacaauggccauuuugagaaagccagugagagacagccagaccagguccucuggccuagcacccaccagugccugccagcucagcccaagucuccucaccuaggauagcuugauggaauaacaauguauuuuaauuugcauaaagaaacuggaaagauaagagacuaaugaacauguuaggaacuggacagauggaaaauugagugggaaugagacuuuuccugguauauauuuauguguaucuuuuuauauguuauuuuuaauuuuugaaucaugaauauuugacucauuuuaaauauuuauuagcaccuguuauguaagcagaaagaaagacaacuuuuguuaacuuaauuaguagauuuuaagcaacaaacauuucaagaaaguaaagguaaauauuuuugucggggagccugaauauuuugcagggcauugcaacuucuuccugccccauguuagauuucaguuucccuagaaacuuaaagagauuuuuuuguuuuuuuguuuauuuaaaacaguucgucacaacuauggugguggagugugaaagaagcaugggguauaaauuaugaauggggaaaagguuagaguggucuuuuuuauuaguaggucauuuauaauuugggaacucuguguguaggcuuguauguuucugaugguugauacagaauccuuucuuuugucuuagacuaaauuacucuaacauuucuuacuuaccugauccagggaacuguaaauugguucauauggggauucuuagcuaucuggaaaaugagggcauugguaccugccucuguguucccuuagcacuuaaagucuuuguucugccauaacccaccugaaguauuccacauacacucauuuaguaguugagguuccugagagagugauucuaagaggagcaaggaaacaacagaaugcaaaguuggggauaauguaguccacaaguaguuugucauucauagguaauuuuaaaagauuuuccagcaaauucugauccucucaccuaaaugaaaaucaguaccuuugcaaauccacuugaccaaaaguagaaacucccauuguuccaguuaucgaggacuuuauaucugcauugaguacaacaauguucugguaagugacuagugcuugggaauauuuuuccuuuccuuuucccacugugaagauaaaugaaggagcacuauauaguguuagaauucucugcuuuguaaagauucuguguccuaaaagauggaauggaugauaagugaacaaaaggagaaaaugaagugucagaauguaaauggacacaaugauaaacuuuagagguuuaaaccagauagguucaagagugcaaacuagagugauuuuccgaguacauccuuagcccgacuuaaccugaaagaaaauacauacaaaauugggaaccugaggucucuuacuuuuaauuuucccuuauugaaguuuuaucauuguucacaacuuguauuggauaaaauauccuuuuuauuuucacuaaagccauuagucuuaagacauacucuuagcccucuuucugguugaucauuacauuuuacauuaggaauaaucucaaacgucacucuggauaauuuuugguuaguaaagguagaacuuucugagguagucugcucugaagacuugagugcaaaucccaggacacaggacuuaaaguuuuaucuauuuugaaguuaccuacagugguguuauucauaucacaauguuagaggagggggaagggcaguaccccagauugagugggcuuacugcuucucugauacuugauuuaagagcaaaggacuuauuugggaauuauaauuuuagaucugacugaaaauauguaguguauuuccugaguuugaguaauauauagacauuaaagcuuacuuuuuuaaagccaugaauucuaaacacucuuucugaaugcugaaaaugacugcuacauuuaucucuaguaucuugaggcucauuuaaauuugaggacccacaugaaucaacauucuugcauguuauuaaugguguuugaagauucagcacaaguuuguuucuuccagauuauuaacugccucacagggugauagcaagggauuuauucaaauacguagcacugaaguuuuucuugguaucuaaguuuaaacuggggaggcuuaggauggguauaguuuuuuuaaguucauaaguuuauuuuggaguccacaguaauauauaaauuagauuauuuucacuucuuaacuuugcucugaguuuagagaugguaauaaguuuuuugugaauugauaccuuaugaaggcauaagcuuuuuucacauuggcuuauauuacauguauuucuuuaaggcucaaccuugaaacaauuacauuaauuaggcuaauaccaaccuggaaguaauuugcauauggcacauuagaaaaaaaauggaaucuuuugauaucucaguagaaaugcugaccuggaaguuaagauaccugggucccaucugccaguaacuuugugacccugcauggguuauuuuaccuucuuguaucucaucuugcaauucugcaagaugaagauuuuagacuacauaagcccaggggccauuucuuaggucuuaggacagacaaucuaagauuucucggauucuaaaauuguuuguaaaagcuucuacaaagcagaagucaucaacuugcuuuuauuucuuaucuucuuucccauagacuuguugaugccuuuuaaagaaauuaugucccugcuggccaggcacgguggcucacgcuuguaaucccagcacuuugggaggccaaggcagguggaucacgaggucaggaguucaagaccagccuggccaauguggugaaaccccaucucuacuaaaaauacaaaaauuaacugagcgcgguggcaggugccuauaaucccaguuacuccgcaggcugaggcaggagaauugcuugaaccugggaggcggagguuguagugagccgaagauugugccauugcacucuagccugggcgacagagcaagacuccaucucaaaaaaaaaaaaaaaaagaaagaaagaaauuaugucccugcuaauacuuaacagaacuuuuucauuuauuuagugacauaucuaugcuaagguguggugcuuacuuucuuucaaaagaaauaaaagcauuuuuucugauuauaugcuaauucauuguuaaagaauuaggagauccuacaagacagugccauaaaauagaagauaauaaagauuaaauaacauuaaaaaguggagaaagaaaauaaaaaaguuauaaauaaauaaaauaaaaauaacaaaaaagaguugggggaaauguauaaagaauaaaauaaaaauuaucaccaaauuuucauacauguacauguauccauuauguccuuuuuucacuuaauauuaaaaaguaaauauucccuaauuauuauaaacauuuuaauaguauccuccuaauacauuguguggcuauuauaugaggcuuuuguuuaccuucauccucaucuuuuuuuuucuuaaagagacagggucucgcuguguuggccagguuggucuuaaacuccuggccucaaguaauucucccaccuuggccucccaaagugcuaagaucauagcaugagccacugccccugacccauccucaucuuuaaaagaaaauguccuuuauuuguuuucagagcaauacauugguacucuaguauccccuaaaggugaauagugacauucauaaaaauguguauuggaacuccuuaccucugcccucuucuuccucuccucugccuuccuuccugucucuguuuccccaccucuguccacucccacuuuuguccuuguuccuaaccucugcccaccuuccaaccucuggcuauuccuucaccuacauuucaucugcugguucccuacuggcucguuucccucagcccugcuguucuuuaaaaaacaaacaauaacaaaaccaaaaaagccucuuuacguaugcucucuucuaauuuuuugagagaguagacuacauuuguugucuugcuccuuuacccucuauuucuuuucuuuucuuuuuuuuuauuauacuucaaguucuaggguacaugugcacaacgugcagguuuguuacauauguauacaugugccauguuggugugcugcacccauuaacucgucauuuacauuagguauaucuccuaaugcuaucccuccccccucaccccaccccacaacagaccccaguguaugauauuccccuuccuguguccaaguguucucauuguucaguucccaccuaugagucuuagucuacuaugaucucuuuucugcuccuguaauucucucagauauccaccauuaagcucaccaguauccuuucaauugccaaauacagcagaaacucuuuagagucuuaucuuauguacccucucugccucaucugucauuauguucuuccuuuuaaacauuuccuuguuuaauuucaaaaaaugaauuuuauuucaggaaacauagacacaagucacuguuaauaguuuaauguauuuacauuuuucuucaugacaaaucucucauccguucauuuuuaugaaacuguuuucucccguuuuguuuuguuuuguuuuguuucucucuuucucuuccuauuccucaguuuauuugauacacuuucuuccuccaccuguccuuuacauaguggcauucuccaguauucuguccuuggcuuuauauucuuccaacuccaugcccucuucuugguuacuuucauaauggccuuuuugaaaaaauacacauacauuuauacauacacacacacauacacacacacacaguaaaauaugcacauaaaaauuucaaagccuauaagaguugauauuuucacagaaaaguaauugccucccaacuuucuuccucagagucauccuucuagggagauuaugugccuaugcuaguauauagguauuuauauauuuacuuaugcaauuauucuuuuaaaauuuuuaugaaaaugauagcauacucaauacuaauuugcaucuuuuuaagucuaaaaauauguaggaguuuauuucacaucaguacacggagaucuauucuuuuuaguggccgcaugacuuuuuauuaaauauuugcguuuuccuuuugcugcaccacauaacaucuuauuuugaaagaauucaaacuuauagaaaaguuuaaagaacagcagaauuaacauccaccccauauaccuaccuaccauuuuacuuucuucuuucuuuuuuuuuuuuuacugagucauuucaaaguuaauacuguagguaucaucucaguuuauuccaaaauugaauucaauauguaugucuuaagagcuaagauauucuuuuacguaaucauaauaccuuaaucacaccaaagaauuuaacauuaguauaguauuaccuaauagaaaaucuguauucaaauuuccauaguugcccccagaauguucuauauaguguuuuguuccucucucuaaucuaggagcuaaucaagaauugagauuuuuacuugguugucauaggccuuucauuuaacuacuauuaaaauagaagacugccaaguuagaucucuggaucaaacucuuuccugaagcagacugaaauaucugcuaaguauaauuauuuggaugucccacuagcagcucuagaauagcaugucccacagugagcucaguauuuucugcucuugaauuacuuuucuuccauaugcccaacuuagugcauggugucauucaaacguugccuaaacaagaagccucugagucaaucuuaaucuccucccucuuugacacuguacgcacuacuuccuuugccuuugauucucuuccuaccuugccuaccugguucagccuuuaagacccaguuuaagcuuuacuccaucuaggaagucuucccuggccuuucuuuuuucucuaugcagaauuagaugugucuccauugggcucccuuaguauccucuacacacaccugugccaucaguuaucacuuugggugguaauuauugacuuacguaucugccuuaauuagagugaccuccuuaaguugguguggacuuaacucuucuuuuucuuuccuuuuuuuuuuuuuuuuuuugagguggauucucgcucugucacccaggcuggagugcaguggcgcagucucggcucacugcaagcuccaccucccagguucacaccauucuccugccucagccucccgaguaucugggacuacaggugcccgccaccacgcccggcuaauuuuuuguauuuuuaguagagacaugguuucacuguguuagccaggauggucucgauauccugaccucgugaucugcccaccucggccucccaaagugcugggauuacaggcaugagccaccgcccuggcuggacuuaacucuuuucuguacuagggauaguaacaaaguaccugguuuguaaaugcuugauaaauauuuauuaaauggaauaauaugcuaguagacagucuucucuguaucaauuaaagauuuuuuaagugacacagacaguaaccccagggagacaggaguuagugaauguuucugaguacuuacuauguaccaguuacuuuucuuuguauuugcaaauguuauuucacuuaaucucuacaacuuuuauuuuucaaaagaggaaauuaaauaagugucccagauuauaaguaaauauuugaacccaagucugacugacucuagaaauaugcuccuaaguguuuuaaaggcauuuaaggccaggcacgguggcucacgccuguaaucccagcacuuucggaggcugaggcaggcagaucacuugaagucaggaguucaaaaucagccuggccaaccuggugaaacuccacucucuacuaaaaaguacaaaaauuggccaggcauggugaugggugccuguaaucccagcuacuugggaggcugaggcaggagaaucgcuugaaccugggaagcagagguugcagugagccgagaucgcgccacugcauuccaggcugggugauagaacgagacucaaucucgaaagaaagaggccgggugcaguggcucacgccuguaaucccagcacuuugggaggccgaggcgggcagaucacaaggucaggagaucgagaccauccuggcuaacgcagugaaaccccaucucuacuaaaaauacagaaaaaaguagccaggcaugguggcacgcaccuguagucccaacuauucugaaggcugaggcaggagaaucgcuugaaccugggagguggagguugcagugagccaagauugugccacugcacuccagccugggugacagagcaagacuccaucucauugaaaaaaaaaaaaaggaaggaaggaaaagagagaaaagaaggagugauuaagagaguuagucuaaauuuagagaaaacuauaguauccaauuguaggacaauaaauuaugguauauccccacaauuaaagguuauauaaucauuacaaaucgugugguugaggaauauuuacugucuugggaaaguguuuguguaguacugugaaguacuaaaaaguaguauauaaaaguaucaaucuauuuuuuaaaaugugucuacauauacagaaaagacuggaaggaaauacaugaaaggguuggcaguaauuuucccagaguuguggcauuuauagguuauauuaauuucuucuuuguauaaucuguauuuuccagauucucuacaaugaacaugaacuuuuauaaucagaaaaaaaaaggucauuuaaaaaguaaaggacuaaagaaaaaauaaucaagcagaacuuauuuaagguuuuagaauuauuaaacuggaaagguuugguguuggccuuccuugccucuggggugcaacuggccugagcaucccaggcagaugagugguuccuauuuuaagaucuucucacuaggauaagccagcuuuccucugccuuacaaucaguugcccaauaaccagugcaaaaggaauuuuuccuuuauacuauuuuaugaagaaaugauaaugagauacucuucugugucuuguggaaauuaucauuguauaaagagguuuuuuuuuucucucuaauauaagaaaagggccaaauuaauguuccugccuggaagaaaaaaaaauguaaugcuccugcccgaacuuuaucuuuuacuguauaaaaacauugaaagaagucgauaauguagauauuuaagaagaaccaaaaaggcauaggaaagcauggguuguuacaugucuccauuaguuuucuuuucagagacauucuaugcaugagguaucucuguuuuuccucuggguggcuguuuuucuagcauagcaugcaagacugauuagucuuaauuuuucacguugggauuuagcacacucuaguggacaguagcuuuucaguuuucacaguuuuuaaaaaaaucauaucaaauuacuuuauuggacaauucagugauauacuuacuagcaguaaaguuugucaguauuugaaucaaguaaugacccuagugagcuggaguaacuuugucagccacugggguguuguacauuuuuacaugauuuuuuuagcaguaggaggagaggcuuuuaucguuaugucagaacuuuuccccagugguuuuccucuuuugaguggaaugaaauugauggggguggccaaaaugaagaggaacacuuguaccucuaccucacacucuuuaggucuuagaaugugcuuuauguuuucauuuuaggacucuugagaauuucuauauaccagugugugacaauuuugacuguuuguaaauauuguuacauccuaucuugauggauuguuucuggaaaugggcucccaccggaaacaaaaauaaucuuuuauuuugcuuuugcagagugauggugaugauuuuaauuacaucauugcauuuuuccuuggaacagcagccugccuuuaccagguagguuuucuuccauuuuaaagaaacacuuaccauuauuguuuacuucggguaucaguucuaacaauugugcauuuuaaauaaauuauuaaaacucugaguucuuugcuucucuuuuaauuugagccucuuuuaacuuugugaccuaugucuccauuuugaguagacauacaucccagugaaccugauguuaaccuucuuccugugcugaggcuucaguggugguaugucaucugccuaugguaguaaagacuacuucuaggcugggugugguggcucaugccuguaaucccagcacuuuaggaggccgaggugggcagaucacuugaggucaggaguucaaggccagcuggccaacacggugaaaccuugucuguacuaaaaauacaaaaauuagccgggcauggugaugugugccuguagucccagcuacuugggaggcugagacaggagaauugcuugaacccaggaggcagagguugcagugagccaagaucgcgccacugcacuccggccugggcaacagagcgagacuacaucucaaaaaaaaaaaaaaaaaaaaaaaaaaaaaaaaaaaaaacuacuagauuuucuggugguugauuauucagcuuccagguucuacuuauacucuaggcugaggauuuuguauuggagggaaguuuuugaauagagaacagcacaguaaaaacaggauuuuaggauucaauuuagcaguaaugaauagaauggacuguaagagcagagagacuggaagcaaggaaauugguuuggaauuauuacuacagguagaagguaaugaaagccaacauaugguaauggcagugaggauagaaaaaaauagacauugagaaggaagacucacugggacuugaagacugugaaacuuaaggagggaagagauuuugcaccuuggugacauggagacugauagucacauuuccaaggccagaggaggcacacauuuguaggaaaggaaguuaccaguuacccaaaugcaagaaugucuuuguuaaaacguguuacagcaagcaaggcuuuuugaccuaacuuuuuuguaagugacacauuuuucuagcuugaauuagaaaaaauguuaagagucagaacugcaaauauaagacuaccuaaaguucaguggacgucuuuagggacguauuuugaauauauguauuugacuuuuauguaaagacauuagacauuuuaguuccaguggccucauuuuuuaaaaucacuugauuuucuuuuucuuuuuuuuuuuuuuuugacggagucucgcucugucgcccaggcuggagugcaguugugcgaucucggcucacugcaagcuccgccucccagguucacggcauucuccugccucagccucccgaguagcugggaauacaggcuccugccaccaugccuagcuaauuuuuuguauuuuuaguagagaugacguuucaccauguuagccaggauggucuugaucuccugaccuugugauccgcccaccucggccucccaaagugcugggauuacaggcgugagccaccgcgccugaccaaaaaaauugcuugauuuucuuaaccauuuauauuaucuucagaaauuuucugucaaaucugacagauuuaauggugaugagugacacuucaugcaggaaaugugaaaacauauuuguuaaugucacauagugcuuuaauuuuaugaaauauucuuguauauauuuucuauuuuaauuucuauccugucacaaaagggauaauaucucauuuuuuaaagugagaaaacggagacaguuucaguacuguccugagaucacauaaucagaaagugguagagucaguacuuaacucugggugucugauuuucaguauuguguucugucuacuauaucaugcugucuguaggcaaaauuccuaauuuguguaauuuuuauaauguaauaaaguuauaauuuuauaacuauacacaugaucucauuugauuuuuaucuaaaacugugagguauuuaauauaauuuuaugaauaaucauucuuauaaaauacaaguuuugguugcuuugucuuaaguaauuguaaaugcuuaguaauaauggcagaauguauugagcucuuauuuuguguuaagccuuuuauagucauuguaccauuaaauccucacaaaaaggaggauauaccauuauaucguccucacugagguauagacaguucuuauagcuuguuagugacuuaaacccagaucuuugugacuucagagcaggugacuaccaggcuauagauaggcauaccucuguuacacuucccagaacagccucgaguaguucugagaguugcuucgugguagaguggugucacucagguguucuuuuacuugagagaaguaaacaaauucaugcuuuaaaaaagaaaagcagaaaacuaauuuccuucauauugaaaggcaugaaacugccugcuuucuaaauaugaugagcagggugauaauaaugcuguuuuuuucccccacaguaaaacuuaaguaauuauguuuuaccauauaacaugcucugucuccaguugucaggauauuuuuaaauccucuuuagaucagaucugaaaagccauuaccacaugguuugucaucuuuuucuucaggaugcaggugcuuauggaagcccagagcucagccugauaggauuaaucuugauauggaacauuucaaauaggaaagcaaaggaucagugaagaaacuagagacuuccuguucccucaauguuuuacuuugaaaacuugaaacuuacagaaaaguugaaaaaccaguauacuuagagucaucaauuguuaacaucuugcaacaccuucuuuaucucacucucuauguaugugcauauagcguguauaaacacaccauccccgacuuggaacuuuuuuuacuuucuaaugaugcaaaagugauaugcacucaguagaaacuauguuucagguacucacaugaccauucugguuuucagcacacuauucaauaaauuacaugagauaaugaauauauuugaauaaaauaggcuuuguauuagaugauuuugcccagcuguaggccaaaguucugagcauguuuaagguaggcuaggcuaagcuaugauguuugguaaguuaauuguauuaaauacauuuuuaacuuaggauauuuucaacuuauaaugaguauaucaggaugugacccuaucguaagccaaggagcuucuguaguuguuuuuaaaguaaguuuuagacauauguguauggguaaaguuuuucuaauuaaacuuuuuauuuugggauaauuguagauuuacguggaguugcaagagagaucuuacguacccuuuacugguuucccccaauguuaccaucuugcaaaacuauauaaaacgguaucacaaccagaguauugauacugauacagucaagauacagaacauuccugucaccacagggaucccucauguugccuuuuuauagccauauccacuuccuuaaucuaaccgcuccuuaaucucuggcaauuacuaacgcauucuccauuucuauaauuuucucauuuuaaggacauuauguaaauggaauuauauaguauauaacuggcauaguucagaaugcuauaagaaaauaccauagauuggguggcuuaaacaacagacauuucuuucucacaguucuggaaucuggaaguccagaugcuggcacaucauguucuugcugagggcccuuuuccuggcuugcagaaggcugccuucucaguauauccucacacagagaaagugcugagaucucuuccuccuccuacauagucauugauuccauuaugggggcuccgcccucaugacuuuaucuaaaccuaauuaccucccaaaggccccagcuccuaauaccaucacauuagggauuaagggcuucaacauuugaaguaaucuuuugugauaggcauuuuuuuguuguuuuuuugggacggagucuugcucugucacccaggcuggagugcaguggcgcgaucuuggcucacugcaaucuccacuucccaguucaagcaauucuccugccucagccuccugaguagcugggauuacaggugcgccaccaugccuggcuaauuuuuguauuuuuaguagagaugggguuucaccauguuggucaggcaacuucugaccucgugauccgcccaccucagccucccaaagugcugggauuacaggcauaagccagauaggcauuuuuuuagucagcauaauucucuggagauucagccaaguuguugcauaaucaauuauuuguugcuuuuuauugcugaguaguauucuaugauauguauucaauguacuauuaaaugauuuguuccuuuuuuuuuuuuaaagacaagguauugcucugucacccaggcuggagugcagugaugccaucacagccucaccgcagcuuugaacugggcucaaaccuccugaguagcuaggacuauagaugugugcugccacacccagcuaauuuucugauuuauuuuuguagagacggggucuugcuauguuuguugcccaggcuggucuuggacuccuggccuuaagcaauccucccaccucagcccccacaaagcucuaggguuacaggugugagccacaacauccagcuucauuuacuuauugaaggauauaugaguuguuuuaaaauguuggcuguuauaaagcugcuauaaacaauuaugugcagguuuuugugcagacauaagucuucaguucuuugggauaaaugccuaggaguacaauugccagaucaugugguaguuuuauuaagaaacugaaaaacuuuuccagaguagcuguaccauuuuacauucccuccagcaaugugugaaugaucuaguuucucugcauccucaccagcauuugauauugucacuauuuuuuauuuuagccacucuuuuaaguguguggugauagcucauugugguuuuaacuugcguuguuuaacaucauuagcuaaugaugcuaaacauuguuucauguauuugucauguguauauucagugaaaugucuacaucuuuugauuuuuuuuuuuuuuuuuaauuugugacgagucuugcucugucacccaggcugaagugcagugucaugaucucggcucacugcaaccuccaccucccggguuuaagugauucuuccgccuuagccacccgaguagcuaggauuacagguacccaccaucaugccuagcuaauuuuguuuguuuguuuguuuuuguauuuuuuuguagagaugggguuucaccauguugaccaggcuggucaugaacuccugaucucaggugauccacccaccucagccucccaaagcucugggauuauaagcgugagccaccgagcccggccuugcuuauuuucuaauuggauucuuuguuuuuucacuguuuuucuuaaagaguuuuuuauacaauugacccuuuauauuuguggguucugcauccauggauuaaaccaaccauggauugaaaauauuuggaaacauauugcauccauacugaacauguacagacuuuuauuucuuuucauuccguaaagaauauaguauaacagcauuaacauuguguuagguauuauaaguaaucuagagauuaaaguauacaagaggaugugcauaaguuaaaugcaaauauugugccauuuuauaucagagacuugaacauccacaaauuuugauaucugagggagguccugaaaccaauccccuauggauccugagggacaacuguauauucuagauacuaauccuuugucagaaaggaagugugcagguauccuuucccagucuauguuuuuuuuuaaaaaaaaaugguuucagaucagucuguaucuugucuuuucauccucuuaacagguuuuuucccagucaguuuuuuuuuuuaaugguuucagaucagucuguaucuuaucuuuucauccucuuaacaggguucuucacagaacaaaaguuuuuaauuuugauaaaguucaguuuaucaauuuuuccuuuuaugggucaugcuugugguggucaagucuaagagcucuuugccuagccuaaguuucucuacuauguuuuuucuagaccuuuuauuauaguuuuauauuuuacguuugugauccauuuugaguuaauuuuuguaugagaugugagacuuagauagcuucaaccaagguuccuuugucuauauugcuccagcaccauccauggcaaaggcgauuuuuuuuccuccauuaaauugcuuuugcaccuuuguaaaaaaucagcuggacauacuugugugagauuauuucuggguucuguauuuuguugcauugauuucuuuuugucuauccuuccaccacuaccacauagucucgauuacuguagccguauaauaagucauaaauuuucuuaguaguuuuauagaacuauucaaauuauguuucauguugagugaauuuaugguaguuuguguuuuuugaggaaaugguccauguuaucuaaguuaccaaauuuauguguuuagaguugguuguaguauucucuuacuggccuuuugaugucugcagggucuguagugguaucuccuguuucauuccugauaaugguaauuugcauguucucucuuuuucuuugucagucuuacuuguuaauuuuauugaucuuuucaagaaccagaucuuuguuuuauuguuuuuuccuacuguuuuuauggcuucaauuuuauugauuucugcuuuuaucuuuacuauuuucuuccauaugccugcuuugcauuuauuuuguucuuuuucuagguucuugaaguaggagcuuacaugauugguugagaauuuucuuuuuuauaauguaugcacuaacuccuaaagauuuccgucuuagcacuucuuuagcuguauuccauaaauuuugauauguuuuauuuucauuuucucuuauuucaauuuuuaaaauuuccuuaagacuuccucuuugaccuauggauuauuuagaauugcaucguuucacuucuaaauguuugaagauuuucuuguuaucuuucccuuacugauuuccaguuugauuccauugugauuagagaacacacauugugugauuacacuucuuuuaaauuuguugagguuucuuuuauggccccaaaauauggucugucuuguuauauguuccauagccacuugaacagaauguguauucugcuguuauuggguguguucuguaaauguuuagaucauguugcuugguauugucaaguucuguauucuugcugauuuucugucuaguguuauaccaguuggcuagagaagaguauuggauuauagauuuuuccauuuuguacuucaguucuauugcuucauauauuuuguagcuauguuguuugguucauacacauuuaggauugcugugucuucuuguugggugagcccauuuaucauuauauauguuccucucugucccugguuauuuucuuugcuuugaaauauuuugauauuuaucugguaucaauauagccacuuuugcuuucuuuugauuacuguuuaugugauaaauccuuuuccauccuuuacuuugaacuuuccuauguuauuuaaagugaguuucugacagacagcaugggguugauucauguuuuuuaauauccugccaaucucugucuuuucauugcuguacguaagucauuuauaguuaauguaauuauggauauguuaggacuuuuuuuuuucuuuuuucuuuuuuuucuuuaucuuccuguggguuacuuuaacauuuuaaaagauuuccauuucaguuuaucuguaguauuuuuuaguguaucuauuuguauagcuuuuuaaaugauugcuguaggcaucacguaauacauacuuaacucuucauggucuucucgugucaauauuuuacuaguucaagacaccuuaucucccuagauguguuuuugcccuccccuauuuauaauuggcucagauauuuccuccacauauauuuagaaccacaucagccaguguuauaaugauuuuuuuuuaaccaucaaacauaauuuagaaaacucaagaggaaaaggaaagccuauuguauuuacccauauuuuugcauaccauguccuuuuuucuuucccaauguuucaagauuccuucuuuuuaauuguuuucuuucuauuuagagagcuuccucuaaccauucuuuuaugguagaucugcuagcagcaaauuaucuuaaucuuucaucugauaaauguuuuuauuuuccuuuuauuccuaaaggauauuuuuguugaauacagaauucuggauuuggcaguauuuuuuucuuucagcacuugagaaauguucuaguuuuuuucuggccucugugguuucugaugagaaucccacugucuuguuaccgaugagaaaugaauuaucuuguuacugucaagugaaaguggguguccagagucccacguguucuccacugauaucacaauaagaggguagaggagggauucauugccaucuagugggaaugaaaguccuggcuucuacuugccuuuucugaagccaugcugaaggguuaaaacaucugcuuauaauguucuaggcucucaacauuugaugguguggguaugggugggucacagggguuuuuugugugauguuuggcuagaggauaauaguuacuguuuaaaaguuuucugucuugcuaaggugccucuuuccuggucuuuuaccagagagagcaagauguuauugagggucuuuuuuguuguuuguuuugauaugcaugccuuggcauuucuaguugccagcuucuucagcuccaagucugggauauaugaagcaaaaaagaaaacucagagaaccuaccacuguggcauucuuggaucucaagauucuuuauuugucugcuuuuccuccacaguucagagucuucuuaugcuuguuuuacauauaauguccaguguuuuuauuuguacuuagugggagaaauagggaaaagugugucuacuccaucuucccagaaacagaagucccugagccguuguuuuuaaaguaaguuacagacaucaugauauuuuuuaccuuaaaauacuucaugauguaucuucuaagaauacagacaucugucuacauagccaggacuucauaucacaucuaagaauuuaacauugauacaauauuaucuaauauaugauuccuauucagauuauuucuguugucuccaaaauguuuucuguggcuauauuucuccugauccaggauuaugcauuucauuugauugucguguaccuuuugaucuaugauacagucucccagccuuuuuguuguuguucuauuuuaguuugguuuuaucuuucuuaacauugacuuuuuuaagaguucaggcaaguaccacaaucuggauuagucuguuacucgugauuauauuaagguuaaauauucuggcaacagugcuguauaguauaauaugcugaauaucucucauugcuucagucaggaaaugugauaaguuugaucauuugguuaagauggugucuaccagauccccauugcaaagauaucuuuuucuucuuuguaauuaauaaguaauaugugggguagagaccuauuauuuuaaaagccuuggaaaaccuugaauuaaauauauguguguguguguguguguguguguguguguguguguauauauuacuggaaaugcuagcucauuuuuacaguagcauuccaagcaauaaauauagauaaaaaauggaaauauaaaaucaccauuaagcgaacaccacaguaaucauuguugcaggcaagaaucauuaauggauacuaaaauuaaugagcaaaaguaugaugagauaagauauucacauaaucucaacucccugcccccaagacaauaauugcaaagggaauagauaccaccuuauuaagugaucuaauuuaauauguaauaacauguauugcguaucaccucugauauucuugccaaaauuguauaaccucauuucaaucuugacaaaacaucagacacacccaaguugagggacauuccuacaacauaacugauuaauacucuucaagacugucaaggacaugaauuuuuuuuuuuuuuuuuuuuuuuuugagauggagucuugcucuguugcccaggcuggagugcaguggugugaucucggcucacugcaaccuccgccucccagguucaugccauucuccugccucagcuucccgaguagcugggacuacaggcgcccgccaccacacccgacuaauuuuuuguauuuuuaguagagacaggguuucacuguguuagccaggauggucucaaucuccugaccucgugauccgccugccugggccucccaaagugcugggauuacaggugugagccaccaugccuggccaaaaauuuuuuuaaaaaaagauggaggagcuguuacagauuggaauauacaugacaauuaaugcaauacagaaucccagauuagauucuggaccagaaaaaggacccuagugggacaaugggcaaaaucugaauaaagucuguagauuagcuaagaguauugaaucaauguucauuuccugguuugaugauuauacuaugauuacauaagaggauaacggggaacagggugaagaguauacaguaaacaaagcguauacaauaaacuguuuuugcaucuuuaacucuaaaauuguuuagaaagaaaaagcuauuuuuuucuauuuuuucagucuuauaugaugaaaaucacugauaaauacuuccaauucauuuugcuuggauagcagucuucuuuuuaaguaaacaguccaaauuugcauaagaacuaaacauauuuaacagaacauuuccacauucuuucugcauuauaacagacacugguguguccuucccauucugaagccuggacacaguuucucagagagaccugggccucucucuuagacuuugugguuccuauacuuaccagguugugaauuuuagacaucuucuagaaaacaguuuauucacucaacacauugagcacuuacuaugucccaggcacuguucugggcacuggagauaaaugaguaaauaacaguaaaaaaucucaccccucaugaaauagauucuguugaaagccuauggaugacaaacaaaauaagcacauuucucaaguauguuuauaguauguuguggagaaaaauaaagcaguaaagggugaaugccaggaugggcaggagcggugagagggggaguacuuucuugaccguuucaucuaaaauagcacccacuaucauucuuacucccuaucccuuuuuccugcuuucucuuuuucaagacauaacuguuugauauuauauauuuaaaauacauuuauaauucuuccccauuaaaauuuaauauuuauaugaacaagggcuuuguuuuacuuacaacugaagaacaaugccugacuuguagcaggcccugaguaaauauuuguugaaugaauucucccucaaauguucagucagaugcuguaccuagcauaguuccuuguacucagugggcgacuaguaaaauguuguggauuuuguuaauacucagacucagguuauauuaagaguccauuuuguagaauagcuuguaugugcuuuuuuguauuuuccugggugagaauggaacacccgcagacccugggaaugcuucuuaguugccugucaccauggggaauuugcucagccuguuugcaaggaagucauuccauuguacuuccauuuaaaauaugauacaaaaugcuuuucuucugaaaaaugaaaaacuuaagaggaaaaucuauuucccuuucaaacugugaaacuuucauagcugaaugucuuagauauaugcuacauuaucuuaucccuagauaaaaaauaaccuuauccauucuuauauuuuacucucugaccuguuacaauuuuauauuagaaacaucuguuucuuuuccuguaacccuaaucaucuuucauuuuuauauuuugaacaguguuauuuacuugucuacuacaccggcuggcggaaugucaaaucuuuuuugacuuuuggcuuaaucugucuaugcaacauguaucucuaugaacugcgcaaccucuggcagcuuuucuuucaugugacugugggagcauuuguuacacuacagaucuggcuaaggcaagcccagggcaaggcucccgauuaugaugucugacaccauccuucagaucuauugccuuggcuucagggggauaaggagggaacauaucauaacugcacugugaugaagaagcuguuccccacagaggagaagcucugcuuucuuucucuccaacuuuccuuuuuuaaaaucagcaugaugugccugugagcauggaagaguccucucagaagaauguuggccaugagacuaucauucagaggaggaggggauuucucucuucaaggccguaacaguggaagaacagucauaugccauuggaagucuuggccagcaguccugaauccuuccugaagaguucagaaaauagaugugguauugcucugaggaccaggcaggaggaacucuacaaccugaguuugccuuugugaggcauuaguauagaccaaauaaaaagcugcagaaauuggaaaguuuauguuuuaaauaaaugacugugauaaauaucagauuauuugcacacuuaugguacuacgaguuuauaaaguccaagauggugugaaauugguucuuuuuacuuuuauauuuuugcuugaaucuuaacucuggaaaucaccugauguagaagaagacugugaugagcucgucuguggaacaucacaaguaucgaaaauacaguaauggauguuuccuuucuaauccacauuuauuguuucuuuugaaaucacgucuaaaaaauaugacucacacuauagccguuguuucccaaacuucagucucuuuaguacuacuuguauuauuuucuuaauauuuaucuuuuaaauuuuaaaguuuuuuuaaaaaaaugaauccugcuccaaguggaaaaccaguaucaguuugccauaaauaaaagguaaccacaaaauaaguaagaugaacacaaaaaauguuguucaguucuagcuagaaacuaaugccuagaaaggcuccgaaucuuaggcucuuucuuuguggcagugagggagauguuaccagcaccagcaugaggcacugucucuggaauagucagaggauaaaaggaaacuguaaagggaaugacauucucacugugauucagcauuauucuauguugugcaucacuuaaagacauguugugugccaccaguggcauggguccgcacuauggaaaugcuugacuguaguaagaaucagaagguggcuuuccuagcaacucauuauuuuauggcuuugaggaauuaagccccuaguaucugagagaacuuacuuguuuuuugauaacguuuuaaagauuguuuaagcaguuaugaauuaauaauauaggaagcacaguuggauuccacuagcaaaaucuauaacucucaugguuuuggaagucaucuucaugggugauuuuccuuuguuuuuuaaagaaaauauuucaaacaaggaauucauaggauacugaaauuugauaucauccagaaaaacagaucccauuacauuguaauuguuguuacuaggcauauuuauuaaguagagaaauagaggguaaaaaguuagugaacugucuuguuugcgugaaccaguauuuguggauaugucuagaacuguaaaaucuugcuuaacuagaaccuuagucugcacccuccuuuuaggagaaugagguaaaaggaagacaauaagcuuaugauaucagggauucauguaaaacaggaaauaguaguuggcuccagucuucuccucuaacaaaaguaugcauauucugagagauaccccaaggcaucacaagauccugaaucaucaaaacaccauugaauuguguugggcauuuuguagccaggaaagugaagugguucaauuuagaaaggguuucaggccaggcacggugacucaggccuguaaucccagcacuuugggaggccgagacaggcagaucacuugagaccaguaguuugagaaucagccuggccaacguggugaaaccucaucucuacuaaaaauacaaaauuuagcugggugugguugcgcgugccuuuagucccagcuacucgggaggcugaggcaggagaaucgcuugaacccaggagguggaaguuggcagugagccaagaucacgccacuguacuccagccuggccaacagagcgagacucugucucaaaaaagaaagguuuucuaaacuaaugguuaaaacagaauuuucuuguaaauagggaaguuggagcauucugguugagauuuugcucuguauugacacagcucgcaccaguuugguucaggagcuaccuccuugucauugaauugacgaguuacaauguuugguauucggauacauucagcaagaacacuugaaaacuccucaccaacuauuuuuaaaggcuuacuuuguuuuuguuuuuauuuuuucacuggcuauuuuggauaagaggauguuuacaucuuaauguaaaaaaaugaaaacagguauaaauguuuuauguauagaaauguuuucuuucauuauuuggugccuguaucuccguguuuauaucauuuccccaccuguaucauugcugccaaaaaaagaacuuugaauuuagaaaaagaaauugguguaaaguccuggccgggcacgguggcucaugccuguaaucccagcacuuugggagcucaagguggguggaucacgaggucaggaguuugagaccagccuggucaacauagugaaaccccgucucuacuaaaaauaccaaaaaaaauaagcugggcgugguggcaggcgccuauaguaccagcugcuugggaggcugaggcaggagaaucgcuugaauccaggaggcggagguugcagugagccgagaucacaccacugcacuccagccugggugacggagugagacucugucucaaaaaaaaaaaaaaguccuuaggcucuuuagaaagaaucacuuuaggccuccaugguguaugaucuucuguuucuauugcacuucuaagagcaagccugaguuuaccuccucauaguuuuguagcauaggagcaguaguagcugcccucacucuaagggggaggacacagaggugaucagaugguaaugacuuagccaguucacauagcuaagcacacacaacccugaucuagugcagggcucuucgcacuagcauggaacuagugaaggugaccaguguuauauucagggaauaugacuguucuugguaaagccaaggaguugagggguucugaaauuggugaguccaggccugcugcuggaguauuuuauccuaauagguguauuuuauuuuaauuuagauaauuccuaaauacugcuuuuugauuaagguguaccaugagagcgaagauacccucuuuuauauacuaagauaauugcaauauuugcuugcuuuuuucagucuguauuugaaauauauuuacauuaauaccuggccucuuucccaaaagcacuugaagcagcauaccaagaaaagacauauacagccauguuaaugaaauaugaacagaaagggaagaaaaacaaaugaaaauugaagggaggguuuacauacauuauuguauguaaaauuugacucuggaacuuucuggaaaucaaggcuaaggguagggaaagaaguuaugcacugcccuaucaguaggugaaaagcauaccaguuccuuaggggagagccuuuccugaugccuucuaguaaagguguucucacuggggguccugugaagugcuaaaaugaacagaauucucgauuuucacacauuuacauguuaugauugugccuuggauccuuaccuuguaccagcuuucaaaggcuuccauuucaggauuuggggggauuuguguaggugugguuaauaaaggauuuuguuuucauagguaagaauccuaagcugaaaacaaguauuaagcuugaaaaucauuugagacaaaugccuuaagacaug

SEQ ID NO: 18104 - RNA, 88223 nt, Homo sapiens
ucagccgcgcuggucccugccuuuucagcgcuaccugcccuccgucugggaccuggcuccuuuccucucgccgguguuuccucgccacccgcggaggggagggcggaccccagccuccuugccgccugccccgccuccccgccuccccgccggcccggcucgggccgcgcaggcgcaccaggcgcgguccggaggccgagggcgaccacagcagccuccgccuccugcugcucaggacuauucugcgcugggcuagucggcggugacccggacugcgcccggcaguggcuucgcgggcgacgcgucgccaugggcucucgcuggagcagcgaagaggagaggcagccgcugcuggggcccgggcucgggccugggcugggggccuccuggagaagccgggaggcggcggcggcggcgcugcccgcggcggucccgggucccgggcggguauacgggcgccgcuggcuggugcugcugcucuucucgcugcuggcguucguucagggccuggucuggaacaccuggggucccauccagaacucggcgcgccaggccuacggcuucuccagcugggacaucgcgcugcucgugcugugggggcccaucggcuuccugcccugcuucgcguucauguggcuccuggacaagagaggugaggggucgcggagcgccagcccgcgcugucucuccuccgggagcaggcgccugcccgcgcuccaggccugccagccgccucccuuggccccggcauagggguugugugaggugauagaguguugcuagcauuccauuucugacuuaggaacccuccguccccaaagcgacaaauauggaaaggcaaccuugcaaauauuuauguuuuuuaucaaggcccuuuaugcaacaccagggauuuaagcgaucucuaaacguucaaguuuuuacacauugugaacaucagagcauccccgugcacgugcgguguauguguuuuacaccugacaaaaaugacugaugcuuugacuucaaagggauauggggauguugaggaugaaaggucggaaaauagauugacggugcccauauguaaggaaauaaugaguucguuuuguguaauagaugacuccagcccaggaagagcuauugggaaacucagaucugacacuuugguuucuggaagguggugcucggcagcuuuaaaauguguguaugugacuagauggcuuucucaguugagauuugugacuuucaauuaaagcuugcagaugagugaagaugcuugcuuagaaugguacccuggacaucucacuuuaccacuugccagugugauucucugagaagaaaaagccauagggcugagaaucaaggcauacuuaccacauaaguauggauaaaugauuaguagugacagucuacccucaagaggcuguugugcaagauuuuauauuuauuaauugaauaaugccugggagcuacuuuguacaguuucuguucaaccuuuuauaaguuuuguugcaaugaguucuuuagucagauuuggaagguugucuuaguccacuggagcugcuauaacaaaauaccauaaacuggguaguucauaaacacagaaauuuauuucucacaguucuggaggcugggaaguccaagaugaaggcucaggcagaaucggugucgggugagggccugcuuccuacacaguggucucuucacuauaacauaagauggaagaagggguuagggaaucccucugaggucuguuuuauacgggcaguaauccuauucacauggguuccacccucauaaccuaaucaccuuccaaaggcugcaccuucuuauuccaucauuuugaggguuaagauuucaaaaugugaauuugaggccuggcgcaguggcucaaguaaucccagcacguugggaggcuggggugggaggauugcuugagcucaggaggucgaagcuggagugagcugugauggcaccacugcacucugcccuggucaacagggcaagacucgucucagaaaaauuaauacauaaacaaaauaugaauuugaggggaacacauucagaccucagcaaaagucaaguguagguagguauagaauugcaauugucuggcauguaguuagcacucaaaauuaguugguuauuaagagaauagaauagcagggugauguuaguaguuauacuuccuucucuccuccuucacuggaauuccuucauuggaauccaugugaaaaagacuaaggaauaguugauugugaauuccuuaaugaucaacaauauaauguagcugcuaaaaaagaaaggacaguuuaggcauagaaacauaguguccaaaacaagaagcaaaauaguuugauaggcucuacauuaguguuuaguucugagcuugauucugagaaggccauuugacaaacugcagaacuuuaaagguucugcgacaagaaugauaaaggguauaaaaaucaugauguguaaaaugaagggaacuuguguguaucacacuucaaaaagaaacuugaggcaagauauagacuaugugaagaucaagucaaagaggaauucgacuuauguguuguucuaggaggaagaacuagacugagucaaguuacaaagaaauguaacucaaagcaauacaaggaagaaccuucuaacaaagauacccagcccugaaugggugugucuugacugcuguagaacuuccagcuagagcaaauacuuuugcagaggaugugugcuagaugccgaagaagggcuucuccuaccaaagggagauuuucuuuggguuauuguuguuugcuuuuaaacuaaauauugauuuucucuggguuucugcugggcucaguggcucauguuuguaaucucagcacuuugggaggcugaggcgggugggucacuugagcccaggaguuagagaccagccugggcaacauggugaaacuccaaaucuacaaaaaauacaaaaauuagccagacauguuggcaugcgccuguagucuuaguuacuggggaggcugaggcuggaggaucaguugagcccaggaaguagaggcugcagugagcuaugauugcuccacugcacuccagccucagugacagaaugagacccugucucaaaacaaacaaacaaacaaacccaaaguaguacuuuaccuauaaucaauguuacaauaauauuuuuuuaaaaagaaaaaagauuguauuuguuuccacugauguauuuuucuucuguuccaggauucggucuaggguccucuguuacauuuaguuguaauuucucuuuaguuuccuccaaucugugauaauuccuuggucauucccuuaacaagguuggcuaaauucaggggaaaaugcuguguuauaguuucuuuuuauuuuuaucaggagcauuuuucaauauuauuccccaaauuuagccaaccuuguuuuuuaugguagaaaaauguuaauuugcacccuucuuauuauaauuguaccuacuauccauggcaggauaaauuagaaacuacccauucacuuuauaaaauaagguacuuuaguucuucaguaguucuugugacuauauggugaauucaauuuuauauuuuccuuugguugaagcaauaaaaaauacauuuaaaaauucucuuuauuaggaaguaguuuucauuuuuaguagaagaaagcaaauacacuuuuauauguuggcuuuccugcuacagguguuccaucuacgcacguagaaagcagguucuuucuugcuucuggcauccuuggguacuaaaauaucuuuuuuuuuuuuuuuuuuuuuuuuuuuugagacagagucucacuuggucacucaggcuggaguacaguugugugaucuuggcucacugcaaccucaaccucccugggcucaggugauucucagccucugaguagcugagacuacaggcacgcaccaccaagccuggcuaguuuuuuguauuuuuugcagagacagggucucaccauguuguccaggcugguuuucaacuccuaggcucaagcaaggcaccaaaauaucuugcacccugggggguaggugguuguuuggccuuugugcugccucacgccccagccugauuagccuaggagacuguuuaucuuccuaaaauggguuuguaccuucccacccuuuuucauuuaccagcaaggagacagaaaaggacuagccagagagguaguagagccaagaccaagugugcccucgaagcuaacuaaaggaaguuucaaggagauagcaacccaguguguuccacgcacuggggacauggcccucacagacccuccuccuaguaaggagauccagacagcaaacaagaaaagcaaauauuuaguaugucaccuagugauauugauacuugcuuuggagaaaaauaaagcaggguaaaggaggaagggaaugugauagagugguaucauacuuuacauaagguuuuagggaaggugucacugauaagguguauuugagcagacaccugaaggaaaaaugacaccugacauguuaguucuggagaagacuguuucuggcaaagggaauagcaaagauaaagauuccaaacuugucuggcauguccaagaaagagcaauaaggccuuugugacuggaguagagccacugaggggaacagugguaggaaaugaggucagagagguggugagaggccaggagauacagggcccuguaaaucauucuuaaauggcaucucagccauuauccagugaggagggcucacuccauugacgggcuuuaaguggaagaguaaaacgaugacuaugcucuugucuucaggacaagagccagaacagggagacaaguuaggcuaguagaauaacccagaugggagcugaugauggcuuuugacuaaggugauaguaguggaggauuugagaagugguuagauugcagauaugugucgaaaguagauucaccaguauuuguugauggaugagauguggagcgugaaggaaggagacgagucuaagcuguuucucaacuuuuuaguauuacugauagggagaauacagcuucaauuuacuaaguuguguaagaugguagagagagcaauuuuggagcagauggcguggagaugagggauuugaaaugccuauuagauacccaaguagacagauuaaacugucaauuggauauacaaguauggaguuaaggggagaggccugugcaguauauuugggaguugucagccuacaaugguauuuaaaguaauggggcugguucaagcucauucuuauugguuaaaaaaaagaaaaaagaaaaauauaaaaagugucuuguggcugggugagaucaccuguggagaaggguggagcuucccuggaguagaggacugagccuuggggcauuccaacauucagagguuggggagauaagaaagaaccagcuaguaaggacugagaauagagcacuggauuuagcaacaucgagaucuuuugguguccuuugaaagaaucaucucccuugaaugauguggugaguuugaaauaaaauguaacaagaggaaucaaagacagugaguguagaaauuucuuucaagaauuuaugccauaaagggcagcagagaaauaggcaguagccagagggaauguggguacuaaggagguuuagguuuuguuuuguuuuuucuuuuuuuugguaagagauauuaaaguauaucuauuaaugcagcauccuaacaguucuauaaaaaggggaaaauugaugaugccggagggaaagggaggaacugcuguagccauguaggcaagaugggaugugguccuccagggcacagguagacaaguuggccuuagauagaagcauugacaguugauucuuuaguaguaacgggaaagaagauagaguauacacauaaggugcagaugguggaugauaagagcuuguagaaguuaucuuugcuuuuuuccccucagaaaaauaagaaacaaaaugauccccugaugagggagaauaggggaacaguuacuggagagaggauuaauuaugaaacuauuuuauagaaaaauggagaacacaugguuuacgaaauuguaguaggauucuuggguagcacugagggccugcuuucagugacugauuauuaauuugaagucagaccagucagcaugguuguguguuucccuccagccuguucugcugggcaaguacaggcaugggcagaguuggcagagagauuuaaccagaguugcaguuuuaccaggugaauaggacugacaaguacaggccaagaguagaggguuagguagagagcaaucugacaguggaccauggaaucuaaggaggacaaaggaaacacaugaggugguugagaagaaguagcaagcucccaaauugucauuccguauuuaaucaauaauuuguucuuguuagacuacuagagggaaugaaagggaaagagaggaggccaugguugaggaaugggguacuugaaauugagauuauggccuguaaucccagcacuuugggaggccagguuggguggaucaccugaggucaggaauucaagaccacccuggccaacauguagaaacccccucucuacuaaaaauacaagaaauuagccaggucugguggugggcaccuguaaucccagcuacucgggaggcugaggcaggagaacacuugaacccagaaggcggauguugcagugagcugagaucgagaucgcgccauuacacuccagaugaauagcgaaaccucaucucaaaaacaaaaaaagaaauugagauuaugacauggauguaguugugguaaagauaaggucagaguauaaccaaaagcauggauggcagagguagggaaaagagcguaccucagaccauggaacaagaggucagagaucugagagaccagcauacugaaaggaucaucuaguggauauugaaaucaccaaguuuaugaaaggaguaguguccugaggaguaauaaugagccaagacaucuuuaagcagugaaggcgaaugaccuggaggcaggugugugguggucuguagacaaccacagcaaggagcaguggguauuagucagaaaaaauuagaccaaaggcuguucuggccaugauggaguaacgggaacuggauuuauccuucugucuuaauuaaaaaugaaaaauaagaaaucaaaauauauggaacuaaauaaauuucaugagccaggcauagcacaccuguaaucccagcuacuggggaggcugagaaaggaggaucacuucaggccaggaguucaagaccagccugggcaacaucgugagacccuaucucuaaaaaauaauaauaaauaaauauuagaauaaaacaaaauauguaaaacaaugguuuucaaacauugggcgacaggcagggcaggacagggcagugaucccuaugacugcuucaguuuaccauccagagagaauuuccaggcaggaguacagaaauggggagcucagucagagcccagcaguuuuccugaauugaggagacggaggugagaauucaaagaggccaacauagcuagaauucuuaagguauaaaacaacagaggaggaaacuuuacagagaauguucuggaucugcaggguguuccucuugagucuucagcagaaaacugaucagaggauacaugugaggaaauuagccaagacuggaggaaggacugccaaaaaagagcaggcagaacaguuccccaggaucacacaggcugggaauaguucauguucccaagaccuggaauggaaaaaccucugcaaacauacuacaaauguucaagaagauagaagaaagaaagcaugagcacauuaaggagagacaaagaggacagaaaaagaacaacauugaacuucuagaaaugaaaaauguaaucaauguguaagacgaaaaauauaaucaaugucugagaugaaaaaaauauacuggacaggauuuaacagcagacuagacauugcugaagaaaaggucgugugacuugaguauauagcacuagaaacuguccacaauggaacacagagaaauaaagacuaaaaccgaucaaacaaaaaacaugaguaucggugagcugugggacaguuuuaaguggccuaauaugcauguaauuggagucucauaaggaaaagagagagaaguaagcagggagagcauggagugagauggaguggugcaagaaaauugaagaaauaauggcagaacauuuuccaaauuuaaugacuucuauaaacccacaaaucuaagaaauuuaagaaucccagcagaagacccauaaggaauccuacaccaaggcacaucauggucauacuucuuuaaacccagugauaaagagaaauccuuaaaagcauggagagaaaaaagaccagguaacuugugggcagagagaguaggaaugaucuggaaguggcagggaaagcaauguaagggauuucucugggaguaagaagguagagagaauguuuggagaagagcuucaggaagguagggauuccagugauuaugccugagcacuccagaaggcacagaggaagguuucuggaguugaggagguaggaagaagagaugaggucucauuaggggauguauaaagccauaucaggauaaagaugaccugugaaucuugaaucuuuugugucugauuuaaacaggaaaaacaggcaugaugucauuaguucugacaaucuccaaggcagauuggggugacaaggcugugaggguuaugagcagggaaaaggggaucugccccggagccagcagagcucaucuucacuucagcugauggaaguguggagccacgggaggguggucuuaccaggugagcucugugccuguugcugauuuuccaugcuuccacuauggguguguggguugugggggagggauuuagucaacucugcagccugauucuuuagacaucugcuguggagauuuccauuccuacacucaauggguccccagcaaaaggaguuaucacaucuguugaaaggaagcauucugaauguuggaugccauguuugaaaagaaauauuuuuauuuucaaugauguuuguuuuucugaaauuguucacagauggcuuuuacacuuacauccuauuacuguuguaaucacuuggggucuauuuauauaacaguccuauaugucucagaagccaaucuguuaggcaguuccuacauugcuauaaagaaauaccugaggcuggguaauguguaaagaaaagagguuucauuggcucaugguucugcggguuuuacaggaaacauggugcuggcauucacucaucauccagggaggccacaggaagcuuacaaucauaacagaaggugaagggggagcagccacaucacuuggugaaagcaggagcaggagagagaaagucggggagggggaugccacacacuuuuaaugggccagaucucaucuccugugaacucagcaagaacucagucaucaccaaggggauggcccaagccauucaugaggaucugucccuaugauccaaacaccucccaccaggccccaccuccaacauugaggauuacauuucaacgugagaccugaguggggacaaauacccaaacuauauuaggcuauucuccugggguccucauaacuccuuucccuugaugagcugauaucuuuuugauuacauggaauuauagaguuaugccuugucaggaugugagugacaugaggaaagcauuuuauucaagaucaucagcugggauagauuaaacaacacuuggcagcaauuaaaaauacacaagaaagccaccacacuguacuugugagguugcuuuauuuuucauuuuuguauuuuuguggagauggggucucacuauguuacccaggcuaaucucaaacuccuggcuucaagggauccucccaccuuggccucccaguguguuaggauuauaggcgugaaccacagugccuggccacagauugcuuuaauaagcaguuuuucacaauuuauuuacucuuaaaaguuuauauuagcuguuguauuguuaaauauuugauaaaaagcauaacugaguaaaguaugguagccuucagcaguaacaauaggaagccugguuauuggaccauauggccauaaacagugccucacugcuugcuuagugucugcuuaccuuaauuaaaaacaaacucuuuagaaaaaaauaaauaucauguagaauguaagccuaugguccccaaccuauaaaaauucuauucaguaucucguaggguacccaguauauccuuguaagagcaacauuuugugauuuuaggauauuuaugaccauguauguacguuucauuaauugcacucuguuuccuguggcuauaaugugauuuuuaaagucuguauucuguuaguagaagcaguaaaugagcaguauguaugcauuacuuguuaccaagaagcacaguucccuaugguauuccuucugguaaauuguauuaaucauauccagauuauauaagaauauuauaaaguaauucaguucauaucacaaauuauccuuaauguagcaugucuggaucucaaguuuauuuucuuugcuauguuugaucugcauaauuauagucuuguugacuuucaauuuucuucaaggagaguagcucuuuaaaaaccaaacauuuaaccauguacccucugcaaaaagagaggagagagcccuggaaaaaaagaaauauuacaucagucaguuuaugucuauucucugugugaagugguuucaaggugauguuggauuugggaaaaauuugaagcaauguggccaccuuugccauagacuuuguaugaaccaccugugugauguggcugccacaaacaguaagauauguuaauuuaguauuaacagaggcguagcauuccaacaauaggaggauagaguucuguuagauuauucugccauagcuagaauauuguugucuauuucugauuaucuuguuuuuguauuuguauacuuugcccucugugugaccaaccacugacacacauuuucaaaguaauuguuguguuuggaauacaaggggaaaaaacuaugugauccacauugucuucuaaaguccuaagccgugauuuuuuuuaacauuauuaagcauuauucuauaaugaaaaccaucggauaaaucaagaaaaaaauaaagacugugauuauauuaauaaucagagaguucuaaaggaccacuuccuaugacgcuuuaacaaccuuagcuuguucugauuaugaaauauguaguucccuaguugucaguuuugagaaaaguuaaggcaguacucuaucaccuuaaaauacuuuuuagggacaguuaagaguuuuuuuuuauuagcagcuuacauuugaaaauucagauuuuucuauuagagauauaaaacuaaaauaucuagucuuugaaaauuauuugccauauuuuuaaguauuauaucugaacggaacauuuuagacauuccuuuugaaaaauuagagcuaauagaacuucuuccuccaucuuugauaugaacauuccuauuuuccauuaaaguuagaaucaucuuauuuucuuuuuucuuuuuuuggaaacagagucucacucugucgcccaggcuggagugaaguggugugaucucagcucacuguagccucugccucccagguucaagcaauucucaugccucagccucccgaguagccgggauuacagguguaauccaccacacacggcuaauuuuuuuauuuuuaguagagacaguuuuaccauguugcccaggcuggccucaaacuccugagcucaggugaucugcccaccucggccucucaaagugcaaggauuacaggugugagccaccaugcccagcccaucauuucauuuucagcauguaggguucguuguuuuuuuuuuuuuccauuuuuaaaguuauacagaaaagccauaauauuagcauauaaugucaguaugauugacuaaaaauaaucuuuauuuuuaacauuggacuuaggagaaaaucaagauaauuucaaugucuuuguuucauuuuaggucuccggauaacugugcuccugacauccuuccuuaugguuuugggaacuggucuaagaugcauaccuauaucagacuuaauccuuaaaagaagguaaauccuguaaauaacauuucucccccauuuuucauuuuauuauguguauaaauuuuuaagaagaucaguaaagggucauauuuauagaagcguuuauuuuuuuacucuauaugaugauuaauuuaauugauauuuaucaguugucauggaagacacuaguuguuguggaaauaaaaagagcaaguuaaucuucauauuguccaggaacaauaauaaucaugugaaaauaauaguauaacauaccauuuguaaguauaauaauauaacauauuauauauauauauaguguaguuaaugcuacagaagaaauacaaaauugccucgagacuaggagaaguuuuggcuguggguaucaaaaagaggaguucauaaagguggugguaauuaaacuaggcauugaaugaugaguagaauguugguaacuauagucaggggaaggguauuccaggaugggggaauagcaagagugaagccauggaggcagguaagcauaggccuuuucugggguggauagguagucuuauuuguauauagcagccuuucugcaacugggaccguggauuuauucuuagggaguguaagguauacgaagguuuuaaauuuuguuuuuauauugguuaugauacaguauuauuuuaccaguaauaaucugcaauaaaaagguauuuuuguugaccaggauguuaauuucuuaaauuaguguuuccgagacugggguccuugaaugugaccuugagagucguugagaaauuuuuucccuuucagaaggacccauaaauuacucaaguucgagagauacuggucuacagauuaagguguaagaaugggauauaaaaagaugagguuagaagguuauauuuugauucugaagggucuugaugccauccuguauuauuaacaguguacuuuacucacuggauaguggaaaaccccuuaggcucuuaaucagaggagugcuaguaucagaccuauguuauauucacuauggauugagauauguaggcuugauuauaagggguagagauugcuggcagaagaccuggaaagauacagugggaccccaagcugaagucauucuuuuguugguucauuuauuaggucauucauucauucaacagaauucacugagcuucuacuaugugccaaccucuuugugggcauugggaauaugacagaagacaaagcagauaaaaauuacuauguaauguaguaaauuacauaguauauuacauaguacauaguaauuuacuauauaauguacauuacaugacauacuauguuugugauguaguuucauuccacucagggaaaccagcaauaaacuagauaaauaaguaaaauacauaguaugugcuauggagaguaaaacaaaauaggaaagaaggauaugaaaaggcgaggaaaggauggugagauuucagaaagaaaaaccuaacugggaagauaaccuuuugggauaaaaaccugacagaaguaauggaugaugcaguaucuaggaaucaagcauuauaugcagagagaaccgcaagaguucaggguggaagagggacagggaugccuggcagggaggcugguguggcaugagaaaagcagguagcaaaugaggucagagcgguuacagagugguagugggagggugggaccagauucuuuaagaccacgucagcuccucagcuuuuucugagcuaggaaaccacuggagguuuugagcugagagugccauggugcucggcugcuccuuugagaauggacugaagcuugaggucaugggcauaaguaaggaaaguugggaaacaagugcaauaaaccaggugagagaugaugguggcuuggaccauagugguggcagugggaguggugagaaguggucaaauucugaucaucuugaauauucaaaauguaauuauauucugauuauauucugguccauuugcugauggaccagaugugggaaguaagagaaaggaguccagaaugauuccaugcugugggaaguugggggaauggaaaggauggcacagacaugaggggaagugugagaaaaagagaugggaggugauaugcuggaaguuucacucgagggacucugaaauuguugauuccauuaacagauggggaacacagaagugggggagaguggauuucagggacaagauguugacuuucuuuuggaacagaauuuuucaguuucaaaauaaauguucaguuuugaauuucaaaauguguuuucuuucuagaaaauuuaggguacaaggguucauguuugaaaagggagauaagacaaucaucuagguuccuauggaaagcuagucauaauuuuccauccuucucaguuagauuuuaacacaagucucauuauuguauuugagaugcucuuaauuuuucaaacacccagagguguguuuuuucaagcauccacagauuuuaaguacagauuuucauguaagcuuaaauucaacacugcuuucuuuuaaaaugccuauuaaggccaggugcaguggcccacaccuguaaucccagcacuuugggaggcugagacagguggaucucuugugccugaaguuugagaccagccugggcaacacagcgagaccccaucucaaaaaaaauaccuauuaauauuuuugcuaguuuuucuucuguuuugggccauccauacuauuacuugccuccagucucauaucccuuuauauccuuuccauauacaaaauucugggaauaauagaguugacccuccaucuuguuggagaaggugguaugaaaaagaaacaauucauaaauaaauguaaacaaauguagaacagguaagaaguagaaauaaaaaguucagagauugaaucuuucauaaaaagaguguauaaauugaauuuucaaucuuauacauucaucuauaaagaauacaggaguauuaaccccuugaaauaagacuucauuucguagucuuuaagcauaucuuuuaagcaguguuguuaacaaugcaugaugaagcuguuaaaaugaaaaugcuacaauuggaacauguauuuucaacaaaucagguguauagccaucacuuuuaagcuucagucuccauccgauguuccagggaaggccaguguugaaacaagcauuuacaagucuguguuuuuguggccuuguuucacucggagcuuuuugagcuuuugacccagccuuuuggaauggcuccccugcacccuugacuuccuguaucuuagcucccuuaaguaucaagacaugagaauagcagcauucugacaagcucuuccuaaugguguucuacuuauauauaguaucaguauuuauuuuauuugcauaguacugaugaaaacucaggaaaaaauuauuuugccacguuuuucuuauaacaucuuagauaaauaaggaacuugguauaacaaauuauaaagcauuuuuucuucuaugaucucgaacaaaauaauaccccaaaaaaauuguaaaagccaucacucuauugcaaugagcgcuauuacucuauagugugaaauauuauuauauugcuuucccaguaaacaacuuaaggacuucugaagggugaacuuauaguaaguuauaucugcucguaaucauagguguauccagugauuccuguaacacaugccauguauauuuuuaaauuuuauuuuaaguuccaggaugcaugugcaggaugugcagguuuauuacguagguaaacaugugcaacacaugccacauuaucuuuucaguucgguguaauuuucauuaauauuaacaauacuuaauguuuaccaacauguauuaaauaguuugguucuaguaaacauagauuuucuagaaauauacuccauugugaaauacuuugcagcuggcaggauuauguuuaaaaugacccuaacagaaaaaggugaauuguuuagugacugauuuugugacagcugcuuagcuaucugaauaaacaggaagaagaaccuagaucccucccuuaccacuuaaguaaaucccagcuguaucaaagacuuacauguaaauaaugaaucauaaaaguauuagaacaugacuguuuuacagaaucugaggguggagaggaccuuccaauuaagacacaagucccagaagccauaaaagaaagccuugauauauuugacuauguaaaaauuuagauuaucuuuaugauugaauauacuauaaaacaaagucaaaagaugaguuaacugggaaauauuugcaaccguaagacaaaugaguaauuccuuaguucuuugaaaucaauaagaaaaauagcaacucaauaggaaaauagguaauggauaugagcaagcaauuacagaaguugaaauauaaauggcaugaacucaagagaaguucaagagaauucuuucuugagaacucgagagaacucaggagaauauucagcuuucgucauaauuaaauaaaugaaaauuaaaauagcagacagaugucuauuuacuggcaaagaugaaaaaaauugauaauguucuaugccugagauguggggaaaaacaggcacugcugaugugugagcaguuuggggcaucauccuauuuggagggcacuuuggcaguauuuaccagauucaaauauacaugucuuuaaccuacaccuauauuugcacuuauagaaaauuagcccacauauaaagcucugucaguuugcaagaauuaccauguuugugcagcuuugcuuguaauagcagaaggcuggauguaacccagaugccuucagcagagaacugauuaggaugcaguauaucauggaaucauauugcaccaugaaaaggaaguaaaaguccuauaagugcuaauaugaaaauaucuccaaaauauauuguuuaguuaaaaggcaaacuuuagaauauuauguuuaguauguucuuacuuggaaaaaaaugggaaggguaucauugguuuuuucugggaagagcaucugaggaauagaagucugagguggaaaggacauuuacuuuuuauuuuuuacuacuuuugggaauauuuuuaccaugugcauauauuagcuuuuuuuuuucuuuuggaaacacucuguugcccaggcuggagugugguggugugaucauagcuaauugcagccucaaacuccuaggcucaagggauccuccugccucagccucccauguagcugggacuacaggcaugugccaucacaccuggcuaguuuuuaaauuuuuuguagagacagagucccaauauuuugccugaguuggucucaaauucugggugcuagugauccucccaucucagccuuccaaagugcugggauuacaggugugagccacugcacccagccuauauuaccuuuuuaacugaaagcacuagcuaaguaaaacuaaaaucaccaccucagagccuuaauaauaggaaaaguaaagagaaggaaggguuauaaauuugcccagcauagaaauguaaaucuuuugauguaaaaaugagcaauugguagauuuaagaacuaagacuuuucucaguaaaauacagaagauucagauuccccuauaucagugucuucuaaaauaucauucacagauuuccugcuuauuaaaauacagaucccagggcuccaacccagucccacuuaguuaggcucuugagugaacccugagaaugagcaguuuuaacaagcucuuuuaguuagucuuacacucauuuaaauuugagaacuacuuuccuaguucccuagucuuauacucauuuaaauuugagaacuaccucccaucuucacuuuaaauaguaauugauuaaacaaauaccuuuaugcuuguccauccuacaguauaaucacacaauacauuuaaugucuuauuuuaaagcagauuaaggauuagccucuauuuaauaaaucuguuugccuuaauuugacucuuaaaacucaaggcaacucaaggcaaguaaaacucaugacuaugucugcauaguggucagguggacuuaagaaagauuuguaagaaaagauaaccagucaugauaagcauuuaagagggaaaaaaagggaguaaaagguguguaaaggcagggcgugaugccuuuauaaucccaguacuuugggaggucaaggcgggcggaucaccugaggucaggaguuuaagaccagccuagccaacauagugaaacccagucucuacuaaaaauacaaaaauuagccgggcguggaggcgcuugccuguaaucccagcuacucgggaggcugaagcaggagaauccgggagguggagguugcagugagcugagauugcaccacugcacucuacccugggcgauagagcgagacucugucucaaaaaaaaaaaaaaaagcuguguaaaauugucuuuagaguuuuggaaaacucuuuuuuuaaccuuuuuguuguuuuugaaauacgguuauuuaugagacauuuuuuccaagggcccacaaugucauuuaugaauuuuuuauugacuuuuuucuuguucgguacaucauacagagaaguauauacaacauacauguguaucaucagacugauacccauguagccgucacucagcccagacuccagaagucuccugcgugccccuuccugcucauaauccucucucucccuccuguauaucaucacaaucaugaauggauagaauuuucaaaguagaccgaguugaaauuuauuaagaauauauucaaaaccuauugcaaauguuuauucuuuucuuugaaauaaggauuugccuuagauuucuuuuccgcuuaauaccaaaggggcaaacaauuaaaacuuuaucugcaacaaaaugauuagaggaacaaaauaugcuagaggcagauguugauaacaauuuaacauauaauuuaaaaaaucaggauuauuugaaaaaucauauuuuauuaaauagaaguuuauguauuuuugcaaauucauuacauauuaguuuaaaaaaaugaauccuuacuuugcaccaugcauuaaaacauauuccugauggauuggagagcuguguauuuaaaaugagacaggauaagggaaaaugaaucuuaaagacauugcuuuauuucccaagcauaaaaacaaugaaagugguggcucacaccuguaaucacagcaguuuaggaggccaaggcagguggaucacuugaggccaggaguucaagacuagcauggucaacauggugaaaccucgucucuacuaaaaauacgaaaauuauccaggcauggugcauuccuauaaucccagcuacuugggaggcugaggcaugagaaucacuugaaccugggaggcggagguuacagugagccgagauugcgccacugcacuccagccugggccacagagcaagacccugucucaaaaacaaaaacaaacacaaaucacaaagggaaagauuugugauuuggguuuucagguuagaguuaggcuaacauuuugacaacauuuuccagcuuuaugcuucaaaacagauuauaaaauuaaaaugcaaacugggagaaauauguguugcaaauauaauagauaacuuauaaguaacaugagcauuuuugaaaauugaauagaaaaauggacauaguagacauggcuaacaauuguugauucucagauuucaucauuuaaauguauaauucaacagucaacauuuauugacagcauauguauauguuaguaaaguacagacugagcuguguaacaaaccaaaaauauugaggcucaauaagguagaaguucauuuuucucucaaggaacaaucuaaaacaagcuuguccaaucuguggcaugcaugcggcccaggauggcuuugaauguggcccaaaacaaauuuguaaacuuucuuaaaacauuuuuuugugugacauuuuuuugugaguuuuuuugugugacuuuuuuuuuucuuuuagcucaucagcugucauucguguuaguguauuuuauguguggcccaagacgguucuucuucuuccaguguggcccagggaauccaaaagauuggacaccccuggucuaaacaauagugggcuauucaggggaaguaggcagcuuuguucugaaagguccuccaggaccuaggccccuucucuguuguugcuccagcaucuccuagggugauauuauugucuguaucaugcugucauuccagcccacaggaggguaagugggauauccaaggcaggugacugcaucuucuuuuuuuuuuuuugagauggagucucacugucacccaggcuggagugcaguggcaugaucuuggcucacugccaccuccaccuccuggguucaagcaauccuccugccucagccuccugaguaacuaggauuacagacaccugccaccaugcccugcuaauuuuuguauuuuuaguagagaugagguuauuuauguuggccagacuugucuugaacuccuggccucaaguaaucugcccgccucggccucucaaagugcugggauuacagaugugggcccccaugccuggccuguuugugucauuucuagccauaucccauugguugcagacuuaaaacuuggccacauggaucuggaagagagguuggaaaaguagcucagcagcaauguauguaguuaaacucaaggaugccauaccaaaacaaagaaagggagaauaaauaggcagagacaguuaggagucucugcugucagaugccuccauguguccaugcacuccccucuucccauguagagaacauacucauccuuccucaauggagaaaacucaaaguccuguccaauuaaugcauccagcucaaaauccagaaucucugggcucuaucagaucuuuguggcucucugaaaguaauuucuuugauuauuguuuguggcuuuuggcuuuguccucuggaaagcucuuuuuuugguccauuauucccagugaccacaccugaagugguuguuggacauuucacuuucugcuugaugcugauuugggaaccugaagauuacuuuagggaucaagcagucuuaauccuugguagaagcguuuuguaguaucuuggcaauacgcuucccucaaaugcuuaauagucuuuuggucuauuuacaucagguagguuccauggaaauguagccaugccaaaauauuucuccuucugcuuaugguucuuauaccuguugaaucuccucuuuacuuuaccagcuuggguacccaucccagauuuucucaauuuagugguauccacauugaugccaucugaaaaaaguaggccugggaaggaaaauaucacccuuaaccuaauuuuugcugcuagacuggcucugaagcacauuuuauuuccugccauuuggauucagaagcaaccugaggcuucaaauuucuggauucucauuaaauuuauauugcaggccucgggcagagaaacucccuuagcagagcucuugucccuuccaucucugcuugcaaaccagcuaauucuuuauaucucucuugugccauccuacacucaguaaggagcaagaaacacagaguaauguucugauuuuuuuccagcaaaucccaggucaucacaagcagugguauugcugcggccacaggucaccugccuuuucugccuacagccugaccacuaagucagugccaauauguugugccuuugugaaugcagcaccccaauucuugagcuaauuucucaauuagaggacaaauuaaguugcuauaaugaggagaucucaaaauagagugguucaaacaagacaauauuucuuucuuauuauuaguccagaguaagcaggugggccagggcagguagcaguucugaucuacgagguugucuagggaccuggguucccucuaucuuguuaccuucuccccagggagaugaccuugacaguauagucaacagccaguucaucagcacaguggucacauugcacccacaggaagaagcagagcagggagaacaguucugucuucauggaggugaccuugaggucccccugcucuaaucucauuggccugaacuuaguaauaacaaggccccagcuaucugugaggagcgcuuuuacuccugcaaaaacuuaaggucuucuguaacuaaaaggaaaacagaaugacccugggguaauaguuaaucaucucuaccacaggcaaauuggcuaccuauuugggaggaaaagaccauuuuguauccucaugucauauaaugugucaaaauaaauucaaauaaacaaaaugguuaaauauuuagcugagaaacaauauauggggguauuuaucugaucuccacaugggaaagauauuuuuuccaagcaugaaaauaaaggaaaaucauaaagagaaagguagauagauuugaggaagaagaagucagagaaauguuuucuugcaucuuccagcaacugcaguugcugccuuugaaaacagaggaagagggcccugagccaacgaaugcgggcggccacuacaagcuggaaaaucagggaaacagauucucuucuagagccucuugaaaggaacccagccuugccaacaccuugauuuuagcccuagagucccauguuggacuucugauuuauggaacuguaagaugacgcguauguauuauuuuaaccacugaguuugugguaauuuguuauagcaggacuaggaaacuagucaccaaguuuugcaugugugugugagagagagagagaguguguguguguguauuuuuauuuauuuauuuauuguuuucuuugauuuuuuuguuugagauggggucucauucuguugcccaggcaauuguggcucacugcaaccucaaucuccugggcucaagcaauccuccuaccugagcuucacaaguaccuggaacuacaggcaugugccaccacacccagcuaauuuuuuuuuuuuuuuuuuuuuuuuuuuuguagagacaggguuucacuauguugcccaggcuggucucaaacuccugggcucacaugauccaccugcccuggccucccaaagugcuaggauugcaggugugcaccaccuugcccagugugcauguaucuuuaaauagugaugcucugugcugaugaagcagacacugucagcuacuacugaugggaauguaaauuacuacuaauccuccugaaaaacaguuugcgaguauauuuccuaagaucuagaguguucacacauuuuaacuuacugacccuaaaauaauuuugaaaguagcuaauauucacauacaaagauugucacaccagcauuauuaauauuagcaaauaaguuguuggaaacaacuauccaacauuaggaaaaugguuaaaugagauuuuauauaucuguauaauauaauaucacaaaaccauuaacaauuauuauaaagaauaaugaaaugagaaaaugcuugauagaccauaaaaugacuuagugcauaagcuguauauucaguaugguaucugugguuaccuauguacgauuaaguauugauugaucaagagagugagagaugcauuaggaaaaaaacugaagaaaagacuggaaaaucaaaauauuaguagugguugucugaauugggguauuccauuuauagaugauuuuuuuucuucuuuaugcauuucuuuucaaaauuuucuacuaugaauauguauuaauauauacucuuaaacaaaaagacaaaauaaaaguuaugugacaagaaacaaggaaugaaacaaaaugaggggagguagacaucuuucagaccaggacuaaggccauuuuuccccugugcauugcugagagauuauuguauaugaccuuaauaaaaaucuugugagagaaacugggcuuguuggcucacacuuguaaucccagcacuuuggaaggcugagguggguggauugcuugaggccaggaguucaagagcagccuggcuaacauggugaaaccccaucucuacuaaaaauauaaaaauuagccgggcgugguggggugugccuguagucccagcuacucaggaggugaggcaggagaauaguuugaacccaggagacagagguugcagugagcugaaaucacaccacugcacuccagccugggcaacagagugagugagauucugucccccccaaaaaaaaaaauauugugagaggccagccucuguggcuuaugccuauaauccuagcacuuucggaggccaaggcaggaggaucacuugaggccaggaggacuagccuggguaacauagcaagacccugucucuacaaaaaauuuaaaaauuaggugugcuagugugugccuguagucccagcuacuugagaggcugaagugggaggaucacuugagcccagaggucgaggcugcagugagcugccuucgugccacugcauuccagccugggagacagagcaagacccugccucaaaaaaaaaaaaaaaaaaaaauccugugagacagaaaguaucuuuggagaaauugaaacagaaagagaaugugauuuucuaaagauuauaugguuaauaaauuuaguuaagacuagaagcuaagcccugugauagcuaaucuaauauuauuuucacuguauuuuuuuauguauuuucuauagcugguacuugguaaguuauuaaaagcuucuuuagggccaagacuguaauguucaucuucauauucccuuuagugccuagcugcaggugccuugaccauagcagauacucaauagauauuuuuaauugaaucauuauugaccaaaauuaauaaaggauacaaaaauaaaauagauuuuugugaaagaaaacugaggcugugauaccaaaguuuuuggaaugcucauuacuuuuccaccaccaccucuauuucucuuuuccugucuuccuuuuuccuguaguuaauucauaacaucucuaacccucuuuauugcccaccuuuucuugggcuaaauaaaggaaaacuauuuccagcacuuuugccauuuucaacaucaaaaaaauccuauaaacacaugacuuuuuuuuaaaguuuuuuuuuuuuaaagaauaugagcuaagaguuuauuuugauauggcauaauuaggaauugggagaaaguuucugaacuauugaccuaaugaguuuuggagguaaguauuuuuauguauucuaaauuacuucauauuaaaaauauauagaauuuaaauucugaauacuagaauagcacugaggaaguaucugccagauuucuaaaaagccaacucgaauguuagcaucaauguuagucauaauaaacuagagguuuauaaagcagguugauuaacagaauaaaaauauucuguacugugugccuuuggauuuaaggaacauuggauuuucuuaacaaucaguaauuuuuuuuauuauuaacagagaaccuucagaaugggaucaugugagagaguagagauuuguggacugaugaaauuagcuauaauuuugauuucuaguucuggcugagccauuagcuaguuguaugacuggagcucccuccaauacuuuuuaaagaaaggaaaguuauaaaauuauaaaugugauuuuacauguguuauuaacuuucuggaagggguuggguuaucuaggugaggucugaagucacuucuggcucuaaagauuuuaauucuaaaacaucauauuauuuaaguagaaauaauuuaggagucauagguauuucuuccaggauauuagaaagcaaaagguuaggauaccagaauauuaaaugcaagcuaaaaugucaacuacauuagaagaugugaacuguagaucuucaauuugaacuucagcuauuggcauuugucugaaaagcuauagucaauugaaugauacagaaagaaaugcagcugugcaccagcuccaucccacgcaccccugcaggcauuguccucugugggcaggggcacuaaucgagggcagugggacucugcagcgcaccuggggcugagccuggcuggguccucuccuauuccugccacaggcuagaagucucagcagugcugaugcuagugggcagcaccaggucucccucucuagucuccaccauuccugcucugccaaugcaggagaaguuccccucugauaugguuuggcuguguccccacccaaaucucaucuugaacuguaguucccauaauccccacaugugggagagaccuggugggagguaauugaaucgggggugguuacccccaugcugcuguucuugugauagugugugagugucgugagaucugaugguuuuauaaagggcauuuccccugcacacacugucuugccugccgccauguaaggcaugccuuuacuccuccuucgcuuuccaccaugauucugaggccuuccagccauguggaacugugaguccauuaaacuucuuuuucuuuauaaauuacucagucucggguaugucuuuauuagcagcagagaauggacuaauacacccucucucauucacuuuuccaucuggcuuguggggaugggaugagccaggcuucagaaguagacagaggcuagguaaggaggaaaaaaagggaaaaggagaaagacuucagagaagagggaagaaaagggaguugggggccguggguugggagguggauggagaaacaggagagaguuaaggagucaguaugaggagacugggcugaaggaggaggcacacaucugcuuccugacagaucucucacagcuugaccugcagaggugcaagagaaaugcaguccauuaacugugaggauacacgugcuuucaucagguguggaguuucggguaaggaggcaagagucagaccccuugaauuaacuaguccauuacuggacaacugccuuucugcuccagagcuuauugcccagaagacaaaacugccuccucacacuccuaacuucugcccacccuucccaaguccacugugcuugagacaguuaugucacauuggccuugcuuuuaaaacacccuaaaacauccuuuuuuaaaaugucacauuggccuugcuuuuaaagcacccuaaaacaucuuuuuuuaaaagcuuuauuuugagaauauuagucaucuuguuuuuuguauuacugaauuuaaacuuguuaaaauuuaucaauagaacugaucugauguaugcauuuggauaacuuugugaaguuuuggaaacacaguuuaguugcauauuucagugacugcaugucccuguacugggcccagucugugaguucccgagagcauccacacugccuuagcgcuaugggagugaggccuguggggacugcugccaugauccugaccuacaaggaccuuaacuuuuaccuagcaaaacaaaacugaggcauguaaugaugacaaacaauuaauauuaaacugugugguugacuucacuguacugaagauuaugaaucccccuccuucguuuuucuuugucguuuuuaauagucagcccagaucaacagguacuaguuucugagagccagcuucuuucauaagugcuuagaaagcauuaggauaaucgugagucgcauuuuaucuuuuaaugugugaaaguggagagacuuuuuaguucagacuguucauuuaagcuggauguuuuuucuuuucaguucacuucgcuaagcuuauauagcuaauuuuuauuccugcaucuguuucuucuagaaauagucuaaaucuagauuucgauuuccucaugagucugacuuccaugcugaacacuccacugaaacugcuucuacucagaccacaaaugaccucuucuuugcugaaucuggugguuacauuucaguuauuauaaacgaucuuucuguuugaugugauguuguugaccacuugcucuuauguucuuggaacucgucucucuuuaguugccgugauaccagucuuuccucuuuugcuuuuuuucugccuuguaauggcuccuucucaaucaucuugcucgacucccauuccucuauuuuuaaaauguuguuauucucuaguguuucuuccccaccccaauccaccuacaacuuauauuucucagcucagacugcuuuucuuagcuucuggccuauauuagccacauguuagauguuugcacagaguuaugggugcccuccaguauccacccccucuccuugccauauauauuguaucaccuuaacgguucuccagaccauccgcccuccaccuccccacuguguugccaguaccacuuuaaaccaugccauagagucccuguccuggauuccaugccugagggugucccauucuggcuuucuuucagccuugcccuuccauguggguugaggauuucauagggccaaggggaugugcacacccugcccucuacccucuagucuuaugcacuagcuacacaagaccccagaaauaggccuuacaacaagccuguuucccaggccugcucuuccaagaguaggcugcaucccugcuguguacuuccuaggccuaagggauagcuaaggggcagcuguuuggaggggauaguuggagcuuagauggaguuggaccuucagcuccacaugcauauaugcaaagcccugauauauaggccagggccagaggucagaagagaagaaggacaugcagagaccuccaucuguacucuugucauaggcagcauaagcauagggcaaggccuaacuauugccuucuuuuucuuuauauuccugcuacagugcuaguaucacuguacuuuuagggauucuuaagggcaagggcuuuagcuuuuuaauuuuacauucucauuugccugucacagugccuacccaacacauggugacuacucaauauauguuuguugaauuaaguaauaaaugcauaguuaccauuuuauaauuauuuuauuuccuuuauuaucauuuuaaagagguuaugguaauguucauaugauuuuaugaugucuuagggucaauauuuuuccagaaaaaauguaucucuaauuugcauuccuauuaaauggaaaaauuagacuuaauguauaaagcagaauuuuauuuuuacauaucuuuuuacagauuuauuucguaaaaugauguuuguuaaugguaggugguagaaaauagugucaggcaaacaugacaaucuuaauauuacagauuacuguaacaucacaguccccaggacaacagugcuuaugaccaguuguaacacauuagaagcugcugaacccugagggacgcuaggauauaagugucagaaggagcaggacuaaguucuggaaaacuacaaagugcugggaggagugggacuggguuucccugccagguuucucaugaauucagaggauaacuaguucuccuacugagcuuguuuaugaagaguguauguaugaugacuuuuaauacaaaagcauguaauuaucuaaaauuggaguaacuuugcaacaccacauaagcuuauuuuaauuccugagaugguuuuuaacucuaacuuauaugcccuagauuggccucccaaguucaaggaccuuuaaaccaagaacccaucugaagugucccuggugcuauuccuucuuuggauacuacuuuaacacguacuguaucguagugagaaauguucuggucuaagagucaaguaaacuggauuuggauggcccuuaaauuaucugaaacucacacauucucugacucuuaggucagacucugcugcuuggguaauagucuauuugugauuccacugagaggugacaaagaguuaagccauggcaauaauuugaguuuuauaccuuaacuaugaggagcuucacuuugcuucucuucucuucucuucuuucuuucucuuucuuucuuuccugucuuuccuuuccuuucuuuucuuucucuuucuuucuuucuuucuuuuuccuucccucccucccucucgucuuuccuuccuuccuucccucccucccuuccuuucuuccuuuccuuuccuuucuuuuuuuuuccuucuuuuuuuuuuuuuuuuuuuugagacaaaaucuugcucugucgcccaggcuguagugcaguggcacaaucucugcucacugcaaccucugccucccaagcucaagugauucucgcgccucagccuucugaguagcugggauuacaggcaugcgucaccaugcccagcuaauuuuuguauuuuuagaggaggugggguuuugucauguuggccaggcuggucuugaacuccuggccucaagugauccacccaccucggccucccaaagugcugggguuacaggcaugagccacuguucccagccaggaguccugcuuucuuaucagucuuuuuguuuguuuguuuuugauuuauuucuuccauguucuccuucuacccuuaacauuuuuagacauaguaaaguuuacucauuccaagccuucuaguugacaugagucuaauaccucauuaaaaguaucaaauaucaaagcaguuacuuuaugggucaucacacacugucucauuguugugccaucacaugcaaugauuaaaaccacuuaaugacguuauugcuggaacauuucuguaauaaaauugcugugggacagcuuugguuccacuggcuuuuggaggacauaaacaguuuaaauuauuucugucaucuggaaaauaauuccccuuacacagagagauuuuuaaaugucuugaguuuuuuuaauuuaguaauaucaauaucaaugacacuuggagcuauguugccuucauauaauuuuuccaacauaacgaagcuaugggcagcccuaauucacauauuucacuucccacucacuucuguuucuacauuagggcccuuccucuccccacgugccuguuuauuuuucucuucggcauucagcaaacuuuucuaacuggcuuaagauggcaguuuaaaaaaaaaaagaggauuugagacucacauagugcuuagaaagcaaaacaagcagaagaaaaagaugaguucauaucaugaaaugucacauguacugucccuucccuuuccucuaccuccagggcaagagaggucgacacaucucccuuucuugucuaugcuuucuuuggacuucuggccucuuuucuauuucaaggcagcucuuaaaugugaauguguauauugggggugagggaguaaugggagaaaagaguuggucaacaaggaacaggagugcuaaggagaauauugggaaaaggucagcaagagaacaaauggaauggaaaaaagaaacugcuuuucauuaacccuuacaauuaaagucagaauuagaguaugagaacuggaagggacuuagugguccugucauuacaguacccuaaccuaacagaugcuccguaaaugcauauucaacuucagcugaucuccucauuucacgagggaagaaauggaaccccacaaaguuagguauuguucagggcuagcccugagcucagcuggaacccagguccuccgguuccucaacuaccuuuucuauuagaagauauuuuaaugagucuuucauuuuuuguauuuccaccauuuggcaaagaguggguaugaaauguugagcucaacuauaaggcugguggcacuuaguaggucuguuaaugaguggcagucuaguagaaggaguauggauuuuggaaucagaccuggaucuaaacuucagcucugccugucagcgcuugggcaaguuucuuaaucuuuccaaaucuaggauuuuucaucucaguaaauggggaucauaauagcuaccacuuaguguuguuauaacaacuaaaugaagcaagguucuaaguacuuacaggaaguacuuaguuugauguguggcacaaaucauaggucacaguaaauauuugugaaaugaauaaaugguaacuauuacuauguuugauccucccucauagggagucaacauaccuguuuuagaagguaaaucaacaugucuuuuaggcaugucauauucuuuacagauauguauacuuauugccauaguuaaaaacugcuguuuggcucauuucuuuuugucuuagaaaaugccuguuucaaauaccucacagccuuuuaauuuuuaaauuccagauuaauucauggaggacagauguuaaauggauuggcagguccaacuguaaugaaugcagcaccauuucucucuacgacgugguuuucugcagaugaaagggccacagccacagcuauugcaucaaugcucaguuaucuugggggagcaugugcauuuuuaguuggaccacuuguuguuccagcucccaaugggacaucaccucuucuugcugcagagagcagcagggcgcauauuaaagaucgcauagaggcuguguuauaugcagguaauuugaaguuuauuuucuucuuguuauacuuugucuuuuaucucaaucaucuucacucuacuuuuuguauaacagauaccuucauaugaaauacuugagaggacuaauauguaaauuuacaugcacugugcauuccuugucauaugauauagagaugcuuaauuaaaacugaacacucuuccuaggaaguuaaguuuuaaauuuauuauugccacauggagggguauuucuuaauuuuagucuuuucaucuauuuacgguuaaguacuguauaacacauuuucuauguccucucuagauaucuuaucaggauauaaaacgucaugacugacaauaaccuuuuguuaaacaucuaucuguugguagguguuaagcccguuuucucccuuguaguuucuccauuauuagccauguucuguaaccuuauuuaccuugaucaucuacaguuuauccucauuuccuacucucuguauguuuagucuguuaucagggauacugaccuuucuaaaauauucuuugaauuauuuuauuucuagagucaagcccugguccacucuuauaguauagucuccuacggauuuucauagauauagccccucucucuauaucccuguuuguuauuuccucugcauucagaacacuuuuuguagguguuuacuauaugccaagcacugugcuaagcacuaggaauugguaaggucaacgaugagacaauuauaauacaaguagagauauacagagguugggagaccuaacuugccuggguuuguagggaaguugagggggcaggaaaggcuucaacaagaauguaauaauuaaaguuaagaauuuuguaggaguucaccaaguguuugagugguuaguguauuccauacagagggaacaguaacugcaaaggcagggaagguaugagagagcucaguaugucuagggaacugcaaguaauugaguauggcuggagugguguaaauguuuguguuuggguauggguaacaaguggcagaaaaugagacuggaaugauaagggacccaauuauacugaaccuuguuuuaacuuuuuuguucacuuauaaauuucacaaacauguuuugaacgccuauguaucugucacuaugugagucacugagauaggcaugguuccugguguaacagaacuuacaguguccugaaugguacagacagguaaacaauuguaaaauagagcagggaguauuauaaaccaaaggccuacaauugcucugagagcucggagaaggagcaccuaacccagauuuuggagguaaaguagagcuuccuggagaugcagcuucuaaaucagagccugaggaaugagagaacgaugguuaaauacaguaggcaggaagauuacacuguagagaggaaacuuaaaggagaaguccagugaagggagacacccugguacguucaagcccagaguggcuuagaucuagugagaguacuaguaggugaagcuagagaggaaggcaagccccacgcaaaccuucuaagcaggccugaaggguuuaagguucaccacauuguaggcaaaggccacacucugaagaacuguaugucagagaguuauuugaugacauuuacauuucaaaauaugguuuagaaggauuaaaacugaaagcaaggguagcagcaguauauaaagcauuucaccuccuuuacacaacuuauuccuuuuaaagaaaaaauaaaaauguaaaaaugaguaaauaaaacugaacgcaggugaaacauaaguuuuaaacuuuauuuuggucauguuauuauuuuuauugaaaaccuaagcaaugauuguauuuuuuacaugauguuaagcacuguuaagcauauauuaaugcaguacaugcagcucaugguucucaugcagucaagcagaagccccugcucaaagcuucccaguuacuucuucauugcuuucauguuugccaaucugccuuucugaaagacugucccaggacuucauucuauucaaaauacuguacuagaauugucauuuuaaaaaguuagagauucuuaaauuauucccgacaaagguaacauaagaaaaguaaacuacagauccaaaucucagaugaguauaaacacaaaaguccugaacaaaauacuagcaaacugauuccagcaacauauaucauaaaacggaugauauaccaugacuaaaugggauuuauuccagcaaugcaagguugguuuaacauucaaaacucaauuuauggaauguaucauaucagcagauaaaagggaaaaaacaugaucaucuuaaaagaugaagaaaaagcauuugacaaauccaacacccuuucaaugaacuggaaacaaucaaugaauuaggaauagacaggaacucucucaaccuaauaaaaagcaucuauuggaaacccacaagaggccuggcacaguggcuugugccuguaaucccagcacugugggaggccgacaagggaggaucacuugaggccagaagucugagaccagccuggccaacauagcaaaaccccaucucuacuaaaaagaaaaauggccggacaugauggcacaugccuguaaucccaguuacucgggaggcugaggcacgagaaucguuugagccugggaggcagagguuauaaugugagccaagaucacaccacugcacuccagccugggugacaaacaaacaaacaaacaaaaaaccuggagguaacaucacauuucacuucuaggguuaugaacaagacaaggauguccauuuuuccaugccuuuuuaaaacugugcuggagguucuaggcaguaucacugaacaagaaaagcaaaagauauccagauuguaagggaaguaguaaagaauaucucuguugaaaaugaucuugaauauagaaaauuaucuggaguucacuaaaaacuauuagaucuaaaaaaagauuuuagcaaaguuuuaugguacaagauuaauauguaaaaaucaauugucuauauauuggcaaugaacaaucuuaacaugcaauucaauuugcaauagcaucaaaaagaauaaaagauuuaggaauaaacuuaacaaaugaagugcagaacuuauaaucugaagacuaccacuguugaaagaaauuuaaaaagaccuaaauaaauggaaaggcauuccauguucauguugggagguuuaauauugugaagauauccccaaguuuaucugcaaauguagugcaaucccuuuaaaaaucccagcugccuuuguugcagaaaucgacaaggcgauccugaaauuuacauggaaaugcaaaggaccagcaauauccaaaacaaucuugaaaaggaacaaaauuggagaacucagacuucucaacuacaaaacuuauuacaaagcuauaagauagcauaguacuggcauaaggauaggcauauaaaucaguagaauagaaaugagauucuaaaaaagugauacugcguagaaacgccauuacauuuaugguuaauugauuuuucagaagggucccaagauaauaagggaaaaagucuuuucaguaaaugguacaggaauaacugaauauccaaauucaaaagaaugaauuugaaccccguuguuaacucaaaccuaaauguaagagcuaaaacuauaaaacucuuggaagaaaacuaacaaguaaaucuuuaugaccuuggauuaggugaagccuuuuuauaaaagacaccaaaagcaccagugacaaaggaaaaaagauaaauuagacuucaucacaauuuaaaauuuuugugcuucaaagaacccagagagugaaaaagacaguccacagaaugggagaaaauaauugcaaaucauauaucugauaagggacuuauauucagauuauauaaagcauucuuacaacucaacaacagaaagacaacgccauuaagaaguggguaaaggacucaaacacauuucucccaagaaaauacacaaauguucaucgaacacaugaaagauacucagugucauuagucauuagggaaaugcaaaucaaaaccaugguaagauacacuucacacccaguaggauugcuagaaucaauaaaauggaaaauaauaaaguacuggcaagaaaguggagaaauuagaaccuucauacauucccauaugugggaauguaaaaugguguagccgcauuggaaacaguuucacaguuccucaaaauguuaaacaaagauuaccauacaauccagaaauuacauuucuagauauauauccaagugaaaugaaaacauacacccauguaaaaauguauacaugagcauuauuuauaauagcgaaaaaguggaaacaacccagaugucuaucuacugauaaguggaugaacaaaaugugauauaucugugcaauggaauauuauuugacaauaaaaaauacuaaaguacugauacauacuccaacaugaaugacccuugagaacauuaugcaaagugaaagaagccagucauaaaagaccacauauuauaugauuccauuuauaggaaauguccauaauacucaaaucuauagggacuaaaaguagaucagagguugccuagggcugggagauugagaguaauggguacagaguuucuuuuuggguuguugaaaaaauucuaaaauugauugugguuaugauuguacaauucugcugguaaaugaaaaaccacuagauugugcacuuuaaaugugugcauuguaugucaugugaauuauaucucagugaaguuguuuacaaaaaugccaguagauggucaaagaauaugaauaaggcaaucaugcaagacauacagguggccaauaugcauauuuuaggugcucauucaguauuacuaauaauuaaaauaacucuaaauuagaacaguucauuaacuucuuguugcuccuuagauugacaaagacuaaacagacugaaaacaccaaaaaaaaaaagaaagaaaaaaaaggaaucugcuaacaaucuuguguuuaaaaaaauaggaaucuuuaaauuucuaacugaauuaaacagaauuaucugugguuaauugucuuauaggaauguuguccuuuuuugcuaagaauauagcccuagaauuaaaauuauccaacugaaaggaccucuagaaaucacuaaauucaaucuguuuauuggccuagaaagauuaagggauuuguucaaauuacaagcuaauuaauggcauagacaggucuauauuccaaguuuccugacuuuucuacuagggcugugcuuuucuacaaaauuggacacaguuaucaaaagcuggaacuuccaagugccagaauuauagagggaaagauugggaugcuagaaccuucccuucuauaauggggacaaauuaagauuguuuggguauucauuuuacuucugauuguuuaauacucuacauuagcuagucuuguguuuaaauucuauucccugucucuuggucucuuauuuuuggaugcuuucuuguucaaauuuuccauacagucuguaaauugggucugucuuauacaaugcaucagacuauccuauuaugaaucaaacaaaccuccuauccuguuauuucuuaccaguuuuuuuuucugaaugccacacuuauuagacaaucauccuagaccuguuucacaaucucuuuuauaguaagguacuguuggcuuuuaauguuuucuccauaagacaacauuuguuuacuuccucagucuuuuuaucugugugccauaguaucagcauauacaucauuguuaguauaaccucuuuaccaauuacuuguugaaauuuauauuuuuauauauucaauuuuguuuuuacuagacugagcaaucuuggcuagauacuauauuuugcuuaucucuauacgucucagacucaguugauacuuaguaaauauuuguuagauaaauaaauaccugagaggccgggcaugguggcccacaccuguaauuccagcauuuugggagacugaggcaggagaauggcuugaacaucacuugagcucaggaguucgagaccagccuggacaacauggugagacccuaucucuacaaaaauaaaaaauaaaaauuagccugguaugguggcaugcaucuauggucccagcuacuugggaggcugaggcaggaggaucacuugagcccaggaggucaagucuguagugagccauguucaugccacugcauuccagccugggugacggagugagacccuguuucaaaaaacaaauaaauacuugaagucuucaacuuuuuguguuuccugguuaacauuuuaccuauuuuuuucuuucagaauuuggaguugucugcuuaauauuuucugcaacacuagcuuauuucccaccccgaccuccucuuccucccaguguugcugcagcuagccagcggcugaguuaucggagaagcguuuguagauuauuaagguaaauauacugagagucacuggauggcuuugacugacaccuucaagguaacuucagauuuuuaaaaaauaauuuaagauaguaauuuuucagcaaccuauuaauuagguuguaaguaauugauaaaauacuaauugaauauuuuagauuuccuaccagaaaucuaucuugaaaaaucaccaaaaacaaaaacuucuauaauuuuugccuucucuacauaucaccuauacuauuauuugcuuaauguuuuaaaaaucaaauauuuuauuuuucuuaaauaauuuucuuuuuuaaagaaucccauaucauacaauagugucugugaaaucaugaauucuauguguuauacuuuuccuaauaugcacauuauuuuaacuuauuauguauuuguuaaggcauauuaaaauaagcaggugguagucaauacaaagugaauaaaauaaauaauauuauucacauaucaccugaaaucauuuucuguacgagcaguaggaucauacuuuaagaaaccaaauauauuauuuaauuuuauugguauaacuuaguauaguuagauuaaacucuacucuugaaggcucaaaugcccaguacugaauuuaauucuugggauauauaaaauaccacuauugauuaugauuugcaguuggaccacuagacuuugucauuugaaauuuuuucacagguaguuguuaugaguuuuuauugauucuucaacaacucucucuaaauugguucuuucuuuucuuggguuccucuccccagaugguaaguuucuuguggucaagaagcaguaucuaugucuuuacaucugcugcaguaauacuguccaguaggaauaaaaugcaagccacauaaguaaucuuacauuuucugauagucuucaauaaauuuuuauaaaucaaaaucauaucaaguaucuucugugaccacaguggaauaaaacuagaaaucaacuccaaaaggaacccucaaaacuguacaaacacacggaaauuaaacaaucugcuccugaaugauuuuuggguuaacaaugaaaucaagaugaaaauuaaauucuuuaacaugaaccguaauagugauguaaguuauuaaaacuucugggauacagcaaaagcagcgcuaagaggaaaguuuauagcacuaaaugccuauaucaaaaagucugaaagauuacaaauugacaaccuaaugucacaccucaagaaacuagagaaacaauaacaaaccaaaaccaaagccagcagaaaaaaagaaaaaacaaagaucagagcagaacuaaauaaaauugaaacaaaaaauacaaaagaucaauaaaacaaaaaguuggcuauuugaaaagauaaacaaaauugauaccccauuagcuagauuaaccaagaaaagaagauucaguuaagcucaauuaaaaaugaaaauggagacguuacagucaauaccacagaaauacaaaagaucauucaagacuacuaugaacaccucuauggacacaaacuagaaaaucuaggggaaauggauaaacuucuggaaacauacaacccuccuagauuaaaucaggaagaaauagaaacccugaacagaccaauaaugagccgugagauugauucaguaacuuaaaaauugccaaccaagaaaagguuauggucagauuggccagauggauucacaguugaauucuaccggacuuucaaagaagaauuuauaccaauccuacugaaacuauuccaaaagauugagaaagcaggaauccucccuaacucauuuuaugaagccaucacccugauaccaaaaccagauugagaaagagggacuccucccuaacucauucuaugaagccagugucacccugauaccaaaaccggaaaaagacauaacaaaaaagaaaacuacaggccaauagccuugaugaucauagauacaaaaauccuuaauaaaaacacuagcuuacugaauccaacagcacaucagaaagauaauacaccaugaucaaguggguuucauaccagagauuguuuaaaauacgcaagucaaaugugauauaugacauaaacagaauuaacaacaaaaacaguaugaucauaauagaugcagaaaaggcauucaguagcaucucuuuaugauaaaaaaaaaacccucaacaaacuaggcauagaagggacauacuucaaaauaaaagcuguauaugacaaacccacagccaacaucauacugaaugggaaaacuugaaaguauuuccccugagaacuggaacaagacaaggaugcccacauucaccacuucaguucgaaaguacuagaaguccuagccagaacagucaggcaacugaaagaaauaaagggcauccaaauuggaaaaagaggaagucaaaugaucacuguuugccaaugauaugaucauauaccuaaaaaacccuaaagacucuuccaaaagacuccuagauuugauaaaugaauucaguaaacucucagguuacaaaaucaguguacacaaaucaguagcacugcucuacaccaacaacgagaaaggcaagaaucaaaugaauaacucaguccucuuuacaauagcugcaaaaaaauuaaaauaccuaggaauauucuuaaccaagaaggugaaauaucucuacaauaacuacaaaacacugcugaaagaaaucauagaugcccauucagugugauauuggcuguggguuugucguagauagcucuuacuauuuugagauacauuccaucaauaccuaauuuauugagaguuuuagcaugaaggguuguugaauuuugucaaaggccuuuucugcaucuauugagauaaucaugugguuuuugucuuugauucuguuuauaugcuggauuacauuuauugauuugcauauguugaaccagccuugcaucccagggaugaagcccacuugaucaugguggauaagcuuuuugaugugcugcuggauucgguuugccaguauuuuauugaggauuuuugcaucgauguucaucaaggauauuggucuaaaauucucuuuuuugguugugucucugccagguuuugguaucaggaugaugcuggccucauaaaaugaguuagggaggauucccucuuuuucuauugauuggaauaguuucagaaggaaugguaccagcuccucuuugaaccucugguagaauucggcugugaauccaucugguccuaggagcauucccuuugaaaaugggcaugagacagggaugcccucucucaccacuccuauucaacauaguguuggaaguucuggccagggcaaucaggcaggagaaggaaauaaaggguauucaauuaggaaaagaggaagucaaauugugccuguuugcagauggcaugaucguauaucuagaaaaccccaucgucucagcccaaaaucuccucaagcugauaagcgacuucagcaaagucucaggauacaaaauuaauguacaaaaaucacaagcauucuuauacaccaauagcagacaaacagagccaaaucaugagugaacucccauucacaauugcuucaaagagaauaaaauaccuaggaauccaacuuacaagggaugugaaggaccucuucaaggagagcuacaaaccacugcucaaugaaacaaaagaggauacaaauaaauggaagaacauuccaugcucauggguuggaagaaucaauaucgugaaaauggccaugcugcccaagguaauuuauagauucaaugccauccccaucaagcuaccaaugacuuucuucacagacuuggaaaaaacuacuuuaaaguucauauggaaccaaaaaagagcccgcaaugcccagucaauucuaagccaaaagaacaaagcuggaggcaucaugugaccugacuucaaacuauacuacaaggcuacaguaaccaaaacagcaugguacugguaccaaacagagauauagaccaauggaacagaacagagcccucagaaauaaugccgcauaucuacaacuaucugaucuuugacaaaccugacaaaaacaagcaauggggacaggauucccuauuuaauaaauggugcugggaaaacuggcuagccauauguagaaagcugaaacuggaucccuuccuuacaccuuauacaaaaauuaauucaagauggauuaaagacuuaaacguuagaccuaaaaccauaaaaacccuagaagaaaaccugggcaauaccauucaggacauaggcaugggcaaggacuucaugucugaaacaccaaaagcaauggcaacaaaagccaaaauugacaaaugggaucuaauuaaacuaaagagcuucugcacagcaaaagaaacuaccaucagagugaacaggcaaccuacagaaugggagaaaauuuucacaaccuacuuaucugacaaagggcuaauauccagaaucuacaaugaacucaaacaaauuuacaagaaaaaaacaaccccaucaaaaagugggcaaaggauaugaacagacacuucucaaaagaagacauuaaugcagccaaaaaacacaugaaaaaaugcucaucaucacuggccaucagagaaaugcaaaucaaaaccacaaugagauaccaucucacaccaguuagaauggcgaucauuaaaaagucaggaaacaacaggugcuggagaggauguggagaaauaggaacacuuuuacacuguuggugggacuguaaacuaguucaaccauuguggaagucaguguggugauuccucagggaucuagaacuagaaauaccauuugacccagccaucgcauuacuggguauauacccaaaggauuauaaaucaugcugcuauaaagacaugcaaacguauguuuaugguggcaauauucacaauagcaaagacuuggaaccaaccuaaauauccaacaacgauagacuggauuaagaaaauauggcacauauacaccauggaauacuaugcagccauaaaaaaugaugaguucauguccuuuguagggacauggaugaagcuggaaaccaucauucucagcaaacugucacaaggacaaaaaaccaaacaccgcauguucucacucauaggugggaauugaacaaugagaacacauggacacaagaaggggaacaucacacaccagggacuguugugggguggggggaggggggaaggauagcauuaggagauauaccuaaugcuaaaugacgaguuaaugggugcagcacaccaacauggcacauguauacauauguaacaaaccugcagauugugcacauguacccuaaaacuuaaaguauaauaauaauaaaauaaaauaaaaagaaaucauagaugacacaaaaaaauggaaacacauuccauguucauggauuggaagaaucaauauugugaaaaugaccauacugcccaaagcaaucuacagauucagugcaguuacuaucaaaauagcaacaucauuuuucauagaauuagaaaaaaaaauccuaaaauucauauguaaccaaaaaagaguccaaauagccaaagcaauccuaagcaaaaggaacaaaucuggaggcaucacauuaccugacuucaaauuauacuacaaggguauaguuacuaaaacagcaugguacugguauaaaaguagucaaugggacaguccaauggaacagaauagagaaaucagaaaugaagccaaauacauacaaccaacuaaucuucagcaaagcauacaaaaacauaaauuggagaaaggacacccuauuuaauaaauaguucugggaaaacuggcaagccacaaguagaagaaugaaacuggaucccuaucucucaccuuauacaaaaauaaacucaagaugcaucaaagacuuaaauauaagaucugaaaccauaaaaauucuagaagauaauguuggagaaacacuucuggacauuggccuaggcaaagaauucaugacuaauaccccaaaagcaaaugcaacaaaaacaaaaauaaacgggaccuaauuaaacaaaaaguuucuguacagcaaaagaaguaaucaucagaguaaacaaacagcccacagaaugggcgaaaauauuugcaaacucuguaucugacaggagacuaauaucuagaaucuacaaaggaacucaaacagaucagcaagaaaaaaaaaaucucaucaaaaagugggcaaaugucaugaccaggagacauuucucagaagaagacauacaaacacuaacaaacauaggaaaaaaugcucaacaucacuaaucaucagggaaaugcacauuaaaaccacaauuagauaccaccuuaccccugcaagaauagccauuauuaaaaagucaaaaaacaauagauguugacauggauguggugaaaagggaaugcuuauacacugcugguaggaaugugaguuaguaccaccucuaugcaaaacaguauggagauuccuuaaagaacuaaaaggagaucuaccauucaacccagcaaucccacuacuggugucuacccaaaggagaaaagucuuuauaugaaaaagacguaugcacaugcacauacauguuuauaccaacacaauuugcaauuccaaagauauggaaccaaccuaagugcccauugaccaaugaguaggaaaaugaguguauauacaccauagaauacuacucagccguaaaaaaagaacaaaauaaugcuuuuacaucaacuuguagggagcuggaagccguuauucuaagugaaguaacucaggaaugcaaaaucaaacacuguauguucugacuuauaagugggagcuaagcuuaggguaggcaaagacagagugguauaguggacuuuggagacucagaauggagaggaugguggagacugaaggguaacaaacuccauauuggguacacuguacacuacucagguggcaggugcaccaaagucucagacuucaccgcuauccaauucauccuuguaaccaaaaaucauuuguaccccaaaagcuauugaaauuuuuaaaaauuuguuuuaauuuuuuguauauuugggauaaaaaucuuugaaaauuuuuaauaaucuuauuuuaacaggaaaaauaaguaaaauuaauuagaaauaaguaaaauuaauaaguaaaauuaguucuaagaaaugaguaaaaucaauuuuaguagcauauuguuuaaccaagcauaucuaaaacauuauuuuaacauguaaucaauauuaaaacuuauuaaugagauauguuauucauaacaucuuugauauucaguggauauuuugcacuuaaagcacaugucaauuuggacauuaaauuuuuacuggaaauacuugauuuccaguagaauuaaguggaauauuucagauaucacuaaauuuaccguugaaaaaguaugcauugagcaaugucucuuguauugcacuguuuauccuaaguuaaaaauaaauaauuaguuucugaaauuuugaaucaacagauauuugcuaucguuagaaaggaucuuacauucuauaggccauuguuuggggcuuaauugcagaucuaacacuucuguagaauacuauuuuuauucuuuuccucguaauuuuuaacaaauuuccauagcuaaaaacaauuccuuuaccaucucuugaucuaaaaugcuuuucuuuuuguacaaggauccaaacaguuuuauagcuggccaaauuauuaguucagaucuguuaaaaaucauuuaaguguucauuggacauuuaauucugauuucaggcaacuaauuuucuugauucuuuuuugaucugaaaagaaacgucuauaaaauugaccauguguuugcuaaaaugucuuuuaauauuauucacuuaauuauucuaaacuuuuuuuccacagcagacauuuuauuuugcucugcuguagcaaauuguaauugccguucauugugaaguuugcaacaugccgucuucucuuuuggucucuucuuucuacaggaaauauucaaauacacaaauuacaaugucacaugucacaucaguguguagaaaaaaauaauuagaacugaauccauucauugacgccaauaucagugauggaugaugauacuagagacaacacaugccccagcaugcacacuauaauaauaucuuaguguugcagcuguuaaaguaaaauguacuccuaccaaacagaguuacguuuaauggaaaaguaacuuucacugcuucgcuucaaauuuagauuuaaauuaguuaaaaugaaauaaaauuaaaaacucaguuccuugguugcaccagccacauuucaaaugcuauguaauauuguuuuccaaacuuugguuuacagccaacuaauucagugaggugacagccauuuuccuuaagcaaaauagaauggaauaaaauagaauagaaaauauuauuucaucacauguaauaaggauaccuucuuuuagacuuuuguuucaguauauauguugcauauagguaggucacaaaguaaaaauaaauuucuuacucuggguacaguaaaaaguuuuugaaaaucacuucucuauagcacgucguacauugccuuucacauaauagguaaaaaaaauguuagguugaauugugauuaguggcacacauuuguaagaugacaguuuaaaaugaucguuuuuuaaaaacaaugccacuuaaguaaauuuuuuuccaugcaaaccuagcugcagauguuagauagcaauagagaaagguagagagguagauugggaucauauuaugacauacuaauaauuuuggacuauucuuuaggaaaugagucacugaaggauguuaagccaagaaguuauguacaagauugcagauguuaggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuaaccgggcuugguagcgggugccuguagucccagcuacucgggaggcugaggcaggagaauggcgugaacccgggaggcggagcuugcagugagccgagaucgcgccacugcacuccagccugggcgacagagcgagacuccgucucaaaaaaaaaaaaaaaaaaaaaaaaaaagauugcagauguuagauagcaauagagaaggguagacagguagauuggggucauauuaugacguacuaauaauuuuggacuauucuguaggaaaucgugagucacugaaggauuuuaagccaagaaguuauguacaggauuguucugacaaggaaaaacaguuaacuuaaaauuguccccccaaccccuuugacuuguguuuacuucuaauuacccuagagucaaacucuucauucuguuuaaaccguaaaguguaagaucuuccuucucuauaaagaguccuuuucaccaguaccuaacauuccuuugucuuuuauugcuuacucugcaugaaugccagcuucuaccuuugggcucuccaggggaguucugugggccugccaugccccauucccuuccuaccaguguaauuacccccagucucucauagaauuccugaaaucauugcuuucugaguuaaucagauuauuugccagcacguaaacacauuuacucaucuacuuuuuuuacguuuauauuuccuucucccauuucccucccccaacccaggccaccucucagaugccuuuaauguguaucucuuugucucugugcuuuugcaguauguguacuguuuuguaugcaucuauguuuaauucaucuaaauuaugccauauugugcauaucauucuguuugacauuuuucacuaagcacuacaugguuuauuuuuuuuuaacuuuucauuugggaauguuacaauaauauacaaagguagaauaguauaaccccauaagucgguaucaacaauugucagugaguuuacaaccagucucguuuuaucuuuguaccacccacuucccacuucccaccuuccugcaucaugaaacaaaucccagaugacaacuccauuucauccagaaauauuucaauaugugcaauauaugucaaaaauagacucuuuuuaacauauagugccguuauuuuaacuaaaaacuuuuaaauaauaauuugcuaauaucaaaucaguguuuaaauuuucaauuaucucauaaacauuuaacaguuuguuugaacaguuuccacauuagggccacacauugcaauugguccaaagugccuuagaaucuauagguuuccuuaacauggcucuuuguuucuuauaauuuaauuguugaggagccagcacuuuuauucccaacaucuggauuuuguugauuuccucauuguauaguuugacauguuccccucuccuuuaugguucuuguaaaguauguugugauucagguuuuaguuuugcuuuuguuuuuguuuuacaagaccgcuucguaagugaugcugcuuccuuucaucaggaggcguauaauaucuggacaacucucauuuugugauguuagcacucuguuucaagaugcaccccugcugcuguguguacaccuaguucuuuguacuccaugguauuaaucuaucacauuucaucuacucauucucauuguguacccagauugccuccaauuuauuguuaccauaaacacuacugcagugacauccucaugcacgucaccauagaccugaaaauuucuuuggaaaacagacccuguaacaugauugcuaggucauaaaauagucuaagcuuaauuugucaaguacugccagauuguagugaugugaucauagcacacaguaaccaccugccucagccuugcaauuaacugggauuacaggugcacaccacuauaccuggcuaauuuuuauauauuuuuuauagaggugaggucucacuaucuugcucaggcugaucuugaacuccuggccucaaguuauucuccuaccuuggucucccaaagugcugagauuacaggcaugagccaccauaccuggccagagcuuuuuuuaaacuaccuacucauuugaugaaauaauauugguuaucuguauaauaaacauugagaauuuuaaacaauaugaacaaaauauuauucuuauaaaaauaaaaaauuucaagaagcgagccaggugcaaugucucacgccuguaaucccagcacuuugggaggccaagguggguggaucaucugaggucaggaguucgaggccagccuggccaacauggcgaaacccuaucucuacuaaaaauacaaaaauuagcugggugugcuggcaggugccuguaauuccagcucuuugggaggcugaggcaggagaagcacuugaacccgggaagcggagguugcagugagcagagaucacaccauugcacuccauccugggcuacaagaguggaacuccaucuucaaaaaaaaaaaaaauuucaagaagcuugaauuuauuaacugacagauuuuuuucuuuuauaaagcuugccacuuugagcuucuugaagaauauauauauauauauaccuguacauacacauauuguacauauauguguauauauaguuauucauauguguauauguguguauauauacauauauauuuuuuaacuuuuaggcucaggguacgugugcagauuuguuacauggguaaauuccaugucauggggguuugguguacagauuguuuugucacccagauaauaagcauaguauccaauagguaguuuuucuguccucacccuccucccacccugcacccucaaguuggucccagugucuguuuuucccuucuuuguguccauauguacuugauguuuagcucccacugauaagugagaacaugugguauuugcuuuucuguuccuguguuaguuuucuuaggauaauggccuccugcuccauccguguugcugcaaagguugugaucuuguucuuuuuuaugucuguggaguauuccauaguguauuuguaccacauuuucuuuauccagucuaccauuuauggccauuuagguugauuccacaucuuugcuauugugaauagugcugcagugaauacacucgugcauguguuuuuauaguggagugauuuacccaauaauggauugcugggucaaaugguaauucucuuuuaaguucuuuuagaaauugccaaacugccuuccaugguggcugaaccaauuuacacuucaaccagcaguauauaugcguuuccuuuucucugcuaccuuuccagcacguuuuuuuuuuuuuuuuuuuuugaguuuuuaaugccauucugcagauauuuucugauucugguguuccaguuuccaaaugacauacauuuuucaugacuaaguuuauucuagauuuuuaauuuguuacaauguuuccuuuuauuucucauucacagcaauuuucgauuuuugaugauugcuuuagcauaugccauaccacuugguguauuugcuggcuggucuggaguucuggacuuaauuuuaacaccagcgcaugucagccaaguaaguauuuuauuucuuuauauguuguagguauuuuuguucauuuaauuuauaaauacugguuacguguucuugguuuuagcuucaaggacuggguaaaacaucguccuauaccauuguugcaaaagcaagaucuuuauggaauagguaaaaaauaauguugauuuuccuccuugauuuugacaauaguugugaauuucacauuucugugggcauuauuaaugauacuacugguuuuuuaaaaaaggaaggaagucuuaguuuuguugaccccauucuuuauccuugcuucguaccuuauaaagaagauuaagaucccaucaucaaauauauagcuauuucuucaucuaguuucugacuuucucucugggcuccaaauaaggguauuucauuucuuuaaaaauaaacauuucaccuauaugcuugaugucauccauuccuucucuuugcuuccagauagcaugguagaaaggaggagagagaaauuuugagagguaaauagaagagaacacacugcugugauauucuauuguaugaguaaaaaaaaaaaaauuugucuauucugcuuuuggugaacauuuggauuggauuguuaaccaguuuugacagccacaaacaaugcuguauuaacacucucuuacaugucucuaugcaccucuauacacauuucuacuggauacauaucuaggaauggaacugcugcguauaguauaugcuacuuugguagaugaugccaaacuucuccaaaguggugguauccauguguaauccuaccagcaaaaauuucucaucaucccacaucauuugccacuugugugauaauauuagucuuuuucacuuuagacaugcugauagcugugcaguuguaugccaucauagugacuucuguggugucuuuucagugugaauuggauauuuugaauaucuuuuucuugugacauacuaguuugagucucuugcccacuauugggcugccuuuuucuuaccgauacguaaagaagagggcugugcagaagagggcuccccagaggacuuugggggacuccaguaaucuuuggcugagaaaugggcugcacauauaaagggcaaaacuacuggaggcuuaacagagagagugguauggguugaaagcagaacaaagauagaagacgucaagauugucuuggaguucuggcccagccagaaugguaacaccucauucacacuuguuaaccagaauagccaaacuguagaaucaaggaccaugcccuagguagaggaagccuuacucuaguguagacccauuauaaacaaagacaaaaaucugaagaggagagaguuuggagaucuauccuuauaaaguacaaaaugaggccuacacaugcucaaggugaucaacuaguaauugaacugccuacuagaacaaaagccagccaucuuagaaaagauaaaagaaucuagaaucucuuuauugugucauccacaacauacaguguacaauuuuuuuuuuuuuuuuugauggagucucgcucugucgcccaggcuggagugcaguggcgcgaucucagcucacugcaagcucugacucccggguucacgccauucuucugccucagccucccgaguagcugggacugcaggugccucccacacccggcuaauuuuuuuguauuuuuaguagagacgggguuucaccauguuagccaggauggucucaaucuccugaccucgugauccgcccaccuaagccucccaaagugcugggauuacaggcgugagccaccaugccuggcccaguauacaauuuaaaaaaaagugcauuaaacauguaaagaaacaggaaaguaugaccccuauuuggcugggugugguggucucaaauauagauacauaaaauuaaaaaaauuaaaaaagcaaucauuagaaaccaacucuuagauacucuagauguuggauuuagcagacugaggcuauaaugcagaaaagagaaagauaaaucuuugcuugcuccaaguucauaaauauguuaucuuguacaacugugucauccuguauaguagcuacuagccacauucaaaauaaacuucaaacuuaauugauauuuaaaccaauugaaaugaaauaaaaguaaaaaaucacuuccuuaguugcaguagcacuuuucaagugcgggauagccacaugagacuagcagcuaccauguugcacgguguagauagagagcauuucuaucaucaaagaaaguucuguuggacagugcuguucuggagcucuguucuuuuaccugucacauuuaccuagaauuuaaaccuagaauugauuuuauauuuauuauaggcguuaaguuucuuuuuuccccauagauauuuguuaaccuaauaucaguguuugaaaagaucauuuuuuuucuucacugcccucuauucaucuuuguuguaagcaagucuccuuauauacacugguguauuucuagacuuuauuccuuuagucuguuugucugucccugcaccaauaccaaauuguguuauuuauacuaguguuauaaauaaguacuaguuuugauauuuaguaaauuucucccuuuauuaggauuucuguuagaguuuuuauauuuacagaucauuuucaaaauuaacuccuuuauaauauuugaguuuucugaaccaugaucauuauauuucuccucauuuacuuaggucccaaugucucugaaugaugcuuuauaauuuucagcaaagauaccuucuauguguuuguuagcuuuauucucagguauuugauacuuuuugaagcugagcagcuuuuaaaauuuuuauuuuauuuuucuuauuuuuaaaauugauauguaauugcuguacauauuugggggggauauauaauauuuugauaccugugcacaguguauaaugaucaaauugguaagagugcuauccaccucaaacauuuauuuuuucuuuguguugggaacuuacaacucuucucuucuagcuauuuugaaauacacaauaagcuguuguuaacuguaauuucccuacuguacuaucaaguacuagaacucacucuuucuaucuaacuguauuuuuguaccccuuaaccaacuucucuucauccucccacccuucuucaucagcagcugguaacuaucauucuacauucugcuucccugaaauccaccuuuuuaguucccacauaugaaugagaacgugcaauguuugucuuucuauaccuggcuuauuucacuuaacaugauuucacuuaacauccauguugcugcaaauaacaggauuucauucuuuuuugugacugaauaauauuccauuguguauauaucugauauuuucuugaugcauucaucuguugaugacacuuagguuguuuccaaaccuuggcuauugugcugcaauaaacaugggagugcagauuucuuuuucauauacugauuuuauauacugauuuuuauauacugauuuccuuucuauuggguauauacccagaaaugggauugcuacaucauaugguaguucuauuuuucguuuucuacggaaccucuguaccguuuuccauaauggcuguacuucuuuaauuuccaccagcaguguccaagcacucccccuucucuguauccuugucagcauuuguuacuuuuugucuuuuuggugauagcuauccuaacuggggugagaugcuauucauuguaguuuuguuguacauuucccugauuauuagugaugcugaacauuucuuuuuguauauuuguuggccauuauaugucuucuuuugagaaaugucuauucaggucuuuugcuuauuuuuuaauuggauugguuuuuuuuugcuguugaguugcuuggguuccuuauagauagauagugguucuuaaucccuuguuggauguauaguuugugaauauuucucccauucuguaaguugucucuucccucuguuguuuccuuugcuguucagaagccauuuagcuuuauguaaucccauuugucugauuuugcuuuuguugccuguguuuuugaggcuguacucaaaaaaucuguguccagaccaguguccuguaguguucccccaauguuuucuuuuaguaguuucauaguuucaagucuuacauugaacccuuuucccuuuuagaaaaaaaaaaagugcagcucgcugccagcacucauuuaauuuuauauaaacaugcucuuugaugcugaagcaaaucugacugacuuucaauaugaaaauauaaaaacuguucuuggaguuauuucuaaauagaacuaacaucagaaucaucugaaucaucagaaucgucuauuucagaaaaaucggauccgucaaauaaaucucuagccaacgacuguuugagaacgauguuaauaucacacguaggaaugcuccuuuuucuaggauuugacauuuucagcaguugagaauuacuauauuuuguaaauggaaauaccacuacuaaaaacagaaugcuauaaguagaacgaugucuuuugucgccaaaguugauauacuaagagugaugugaaaauagucauaaaagcaagauaguuaauggcaaagauaucuugggguaaaugcugcagcugcaaaagcaccucuggcgaguauucucagggcaaacaggaaaaggauuaaaucuuuaauccauuuugaguugauuuuuuuuuuuuuugagacagcaucuugaucuguugcccaggcuggagugcaguggcagaagcauggcucacuggagccucaacuucuuggguuuaaaugauccucccaccucagccacccaaguagcuagggcuacaggugcacaccaccacgcccagcuaauuuuuucaaguuuuguagagaugaagucucuauguuucccaggcuggucuggaacuccugagcucaaacaauccuuacacuuuggccucccaaagugugggccaugucgggccaucuuuguguuuuaauuggaguauuuagugcauuuauauuuaauacaauuacugacaaguuuggguuuagaccugccaucuuacuauuggucuuuauuuuguucagcccugucuauucuuuuugucaucuuuccuaccuucuggauuaaguauuuuuuauuacuuuaauuuccccccacucuauuagcuuggcaguuauagacucuuuuacuguuuaaugauuacccuaaaaaguacagaaugcacacuugacuuaucaaauuagaauuuuaccuuuucuaggauaaucuaagguuuuuagaacccuuuaacuucauuuaacccucucccaucuuucaggcuauuacugucauauauuuuaacugcacaagacauuauuguuuacacaguuaauauucauugacucgaauuuaucuucauguuuacucauuuuguucuuuauuucuuuaucuucagucuucaaaucuguagucauuuuucuucuaucuaaagagcacccauuaguguuuuuguuuguuuauuguacaggucugugggugacaaauucuuuaguuugguguuugcauuuuauuuuguuguuguuuuggucuaaaaaugucuucauuuuaucuucauuuuuagaguuuuucuguugcugggcauagaauuauugguugacagucauuuucuuuugguucuuugaaaaaaaagauccauuuucuucuggcuuccauuguuuuaauugagaaguuagcucucaaauuuaaaagcuggcugcuuuuaagauuuucuguauaucauugguuucagcaguuuugcuuugauaugauauaacuagguggcauuuuuuuucuaaauuuauucuacuugagguuuacacaacuuauugaaugucgucuuguuagcuugaugucucucauuaauuucugaaaauuucuagucagugucucuucaaaacuugugcucuguuuucucuaauuucuuuuggguauucuaacuauauacauuauaccuuuauacuguauucucugugucucuuuugccuuucuuuucuucucccacccacuuuuuuuuguuaugacauauucuuuuuccuuucuaugcuucagacuagauauuuuagcuaucuuuucuuccaacucacuauuucaguuuucaacugugucaaauaugcuauuaaauucaucugugaguuacuuuacauuuuauaaaauuuaucuuugauucuuuuuuuuuuuuuuuuuugagauggagucuugcccugucacccaggcuagagugcagcggcgugaucagcucacugcaaccucugccuucuggguucaagcaguccuccugccucagccuccccaguagcugggacuacaggcgcguacaaccauacccagcucauuuuuguauuuuuaguagagacgggguuuugccauguuagccaggcuggucucaaacuccugaccucaggugauucgccugcuuuggcuucccaaagugcugggauuaacggcaugagccaccacaccuggccugucuuugguucuuuuuuauaguugacagauuucaguagaaaugcuugauaucuuauuuuuuucucuauuaaaaauaguuauuucaaauuuguaucucauaauuccauuaucuuggucccuuguaggucuauuuauauguuugauauuugguaauuuuaaaaaaucucuuuaugcauucaguuauuuuugauugagugcuagacauaguacaugaaaaacuguggagauaauuuaaguaucaagaugauauuguuuuccuucagagagaauuuauauuuuuucuggcagaagucugagaaucaccuuaaucuaguuucagagcuugagaucacuuaaagcugggcuuuagucccucaggaggcuguuccauuucuaguuccuccugcucuuagguacagcccuucagagugcccaguuaaaacccgggguuuuuacaaaggcaccccacagcaggcccuaaacucauauuuuuucuucuaggucagugaggcugucaauaacuucucagucccuuagccaccuugucugaaauuagcagacaacccuaaaggaaaauugucuccaaauaccgugcuuaucucuucagauuaucuucccauccuagaucaugguuucagaauucuggauuauuuucuuggcucucugauggcuucagauaaaauuuuccccagauuuucuaguucucaaccagaauacuaaccuaaauuaccuaguguacgugucuuagucuguucagacuuccacaacaaaauacuuuagacuggguaauuuauaaaucauagaaauuuauuucucacaguucuggaggcuagaaaguccaagaucaagguuccaacucauuuauaucuggcgagggcucacucucugcugccaagauggccccuucuugcugcauucucauguggcaaaggggcaaggcagcucccuucaaccucuuuuauaagggcacucaucccuuaauuacuuccuaaaggcccccaccucuuaauaugaucacuuuagggauuaaguuccaacaugugaauuugugggggacaccaacauucagaccauagcagcaccuuuacuauaauaagaaaggcuuccuuuaguuuucucaccuguuuuucuggauggcagguauuccaaguaugcucaguucuguuaaggaaaaguguagcacccauuuaaaugauacugauuuugacuggguaugguggcucacgccuguuaucccagcacuuugggagggugaggcagguggaucacuugagcucaggaauucgagacuagccugggcaacauggcaaaauccugucuccaccaaaaauacaaaaaauuagcugggcgcgguagcacacgccuguaaucccagcuacuugggagucugagaugagaggaucacuugagcccaggaggcggaggcugcagugagccaagauugcaccacuauacuccggccugggugacagaguaaggccccaugucacucacacaaaaaaugauauugauuuggcagaucugugcuucauguuguaaacccuaagaaguccuuccaaguaucuuucuugguacaaacucugagagagauagagacccugaaucauaucaguuauuaaauaaaguagaauuuaaaauuacaugaaagcaauuuuuuaaauuuuuaaauuaaguauuggguagaauuguauuaacuagggcaaaugucaugaacaaagcaaguagaaaaguacuaaauguucugaaaguaccagcaucaguacagccagauaugcagugguccuuaaccuagagcaugaccccacucaccuagaggauagaaggaaguguuugugggagccuagugggcguuggauuauagauaccagaugugcugcaaugagaggagugguccuacagaacagagaauucucuugccucaaaugccaauagugugaaaaacuauagagcgauaauuuaagcuucaggauguuauccuucuccugagagccuucauguuugcuucuggcagcaaacaccaauagagcaaaagacucauauaaaguuacuguaucgcuuagaauaggcuaugcuccugggagaaguagaccuccaaaauucugagacuuaagaaaaauuuauuugucauucacauugcaaucugggacagcguguguaaucuaggacaguuguccaguuuggacagcucuuuuccucacacugauuuaagagaccgaggcugcuuccacuuguauucucuucuguccccuaggaccuugucauuauaugcaugggugcagcugggcagcuacguccagauugcagcuggcaggaagggagagaaagcauggaggaggcauacaccuucuuccaaguucuaaccuggagguggcacacuucacuuaugcucacuuccauuaaugagaacugacacauggucaccuguuccagcuaggaacugggacaugucaucuagcuaaguacccagguagaagaagaaaucguuugguggacagcuggcaaucccugucacaaguguaaugaaaaauaugacucaaaggcugggcgcgguggcucacgccuguaaucccagcacuuugggaggccgaggcgggcggaucacgaggucaggagaucaagaccauccuggcuaacacggugaaacccagucucuacuaaaaaaauacaaaaaauuagccgggcgugguggcgggcgccuguagucccagcuacucaggaggcugaggcaggagaaugguguaaacccgggaggcggagcuuacagugagccgagaucgugccacugcacuccagccugggcgacagagcaagacucugucucaaaacaaaaaaaaaaaagaaagaaaaagaaaaauaugacucgaaaaacaacaaaagguagaagcuaguuugcacaaugcucaagugccaggucaaguuuggacuuuguccuguaaccacaaggaaaaccaguaacuauuuccgagcagggacacggaaugcuuaggauaauuauucuggcaacagugagcaaaauagauugcgaagaccauuuaagaagcucugacaggggucaagaaguaagaagauaauaaaagcaagcaugguggucaugggaaggagaaagaggaaccaguauuauuagagacaugaaauuucauucauaacaacuaacaugcauugagcacuuuacauuuauuaacuuauuuaacccucagaaaaacuuuauuauccccauuccacuaaugcaggaacugagaccuagaguaugaguugggacagaagccaagucauaauaagaguuaaagauacaggagugaugaggaauguaggcagcauucguagauugcugugaaaaaauguggccacacaagcaggaaagagacaagauagauggagacgccucaucaguuaguaauaauaagaacagcuaauguuuauugagcacuuccuaugucuuggccacugaucuggguacuguauacaaauuaucucauuuaauccauuuuacagguaaaaaggcauaauuugcucagagucacacaguuaguaaaugacagggcuggaaauguuuucucaagaggggaacaagcuauacuuuugaaacccagcucaacuucuuuuucucugucuacucucuugcucagccccacauuucucccugccuuccaccuccugauacauuuuuaguuguugccccauguuuuagcaucucauuauuaccuagcaguuuccuauguugguuauauuuaaacuuuuucaggcugugacuaucuuccauccuuuucuuauuuuaagaguuccuaguccaauauuaggcauguaguacauacuugaaaauauuuguuugaugacguugauuauuuuguuuucaauauuccaauaaacaguuaaucaaggacauauuuuagauguuuguauacauuaguuacacaugaauucuuuuauuucauccauuuagcuacuaacauauugauuauagaggacuuuuuuucauuccuuuuauauugcaguaugauugucuuguauuaaaugugucugcuucuuucuuaacagguagaugcuggcuggauuggauuuugguccauaguuggaggcuguguuguuggaauagcuauggcaaggugagaauauuuuguuaaacuugugaguggacagagcagggggaaaaagccuaaagauaaauaggcuccccuaaauaaacauuacaauucagggaaaaguaaaacaagcaaaggucagaaagggguacuuguucagaguacaagaaaauucauaugcguuauauagaauugcugcuaacaggccgggaaugguggcucacgccuauaauccuggcacuuugggaggcugaggcaggcggauuaccugaggucaggaguucaagaccagccuggccaacacggcaaaacccugucucuacuaaaaacacaaaauuaccuggguguggugaugagcgccuguagucccagcuaccagggaggcugaggcaggagaauugcuugaaccccgggaggcagagguugcagugagccaugauuacgccacugcucuccagccugggcaauagagugagacuccaucucaaaaaaaaaaaaaaaaagaauuugcugcuauaagaaaguuucucuggaguaucccuuccucaaguguuuuuuucuggagacuggaaauguauuuccaguguaguuaaggugccucuuuccauauuauuggagaacaacaucuacaaauggagaccaaaaaagguaauauaauaauaaagacaaauuaauagcuguggagacuaaaaggguugagaagaaaucauuuguaaaagugucaauagaacuuuccaugaacaggcaguguccugauuagcagacauuauuuauuuauggucuuuuuuggcugguauuuuccuaugguuaucccuuuuugaugcaaaaugucugugaagacuuucaguuucaucacacucucuuugaucauaaccuauuacaacaacacauuguuagaaugagucagaaguaggaaaaaggucccauucguucuaaaaaaaaaaaaaaaaaaaaaggaaaagaauuaaaauguuacucucuuaggcaacugccuauaaaacuauucuugguauuuccaaagagauaauauucauucacuucccaaaucauuuuacucugcucaaaaacaaaauuaggcaaucaacuuuaccaugaagaggagaaucuaauuauauauuugggaagaucaaauauaagauccacauaucaccucaauaucuaaauacuugaauauaauugauacaggauaauguuauaccuagacuuuaugguucacauaguguuucagggauauugaaagaauaaauugacacuguaauuucuaaaucacuuuauuugaaguguuaggaaaauauaagaaaacuaaaagcuaaagaagcagaaggggaauauaguauuuguaggaaaucacugauacuaaaaauacauugaccugucuuauuuugacaagaaucauaccucauuuuucuaguuaaaucuccaagccaauuauagugagucauugaucacauccuauucugagcaccaaauuggucaaagggggaacaauuauguaucaaaaaugaugucucaaaugcuccuuugucauuauuuuccuucuauaccccuuaauuuuaacuagauauagauauaauuaaagggaaaauuuagaaugaggacuuuucugcuuuuaauuuguugaaauggaaguucuaaaaaaauacuacccuuacucugggaucugaagucaauuucaguuaucuccuagcccuaaaaucaauuuuaaaauuacuuuccugacaccauuuuuugggauucccuaggacagugcuaccuuguagacauacaugagugcuuugggugauauuuuuguaauuaaagaccacuauuaaagauacuucuucguccuaauaauacacuucaaugguaucagccuauucgaaaggacuggaucuccaaaaauagcagacuacaguugucgguuuauucuuguaugaucaguuucugugaaacuuucuugcaauucaacucugauuuguacuaaaagccuguuuuauucucuuauaccuugucaucucuguaucugacaaauaaguuuaugcagcauaccaaaauguaaaucugaaaacuguuagguaagcgugggauuaaaacagucuuuuggauuuucuugaggaauauuuuguaaagcuguggaaacuuuuucagcauaccuaagaauuuucugcuugaggacaaauuuaagucacugggcaaaagugcauucauuuuucccaccaaaagauggcaucagcucucauaggaagucauuuuauucuagaaaacacaaacaugauuaaccauaucaugucaaauaaguacaaaacagaagauaguauucaaaguuuuaagaaggacagucacauaauuacaauagaaauguaaaucaacuuuagaaaauuaaaagugaagagaauauaguaaauguuguauuugagaugggaucagcuauucuauaagaggaacaguucugaaggacagaauaaauugugcagccagaggauugugcccguacaaucaacaguuaauccacaggugaggaaaagcagcuggcaaguggaaaauuuuuuuggcauagcuaaugauaagcgucucuaccagaugcccuuuaguuucaugaaaacucaaacaugaaaacuuaaaaugcuauaaaagucccaaguuuagaagaauaauauucacuauuccagaugccguguauguuuuguucucaagaaguuuacaaucugguagggaagacaaaaauaaaugcaaaaacaagaguuuccaauagagaaagugcuaugaagaaauaaaauagaaaguggaggugggauggggaaagacuucuucacugagcccagagggccuuguugaacugagaccugaaugaccugagggguaaacaggaguaagacgugaagauccgggugguaccagcauuccaggcagacggaacaaguacggaagcuacauauugcugugguaagcaaccauggcauguaugagaaacagaaacauggccauccaacuggagaacaguagaagaagagagagcagggccaggcagcaggucacauaggaccucagaggcucugguguaggcaucuguguuuguucucuaagugaguuugaauuuugagagagaucuuugcaaguucaugucaacaaguuagccugauuuucaaaacuaagauaauacauguucauuauagaauguuuggaaaguauagaaaaauaugaagaaaaugacagugacacuuaaaaacucagaaucaacugggcaugguggcucaugccuguaauaccagcacuuggagaggcugaggugggaggauccuugagcccaggaguucaagaccagucugggcaacauagagaaacccuguacacacacaaaaaaauaauaauuagcccagcuacucagcagguugagguggaaggauugcuugagccugggaggugaggcugcagugagccgugaucacaucacuacacuccagccaggcaauggugagauccugucucuaaaaaaaaguaaacacucagaauauauccuauaaauuauagauccugaacaaagaugccguuuuuuguguuuuauaagagaaaaaaaauuaucacaaaguaacaucauacaagaaaauuuguuuuaaaaaaacacugaaaacugucuuuuaaaagaauauauggaaaauuccucaaguaguuguuagugaaagugugucauuugcuuaaauaguauuuuuaaaucccacuagaauuaauagagcauuuuuguuuuuagguuugcagauuuuaucagggguaugcugaaacuaauucuucuccuccuguuuucgggagcuacacugucauccacgugguucacccugaccuguuugaacagcaucacacaccuaccuuuaaccacaggugagcauaggcuauuuuugaacuuuuaauaaauauuuucauucacagaaguguacauaacucugacaguaggacuucuucuugcuuucuguaaguaauuguuaaauauacaaaaaaguuucucuuguccagucaucaaaccaucaucuuaucuaaagaguccaaaaaauaacuaaaaauauuuuaauugguauuuuucacauggaaaagaaguauaaucuuuagccuuaacacauagagcauggaaaugcuuauauuuguuuaaaauuucuaucagagcauaauacaaagauuuuuaucuugguuauagucauuauaucacuguuaaauaauaauaauaauuaacaaggcaaaaaacuaugguauacuucaguaaaguuauuugaaccagccccuauagguuuauuuuacauuuaguguuauuccaucauuaauacaaagcaaaacuuacuggaaauaccuguugaaaguauauuacagccagcuuacuuagcuuaucuaauggaccugaaacauuuuuaguugcuguuguuuuucuugucauuauuaauaucaucaauucagagucuauuuucuauugcugcuguaaaaguuaugcaaauuuagcaacuuaaaacaacagaaauuuauuaucuuacauuucuguagaguagaaguucaauacaggucucacugggcuaaaaucaaaaugugaacagacucuagggaagaaucuuuuuccuugccuuuuccaacuucuagaggucacccacauuccuuguuuauggcucuguccucugccuucagagccagcaaccuugggucaaguccuuuucacguugcauuaucugugccuuucuuccaucguuacaucugcuucugaacccuucccuucugccuucuucuuucuuccucuuccacuuuuaaggaugcuuaugauuacauuggacccaccaagauaauuuggaaaagucugucaauuuuaaggccagcugauuagcaaccuuagucccauuucaaccuuaauccccuuugucuugugaaauaacauauucacaaauuccagagauugucaugaauaucuuuaggggagggagggcauuacucugccuaccaugggaucuuuuuaaaauuacuaugacagauuauuauuggcuuauaaaccagagacucuguuauuacuccuuccuuucuuccagcaaaauauuaagaugcauauuuuauauuauuugcaaguaauauucagccaccuuuugcauuauauauuuaauuauaggauuauuugguagauuguaagauuguaacagucauuuauaacaagcauuugugugaguagaaauaaauaagagucugaaagugacuccauggggaccuauugcccaguggcauguauguuccaugggaaucuuugagaaggcagguguuuuuggucuacauuauauguaaggaauaucccacuuuggaucucuauacucuguaauaaaagaaccagcaguuuacacaucagaggcaucaaaucuuucaaggacagccauuuauuugggauuuccuaccacuuuuacagugauaauagggcaaggggauaagauugcccuauacucaaaauuagcaaccucugcaccaagccagccacccuggagugccucaguaagcucacaagggcagcacagggaucugcaacaucugucagauacugguugaaccucuaguucagagaaguucccaguuucagcauuagauucugcugcauucuuuucgaugacaucguaucuuugcaaaguaauuuuuuuggugguugcugugauaaaaaggaaguaccacacaaguaccacacaaaaauuaguguggaacacaaaaugaggguggggguguccagucugauuccaaaacuuuuaaaagucuugcagugcgcaucagugcacacaucucaucaauaaguaauugugguucuuuaaggaugaaauaaaaauauauuucuuucagcuuaugaguauuauuuuuuuaauggcuacuaaauuguuaggauauaucauacauguuauuaaauaguuugaaccaaagaugugauuaaugggauuguuagcuguuucucuuggccuuggaacacugaaaaaauuacugagacgcuaggagugcuaagaacaaagaaggccuggaaaucccuguucuacaccauccugccaacagucccucuucucuguacacaugcuuugccuggaaaacccaguuguccaaaguaauaauuagauacagaguaaaauacugugcacuguuguacacaacuggcauccuacauuggaguuuugaacaauuuuggcaaguauucugagccagagccagaauuuuuuuaaaauuuuauucugguauaacuucauaauuuagcaguuguacaacauucugguggaacagucuuaguuuacaacucuucuuauucauggcauuacauucagauuuuuugugugugauacuguaugucaaguuagcaucugugggauuuuacaagaacauagucaugaguacauaaagaacagauuucuuucccuugaauuaaguguagaauuuuuauuauaagauaguacauuccauuaaauuuuauguauuuucaauuuaaugugauaacagcuuuaucucuggguagaauauuaagaaugaauuuaauuuuuuaaucucuuuuuuuuggucuggauuuguaugagcauguuuuaauuuuauaaucggaaaaaugcauuugaaaauuauucaucuuuuaaaucuuaaaauugaugugauugacccuagucaagaccauauuuuaccagucugguauugaaaacaauuauguuggacagaaaggaaagcagaauucuaauuaaggccagaauugaaagauagaauugauguggccaccuuaacaaccacagaauuuauaaguucuacuguuguuuucaauugcaaguaaguuuuugaaugucacuuagauacucuugaaagauguauuuuuaccuuacaagcacacuggguuacggacuagauuuguccacauuccuucucugaauuauagcagguuuuugucucucuccccuaauacuacuuaauaguuacuuagguauauaugucuuaucuucccuaccagucugaaaaucuggagcaugguuuugugccaacucccacuguggaaccuagcacaggcccugaagaaggagugaaugaaugaaugaaguauauguuaucuccauuugagccacaguaaauguuacuuguugccagugguagucagcaauuguggucacucuuauucagcacuugcuguaggaagguagaagggcauguuuuaaauggaacacgagaauuugaauaaauaugucacagauacccuuacaagccuuguaaaaaucugaccuaauuccuuuuaaguaaaagagguuucaugaaaggaaacuuacuacaaaaucuaauuauagacaaaucuauaccuuuaggcugguauuuaaagucuguaaugguaaauucauguuucuuuuuuacuggucauuccuauuuuaaucaggaaaauaucuagucuuuuuccucuuuccuagcaaacuuagaauuucuuuuacugcuuuuuauauaucagaagaaucuaccugaaacguauuuguaaauauauguauuaaacuguuuaauaaauggaaagcuaguuaauuuuguucaacccauguguuauaagugcuacugcugucucauuaaaacuuugucuuuuuuuuuugagacagucucacucugucacccagacuggagugcaguggugcaauuucagcucacugcaacuuccauuucccagguucaagugauucucaugccucagccucccaaguagcugggauuacaggagugagucaccacgcccaaccucauuaaaacuaaaauuuucuauggcaaucuuucuguaguucacugguugugauauuauuguuaccaucucuacagaauaaaaacugggucauuccagucuaucccagagcauacuguuuugauacauuuacuugcuuacauauauccucuuggaugcuuuuccuuagggaaacucagaauauuuaaaauugcauuaugucuuuauuuaaauugaaguacuuagaauagggcgaauaaauaaccucaugaccagauaacacgaguuucaaaaucuugaaguuuaugcaauaaacaaaauuuugaaaauacauuauucaccuuaucugagaacuagaugucuagcagcccuguuagccacaacucaccaagucauuuuguacugaacagaugaaugcuuugaaaauggcauuuugaaaaauguuagcacuuuguugaguuuacugaaacaguauaauuugacuguuugacagaaguugccuugggagagauuauuuaucuaauuucaucuaaacuuacuagaaugcuaugacagugauaucagaaacaugcuggaugggggaguaaggaaggacaacuagcuagacagaagcccccagggagugauagcugaccacaaggugacuucaaguguuauuuaaagaaaggaaacauacccaguuguauugaaaggcaugcaacagcugggucaguggguuaugccuguaauaccagcacuuugggaggccaaggcaauaggaucacuugaggccaggaguuugagaucagccugagcaacauaguggggccaugucccuacaaaaaauaaaaaaauuaccagauaucauggcauguuucuguaaucccagcuauucagggggcugaggugggaggaucacuggagccuggaaguucgaggcuguagugagccaugaccacugcacuccaacguggaugacagagugagauccugucucuuaaaaaaagaaaaauaaaagggcauucaacauguauaggcuagagaguaauccucuuacuauauuuucaugucuuuugccucuguucuuaacuacuguuuucaauuuuauggacuaaaagugacaaagucucaugcucaugacagacagcucaaggaagaaaaaguagaauauggauuaaaagaagagaauggauuugugaaaaaucuuaauguaagaaucauuaaaugcugaggcagaucauauaauguuuauccauggagauuuucaagaagagaaauaagucuugcagcagauucuguguuucuuacaguuagagggcuugacuagguaucagugagcguuccaugauuuaauaguaccuuacagcaaaauaugccucauccucuuuuggaaccacaguugcauauacugcguauuuuaaucagaaguagguuaugaaggccacagcagucacuuuuuuuuuaggaagaaaugugaugcugagagaagagguacagcucagugauauagaaauguauauaucuguguguguacacacauacauguguauucuauguauucagcacacucaaaaccuaugaaaaaacuauauaguuagcaaacacugugaauguuucuucuggcugcuuguuguuucucuuuauaugugccuucauuugcaaaagguguauuuucacuuguucaaguuuaauuggauugugaaauauuuguaauaaagguguaaucuaauaauucccaguuaacuuuccuaacuuuaucaugaaauaaaaguucagucaguaugcacaauaauaaaaguuuguccaguaaaguguguuaauguuauaagccuacacuucagggacauuucuugauucuacuccuuaagauauaauucuugauucuacuccuuaagauaauuauuaucuacuccuuaagauaauaaaaaucuguuguguuauuuuauaaugcuacuuauuucuucauaaaacuguaaacaaaucuauuauucuuuuccaccaagaagcaccuacaaguuuuuuguuuauuuguuuuucuucugaaacagucucacucuguuguccaagcuggaguacacuggugcgaccuuggcucacagcacccucaaccucccaggcuaaagcuauccucccaccucagacucccaaguuacugacuauggcgugugccaccaugcccagcuaacuuucguuguuuuuuuuuuuuuuuuuuguagagaugggguuucgccacguuguccaggcuggucucgaacuccugagcuuaagcgauucgcccaccuuggccucccaaaauguugggauugcagaugugagccccaugccuggcaagauuuuuguuuuuaauauccugguuaaguucuccucccuacauguauuuaaauuuguuauucaucuacuuaaaugaacuuuaggcaucaucuaauauaauuuaucauugaguaagugaaucucuucuaucacauaccagguauauguucaccugucuacaacuuaaauaucucccacaagagaagacaucaccuguuuuguuguuagcucuggggccuagaauguucauccucccagugaguuauaacugacuuggagcaacauagcuugcagagaacaagucaacucccuuucucuuccacugacagcccucaaaacauuugaagacagcugucaugucugaccuuagcuuuuaaucuaaccaucccccccugcccccgaccccauucuuaggaccauuccucaucggauguggauuccacaccacugaccugccagaugacucucuucuaaaccuaucauagauugcuaggguccuccuuaaaacauuuuacuagaauuuagcacacuuuuccugcugcauucagcaccaaggcuguugcuucucaugguuagacaugcuuuuuuuuuuggagagagaaauauaauuaucaucuuaacacugugcauauaaaugguugcuggggcagcagguguccaucauauuccuuagaguauaagagugaucugaggauagaguguguuuuauuuacugcucuaacauagcagccuccacguaauagguaucugauaagucguuuugaagaaaggcuuaagcuaaguuuucccucuuauauacuuaaacaauuuggggccaguuuuauauuuaaugugauuaaaauucaucuuuuuguuuguaaccuuuugauguucuuuguuuuugguucugucauauaaugugcagucacuuccagcuuuugugcugaauacagauuugggaaauaggccuuucaugucaauaccauuggauuaaaaaauaccaggccuuguuacuuuuuuucuuuuuucacugugacacagugaauuggcagaaaacaugcuagagucuguaagccuuaaucauauuauuagcacugauaauuuacacuauuucuaaauaagcuguuuuuuuacuuucagaacuuuggucacuucaacuguaaaauaccugccucaaagagcugauaggaugaucaaauaagauaauauaugugaaagcaguuuuuaaaauauuuuuagaaauuauauaaauccaagauuauaaaguuguaauuguuauugcugucuugagaaucucguuagauguugauagaauaguucuuauucuuaucugugauuuguuuuauaaccacugauccccaaaguuuuuaguguaacuuuaguuaauaaaaauguauucaggcuaggcacgguggcucacgccuguaaucccagcacuuugggaggccaagacaggcggaucacgaggucaggagaucgagaccauccuggcuaacacggugaaacccugucucuaguaagaauacaaaaaauuagccgggcaugguggugggcgccuguagucccagcacuuugggaggccaagacaggcggaucacgaggucaggagaucgagaccauccuggcuaacacggugaaacccugucucuaguaagaauacaaaaaauuagccgggcaugguggugggcgccuguagucccagcuacuugggaggcugaggcaggagaauggcgugaacccaggaggcagagcuuucagugagccgagaucacgccacugcacuccagccugggcaacagagcgagacuccgucuccaaaaaaaaaaaaaaaguauucacacauaguuuuguuucccuaaaguuuaguaauuugguuuuuuacgggcacaaggguggggaggaguauuuucaggguuaugauccaagucaugugcuugaaauacauucauuuuuaacuguaguuugugcuacacaggacuuuguuuuuuaccauuuaaagugugggcccaugaaauuuuauuagcuuuuuauuagaaaaaaaacugcaucagcacuucaguuguguuuguucugcugaauuaccuugaauuuuuaauugaaaggcaguugauuguaauuuuaguaucaguauuauacaaaguuauggaaauacuuaaugaucauguaguuugaacccucuaugacaagcaggaaauuaucuugucugccugacuuuuaauagaugacauucacccacugaauguaugagaacugaaaacucaaauggaagucaaauucagacuuggaauaaucagccucugcuuuaugcaugccccagaacacuggaauauauuaaaucaguccugacacagcuaccuucccccauucugaugaugaagaucucaaucuaaccccuuccuggguaaauuauugugauucuuuacuuucugcauuuccacauguccaagugauuuccacaugucuauccauuguaauagaaaccucuuggucaucacuuuuaugguaauacaagaagcaaacaccaagacugagacaauugaaugaaaaucucuaauuuuugauuacuggccucugaaguuauaucauccguuuauccuacauauaguagcccauuuguccuccauauaauaggcauucuaacaaaugggaaaaucuucaugucaaggauccugcgccaaggcuguguuauguggcuccuggguauagacaucagcucuuugggucagcucaccuggugauaaccauuucugagcuaaugagcucacaaacucacaugaaguggaguuguguccgcuguccauucauuuguucauaaugaaauuucuuuuaauuuuauuaaauaaguaagcuauacacauaguaaaaaauucaaauucaaguaguagaaaaagaguauagagugaaaagucucuacucuccugugaccccccccaguuuuccucucuaaaggcaaaucugauugccaguuucuucuguauucucccagggaauucuguauauuuacagauagauaacguguaugugccguuuauuuuaauauaacauacuuuucagcaccuuuuucacuuauguaucuuaguuauuaauauuauuauaauacauacagaggugccucauuuuuaauuguauaauauuucuuuggauguuuuauaaauuuuuaaccaaccaacaccgcccccauugggggauacuuaguuuguuuugaaucuuuucacacuguauuuuuuuggauaaguguucuuuguauaccuauaccugcauagcaguaggauaaauuccuaggcauggaauugcuaggucaaagaguaauuacauuauuuauuuugauagacauuuccaaauuacucaccagaagaugagcuauuuacaguuucaucagcaauguuuaaccacaauaaaaauuuuaucuuuccaacgacaguuaauuaucccucaucuuccaaguuccucccaggauuuagauacauaaaaagccaaaauccaaagauucuuaauaagcaugaaaugagggccaagggaguuguauggucuugaggucuuaggguuuucagacagcccgcugcuuccccgucagauguaucagaagagacuggacucuucugacacaucccaugccucuuucuuuguaccaugcuugauuuaaaaaaucauuaaagucaaaucucucuuuucaagacucuauauugauaguucccuuucaguguguuauuauauuuucauuauuuuaucacauagaauuauucuauuaaccagauugugauuauuuuucaauuauuacauuuuaauuugucugauuacaaauuguguggaguacauuuccuucagaaauaaaaauguagaaaguauuauuucaaaacauguuuccuaaaaacagcuaauuccauuggaauuugggaaucuuuacucagaaguaguacuugcugguccuuaagagcuugauuucuuuccuguuacuuacuucaguauuuucuuguuuuaaacucuuaggcucaucaagguuuuggucaaugguucucuguccucugacuaccacugacugaucaauaaauuuuuauuuaaaaaaaaacuuuauuauuauuaucauuauuauuauuauuuggagaaacagggucucaccauguuacccaggcuggucucgaacuccugggcucaagcagcccugccucagccucccaaagggauuacaggcaugagccaucaugccagcuugaucgauagauuauucuaggucaggugcgguggcucacacuuguaaucccagcacuuuggggggcugaggcagguggaucacuugaggucaggaguucgagaccagccuggccaacauggugaaacccugucucuacuaaaaauacaaaaaaaauuuagcuuggcaugguggcacgaaccuguaaucccacaugcucaggaggcugaggcaggagaaucacuugaaccggggagguggaaguuggcagugagccgagaucacaccacugcacuuuagccugggcaacagagcaagacuccaucucaacaauaauaauaauaauaauaauaauaauuaauuaauaauucuaaaguguuuuagaaauacaauacucuauagaagccaccagugauauuccauccccagauuuccuaauguaccacuaaugagucauauguaaguagaaaaugugauugauuuauuugaucuacaucuagcaaauauauugugaacaugaaguauuagguuacguuuuaagaaucucuugaaaauuaugucacauuuuaaaugguauuuaucauagcuaucagaugcuucccaaguaauugugcaaauaauuuggucacugccuuagccagcaguauguucuuuauucacuaagugauucuuuuguuaucuauuuccauaucuaucuucuauucaaagaaacaaaguaauuaccaacuauuuguauuaucagaauauacuaaauauuuuauaauccccgaagacuaauguaauuggaggggaagcaagaguggagguuaauuagagaaauuauauuagaaaucaguguguacuauuauuuuuuuuuuaccccuucaacagugucauggacuguuaaugauugcaucaguuaugguaaacucugauaaucugauauguucugugagugugugaauaauacauaacagauuuaauguaacuuccuuacuuucugcaguucccauacaggauuguuuuuuuccuuaacaaauauuuuuauuaaaaauauuuuccuuguaaccuuaaacuuaggauaaauucuacucauuauuaucggugaauaugauauacuuauuaggauauagggacauguuuuagguuucuaaauaggguaucauucuuuccuuuuggguucuguuuucaccuucaaguuaaaauuaacaaggguuuauagacagacaguaguagcaaugauuaaaauuaauuguaguauauuuccccagacuuucuuauaagaauaauauccuuauucaauagacuuugccacagaauaguguuaacagacuuuuuaugguuugauuggggauccuagucacuauuaauuguacauuucuggaugaagucuuuuucuguguuucaaaaaaguuacuuauuuaaaaaaaauguugaccuaaaacccauuccaaaauugaggacuaauuccauuguguuucucaagaaauuacauacugcauaauguuuauuuugugcuugaaagcaauuauuaaccaaucucuuuaaauauguaauuuucaguaacauuuaauguuucugacauuuauucuuagauuuuacgcucucuuucuaaaauuauggaacaagucuacaggaaugugaccaagcaggagaagaauccuuuuaauuauaugauagugguaaauuguuuugugcucuggaauaauccaccagaaagguaaaggagauaaacugguacccauccagcaauaaaaugguuuuguaucuacuccagaaaacugcagcaaagagcuggcagaugugugaugcuuugucaaacuuuaucaacuaccuuugaaaagaagaaauuuuugagucaauacuuaggaaagagaacaccccgaagaucuaucugauaugacucacugccgcuagugugaaacuaaaauguuuguguuuuuauuuuagugacauuguaugccuccuguauucuccugggaguguucuugaauagcagcgugccuauauuuuuugagcuuuuuguggaaacugucuacccaguuccagaaggaauuacuuguggaguugucacuuuuuuaaguaauauguuuaugggaguacuuuuauuuuuucucacauuuuaucauacagguaagaaauuugauuuuuuauuuacuaucuaaauguguuacaagaaaaguuugggucacuaguguauagaaguuuuuauauggagaagucucaccaaggcaaauuacuuuaugugaacuuccauugccaguaaaagaaaaauuccucaguuguuuuucuuaaaaugcauucuagcucaagugcacccucacucuucucugccccgccccuguacucccccacccccgaauuucugaauuaauuaaccugggcuggagcccaguauuuguauuuuuaaaauccuccccacccccacgccuuacccuaccaggugauucaaauauguagauucucauugagaaccucuggucuauugcuuuuuaaaaacuacuucgaaucucucuuaacacaggguguaaauuaauguuagggguguauauggaguuuaaagccugagggaugaaugacaggaugucacccaauguaaggaaugcucuaaaaugugacacuccaagaggccgaauuguuuauaggaguguuucugacaggguuauaacugaaauaauaaccgugcuaaccuccuugacuggaaagcaaauuuugaaacuuuuuuuuuuuuuugagacagaaucuaacucgguugcccaggcuggagugcaguggcacgaucucaacucacugcaaccucugccucccgggcuaaagcgauucucccgccucagccuccugaguagcugggacuacaggcaggugccaccaugccugacucauuuuuguguuuuuaguagagacgggguuucacuguguuggccaggcuggucuggagcuccugaccucaaguaauccacccaccucagccuccuaaagugcugggauuacaggcaugagccgcugugccuggccagaaacuuucaaagccagugugaaacauaauuaucccuggguuuuggacaacuucuggcauagcacuuucacccaacagcaaaaaguguccauaggauagaugaauuucuuaauauaaugaacaguacauuagauuguuucugucaaucaguaaugcagguaaaguaggucuuugcuaaaccugauacaaguuugguuuaucauaugaaggagagugauauuaaugaagucagaaggccacucuuuguuguccuggaaacacgugcuuccauuagggaaaagugccaucaccagaaaucagguucuuugcuuccaauuaguuuucucaacaacgaagucugacaaucauuacauaucagcuuuaauccacuucaguuguaucacaauuuaaauuaaguggcuuauugccugucugccugguaaagcaucggagauggcugugauccccccugggaugguagaagcaguuuuccagccgaugggcacagcuuugcuuagugguuggugccgcccagcagagcaugguuuuuccugucagcuagaaauagaguuuuguccucccaguauuuaaaaagaacaacagcaggugccagauaauguuaucccccaauaaaucuuuugcuuauggucucuaggauauaacaaacacauuuuuguugaucaguuuaaggcagagaagacaccaauaauggaaacugcccuaaacugucuuacugcagcagagcuccguacacaccugaccauuuugccuggccaguaguuuaucucugucacucuccuggguccugcugcgguuuugacuuguuuaacagcaucuggugucuggagugaauuaaauggaaccgacgucagucagugcucauuccucauuuugcaaauucauagugaccagauacaagcagauauuuuauuucuuuggcagagggagcagaaggaacacuuagcacuauuucugcccauuucugauauaaucaaggauuuuucuagcugggagaaacaaaacuucccucuuuuuggucaguuucugaccacauguucuuauacauguuuguguagauguuaaaaaguuuccaccuaaacuuugugacuauugugaacaaaagugaaacuuauuuuuuaaauaauuucaauguuucuuuuagauucaaggaguacaugugcaggauuguuacauggguauauugcaugacaaugagguuugggacaugaaugaucccaucacccagguagugagcauaguacccuaugaaacuauaaauaaucauuaauuuuaauccaccaaggugguuuccaggaaaaaggucucauuaaauuuuggcauuuuaggcaguuaaugagaagauaccuguaaaagagccaaguccagggcacagcuggcacccaccaguguuuguuuuguuucuucuagauaauuagcugacugaugcuaggaaguuaaauaucuagucuuccauuguaaagaaaugcuuuuauauguguauuuaugagugugcauaaugaauacacagaaacaucguccacaucucucuagggcuaaaguuacuagaaccaugaaaucuauguugaaacucuuuuuaguaggauuaauugaucuuccccuaaaaguccugcagcagagguccacauucuuuauggucucagguaugauuauacacaaauugcaaaucuaaaaauucuguaaaacuguuuccuaacaauaacuguuaguuccacagccuaguacccuaaacauuuuauaugauaaacugaacccccuuccauuaaagccaguguucauaugucauuauucaguuauuuugaaacuugaaaacucacccagaaguuaauuauaugucaaaauucaacuauuaguuaugugauuagaaggccugaauuuuuuaggggugggggagacagggucuugcucugucacccagucuggaguacaguggcaccauuauggcucacugcaacguuggccucccagccucaagugauccucccaccucagccucccaaguagcugggaccacaagcaugugccaccaaaccuggcuaauuuuuuguauuuuuuguagagaugggguucugccauguugcccaugcugguguugaacuccugggcucaagcaauccaccugccuuggccucccaaagugcugagauuacaggugugagccaccacacccagccuagaaggccugauuuuuaaucaucauaaagaucugugguuuuuuaagucacuucucaaggaaguacuaaacuuccugacuaggguuuuucccccuacagugugcuaucugauaaaugaauacaucagauaauuuuucagggcuauacagacuaaccccaaaaugaccauaauggaauaucuugccuagcaagcuagguucugcuggcaauuugcuugcagauuagagccauugcagucauugagggcaaaugugguucaggcuccuauaccaaugccacuggcuuauuuggagcccugggucacagggucuccaccuccuauuucaguucugcuuuggguaccuggaaccuugucagaaguuuuuuagaguuuuacugacuuggauuuuucaaggucacuuucaaaaaaaaaguuguuacuugcucccuaauauaaacauauuuguaaaacugaguugcuuccuguguuuguuuugagaaucccauugaguugacauagcacagugaugcuuuauucuaaugaugucacauagaaaaaucaauuugagaaugcuguuguauccuuuaugugcucugcaauguauucuguuuaauauucugaaguuuguguuaucuguuacuuuuuguucuagaagcuuugcagcggguuuugcuaaaagcaucaugauuuuuaucucagcucuuucauuuuaaaguggcugaccaugaaugugaggcuguguugucacucaaaagauucaggggccuggcagaggugggaggcauugacuaaugguuaccaggaaaacaaagagcagguucaacagauguggacuagugagaaguaauuuuauaucuaagaagcagaauaauggaaugugaugguaagaucuacuggguaauugauguggaaugaagauagcagggcauuauccugggaaaucauggggucagcuggcugcucaccuugagugagaaaggagacaaucuuguuaaaucaucauaaaagaaaauaggaaguuuguucuggagagugguagcuggaaacagacaaguacuuauaagugguagaaaccgaaagcgugacuccacuguagggaaagaugaggugaaaaguacaacagugcuuccagaagaaaaaguaagaggaugagcaaaaucccaauuaauucagucccaacagagccucaccauuuggugcagagcccacuucacugaguaaagucgagcaccugucuaaacuauaaguuggcagaaugagcacuccgacugcuguguaguagacaguagagacacagcggaaguauggggcagacuguaggccccugccuucaaguguggauuuauauuuuaucuagugaaaggcaaagggaaggaguauuagaaaaccaugcucauuuuaaaagaugaaaagaauuauaauacaaaaauuucaguggcucgcgauucuguuaguucaucuacaucagggucagaaaggggaucagaaaggacagcagcugacuuugcuacugccaagucaaauuagauuuuuaagcaagucauuuccuugcuuauuagagcaccuaaacagugguuuaugugaaugguuuucagcaggaaaauguagagguuccccuaucucugacuuuuugcuuucuaaaaaggcaaauaauuucgaagaacacuuguaguugauugagacaagugaauuuacugagagguggauuugacuuuugagagagaggcacacaguaaaaaccagucaacaaaccauggcgcuaaagagcaauuaugagacguuuuuagagauuucaucugaaccuauguagaagaaaugauuuuacaauucuaauaguaacgcugaaauaaaagaucuguuuugacaauauuugaaauguuucucaguuuaagaaaagcaaggacaggcggauuguugcuauguguguugcucuaguuccccauaaaauacagucucuaagauauagcaacuaucguuguaaacuguuuugucaauuaccauacuuuuuuuuaucuguugcuuaaaacuugacccugaaguccaagcucucccuuuuaauacaaacaaaaugcuauugucuauauuuuacuacuuuuuaauuuuuuacugcuucuuuuugccuaguaaaauuaucagaaauccagggguuauauagucaaaagcagaaaaugcccagugugucauuucagggaacaucagaaugaagacaggaucucauagaucacaucuucucugaguauuuagacuauguccaauccaaguaaagcagagaaaacagcuuugcauaaaaauaccauugaaauauaugucuuuguuacauacuauagaauagcaugucugacuuuuaaaacauaguaauagagagguggggagucuguauuugugagcauauuacagaaaaaaagguauugcagcaccuuuucuugccagucaguuuucugauuuccauuccugagcauaaauugcuccuuuagccauaagaauuauggauuaaacuaaagcagcaguguggaaaucuuuaggaugacuuuugaagauuaaggcaguauuagcauuuuguagaaguacaaagggaaaauauaaacccauaacagugaccaaaaaagaaaaaaggcaccaaggagcuuauuuuccuuguuuauuuuuugaauugaaacugcugaauggauauuaaacuagaaacguuguccccaccaccuucaccaaccucuuuaugccgaggagcuauucacuucagagccuugggauugacuggcagaugggauugggguagaggaaggcugaacagaugcacagcccuagggucccuggagcuccaggaagcagcuagaggcagccacaguggucaguguguguugguagcaaauggcugaggauugucuuguuggagaauccugaauucaugagagagcauuucuaaagaaccauguucuugacacauuaaaucaaacaacaacagaauugcccauucagaugaugccuauagguuuuccaauaauuggcaucauauauaaccauucaugcugguagagaaaaagacuagaaagaaauaagccaaaauauucacagugaucucucuggggacagaauuaugauugauuuuuuuguauguuuuauuuuuaaauauauuuucucaucuauuuuacagugauuucuacuuaauguuuuugcugagaaauagauauuucuauccaaaacauauaaaaguguuauuucaaaauucagaugauuuucguauuugucuuuuuaauccaucagauauuuauaaacagggacaagagugaugaugauagaggguacuuaaaaaauaauuaucaaacuaacauuuaaaggugauugauuuuuuuucuuugaaguaauuuauuuuguaaccaaagucaagguggauuaaauugaugaaaaguuaugaacaauauugauuaaaaauauuccacauggaagccccgucauauauuacacacaucacuuagucuccagauugucacuauuuauugaaagccaguuucuaggccuuccaggguacauuuauuauaaguacuuuuuaaugcagagcagauuccuuccggcauacaggugguggucugcuggugauacaugaauguuuaaaacugcauguuuuuuugucuuacagaguugucuugguucaacuggugccuucccgggucguguuugcucagucuccuccucauucugugcuucagggaauccuaugacagacucuaucuugaugugguugucuccguuuaauagcacagacuugaaggaguuuaaaaggaggcuggaaaucaauacugcacacugcacauuugcucagaauugcacaucuaacaggaaaagagggagaagaaagaaacuucauucagagguuuuguuagguuacagauuaucacauuaauuuaauuacuacuagguaauaauaaugggagacuugagugauaauaggggauuuuaaaacucuacagauggcauaccugugccugcuucugggguuggaagugugacuucuuacacauaaagcacuaccuaaguaauucucucucuguuuugugccagugcuaaacuacugauuacuuguaauuaugaaaagaaauaaagggugucuaucauaugaagauaacgccuucccuaagucacauaucagaauaggaagauaugccacuaacuucuaaagaaguucaaacccuguauccaauuuuaaugauaaaauagccaagagguauaucgaugauggaaauuagccacauguacacuacauuuuuucuaauaaagccauuucuuauaugacuccuuauuuuaaucaggucagaagcccuuggccaucuuuacuauggugaucaggugcuuuccagugacuucugagcauaggcacugugucuccaucucaacuuauccuuguuucugugaaauacaauuucaucuacuaggcccuuaaauaauuaugugagggugucuaaauguuuaauaugauuacauuaaauauuguaugaaaaaauguaauuccauuaggaucuagcacuuuguuacaagugaaaugacaagucacauggacauacugugucuucugccuguauaugguggcaugagauguaauguccagagccaacaauuauuuaccaggguuagauuuuauucagugacccuuguuuaaaaauaauaauuuaucacauugaaacuuucagcucugucgaaugauuucugaauuacauccuguguuucagcuuagguuguaaaauacuccguucucuguggagucagcauauuugagagggcagcguuuugccaguaccuaucuucuuucuacagaagauagcuuuuuaagaaauaagaguuccacauugaguggcugucagacacagauuucacugugacguaaaauacacugcagugagaauaugguaucaccacuauucauauuuacaucauuccccucacacagaaaaaccaacccuuuucccaaaaagucaagaauacugcuauaccuuuauuauucucagcuuccuccagcccuucuuguuuuuccucacuugaaauugaaccuucauugucagcuaaguauauauacuuuuguguuuuccuggacagagugcaaguggcucuuaucagccaagguggugaagguucaggaaagcugggcagcacugggcccugcuccucucugcaccugugugcgccaugacacacccacaugcagauucccaagucugucuccccucccccuuagcaaguacaaggcugugcauuaacucaccucgguccuagaggaguauccuaguacugcuuggcaacuucuaagacccuaacuugugaaacuagggaaguaagaaaccguucaaauuuaacaucugucuucagucaucuuuaaaucgucucucuuuauaaacacucugcucacuuagcagaaggacugaaggaacuaaggaacuugcuaaagagaagaagaaaacaaaagcuagacuuaguuccaguuaauucuguuauucuucugaaauaaaaaugaaauaaaaggaaggcagaauucucuuuuuuuuuuuuuuuagacaggaucuugcucugugauggugcaaucucaacucacugcaaccuccaugucccagaugcaggugauccucccgccucagccucccgaguagcugggacuacaggcacgcacaaccaugccuagcuaauuuuucuguuuuuaguagagacaguguuucuccauguugcccaggcuggucucaaacuccuaagugauccacccgccucagccucccaaagugcugggauuauaggcgugagccaccacaccaggccaagaaggcggauuccuugaagaugauucaaagccagccauuaaggauauccguagaccaugacccggaugcuaaauaagcaccaccccuuccuguucagagggaagagagaaaggagagggaagaauuauaagguauuugguuuuaguccgaacuauuauguuugaggauguugugguauaacauucugcaauaguaagauuucuuguguagaacauuuuaauuaugguuaauugcacuuuuuuuuuuuaagggacaggaucucaguauguugcccaggcuggacucaaacuccugggcucaagugauccuccuaccucagccuuccgaguagcugggacuacaggcaugcaccaccacaccaggcuuaauucuucuuuuaacacaaaguagaauaacacucuaaaaguauuaccuaaaugacuaauuaguucaaaacaucccaagugguagugauuaaaaauucuugcauuguucagaauucuuguuuuuagaauacaugaggugagacgagucccuguacuuuguuuguaugugcuuaccccuccagcagguaauuguucuaauuauaaacugcaacuguuuuaagugaucaaaaauuucauauaccaaaccugacaggaagggaaccaaaaggcuuggggguggggagaagauuacacaucauuuacuugaauauugcaaaucauauuuucuuuuuguuuuuauuucuaucaugcaucaaaauagaccagcugcuuucuuugcacuuucuaaccauuauagaauccuaaugaaauguuacagcugaaagaaaucuuaacccuucacuaauccaaacccucauuuuagaauuuauagaaaugauucuagagagguaaaguacaacugaggcucacaguuucugacuccuaaaccagguguuuuuuuccuaccucacagaagcuuaauuuagaccauuuugggugugcaugaauaccuucauguuaaaaaaugauagggcuuuaacaguaagcuuccauuauugaguaugggaaguacaaggauuaaguuaaggugauuauuugguuuauaaguaaaauucuuuuuucuccaucacuauccugaagaugcucugucagcucuuagcccuuggguuguaaugacaucauguaaaaagauucugaugaauaauucaaucccauaaaccaagucaacaccaauauuaauugguaaggacaugcuguagugcagguucccuguggcuuaucaauuaauacuucacaguuuaugggaagaagcauuuuuuaauaugaucccugguggagguauaggaacaagacaguuguauacacaaaugcauuucacuggaggauggagcuaauuacgagagaaucaaauacaaauguaauuuuguauauuuaaauauauauggccugagggccaaguuuuuucguagaucauguacucauguuuaauuauggagaauguuuacagcuuguuuuuaugaagcccuucuaaugagagaucuaagcuaagggauuuuaaauugaagagguuaaauccccaucuacuuaacuuuuaauuaguuuuuuguuuguuuguuuguuuguuuguuuuuuacuauuuuacuaaaauccaggcauucaucuuacuguuugcauaaguacaagcuucacuuuaggcucaagauugaauaaaaaugcauagcaaauuugcuuuaaa

SEQ ID NO: 18105 - RNA, 1979 nt, Homo sapiens
cuuacuauaugauuccauuuuuaugaaauucuagaacugccaaacuaaccugcagugacagaaaguagaucaguggugucugagaaugaggguguagggagagacagguuaggaagggacacugggaaccuucuggacaugaucaaaaugucugucaucuugaauguggugaugguuucuuggguguagguauauguaaaacuuaaucaaacuguucacguuaaauauaugcuguuuauuacauaucaguuauaccccaauaaagcuguguguguuuuuuuuuaauacaauacuauuaguacacuuuggucccacugucucgacacuagcaguuuuguucaccauugcauuuguauuaucagugcaaaugucaacacugugaaauaagcaaguaucaucuuagaaguauuaugaaaauaauuuugaucucaaagauccucugaaagggugucagggacccccaggggucuaugggccacucugguuuacaacaucacaacuguaauuacucuauuuuuuucuguucugacuccuccucuaaguaauucuaaaacaguuucuuaugaaaauacauuuuaaaucauacuccagauuaaaauuaaaauacuuuaaucauguucacaaacauuuuauaaguuaaaauuauauaaggauagcauuuaagacccucccaaguauggcugaugccgccugucugcuccacgcaaggcccuguccaaucuccccacugaccuauguucucucuucccuccuggccucugcucaugcccccuucaauuucugccuguuaaaguucuauguuuuagggccuggcucagguucagccuuggcuaugaagccuucucaaccgcuuguccccauauccaucugucccuugccuuccuuccuauauguuuuauuuggauuacuauuuaaaugguaagcaacacagaacguuuguguucuguuccuuuaacaauauuguaagcucuuugggcaauguuuuauaauuuuuuauuccugcaaacugcuaacauagugcugaauacauaauagguauuugaaugauuauauaaguggauuuuuuccuacucuauuucuuguuuugauauuucucuggucuuuaggaccccucagagaauguuuugacuuaaaccccuagcuucaccuuugucaaauuuucuguggcuucuaguuaaucaguguagcauuugucagccuugguaagaaauucuuaaucucucuggcccucuacuaguuuuuuaaguuuuuacuuauagccucuacuugaaguuuccucuuauuaacucuuuucuuccacaaauuaaauucauccaugaaaaauauguacauugauaaacauacuaauaugauuggaaaauauccuguagccuugagauggccuaaaaguaugauuuugacacuuaacugacuuuuguguauagcaaauaaaauuaaucuuauuauuuuuuaguuauacaucauaucauugacuaaauaaagcauuuguuuugaacauuuuguucucuacuuuccuagaaagguagggaauuugugacaguacaaaacaaaauuucuugcucucagacucauuagguaagaaugacaaguuuuaccuuuugcaauuaucguaaguaucaucauaauugaaguuauuaagaaucaacauguaacaaaagggauuuugccccaaggaugcuucucagguagauuccauuugauauugugauuugaauuggcuacugaaggucaggagccucguuaagucaccaggacacagaaucccaaaauacaguagauggaagauuaguuguaacaugucuuggacuuuaaaacauagcuaugagagcauguugaaauugaggcaggugauuugguaaugaauaauggcgucugauggccagugaugcuuucugaugagacaaguuggaauguaagaauuaagguguuuaucaagccuuuucuguuuauguaccuaagguaauuuuucuaaggaaaaa

SEQ ID NO: 18106 - RNA, 11038 nt, Homo sapiens
auuuguuccaaaucuuuaacuuuauuuaaagcagauacagaugauaacagcuuccaaagaguaaaagcaguaacccaaaugcucugcaaucucccacaccaugaaacuugcaugucacacacagugcaaucucccauccagaauccagaacuuaguagaaaccaaacuuuugcuucuuuggaacaaauuuagcuaaaagaugaacagcuagaaaauaacuauaauaguaaagaauuuaaugaaucaccaaaaacuaaauuuauaaucugauuuuuuuuuaaaaacauguaucauuuagcuuaagcuuccucaacucucuggacaaagaaaaagauucugaguuuuuaaguucuuccaauaggauuuccucuggggaaauuugcuuugaauacugugugggaauccauuucugagagaagcccagaauaaagggaucgccucaggcugcuccauggagaaguacccucaugggagacaguacagcucuggggggcagagcuaugggggcagacuaccugguucauaccccagcauuuccacuuauuaacugugugaccuuuggcaaguugcuuauccucucugugcaccaguuuucucaguuauaaaaugggaauaugaacuguaucaaucacacagauguaaagcuguuguaaaggggacaaacuaagguaaguacucauuaaauauuagcuauuauuaucugauaaaaaaauuuguacauguguguauguguaucuuugggaaaagaagaagacaucuuguuuacuauuuuuuuggagagaggcugggacauggauaaucacauaauuugcuauuauuacuuuaaucugacuugaagaaccguuuaaaaauaaaauuuagcaugucauauauuccuuauaguaggcuuauuucaccuuuuuucuguccagagagaguaucagugagaaagauuuuaagggugaaaacaugaauuggugggacuuaguaaagagcugaaaaacuacuacaaugugggcuacgguuauuauaaaaugauagagauggaaacuagaguaaguuuauuuugucuguuaaaccuggaagugagcuaggcauggucacucacgccuguaaucccaacacuuugggagcccaagacaggaggaucccuugaguccaggaguucaagaccagucugggcaacacagggacaccccaucucgaccaaaaaaaaaaaaaaaagccaggcaugguggugcacuucuguggucccagccacuugagaggcugaggugggaggaucacuuggccccaggagguugaggcugcagugagucgucauugugccacugcacuccagccugggggacacagugagacccugucucaaaacaacaacaacaaaaacaaagcaaaacaaaacaaaaaacacuuggaagugggguauacucaaaaauauaaaauuaucuagagaaaaacaaugcucagaaauauauagcauuacuguggcagggcaagugcacccaauauggcaguuuacaaggagcagaaagcaaaggcucaagugaggggccuggucagaguucaggcuccaaguguucuagaauaagaaacucaagucaggcaccguggcacaugccuauaaucccaucuacucgagaggccaagguugggggauggcuugagcccaggaguucaaguccagucuugaugucuucccuugagagacagggcaauauaguaaggacuugucucuuaagggaaaaagcaaugaaagaaagaagcucaguuuuccaaauuaguagcaaggacuccagaaauggcuuccuuacuccugccucugccaaagauuuaggaggcaaauaucccucugcuggcuuacuagcaaccugagucaggcaaacaauuuuaugaaacacugcuacaguuuaguuuguuugaccuccuccaaaucucauguugaaauuugauccucaguguuggaggugaagccuaacgggaggggucugggucaugggggcagauucccccaugaauggcuuggugcuguucucaugggagugacucacucuuaguuccugaagaacugcuuguuaaaaagagccuggcaccuccccgacaccucucucucucacuuccucucugucauuugauuucugcacacacuggcugcccuuugcuaugaauggaagcagccugaggcuuucaccggaugcccaaccuucuagccagcaaaauugugagccaaacaaaccuuuuucuuuaucaauuacccagucucagguguucuuuuauagcaacacaaacagacuaagacaggcaccaacuauauacuaggcucuuggucauuaaaaaugauagucuugugugggugugguggcucaugccuguaauuccagcacuuugggaggccaaggcaggaggaucauuugagcucaggaguuugaaaccagccuggccaacauggcaaaaccccgucucuacuaaaaauacaaaaaauuagccggguguggaggcacacaccuguaaucccagcuacucaggaggcugaggcaggagaaucgcuugaacccgggaaguggagguugcagugagccaagaucacaccacugcauuccagccugggugacagagugagacuccaucucaaauaauaauaauaauagucuuauuccauuuauuaccaaugcuugcccaaucucuacucauggccacuuuucuuaccaugaguaagaaagcagaaugugggucuuuaauuuuucacaaccaacccuuuuuccucccauuuacaauagaauuucacuuucacagguagagaugaaggggaaaacacacaaaaaaccaaagaaccaccccagagauggcaaugaaaaagagaucaauuggcagccgagaguccaacugaaggacacagaagauuauuucggacccaccucuaaccccagugaugacacaagagggaugacaccuuugcagcagauuuuacacagauuuggggggcuuuugucuuccauaaaaaguaucacuccagggcugggcgcgguggcucacgccuauaaucccaacacuuuggaaggcugaggcgggcggaucacgaggucaggagaucgagaccauccuggcuaacacagugaaacccugucucuacuaaaaauacaaaaacaaaaauuagccgggcaugguggugggcgccuguagucccagcuacucgggaggcugagguaggagaauggcaugaaccugggaggcggagcuugcagugagccgagaucaugccacugcacuccagcgcgagcgacagagcagacuccgucucaaaaaaaaaaguaucacuccagaaaugacagacuagcagauuguuauucuuauacaaaccauuucuugagaagaaaaauuucaaaguccuuucuacauaaggauuuagacuggcauuaaaucagccuccuaaaauauauuuuuuugaaagcuugauuuaagacaucuuccagcaguugucuuacucaauuccuuuggcuuucagcuccucuuugacacguuucagguaagaaggaucaggauagccauaccugaagaaacaaaaauuccuuuagugucaccacaaauuguucggauaugugcaauagauauccagcauuuaaggauuuaauuaauauccaguguugcaaacauucacaaguaauccugaagguggaugacguaucaugacuuuuaaauucgcagaugcgagucauuucgcuagcgagugagccuagcugucuggccagcaucugccuuucaagcuggcuucuacccugccaacuacaaaguauuaauaugauguauuuauuacauuucgcaucaaagggcaggggguuugagaauccaagaugaauaguaauacguugauuuacuuugaggcuucaugucuauguuaauucuuaaaauuuuucaguuuaugguaaguagugacucuccuaaaaauauaauaauauacuguguuuuaggggggcaucguaaucacaugcuaguaggauuuucaaauuuaagguuuuggaaaagucucaggguauauauuuuuucuuuagugccaagggucugaggaauccuauuuggguuucauaaagaacaauuggauuucguauaauacaguuucuaccaauagucuccucacaacuuagacuuuuucuagaauauuauuggccaagugauuucagguucucuguggacuggugggggaaggggugaaaaagaaaggugaccuuaaaaggaagcaaagugacauuccgagcaucuagccuucagauagacacaacgccucaaauuaaaucagcuuauauaguauucaucucggauucaaaagcccccuguccuuuggugcaaaauuuaaauaacuccauaguacuuuauagcuggcaggguagaaguugauggggaccaaucuuucugucuuugagauuaccauccccgaucagcagcucucaaaacaccaauuccacugcuauagagucuacuuauauccacauccagaaauugccguauuucauaaucccuauacucuguugagcagccauuacaucccaaaaggaucucacauuucugguccuccaaaccgggauguuuuguggugaauaucauuccaagugaugacaucugagacuccuaauacgcgagaguaccccacuguaaaaaucagcuuuuggucaaaggcccuauaaagcaguuucaaaaccuuccuuccuuccuuauuaucaggcaaguaugcaguucgcuguauuccaggguaucucuuuccuggguuuggguguucuuccugugugagaacaagaaaaugucaugugaaaagagugcccugucuaauuuuuacuauagguauagauguguucauuuguagauaaagcaaaucaaaagcaagaaagguauugaaguuaugcucauauucccaauaacucauauuucuccucuuuccuugaauucaugcuggaaacacuguccaccuuccugauacccccaucucaagauauaaucuccacccacccuuucucugucuuaagaaauagacacaaaagguauuugaauuaccagcaaacauugugaccuuuaccacuauuucagucccuugcacaugacccuggagauaauuccuugggaaaucuauugucuaauaggcaacaggacagucucuuuugcccugguaaucguagcauaguggcaagaaacccauggacuugagaaauacuuacuguuuguaugccugcuuucauagaauaaguaaucacaauggugccaaaggacucauaaccuggaagugagucucuugaaacagugaaaaccaugcuucccucuggcugauuuccuuucugaauaccauaggaagucuggcaugugggacagauuggcuuauaugacauggcuuuguugauacaaggggcgcagaauucaugcuugcacuuugguagcacuuuuuuguuacuaaugguguccauacagaugacacagaugcccuuuuccuucuuguccaguucugaggccucagaacucacagagcccuugaguggcggagaagcugcuuuggaaucaucgcuaucaauguccaucgguguuucaugacccucuuucaauuucuuuccagccaaugaagacauuccuccuccuuuuagaacauacugcuucgccuuugcaaggugauuuggcaaaccagucaaagucauugacucuugauuuagcacaaaguguacauuuggaugucuuuuucuaaagucaucagcaaacuuggucugauguaagugcuuucucuccuugcccaaagacuucaguaaaagaacuucucucaucaacugacaugaggcauguugaaaggcaucgaugaaacuugcauaagcaugcacagauagaucuaccugccuguccuuggauucaaacagaaugcagguuuucugaccuuucucagaaaccuugcugcaaaugucauaccuuuuuucgaucucugauaucuccuguaguaauucaguuucuaaaaguuuauagugggcacuaucaaccucaauuacauucaucauguaauuggcagcaaauaguuucacagguaucuugacaaaagcuucagagauuuuuuguuuggcagcugaaaugucaucuugggucccaaggagaguuaauucgccuccuuucuccuuuauaaggagcuuuguaaacuggugauucaauuccuguuugaauuuauuugccugcuuacugucugcuaaagagacacauucuugcuucagagguucuguguucuucugaaauucacuagcaaaagacucacgagcugcuuccaggucaccugaucgacuugaggugaaaucuaaacagaccauauuuggagaacucuccuggauuucaauguuuacaccaaaucuuuucucuauugaguugauuuuaucaggacagauauauuuaaaguauucaaaguaaggcaagggaacuucaaaauaguugcuuuuuuguucugccuugguuucugguucagaaggagaaaugcagcugucccucuccugcugacugaguggcuuccucucugucauugaaggggaaaauuguuguuucugcucacuuuccaggaacugcucacucaaaaauugauguauucuuucaaugucuuggaagucaccacacaccuucucaauuccaucgugaccuuccauuuuucugauacuagggcacagugugguuauguaugcccucugcucuuuggagaacagguuacaguucaggucagcuguuacaguaagaaagaucugaaauuuuaaaaggaacaggaacaaauaaaaccucucagcaugcaggccuaccaucuucucuucaggagaaugcauagagacuagagaaacaaccacuacaucuuucccaagugggggcaacuucuuucaaauccuauuuauuuauuuauuuauuuauuuauuuauuuauuuauuucaagauggaguuucacucuuguuacccaggcuggagugcaauggcgcgaucucagcucacugcaaccuccgccucccggguucaagcaauucuccugccucagccuccugaguagcugggauuauaggcaugugccaccacgcccggcuaauuuuguaucuuuaguagagacgagguuucuccauguuggucaggcuagccuggaacuccugaccucaggugauccacccaccucagccucccaaagugcugggauuacagacaugugccaccgugccuggucucaaauccuuuuuagaggauacagcacgcuacaucccagagguucucagcccugucugcauauaagacucaccuggcgaauucagggaaaaacaaaccagccaaagcccaagcacauccccagagauucugauguuaacuaaucugcaguggagccugggcaugagcauuucuaaaagcuccauggccaagagauccguguucuacaacugccacuagcuguuugaucuugggaacagcagucaagggaaggcaccugugcucucugggcaaguuguuguggcccucacaaaaguuugugaacuuggaagggagccauaaaacugagggcaauggcuuuuccuauuacuauuuuuucucuucuucacucuuccuccuuuauucuuguuucaacuaaacacucgacugcaugcaaaguuguggacccuucuaaacccuggccuuuagaagcucaaauauaagacacgccagguuaagauaaaaaggacagagaccaauugacuguaauauaaaagcaaaauuccuaauguuuuguuccuucucaaggacuuugcauguuaagauccuuccucuagaucuucaaaauguuuccugaauccagccauuucucacaccuccaucaaggccaccaaagugcaugccauuaucaucuuucaccuggcgcacugcaaccccuccuaaccaggcucuaacucuccauucuauccccuuucuacguucaguuuuccaacagcagccagagugacccuuuagaaauauaaaccagaucgcccucuccccuggcucaaaacuaucugaugaauccccuaacauuuuaaguuaaaaauccaaaauccuuaccuucagccccaaaggccugucuucuggguaccuucccgaguuccuagcaccucucuccauugcucacugcccuccccaccacacuggcuuccuuaaagcuucugggccucaaaaugucagcucuuggggacuuugcaccuaugcuucccucuaggacacuuuccgcccagaaauccacuuggcuagagaugucaccucacuugagguuuuuccagacauccuauuuuaaauggugguucugucacugucugucacuuauucuucuuccuagcagguaugacuggcagacauuuuauuauauaucuauuguuuacuaauauugucuguuucucucucuagaaggugccgucccuggaagccgagucugccauguuccuggcugccuccccagcuccuauaacagugccuggaacacaguaggcaguggauaucuauuguugaaugaaucuugucaucauucaaguuucaggccaaacaucaccuccucagucaaguugucucugauuucugguuagaaguagcaccaggccaggugcaguaauucaugacuguaaucccagcacuuugggaggccaaggcgggcagaucgcuugagcccaggaauuugagaacagccugggcaacauagugagacucuguuucuacaaaaaaaaaaaaaauuggcuggguguaguggcgccuauaguccuagcuacucaggagacugaggugagaggaucccuugagcccaggaggucaacucugcagugagccaugauugugccacuguacuccagccugggcgauaaagugagacucugucuuggggggaaaaaaagaaguaacaccacccccaucuuccccuugcuugcccuggcgcuguuucucuccaaauaaauaaaaugguuuuauuuauuuuguuuacuugccuacugucuuucugugcaugaccuggcccccaguauaagcugccugagagcaggggccuugucuguuauauucaucucuguguccagugccuaaaacagugccuggcucccauguacgugcccagcacauggguguuggaucaauaauacaugaggcuggugacuggagaggaggcgcaggcacagccagcuccuucuuucaauacucaccuuuuggagacaggaauccacagcauuaggaauauguccuucauguugaugcauaucaccagacgguguuucugcuugugauugugucagugaagaaauuugaggucucguguucuucuuuauugaauuuucaguggguaccaggaaaaugggcacagguuuuucgucaacaaguauuuggugcucuccuuuuuucaacacucucuccuuagcuucaguggagacauuaaacacacacauauacacacauaaaaaugggagagauuucaaguaauccucucauuccugugucuguacucugccccagcaccucccaguaaggcugcucccugcauccuggaaugguggguuggcgauggagaaagucggggagcuauuaagagcucuaaagugugcggauuaaguuuuacuauagaagugaaagcuuaaugacaauggaacauuguccaccgauuaaacaucauguuucuaaaacugucuccagucuccccuuuccuucuuccuucuuucccucccucccucccuuccuuccuucuuuuuuuuuuuuuuuuuuuuuuuagacggagucucacucugucacccaggcuggagugcaaugguaggaccucgucucacugcaaccucucugccucccgaguuccagcgauucuccugccucagccuccagaguagcuuggauuacaggugcgcaccaccaugcccggguaauuuuuguauuauuaguagagacggaauuuccccauguuggccaggcuggucucgaacuccuggccucaggugauccaccaaccucggccuccaaagugcuaggauuacaggcgugagccaccgcacccggcccagucucccauuucaauacucauuauacagguaagugacaacagcaggaaucaaaagugcagacuccgaauuuuguaaauauacauguguuugcuggcauucauaaaaaaaggcaggaaggaaauacaccaaauggucacauuguuuaucuucagguuguuuucuuuuuuacucuuuuauuucuauagugagcauauaucacuuuuguaauccucaaaaacacaaaauggaacauccuuuuguucauggauggaacaauggaaccauuauuuaaaacauaaaaguggaaucccugaaugacaaggacagcagcuggcaggcaucugggggaaggaagaugacagcugagaaauuaaguuagaaugaggauauggaaagcauccacacuaaggcgccgucagccagacccgcaccaggcacaugugaggccccauccuccaccgaguguucacugucucagugagucucuuggcaguagggccccgucccuguccgccaccgcacagugacauacuuucucccgcccucuccccuaggucagcuggaacuggguccgccuggaaacccgggggccgggcccccagagggcuuucgcagccuggccgcccgaagcucaccugcccuuucacugaacuccacccggaaggugcccggggcuucguguuccugggugcugaccgugcacuccccgccgcccgaggacuuagagcucuggaaguagcucuccagcuuccuucguacucgggggccggacuuguacacccgcacgaggagcggggacggcgggcgcaggugggaggccauggcucugcgcgucgggagggcgcgggggcuccgggaggcagcugggcgguaaaggcgcggcccgcccugcggacugggcgcaaaguuucaguuucgcuucccuggaggucccucccuguucccggcagagccgcuucccccuccucccugugcugucugcaccgaggagagcggccugccgggugaguagguccggugccucugggcccucgggguccccucuccugcaggcucgaggugggcggggagaagggggacgg

SEQ ID NO: 18107 - RNA, 11038 nt, Homo sapiens
ccgucccccuucuccccgcccaccucgagccugcaggagaggggaccccgagggcccagaggcaccggaccuacucacccggcaggccgcucuccucggugcagacagcacagggaggagggggaagcggcucugccgggaacagggagggaccuccagggaagcgaaacugaaacuuugcgcccaguccgcagggcgggccgcgccuuuaccgcccagcugccucccggagcccccgcgcccucccgacgcgcagagccauggccucccaccugcgcccgccguccccgcuccucgugcggguguacaaguccggcccccgaguacgaaggaagcuggagagcuacuuccagagcucuaaguccucgggcggcggggagugcacggucagcacccaggaacacgaagccccgggcaccuuccggguggaguucagugaaagggcaggugagcuucgggcggccaggcugcgaaagcccucugggggcccggcccccggguuuccaggcggacccaguuccagcugaccuaggggagagggcgggagaaaguaugucacugugcgguggcggacagggacggggcccuacugccaagagacucacugagacagugaacacucgguggaggauggggccucacaugugccuggugcgggucuggcugacggcgccuuaguguggaugcuuuccauauccucauucuaacuuaauuucucagcugucaucuuccuucccccagaugccugccagcugcuguccuugucauucagggauuccacuuuuauguuuuaaauaaugguuccauuguuccauccaugaacaaaaggauguuccauuuuguguuuuugaggauuacaaaagugauauaugcucacuauagaaauaaaagaguaaaaaagaaaacaaccugaagauaaacaaugugaccauuugguguauuuccuuccugccuuuuuuuaugaaugccagcaaacacauguauauuuacaaaauucggagucugcacuuuugauuccugcuguugucacuuaccuguauaaugaguauugaaaugggagacugggccgggugcgguggcucacgccuguaauccuagcacuuuggaggccgagguugguggaucaccugaggccaggaguucgagaccagccuggccaacauggggaaauuccgucucuacuaauaauacaaaaauuacccgggcaugguggugcgcaccuguaauccaagcuacucuggaggcugaggcaggagaaucgcuggaacucgggaggcagagagguugcagugagacgagguccuaccauugcacuccagccugggugacagagugagacuccgucuaaaaaaaaaaaaaaaaaaaaaaagaaggaaggaagggagggagggagggaaagaaggaagaaggaaaggggagacuggagacaguuuuagaaacaugauguuuaaucgguggacaauguuccauugucauuaagcuuucacuucuauaguaaaacuuaauccgcacacuuuagagcucuuaauagcuccccgacuuucuccaucgccaacccaccauuccaggaugcagggagcagccuuacugggaggugcuggggcagaguacagacacaggaaugagaggauuacuugaaaucucucccauuuuuauguguguauauguguguguuuaaugucuccacugaagcuaaggagagaguguugaaaaaaggagagcaccaaauacuuguugacgaaaaaccugugcccauuuuccugguacccacugaaaauucaauaaagaagaacacgagaccucaaauuucuucacugacacaaucacaagcagaaacaccgucuggugauaugcaucaacaugaaggacauauuccuaaugcuguggauuccugucuccaaaaggugaguauugaaagaaggagcuggcugugccugcgccuccucuccagucaccagccucauguauuauugauccaacacccaugugcugggcacguacaugggagccaggcacuguuuuaggcacuggacacagagaugaauauaacagacaaggccccugcucucaggcagcuuauacugggggccaggucaugcacagaaagacaguaggcaaguaaacaaaauaaauaaaaccauuuuauuuauuuggagagaaacagcgccagggcaagcaaggggaagaugggggugguguuacuucuuuuuuuccccccaagacagagucucacuuuaucgcccaggcuggaguacaguggcacaaucauggcucacugcagaguugaccuccugggcucaagggauccucucaccucagucuccugaguagcuaggacuauaggcgccacuacacccagccaauuuuuuuuuuuuuuguagaaacagagucucacuauguugcccaggcuguucucaaauuccugggcucaagcgaucugcccgccuuggccucccaaagugcugggauuacagucaugaauuacugcaccuggccuggugcuacuucuaaccagaaaucagagacaacuugacugaggaggugauguuuggccugaaacuugaaugaugacaagauucauucaacaauagauauccacugccuacuguguuccaggcacuguuauaggagcuggggaggcagccaggaacauggcagacucggcuuccagggacggcaccuucuagagagagaaacagacaauauuaguaaacaauagauauauaauaaaaugucugccagucauaccugcuaggaagaagaauaagugacagacagugacagaaccaccauuuaaaauaggaugucuggaaaaaccucaagugaggugacaucucuagccaaguggauuucugggcggaaaguguccuagagggaagcauaggugcaaaguccccaagagcugacauuuugaggcccagaagcuuuaaggaagccagugugguggggagggcagugagcaauggagagaggugcuaggaacucgggaagguacccagaagacaggccuuuggggcugaagguaaggauuuuggauuuuuaacuuaaaauguuaggggauucaucagauaguuuugagccaggggagagggcgaucugguuuauauuucuaaagggucacucuggcugcuguuggaaaacugaacguagaaaggggauagaauggagaguuagagccugguuaggagggguugcagugcgccaggugaaagaugauaauggcaugcacuuugguggccuugauggaggugugagaaauggcuggauucaggaaacauuuugaagaucuagaggaaggaucuuaacaugcaaaguccuugagaaggaacaaaacauuaggaauuuugcuuuuauauuacagucaauuggucucuguccuuuuuaucuuaaccuggcgugucuuauauuugagcuucuaaaggccaggguuuagaaggguccacaacuuugcaugcagucgaguguuuaguugaaacaagaauaaaggaggaagagugaagaagagaaaaaauaguaauaggaaaagccauugcccucaguuuuauggcucccuuccaaguucacaaacuuuugugagggccacaacaacuugcccagagagcacaggugccuucccuugacugcuguucccaagaucaaacagcuaguggcaguuguagaacacggaucucuuggccauggagcuuuuagaaaugcucaugcccaggcuccacugcagauuaguuaacaucagaaucucuggggaugugcuugggcuuuggcugguuuguuuuucccugaauucgccaggugagucuuauaugcagacagggcugagaaccucugggauguagcgugcuguauccucuaaaaaggauuugagaccaggcacgguggcacaugucuguaaucccagcacuuugggaggcugagguggguggaucaccugaggucaggaguuccaggcuagccugaccaacauggagaaaccucgucucuacuaaagauacaaaauuagccgggcgugguggcacaugccuauaaucccagcuacucaggaggcugaggcaggagaauugcuugaacccgggaggcggagguugcagugagcugagaucgcgccauugcacuccagccuggguaacaagagugaaacuccaucuugaaauaaauaaauaaauaaauaaauaaauaaauaaauaaauaggauuugaaagaaguugcccccacuugggaaagauguagugguuguuucucuagucucuaugcauucuccugaagagaagaugguaggccugcaugcugagagguuuuauuuguuccuguuccuuuuaaaauuucagaucuuucuuacuguaacagcugaccugaacuguaaccuguucuccaaagagcagagggcauacauaaccacacugugcccuaguaucagaaaaauggaaggucacgauggaauugagaagguguguggugacuuccaagacauugaaagaauacaucaauuuuugagugagcaguuccuggaaagugagcagaaacaacaauuuuccccuucaaugacagagaggaagccacucagucagcaggagagggacagcugcauuucuccuucugaaccagaaaccaaggcagaacaaaaaagcaacuauuuugaaguucccuugccuuacuuugaauacuuuaaauauaucuguccugauaaaaucaacucaauagagaaaagauuugguguaaacauugaaauccaggagaguucuccaaauauggucuguuuagauuucaccucaagucgaucaggugaccuggaagcagcucgugagucuuuugcuagugaauuucagaagaacacagaaccucugaagcaagaaugugucucuuuagcagacaguaagcaggcaaauaaauucaaacaggaauugaaucaccaguuuacaaagcuccuuauaaaggagaaaggaggcgaauuaacucuccuugggacccaagaugacauuucagcugccaaacaaaaaaucucugaagcuuuugucaagauaccugugaaacuauuugcugccaauuacaugaugaauguaauugagguugauagugcccacuauaaacuuuuagaaacugaauuacuacaggagauaucagagaucgaaaaaagguaugacauuugcagcaagguuucugagaaaggucagaaaaccugcauucuguuugaauccaaggacaggcagguagaucuaucugugcaugcuuaugcaaguuucaucgaugccuuucaacaugccucaugucaguugaugagagaaguucuuuuacugaagucuuugggcaaggagagaaagcacuuacaucagaccaaguuugcugaugacuuuagaaaaagacauccaaauguacacuuugugcuaaaucaagagucaaugacuuugacugguuugccaaaucaccuugcaaaggcgaagcaguauguucuaaaaggaggaggaaugucuucauuggcuggaaagaaauugaaagagggucaugaaacaccgauggacauugauagcgaugauuccaaagcagcuucuccgccacucaagggcucugugaguucugaggccucagaacuggacaagaaggaaaagggcaucugugucaucuguauggacaccauuaguaacaaaaaagugcuaccaaagugcaagcaugaauucugcgccccuuguaucaacaaagccaugucauauaagccaaucugucccacaugccagacuuccuaugguauucagaaaggaaaucagccagagggaagcaugguuuucacuguuucaagagacucacuuccagguuaugaguccuuuggcaccauugugauuacuuauucuaugaaagcaggcauacaaacaguaaguauuucucaaguccauggguuucuugccacuaugcuacgauuaccagggcaaaagagacuguccuguugccuauuagacaauagauuucccaaggaauuaucuccagggucaugugcaagggacugaaauagugguaaaggucacaauguuugcugguaauucaaauaccuuuugugucuauuucuuaagacagagaaaggguggguggagauuauaucuugagauggggguaucaggaagguggacaguguuuccagcaugaauucaaggaaagaggagaaauaugaguuauugggaauaugagcauaacuucaauaccuuucuugcuuuugauuugcuuuaucuacaaaugaacacaucuauaccuauaguaaaaauuagacagggcacucuuuucacaugacauuuucuuguucucacacaggaagaacacccaaacccaggaaagagauacccuggaauacagcgaacugcauacuugccugauaauaaggaaggaaggaagguuuugaaacugcuuuauagggccuuugaccaaaagcugauuuuuacagugggguacucucgcguauuaggagucucagaugucaucacuuggaaugauauucaccacaaaacaucccgguuuggaggaccagaaaugugagauccuuuugggauguaauggcugcucaacagaguauagggauuaugaaauacggcaauuucuggauguggauauaaguagacucuauagcaguggaauugguguuuugagagcugcugaucggggaugguaaucucaaagacagaaagauugguccccaucaacuucuacccugccagcuauaaaguacuauggaguuauuuaaauuuugcaccaaaggacagggggcuuuugaauccgagaugaauacuauauaagcugauuuaauuugaggcguugugucuaucugaaggcuagaugcucggaaugucacuuugcuuccuuuuaaggucaccuuucuuuuucaccccuucccccaccaguccacagagaaccugaaaucacuuggccaauaauauucuagaaaaagucuaaguugugaggagacuauugguagaaacuguauuauacgaaauccaauuguucuuuaugaaacccaaauaggauuccucagacccuuggcacuaaagaaaaaauauauacccugagacuuuuccaaaaccuuaaauuugaaaauccuacuagcaugugauuacgaugccccccuaaaacacaguauauuauuauauuuuuaggagagucacuacuuaccauaaacugaaaaauuuuaagaauuaacauagacaugaagccucaaaguaaaucaacguauuacuauucaucuuggauucucaaacccccugcccuuugaugcgaaauguaauaaauacaucauauuaauacuuuguaguuggcaggguagaagccagcuugaaaggcagaugcuggccagacagcuaggcucacucgcuagcgaaaugacucgcaucugcgaauuuaaaagucaugauacgucauccaccuucaggauuacuugugaauguuugcaacacuggauauuaauuaaauccuuaaaugcuggauaucuauugcacauauccgaacaauuuguggugacacuaaaggaauuuuuguuucuucagguauggcuauccugauccuucuuaccugaaacgugucaaagaggagcugaaagccaaaggaauugaguaagacaacugcuggaagaugucuuaaaucaagcuuucaaaaaaauauauuuuaggaggcugauuuaaugccagucuaaauccuuauguagaaaggacuuugaaauuuuucuucucaagaaaugguuuguauaagaauaacaaucugcuagucugucauuucuggagugauacuuuuuuuuuugagacggagucugcucugucgcucgcgcuggagugcaguggcaugaucucggcucacugcaagcuccgccucccagguucaugccauucuccuaccucagccucccgaguagcugggacuacaggcgcccaccaccaugcccggcuaauuuuuguuuuuguauuuuuaguagagacaggguuucacuguguuagccaggauggucucgaucuccugaccucgugauccgcccgccucagccuuccaaaguguugggauuauaggcgugagccaccgcgcccagcccuggagugauacuuuuuauggaagacaaaagccccccaaaucuguguaaaaucugcugcaaaggugucaucccucuugugucaucacugggguuagagguggguccgaaauaaucuucuguguccuucaguuggacucucggcugccaauugaucucuuuuucauugccaucucuggggugguucuuugguuuuuuguguguuuuccccuucaucucuaccugugaaagugaaauucuauuguaaaugggaggaaaaaggguugguugugaaaaauuaaagacccacauucugcuuucuuacucaugguaagaaaaguggccaugaguagagauugggcaagcauugguaauaaauggaauaagacuauuauuauuauuauuugagauggagucucacucugucacccaggcuggaaugcaguggugugaucuuggcucacugcaaccuccacuucccggguucaagcgauucuccugccucagccuccugaguagcugggauuacaggugugugccuccacacccggcuaauuuuuuguauuuuuaguagagacgggguuuugccauguuggccaggcugguuucaaacuccugagcucaaaugauccuccugccuuggccucccaaagugcuggaauuacaggcaugagccaccacacccacacaagacuaucauuuuuaaugaccaagagccuaguauauaguuggugccugucuuagucuguuuguguugcuauaaaagaacaccugagacuggguaauugauaaagaaaaagguuuguuuggcucacaauuuugcuggcuagaagguugggcauccggugaaagccucaggcugcuuccauucauagcaaagggcagccagugugugcagaaaucaaaugacagagaggaagugagagagagaggugucggggaggugccaggcucuuuuuaacaagcaguucuucaggaacuaagagugagucacucccaugagaacagcaccaagccauucaugggggaaucugcccccaugacccagaccccucccguuaggcuucaccuccaacacugaggaucaaauuucaacaugagauuuggaggaggucaaacaaacuaaacuguagcaguguuucauaaaauuguuugccugacucagguugcuaguaagccagcagagggauauuugccuccuaaaucuuuggcagaggcaggaguaaggaagccauuucuggaguccuugcuacuaauuuggaaaacugagcuucuuucuuucauugcuuuuucccuuaagagacaaguccuuacuauauugcccugucucucaagggaagacaucaagacuggacuugaacuccugggcucaagccaucccccaaccuuggccucucgaguagaugggauuauaggcaugugccacggugccugacuugaguuucuuauucuagaacacuuggagccugaacucugaccaggccccucacuugagccuuugcuuucugcuccuuguaaacugccauauugggugcacuugcccugccacaguaaugcuauauauuucugagcauuguuuuucucuagauaauuuuauauuuuugaguauaccccacuuccaaguguuuuuuguuuuguuuugcuuuguuuuuguuguuguuguuuugagacagggucucacugugucccccaggcuggagugcaguggcacaaugacgacucacugcagccucaaccuccuggggccaagugauccucccaccucagccucucaaguggcugggaccacagaagugcaccaccaugccuggcuuuuuuuuuuuuuuuuggucgagauggggugucccuguguugcccagacuggucuugaacuccuggacucaagggauccuccugucuugggcucccaaaguguugggauuacaggcgugagugaccaugccuagcucacuuccagguuuaacagacaaaauaaacuuacucuaguuuccaucucuaucauuuuauaauaaccguagcccacauuguaguaguuuuucagcucuuuacuaagucccaccaauucauguuuucacccuuaaaaucuuucucacugauacucucucuggacagaaaaaaggugaaauaagccuacuauaaggaauauaugacaugcuaaauuuuauuuuuaaacgguucuucaagucagauuaaaguaauaauagcaaauuaugugauuauccaugucccagccucucuccaaaaaaauaguaaacaagaugucuucuucuuuucccaaagauacacauacacacauguacaaauuuuuuuaucagauaauaauagcuaauauuuaaugaguacuuaccuuaguuuguccccuuuacaacagcuuuacaucugugugauugauacaguucauauucccauuuuauaacugagaaaacuggugcacagagaggauaagcaacuugccaaaggucacacaguuaauaaguggaaaugcugggguaugaaccagguagucugcccccauagcucugccccccagagcuguacugucucccaugaggguacuucuccauggagcagccugaggcgaucccuuuauucugggcuucucucagaaauggauucccacacaguauucaaagcaaauuuccccagaggaaauccuauuggaagaacuuaaaaacucagaaucuuuuucuuuguccagagaguugaggaagcuuaagcuaaaugauacauguuuuuaaaaaaaaaucagauuauaaauuuaguuuuuggugauucauuaaauucuuuacuauuauaguuauuuucuagcuguucaucuuuuagcuaaauuuguuccaaagaagcaaaaguuugguuucuacuaaguucuggauucuggaugggagauugcacugugugugacaugcaaguuucauggugugggagauugcagagcauuuggguuacugcuuuuacucuuuggaagcuguuaucaucuguaucugcuuuaaauaaaguuaaagauuuggaacaaau

SEQ ID NO: 18108 - RNA, 89363 nt, Homo sapiens
gguaagaugaugaugaggaaagaacugaaaaaggggagagggaauugggcaacaguaaaucacagagaaugugacauuucuugucuuucaacuuuuccucccuguacuuucaauuagggaaaugaucacucucuaagggacaccugaaugacuccacacuucugugauuucugcagucucuaacugcucuggagcuuagagucauauccaaaccccuuagcauaaaauggcacaauuuuaugaccuacucuuugccuaaccauucagucauaucacuuaugucaaauugcccaaaugguccaugcacaugcugcuccaucuaccuccacuauucuguacccucuuuuuugcuggggcaaccccuaauuaucuuuuauuaucuugaucacccucucagagccuaaauugcuuccauuaaguugcauucuaaauuauuuccaguccuucagugaacuuagaaauaauauguuuugcucuuuaacuucuccaccucauuuucuuccuucacaccccuaguguucacuauaauucucaccauacugugcucacccaauaauagaagguagagcuauaagaagaccuacuagacagaaaaaauucuaaucucgucucccauaagaaacuuucauucuguuaaaacugaaagguaaauucuaaggucgaauguggaaauaaguauguagaaagguaaauuuuguguaagggaguacaauaggacucucagugauggcuucuauuuucucuaagauagaagcaaguucaucugcuaggagugugaaguguagacacgggguugggacuuaaagaggauguuaaagguuugaauaauuguggcaaauaggagaggaagcugaagacaagaaggauuugggagugugcugaagauggaguucagcuggaaacugaaugugcaguggucaggacauugaugucacugaugacauuguccugaugucuccugcagcauuuugcuccccaaagguagaaguagagaccaaugguuggacugaugcagguuuaggacuuugcuggguggauacaaucagggauauaagaauaugauguauucauuaaguacugcagcauucaaauucugucucugccccucaccaugugaccuugugcaaauuauuuaaccuucugaagucuuauugucucacauuuaagauaaggauaaucauauauacuuuauuaauuuaacagauauugagugcccuccucuauacuuuucugggaccuggagauaaagcugagaucaaaauuacuaccuuccuggagcuuauaaucuaaugagaagagagauaccagauaaaugaaauauauaguacuuuagauggcaaaaugcuuaggggaaaaagaagcaaagaagaaguauauagugcaugcaggaaauugcaauuuuauuuauguuuguauugauacauauuuguacauauuuauggggugugguaguuugauauaugcauacaauguguaaugaucaaaucaggguguuuaggauaucuaucaccucaaacauuuaucauuuuuguguuuggaacauuucuaaucuccuaguuauuuugaaauauauaacauauuguuaacuauagucacccuacugugcuaucaaacacuugaacuuauuccuucuaucuacguuuguacccauuaaccaaucucuucccucccucccccaacuccaccuucccagccucugguacuuaucucuacuccaugagaucaacuuuuuaagcucccacaugagugagaccaugggauauuugucuuucugugccagacuuauuucacuuagaauaaugaccuccaguuccguaagaugggcagccaggaaaggccuuacuuagcugauguuugaauugugaaguuauguaaucauuaagaugaguauacauacaaugggccagcugagugcacagcaagauucaauaaauucaaacuaacauuacucuuauugccaagagagugccugaaaugacagcucauuggaaacuggcuacuuuccuucccuuuccuuagggguuuaaggaaagcaugagugauuucagucuuuugcuggagcuccucacugacacucauugcagagccugagcccucaacucucaaucuuugcuuagguccuggcuuaggcuccacuuuguaagaggcaccuuccuaguauucacuacucucucucucacaaucauguccuuacagacauugcugauccucuuucauacugacaccggguucuaguccgaguuccaucacuaagucgcuguuugacuuugggcaaguuacuucugugguuaauuauuuuucaucaacaaaaucaaaaggugaaacuagacgaacaacuaagaggcuccaguauuuuuucaaucuaagagucccauaucccccacucccuucucacagcucauucaacaauccuaauggcagcgggugcccgcagucucaagucucugccgaagcccaagccgcugucucggucagucacaaccgacgaagaggaggaauuggaggaagccagcauaaccacuucacacugagaacaucugaccuuucccagaacgcccgcccacucgacacuuccugucccuccccagaucuuguuccggggcaccuacucgcgucuaaucacuccccucauucacucuuuaggguccauuggcuguuucuuugaggaagcggagcaucuucugucguugauugguuuccgucauuguugauagguugguaacaaacaaggugugccuggucucccugguaacguccugccgauaguccugauuggucggugucuuaaucccaucuuccgucccaacugcuaguggcugagucccuggcggggcgcggcgguggaaggugucgcguacgggcuucccgagcugacguggcuugaauugggaggggggcagcuggagccucaggcggcagcgcuucuaggugaguaggggacgcuacccaacucuucccucugcgaguccaauaacggucacccccgccagaggggccgcgggagcugcccaagcagcuacaccggaguccccuccucgccccgccucucccggauucaguccuggauccggcccuucacccgccuccuucaccuaccaggccuaguucuaguagcccacaagccucggccucuccggugggccuucggggucacccugcgcagacuuggaccacuugcucacggucuguccccuccccgguacguuucuccucugggagcgacggggaaaagcgccuaggucaguccuguccgcacggccuuguuccuggagcggccugccuaagucggccuccguacgcagccgcugacgucggaaagaaccugcugggccccugugcucaggcccuaaacaaacuuggugucccgaaggggaggcgcgaccaaaagaaaucaaaggucuuuagggcggagaucacagaaucauuggagauauuaaugcaaacggaggccuguccaauaauccugcuaaugcuaauggguuacuggaaagaugagaagagaggaaagaucccaacgaucccgucaacacgaaaaucccaggaaucagaggugggcaggcuguuagagaaaaaggaaccucuaagagaguucucgaggaaaaauaacuugguuugaugguguggaguauguuuaaucugcacaaccggaaugugaaagggagggugaguccuuugaggaaugaggaauauauuugucugacuuauuuaaagagcuccaguuggucuauggggagcggacaguuugagagugggacagggauauuuacaaucauggguaaguacuuucacuuuuggagauaguuggaagcugucugagcauuuaaaggaccuuuuuacaguucugugcaagaugcaagcaaguggagggcucuuuacauaagggccagaggccuuuccaaaagcgugaauugauaagauuuagauggucagaaugguuaugaaggggcaaacucaggaaauauccuauuggaaaaauggcaggauuugguuuuggaauagaugcaggaaaaaguugaagaguacucaaaaguugcaggcauuguacauuaacugcuucauagcuuuuacuucucaucccuugaccacagaaugaccauuuaauguuuuucuuuucacugcaucaauauuuuuuacuaccucagcagcuuccaaaccuuuuaauugcacucccuaucaguaaaacauuuuugagcaugcaucuccccaaauguuguguguuuaauuauuuauaguguaugacuaccacuguaaauauguuguguauaauaugaaauaugcaaaaguauaaacguaaaagaaugaaguuuuuaaaaagccuuguccacaccuugggaccucccaacccaauuugacaaucacguaaagauacuuccuuguuuuucaagaaggucguuggcauuucuggcauccagacucugggaugcagccuuucuuaaacaugaucuuuagaagauuuuuuucaaccuucugcuugaguuuuauaggcccccuuucuuuuucucccuuugauuaauggauuaauuaaagggauguugacuuuauccuuguuuauaaaauaaaucauucauuaauuucucuagguuaauuacuauuaggaauaccacugaucauuacauaccagucugugguuagaaaccauuauguaaaaggagacuaagcucuauauugcuguauuuuuaauuaagcuauuuuaaaaucagcuauaugcuuuugauaaaaggaaauuuaauacagaaggauacaauguaaaaaaagucuuuuucuuuucuaucuacugaucuacccaucuccauuccccacuucccagaaguaagcacuguaaauaauuucuugguuauauuuaagaaacuuucugaucauaauaaagcacaugauaauauauacccccuucugucuuucccacaaguggaauccuaauacacaugcuuuugccauuuaguacuguauauuaggcacuuucaauauccauggguauaaaacuaccucauccuuuccauggcuacacagcaguccuuuguaaaaauauaaaaauaguauuuagccuguccccauugauggacauuuagauuuucagucauuagccaucaaaacacugcuguaguguuuuguuauauaacauccauguguauauauguauauauauacauauauauacguauauauguauauauauacguauauagacauauacguauauauacguauauacacauauauauacauauauacguauauacacauauauacauauauacauauauacacauauauauacauauauacauauauacauauauauauacacacauggauuuuuguuuuguuauguaacauccauacauaacauguuuuguuauguaacauccauauauauauauauauauauauauauauauauauauauauauaacauccauguauauauaucuuagggcccuugugugaaccugucugugguauaaacaauauggaauuauuuggggccauacuaauaugaaucauuuuaguuuacuuacugcuuuaaaaaaaaguacuuaccuaacuauuaacauagugccuuuaucccuucauucuguuuucaacccgaguaaagaauauuggauaaugagauuauucagaaaauaaaauauuuucuguguaucuucacccaccaagaagcuuugucgaacuaugugacuggggaaauuacuuaacaucccucugccuuaguuuacucaccuuaaaacugggaauauugacgguacucccucuugcgguuguuuuaagaauaaagugaguuaggccgggcgcaguggcucaugccuguaaucccagcacuuugggaggccaaggcgaguggaucacuuggagucaggaguuugagaccagccuggccaacauggugaaaccccugucucuacuaaaaauaccaaaaauuagccagucguggcagcggguaccaguaaucccagcuacuggggaggcucaggcaggagaaucgcuugaacccaggaggcagagauuguagugagaucgcgccacugcacuccauccugggcgacaauagugaaacuccgucucaaaauaaauaacauuaaauaaauaaauaaauaaauaaauaaauaaagugaguuaaauaacgaaaaguaaguuauguguaaagauauuggagcaguguuuggcaggucacgcuguguauguauguuauagcuaccacuuacaaauucauuuaauuaaaauaguggcuucugcaucaugaaaaauaguuguucauuuucuaauuguaaaauuaugucauaauaucgaauguguuauuuccagcuauacagcacuacccauuagccccucaacuugguugaaaaucacuuugagauuuaaggaauuaaggacagcuacugaggcuuaacuaaauaagcaugaaauaaguuugaggagucaccucaacugaaaccuaaccaccuucucuguguuucugugggaaaaugugauuuaaauuccaaaguagauggcauauaugcauauauacacaggcaugcacucacugucuucaguuauuuugcuuauuuuccugugcauauuguucuguuuucgguggcuagggacaugcuuuauaauucuuuuuauauuuuuauaguuccuagcauaaugcugaacaccaggugguuguuauaagaauaaucauugauaacagugaagacuuggagaaaauaaaacuuacuuaauucugagugccacuucaacacauaaguguuaagguccuguggcaggguuugugaaagcugugaccagcauagacugaggaauuguuuuauuugccuuaguguuuuauggaaucccuggccuuggcaugaagcucuguguuuuauucuuuuccuuaguugcuauucauuauuuuggugccuuauaaaauaacagcaagaacauuguccaacagucauacauauuccuuacaugaauuuaugacuaugaauaugacuauuccccuuuauuaaucuuuacauauauguauacauauacauacacguauacauauguauauauauacauacacguauacauauguauauauacauacacguguacauauguauauauacauacacguguacauauguauauauacauacacguguacauauguauauauacauacacguguacauauguauauauacauacacguguacauauguauauauacauacacguguacauauguauauauacauacacguguacauauguauauauacauacacguguacauauguauauauacauacacguauacauauguauauauacauauacauacauagauuuaugacuaugacuaugaauauuuuccccuuuauuaauuuuuaucuauacauuugcccauuucuguccucagugagccuaauagaggggaguacccaucuuucuucauuuagcuuaagcauggcuacuuacuggcuuucuugcccuguaguucccaaccuuugagcuaccaaaagccuacaacugugggugagaugcccuuccauuuacauuuccagauuauuccuuuaaugucaacagcuguagaguagggggcauuagaaugguccuuguuagucuucauuuuaagaugaggaaacugacgcuuuaaggugacuuacucacuaugaugcagcuucuuauugagccaggacggaaaacucaguuccuuggcuuccaguuuggugcucuucccacuaugucaccugcuuuccuguggaucucugagacuguugaaucaaucuaugagagacuccuuuuguccugccugaacaguacaucucuagcacucucucagauuuuuaucucauuuaaauauuagucuuuccuuucuuaaaauguacauauuuuuaaaugguuaugugagaaaaguaaucuauuuuuccuuuaaauagcuuuuuguuuuauucuaucaaucuuuuuaauuuuuuuuuuuuuuuuuuugagacaaggucuuguucuguugcccaggcuggagugcaguggugugaucauagcugacugcacucucaaacuccugggcucaagugauccuccugccucagccucccgaauaucugggacugcaggcauaugccaguaugcccagcuaauuaaauuuuuuuuuuuuuuuuuuuuuuuguagagacagucucacuauguugcucaggcuggucuugaacucuugagcucaagccauccucucaccucagccuucuaaggugcugggauuacaggcgugagccacccugccugacugcuauuguauuauauauuuaacugagggaccuugaaaugucuuaauuucugagugucaguuucccucuauaaaauggggaugaugauaauacuuaucuuacagauuuuguuaagauuaaagaguauauaaagugguacagucacuuugcauuuaaauuaaauguuucucaauuguugccauuaauauuaucauuauuauccuguguucauguguauguguuccucauuugcuaugauauucaaugauauucaguaggaugcugaugggcacgcuccuuucuagggagggucaaucagaaacucaugugguagugguauggguuuccauaauggauuucauaauaauuaaugauauuugaauuacuagaauaaauccacuuggugauaauauuuuucaguaucuagucagauuuaguuugcuaauauuuuauuuaauauucuaauuaaaauuuauuagaauguugucaucaguauucauagggagaugguuuguaauuuuucauuuucuuuuucuauguuuuggagcaauauaaacagcaacuucuguagcacuuagauuaucucauuuuugacaauuugguaaaguuuucuaauagcaacuauuucugguguuuuagcauuggugacuuauuuuauaauuuuuccauggaaauauguguauuuauaauuuguauuccuagagguauuaauuuugauuaacuguauuuuuuuuauuauacuuuaaguucuaggguacaugugcacaacgugcagguuuguuacauagguauauaugugccauguugguuuccugcacccaucaacucgucauuuacauuagguauuucuccuaaugcuaucccuuccccagcccccaaccuccaacaggucccaguguguuauguucccugcccuguguccaaguguucucauuguucaauucccaccuaugagugagaacaugcgguguuugauuucuguccuugugauaguuuggcgagaaugaugguuuccagcuucauccaugucccugccaaggacauuaacucauccuuuuuuauggcugcauaguauuccaugguguauaugugccacauuuucuuaauccagucugucauugauggacauuuggauugguuccaagucuuugcuauugugaauagugcugcaguaaacauacauguguauaugucuuuauaguagcaugauuuauaauccuuuggguauauacccaguaaugggaucacugggucaaaugguauuucuaguucugauccuugaggaauugccacacugucuuccacaaugguugaacuaauuuacacuaccaccaauaguguaaaagcauuccuauuuuuccacaaccucuccagcaccuguuguuuccugacuuuuuaaugauugccauucuaacuggugugagaugguaucucauuguaguuuggauuugcauuucucugaugaccagugauggugagcauuuuuccaugugucuguuggcuucauaaaugucuucuuuugagaagugucuguucauauccuuugcccacuuuuugaugguguuauuuuuuuucuuguaaauuuguuuaaguucuuuguagguucuggauguuagcccuuugucagauggguaguuugcaaaaauuuuaucccauucuguagguugccuguucacucugaugguaguuucuuuugcugugcagaagcucuuuaguuuaauuagaucccauuugucuauuuuggcuuuuuuugccauugcuuuugguguuuuagucaugaagucuuugcccaugccuauguccugaaugguauugccuagguuuucuucuaggguuuuuuaugguuuuaggucuaacauuuaagucuuuaauccaucuugaauuaauuuuuguauaaggugcaaggaagggauccaguuucaccuuucuacguauggcuagccaguuuucccagcaccauuuauuaaauagggaauccuuuccccauuucuuguuuuugucagguuugucaaagauuagaugguuguagaugugugguguuauuucugagggcucuguucuguuccauuggucuauguauguguuuugguaccaguaccaugcuguuuugcuuacugucgccuuguaguauaguuugaagucagguagcgugaugccuccagcuuuguucuuuuugcuuaagauugucuuggcuaugcaggcucuuuuuugguuccauaugaacuuuaaaguaguuuuuuccaauuuugugaagaaagucauugguagcuugauggggauggcauugaaucuauaaauuaccuuggacaguauggcccagugugcuguaauucuuauucauacauauucaaauuauccuuuuagccaaugggaaccuguguccuuugaaagcuuccuaucuuguaugacaagauguuucaggaucauuuuguacauuuccacuuuagaaauggaauuagccauuucucuaagaaaaccuucuuuuaaaaacuuuuuuaaaaaugggaaagaguauuucaagaccccaaucuaggcacuagagauauucauugcuucucaguuugucauuacuuuuaagccuuuuugguggacagagcuaggaaaauaugugaacaaauauaaaauacugaauugucauuucacacugaguguuccuauucagauucaaagauuaguuuguauuucgggguucuuaauuucuucuguauuacaucuguaucuucuuuucauaacugaaaauacagaauuaguguauccauaauuaucauuugcuuuaauucuacauuucacauauaguaaucuaggagugaugauacgaauaucaccaccacaaccacuuuagacgagaucggguguguucaggaugguauggccguagacaacaaccacuuuuaauuauugaaaacuguuuaaaaauauuuuuuauuuuuugcauaugcuauucacauucuucccgauuuuuuuucaugguuguccuauauauugucagagcauauaaucauuacauacuaugcugucucuccuccagucuuuacuuagucuuaauucuguuaguaaccguauauuuaaugcucaccacuaguucuuauaaugauguuucuuuagucauuuggauugccucaaguuuugccucuaguaaauucuuuaggaaaggcuuaagggaauauucauauuucaugaauuuucuugcucguucauaacauuuugucuguguuuuuuauaucuaaaguuuguguuugccagaaauagaauccuuggcucacuuuuucuuuucuugaauaucuuaaauuuguaacucauuuuuuuuuucuggcaaaaacauugcuguugaaaaaucuagugcuuuuuuuucuuuaucuuacuggucauaugaucuuuuagccuaaagccuaaaggauuuuuuuaaguccaguaauuuuacuagaguguuuuguuggucauucugaguugacauucugagguacauugugggcucuuucaagauguaguuucaaaucuuuuuaaaaaaaauuuucaaauaaauauucuuggauuaugguuuuucauauuugugcuguuucuuugcuuugcuuuucuucuucagggaauccuguuauucacauuacuuaucuucaauauuuaucuguuucucgcaaauccuauguaacucuuaauuucuuacauuuuuuaaaaauaaacaaauuauuaggaauuauuucagaucacuacagaaaguuuacuacagaaaauuugcaaagauagugcagaagucugguguauccuuugcuuaguauucccuaagauuaacaugugacauuagcaguguacaaaauuaagaaaccaacauugguacauuaauauuaacugaacuccagacguuguucacauuucaccaguuucuccauuaauguccauuuucuguuccaggauucaauucaggauaucauguugcauuuaguucauuucuuuuucauuuguuuuuuaaauaugaagacaauuguagagucacaugcaguuguaggaaauaaucagagcucuuuuauacacuuuguuguuucuuccagugguaacauuuugcaaaacuaauacauaauaucacaauuaggauauugagauagauauauuccccaguuuuacuuguauauucauuuguauauguauguauguguaucauuaaguuuugcaguguuauaucaccuguguagguuccuguauccacugccacagucaagauauugaacagcugcaacaccacaaggaucccuuguguugccuuguuaugaccacagucacuucccaccccaaccccucucuaaccacugguaaucacucaucuuuccuccauuucuaaaauuuugucauuucaaaaauguuauagaaguauggaauuguauaauauguaaccuuuugggacuggcuuuuuuucauucaauguaauuuucuggagauccaucuaaguuguuggguccaucaguaguucguugcuuuuuauuucugagaaguaugugaugggauguauguaccaguuuguuuaaccauuugccuguauauaucaguuugcuuaaccgucuauuaauagaaauaaagcugcuaugaauguuuauauacagcagguucucuugugaacuuaaguuuucuuuucucuaagauaaaugcuggggaguggaauugagggucauaagguaguugcauaucuaguuuuuuaggucauuucuuuuugauuuuuaaaauuauccuucauuucaacuuugcuuuuuuuuaaugacaugguuuguuauauuuacucauuuucuuguuccuucuaguuucaucuucauuuccaaaaugauuuuuuaaauuuuucagucacuucuuguuuucacuuuauuucuggguuuuucuauuucugauguuuauuuuuucacaucuuaugucauuuuuaaugccuuuuaguuccuucaguagauuuaagugguuauaguuuugaacuguuuuuuugagcauggcucucugacgugcuuccauuuucugucgggauguuaucaugaucguuuuccuccuuuuuuuucuucuaguaauguaucugaauugugagacuuuucaguugcucuuuuuuucuuuuuugugacagggucuuacucuaucacccaggcuggaguguaggggugugauuauggcucacugcagccuccaccucuugggcucaagcagucuucccacgucagccaccugaauagcuggaccuacaugcaugugccaccaugccuggcugacuuuuuaaaaaaauuuuguagagaugggaucuugcuauguugcucaggcuagucuugaacuccuaggcucaagugauccucccaccucagccucccaaagugcuaggauuacaggaugagcuagcacgccuggccucaguaguucauuuuuaauaugaauuuaguguugcugaacuuuuagaaagagauuuuauacagcuuuucuaacuugauaagguuuccucuugugcuauuuucagacauuguucaacuauauggcagcuggauuucucggauuuccugccuuucuuuccuugccacuuucaccugcucuuuaucuggaccuccucuuuccuuagucacuuaauuuuaauucuccucucagcagauucuccucagugugggacccuauccuggaagagagccccaacucuucaguucugagaauuaauaaagguccagacugccucagcucuuucagcccucguaggccccuggcagguaccuguuauuggaaugggaagaccccuccuuguaucaacuacuguucuguaauuggcuuggcgcauuugccagugaaugcccacuggcucuuuugagguccucuugguguuguacuccucuggcuucccucaauuuccucccaguugaacaccagugacacccagaucuuuugacuauuggcgguuugucuauauccacguuuauuuugggguuuguaggaaacuuuguuaaguaguuuuuugguaaaggcuguccauggaucuuuuguuaccuaguugcuuugucuguuuuuaugugggaauaaaggaagauacaaaauccauggggccccuugcuacucccaucuucucagaaucccaucaguugguuauuuuguuuucuuuguuccaaaguggucugaaaaaucugaagauaaagugauucuguuugauaaguuagguuccauuaugauuuucuuugauuagcagaaaucuauauguuuaagaaacucuuuagugaugguauucauuuccuucauuaaaaguuaaccaaagaaaauaugaucucuaaaguugaaaagaaaguuuagaaucuguauacugcugaauugugauuuuuuaauccugacuauagcugugguucucauaucuugaauaaauaguuauauauggcccuauguacucauguaugacacuguguugcccuuccaguauuuagauaugaaguuauauaugauccugcgcugccuuccuagggaacaguucacuuuuucuauuucugucucacguaucuuuuccaagugaugugcuacuuagauuacccaagacaaucuauuaaaaaaacagguaucucucaucacuucuuucuuaagaaccauggcugcccuaaacacuauuauuauccccaguagaagaaaacuguagcagagccuaguuucauuuaaguguuuauuuuguacaauaguuuuuauauuucuucuugcugagguuuuuuuuuuuuuuugagacgcggucuugcucuguugcccaggcuggagugcaguggugcgaaucuuggcucacugcaaccuccaccucucagguucaagugauucgucugccucagccuccugaguagcugggauuacaggcacgugccaccacacccggcuaauuuuuguauuuuuaguagagacgggauuucaccauguuggucagacuggucucaaacuccugaccucgugauccacccgccucagccucccaaagugcugggauuacaggcaugagccaccacgcccggccccugcugaggguuuuaaaagccaaauaacauuuuaucacaaaauguaaaauuaggcauaaucacguaaacuaaugcuaugcauaguccaguucuauuuugauuuuuccuaucaaagcauuaauaugcuucucauuuucauggacuuuauggacuagcaguugacacugaucugaauauguagccuacacagugguuauaaaaguaaauugauuuuggaauaaccuuagauuuacauacaacuugggaagauuagacagacaguuauuguauacacaaagcauccucuaauguuagcauuuuacacaaccaugguagcuuuuucaaaacagagaacauaggugcaaugccauaaacuaaacuauagguagacuucauucagauuucaccauuuuuuccaguaauguccuuauuguguuucagaaccuaauccaggauacugccuugcguuuauuuauuuauuuauuuagaggcagggucucacucuggcacccaggcuggagugcaguggugcgaucucagcucacugcaaccucugucucccagguucaagugauucucccaucucagacuacccaauagcugggacuacaggugcaugccaccacacccggcuaauuuuuguauuuuuuaguagagacggaguuucaccauguuggccaggcuggucucgaacuacugaccucaagugaucugccugccucggccucccaaagugccaggauuacaggcgugagacacugugcccggccuacuuugcauuuaaucagcaugucuccuugucuucucuaaucugugacuguuucuuaguuuuuuguuguuuuucauuacuuugacaguuuugaagaguauuggucagguauuuuuagaaugucccugaaucuagguuuucccaguguuuucucaugauuagacugggcuuacggguuuugcagaagaauaccccagagguaaaguacccuucucaucacauuauaucagggguuacaugauauuacgaugacuuaucacuggugauguuaaucuugaucacuugguugagguggugguugccaagucucaccacucugauguugcuguuuuucuuuuuucauauucuauucuuuggaagugagucacuagguccagccuauacugaaggagagggaauuaagcuccauuuuuagagggggacguaucuacauaaauuauuuggaauucuuuuguaaggaagauuugucucuaccauuaauuuauuuaaugauuuauuuauaucaguauugacugauggguauuuaauuuuuuauuuggguuauaauccauauaauccaauauuauuguuauuuauucugugacucaaauuauucuagccuugaucauugggagcuccuucagauuggcuccuggucacauaccccauuuuuuuucuuuuucuuuuuugaacacuuccuuacuuucuggcucucugccccaacccuagauaggcagccauuucuccaaggagcccuaguuccuuuuauuggagauuggcaauuuagaaaucgagaucuggaugcgcucauugcuacugagguguuacuguuucuaggacuuuucaguggacacggcuagaauauauauuucucuguaauaacugauuauuuauaaugcauacauaucuauacuuauuucugcauuuaucuauuuacauauauauuaaaauaaacaugaguucauacugauaucucugacucuaauccaguaccaugggguuuauccuagcuuucuugccuuauuuguaacuucuuucacugacaguaaaaaaccugaaucucauuaucuacaauuuacuuacucauuuaacccuaguguacaaugaaguaguuucagaauugcuaacccauaccacugugagaaagaaauuuaccaagcagaguacaguguuuaugucaguucuuuuugucuuuauccuuauaguacccagucaaaacaccauuuuuguuucuuagguuagccccaucuccuucagugagguuauaucauauauuuauaauauaguuagaucuauuugucacagucugcauuccauuuuuggaacuccugacauccuggcugagguuuuaaaaaaauuguauacaauuauguuugcucuuuggaauguacaguucagugaguuuugacaaaugcauaugguuaugaauuuacuacuucaagaucauacagaacaguuccuucaccuuaaaaauucccuuguguugcucuuuuauauucagccacaucuccuucccucaagcccugacaacuauauuuguguggguuaauuucuggacuuguucaaaauguuauauaaauagaauaauaugauguauaucuuuuaauguuuagcuuauuccauguagcaaaaggcauuuuagguuuaaguauuguguugugugaaucaauuguucauucuuuugcugaguaguauuccauuguuuggaugugcuacaguuuguuauucauucacuuguugagggauaucuuggcuauuuucagaaucugugauuaugaguaaaccuacuauaaacuugguuagaugccuaggagugggauugguaaauguacguuuaacuuuuaaagaaacugucaaacaguuuuccgaaguagcugugccauuuuguauucuaaucugcaggcauugaaaguuccuguugcucuauaucccugccagcauuaaaaaauacauauuuuagcaauucuaauagguagauagugguauuucauuuugcuuuuaaugaguauuuuccuaaugccagauuaacuuaagcaucuuuucauauauuuauuuaccauccaucuaucuucuuuggugaaguaucuauucacaucucuugcacauuucuuuaucagguguguuacuuuauugauguugaguuuuaagauauuuuuauuguuuuagauucuggauacaaguuauuuacuggauaugcuauuuguaaauauuuucuccuaaucuaugacuuguuuuuuuuuuuuuuuuuuucccgagacagagucuugcucuguugccuagacuggagugcaguggcaugaucucagcucacugcaauccaugccuuccagguucaaccgauucuugugccucagccuccugaguagcugggacuacaggcaugcgccaucaugcccagcuuauuuuuguauuuuuaguagaggugggguuuugccauguuggccaggcugguguugaacuccuggccucaacugaucugcuugccucagccucccaaagugcugggauuacaggugugagccaccacgccuggcuucagugacuugucuuuucauuuucuuaaccuugucuucacagagcaaaaguuguauguuuugauaaauuuuuaaucaauauuuuuuauaauauauugugcuuuuuuggugucuaaaagcucauugccaaauucagcgucacaaaaauguucuccuauguuuauuucuaaaaccuuuacaauuuaaguuuaggucucugauccauuuugagauaugcuuuguauaaggugugaguuguaugucaagguucacucuuuuucagauguccaauuguuccacaaccauuuauugaaaagauuguccuuucucaacuuaauugcauuuguaccuuuguuaaaaaucaguugacucgauuuguaugugucuauuucuaggcucuccauuuuguuccauuuaucugugugucuaugcuuucaccagugcugcccugucuuguaauuguagugaguaauuuccacacuccuugccuuuucauauguuuuagagucagcuuuuugauguuuacuaaaagcuugcugggauuaaguuuggaauugcacuaauuuuauaggucaaaauggggagaauugauacuuuaacauuauagaguucaaauacauguauauguuuuauuucuacauuuauuuagauuuuuuaugucuuccucggguuuucaauaguuuucagcauucagcaaauucugcauauauuuuguuagcuguuuacccaaguccugcucuguuuauucagugcuguuguaaaugguauucuuauugguuucaaauuccucuuguucauuguaaugggaaugcaguugacuuuuuuuuuuuuuuuuuuuuuuugagacggagcaaucuaggcucacugcaagcuccaccuccuggguucacgccauucuccugccucagccuccagaguagcugggacuacaggcacccacaaccacacccggcuaauuuuuuguauuuuuaguagaguuggaguuucacaguguuagccaagauggugucgaucuccugaccucgugauccgcccgcccuggccucccaaagugcugggauuacaggcgugagcuaccgcaccuggccugcaguugacuuuuauauagugacuuuguauccugcaaccuugcugaauucacuuauucuaggaguuguuuuuuaaggaaagucuacauggacaaucauuuugcuaguugagacaguuuuauuucuuccuuuccaauuuguauuucuuuucuuuuucuugcuuguugcauuggcugggacuuccaguauaguguuagauagaaguaguaagagacaucuuugccuuguuucucauauggugagaacauucaguuucucaccauuaauuaugauguuggcuguaaguuuuuuaaagaugcccuuuauuagguugaggaaauucacuucuuaguuugcugagaaugaauuauucuuauugugaauucauaaucaugaauagauauugaaaugugucaaaugcuuuuucucaaucuauugacauuaugugguuuuccuuauuuagucuguuaauauggugaauuacauugauuuucauauuuugaauuagcauuacauuucuugaaccccacuugguugugauguauuaucuuuuuauauauuacuggauuuaauuagcuaauauuuuauggacuauuugaauauuuuguugacugugaccaugaggaacauuggucuuuaguuuucuuguaauaucuuugucugcuuuuaguauuagggcaaugcuagucugguaaaauaaguuagaagguguuccuuccuuuucuaucuucuggcauagauuauauaaaauugguauuauuccuuaaauguuucuuguuaccuacuaaugaagccaccuugaucuggaguuuucuuuuuuuagaagguuuuuaauguaugaauucaauuucauauuuauauguguguauauauaugugugugugugucuguacacacacaugcacccacacauaucuacucauuuauauucagguucucuauuucuucuugagcuuuugguagcuugaaucuuucagugaacugacccauuuuaucuacauggaugaacuuaaaaguauagggcuauuuguaguguuuauuaucuuuuaauguauguuagaucauuaaugauguuuccucuuucauuuaugaugccaguaauuugugucuucucuguuuuuuucuuggucaucuugacuagaguuuuaucaauuuuauugaucuuuucagauaaucaacuuuugguuuuauugauauucucuauuuuucuauuuuuauuaauuucuacucugauuuuuauuuuuauuuuucugcuuacacuggcuguaauuuguucuucuuuuucuaauuuucuauagaagaaucauagguuacugauuucuguccuuccuccuuuucuaauauaugcauuuaaugcuguacauuuugaacaaaguuuauauuuaaauuuuagcaaagccacaugguuuaucaagaaagcuuucugaaagaaugggguucauggggcacauaaaaagaaaaauguugcaguaucauggaguuuauuugaacaagugggagagaauaacagucugacagaggaagaaagaauaagacauucauguuugggcaugugccuguagucucagcuacucgaaaggcugagguggcaggaucgcuugagcccagaaagcagagguugcagugggcugagauugcgucccuguacuccagccugcgugacagagcaagacccugucucaaaaaaaaaaaaagaaaaagaaaaaagaaauucauguuuguaagugaaacuacuaugaaagaagggcauuaaagauaaaaacuaccuuuaagguguauuuaacaauuauagauugguauuuaacauuguauuaauguuuaacgauuagguacuuacauuuuauuuuagaaaugguguuagugauggugauaaccucuguacaauugccacugaaaagaacagcgugugacuacacuggaaguacucaaaugccuuuuugaagacaucauugugcugcagacugugucuaauacaaaucaccuguacaguauucuuuuuucauucacggaugauaugguuaucaauauaggagaagccuauguucauuuugcugauucuuagguuuuuuccccccuucuuuuccuacagaaaugcugagccgauuaucaggauuagcaaauguuguuuugcaugaauuaucaggagaugaugacacugaucagaauaugagggcuccccuagacccugugaguaguucuguucugauuuaaacugguaagacauauguucuguguucuucuaaggaaaauaauuuaagauagaagggugugcgaagccucccugguacuaggugaagcgaggauuaagaaaaauauugaaauuuuauaagugauccuucucuuguaaguuuuuagcuuaaaagccacagugaugggaaacaaguccuggauacaauuugaaagggcuuucucauuugucucccugggccuuguuuggugccagaguguuuuaaguccuuuguucucauccuuggcuauuccuuuuccacaggaaaggucuaagugacaaaugaggaaacuggaacaccuuuuggguuucagaauaucuguuugcuuuguaauuucauuuaccacuucuccuauaguuuguauuguauuuucuuuuuuuuuuaagaugauacaaauuggcaguauguauuauauuuucugaaguccacauaaggaauuaauaaaacuucuuaguuuucugaaaagacaagaaguaaugcguagugguuaagagaguuuuacuuaacuacucuuaauuuuaacuuuuggccuuuuacccuuacugguuuaugauuuuugcuuuccuuuauuuuucucuuugguaaaauuaggauaauaauaccuuaaaugggauaauguuuguaaaaugcuuaacauuuauaaaauacuuaauauauuguaauggcuaugauaaugauuauuauuggaucagaguuagauucuuaaguuaacaagaauaugaauugggcaaaacauaaaaaguuggaaugaagaaacuccuguugggaagcuaauaccuuuuccuggugcacuggcaacuuuuuuccuaaauauuaggaauuacaccaagaaucugacauggaauuuaauaauacuacacaagaagauguucaggagcgccuggcuuaugcagagcaauuggugguggagcuaaaagauauuauuagacagaaggauguucaacugcagcagaaagaugaagcucuacagguacuauuguuuuuauccuuucuuguggagcauuugauaaaggacagaugauacacuacucacuuuaauuuuugucuccacuuagauuauuagggaaucugauuaucucccuaguacuguaaccuuaugccuacugaaaauaacuuuugggucggugugguagcucacaccuguaaucccagcauuuugggaggcugagaugggaggauuucuugaggccaggaguucgagaucagccugggcaacauagugagacccugucuccacaaaaaaaaauuuaaaaaaaauuagcugggcaugguauugggcaccuguagucccagcuacucuggaggcugagauaggaucgcuugagccugggaguuagaggcugcagugaguugugauugugccacugcacuccagcccugguaacagagagauacccugucucugaaaguaauaauaauaaaaauaacuuuuaguaugugcuagauaagaggggaauaaacauuuauguauuuaccaucauuguuuuugggcaggaagagagaaaagcugcugauaacaaaauuaaaaaacuaaaacuucaugcgaaggccaaauuaacuucuuugaauaaauacauagaagaaaugaaagcacaaggagggacuguucugccuacagaaccucagucagaggagcaacuuuccaagguauggugacuggguguaguguauauuuccuaaguugaaaaaaccuaccaauacagcagaucuucaccaaucacaaacauuuaggaugcuaaaaugauacagcacuaaauaauguuuuguuuuuuuuuuucuuauagagcuuguaguucagcuggacuguaggccacacacagggagaaugaaagauguacagaaaacauggauaugaaaugccaguugugaccuggacuuucagggauuaaaaaaggcuuacaggaagaaauaaguacugaagugaggcauuuagagaggagggaaacauaccuuuuggaggaguuucaucauugauuagaagauuaaacuagauuaucucuaagguuucuuccagcucugaaacuuuuuaauucaaugacuuaacacagaauauucuguguccucauauauagucacauagugguggauuaaagcuucaugcaugugggcugaaucagcugaauuaccugggacucucuaaaagggaggcucacuagguuuaugacugcagccaacaaagcaguuuaagguuggagauacagaggaggaauaaggaaaguacugcccugugaggaauauugucccaguacucaaauuuucauuaucuuuccuguaugguuaaacuccacauauucacauucagucagcuauuuagagaacaagaaacuucaguuuuguggagaguuugauacagauuauauggaggcaggcauaucacaugcauacuguaguuauagagugagccuagacuucaccguguguaagaaaucuuuuuauuuuuuuaguuucauuuuguuuugcuuugaccugcuaguauccuuaguucuugggaaaugagauuuuaaucaguuuucuaggcacaaccuuugggaucgcuaguuagugacccaguuccugcuuagucuuuccucucagggccuaaugaucagagaacauuacuuucccugaauugauaaucuuauuuaacuucuugaagccuauuuuaaaagcuuuucucaaucuucucaaauaauuucaccuugauccuucuuuuccuuuugguuuuuccucugucaguucucuuccccucacugugguagcaccaaccucucuccucauauugcuuuguucccuccagcuucuccucagcuaugaugucagauuuuuaaauuauccauuuuauacucugcuuuuuaauuucauuuuuagcucugagaccuuaaagcaguaaugucuuagaguucauuuucuuucucuguuaaagaaaugauuucuaaguuucagcaaucagucauagcaacccuuuaacuauuauauacucaauacagagcuagguauucuguggaaaguauaguugaagaaaugacaacaguccucaggugcuugacugacuuaugugaaaguauaaaaguauucuuuguaauuccaguaagcagaaauagcuuuguuuaggggguugggagggacuaaauuuacaaagaggcagaaucucagucuaagggagagcuuuuggaaaaaaaaauagauuauugaaaaaauuggauuuccccucacuggcucuuuucugauguguugcuucucacuuagcaacagcuauaguuuccugagcucucuccuugauucuucaaggcaacaagacuucggguuuucuauuaagguuuaguccugcauggcacugacugguuuugcccucagaauaaaagcugucaaaaugggaaacucgguaccauuucuuccaauuaucacauccccuccaguaucuuccugcuuuugguugcucuccaguauuuucagauagcuguuuucuauauuguccacaguuuuggguucacaugcuuggugugagggaaaaaaaaaaaaaaaaaaaaaaaaaaaauauauauauauauauauauauauauauguguguguguguauguauuucacaguuuauagcuauuaugugagggaggguaggucuaacaggaacugcuuggccauacaaaaacuggacaacccuaagauuucuuauuuguuagaucagcugguuuuucuugcucccaucaguuuaauaaaauuauaacuaaaugguuguaaaugaaaaauuagaagaaaauaucaaauauauauuaauuguaauucuuuuaaauaaugacuuuaucuccugcauuuucagcaugacaagaguucuacagaggaagagauggaaauagaaaagauaaaacauaagcuccaggagaaggaggaacuaaucagcacuuugcaagcccagcuuacucaggcacaggcagaacaaccugcacagguagggguggaaguuacuucauaaucauuagguuaaugaaucacuaaaaccaauggauuauuaugugacaaauacauuuuucuagaugcacaaugggcauuuaucuauguauauaucagucuccuucuuuucuucauuucuucuugucugguaauuuuauuagaauaugcauugguguuugucauuuuuaguuguuauucauagauacccaguauacucuuucaauauaugguuucacauauuuuaaguuuguuuuuuuguuuguuguuuuauuucacuuuaggccuucuauuuuuuguuuguuuuuguguuuuuucuguuuuuuuaucuucuauacugcaaugauuuuuucuuuucuauuggauuuuucaugaguucagucaccucauuucugauuuuucuaaaucugauuuauguuuuucucucaucucuguauaauuuuuuuuucuuuucuuuucuuuuuuuuuuuuuuuuuuuuugagacagggugucacucuguuggccaggcuggaguggagcaguacagucucagcucucuguaaccucugcuugccagguucaagcaauucuccugccucagccuccugaguagcugggauuacaggcaugcaccaccaugccuggcuaauuuuuuguauuuuuaguagaaaugggguuucaccauguuagcuaggcuggucuggaacuccugaccucaagugauccaccugccugggccucccaaagugcugguauuacaggugugagccaccaugccuggccuguauaauuuucuuaauuuuuaaaaacuuuuugaaauagauugcaauuuugauuuuuuuuuuuuuaguguggcucugguaugcuuuuaucaccuauaaucauaucauucugcuccuuaguuuuguuuuuaauuuauaauaacagaaauuuaauuuaauuuaaauaaauuuauuucuuacauuuauggaggcugagaagucuaaaguugagggacugcaucuggugagggucuucuugcugauagggcucucaguggugucgcaaggcagcgcaagucaucacauagugagggggcugagugugcuaauuugccagcucaggucucucuucuucuuauaaagcuaccaguuccccuucuaugacaacccauuaauccauuaaucugugaauguguuaauccauugcugaguucagagaccuccugaaccaguccuuucuuaaaggccucuugucacacuggggauucaguuucaacgugaguuuuggaggggacauucacaucauagccuuccacccuuggcucuccaaaacucauauucuucucacauacaaauacauuaauugcauccccacagccccaaagucuuagcucauuccugcaccaauuucugugagccugugaaauaaaaacacauuaucuuccuccaagauacaaugguaggacaagcauaggguucacauucucauucuaaaagggagaacuaggcaagaagaaagagaguaacagaccccaagcaaguuugaaaaccaagagaguagacauugggccuuaaaauuccagaauaaucuucuuuuacuccauuuucagcauccucugccgguacagggguuggguccccaagaccucaggcaguucugucccuauggcuuugcugggcuuaguccagccagcauucccaggcugacuuugcauugcacacugguagcucuauaguucugguauggcagugguagucccacaccgugauuccacuaggcauuacucuaguggggacucugcagggcaauuccaaccccucauuuccccuuggcauugcucuaguggggcucucuguggugguucugccucaagacaagccucugccugagcccccuggcuauugaugacauccuucgacauguaaguggagacuaccaagccuccacagcucuugcuuucugugagccugcagaauuagcaccauguggauguuaccaaguuuuacaacucguaccuuuugagcugugacaugagccauaccugcggcugcuuugcacuaaccagaacagcugggcugcaaggagcaguauccugaaguggcacagagcagugguaucucagggccuauucacagaaaccauucuguccucuuagggcuuugggccugugaugggggcuguuggggcagccuuaaagauuucuaaaaugcauucugaaaugccuuuagggcuuuuucccauugucuuaacuguuagaaacuggcucccuuuuagccguguuaauuucuuuagcaagugguggcugugccuucuuggauucccauccugaaaucuucuccauucuuuaccacauggccagguugcaaauuuuccaauuuuuuuuuuuuuugcucuguuuucuuuuucucuguucacuguaagcagauagaaguaaccacauagcagcucaagcaguuugcugcuuaaaauuuucuccugccauauacccuaguucaucacucucaagcucagccuucuacaaaguucuuggccauacaaaaacuggacaaguucagccaaguucauugcuaauuuauagcaaggcugggcuuuacucuaguuucugauacuuuguuccucauuucugucugaagccucaccagaaugggcuuuacuauuuauguuucuaucagcauuguggucacaaccgcuuaaccaaucuccaaggagugcuaagcuuucuguaguugucuuaucuucuaagcccucaucagaaucuaggcauuuuuuuuuugagcuaguuccucagaauuuuuccagccucugcccauuacccaguuccaaaacugcuuccacauuuucaaauaaucauuaucaacgaugaccccacuugucaauaccaauuuuccuuuuuaguccguuuucucuugcguguaacagaauaccugaaacuggguaauuuauaagaaguuauggaggcugagaagaccaagggugagaggcugcaucuggugaggguccucuugcuagugggggcuacucuguuuuuuuaauaguaacuuaaaugggauaugaccuucauccuuuucuguuccuuauuuuugugucaaauuuauucuccuaaaccucuauuuggaaggaggcuugauucaggaaagcuuuucuuaacagacuuccuuuuucuauuguuuuuguguuguguucaaagauaugggagccggauuucugagauuuccuggcuuucuuccuucugcccuucacuugguuuaugccagcacuguccaauaguaauagguuuauuuguaauaauuaaagacuggaaacaacucacaugcccaucaauagggaaauauuuaaacugugguauauccacacacuggaauacuacuuagaagugaaaaggaaccaacuauacaacaauagaaggccuucauuuuaaauuuugaaaugugucuauauuuauuuuugaacuuggaaaauaauucaauuauaauaaauguuuauauugcaauuuaauuauuaguuaugauuaaauugguaucaacuguuacuaaugcugucugcauuaaguauacaaauaaacauauuacaguguuauauaggggucuagaaaaauguuaaacugaaucaacccauugauaccaacugcauauacacuuguugcuugugcagcaccucaacaguaacuuacaugaugcaacagauaagaugaaauauagucaugccaaaacaaaguuguacuuaauggaaaaauaaucuauauuucaguuuucaaauuaaaauuaaauaauguuaaaaauuaaaaauauuucuuuucuaucagacccauuuuaagcccucuauauccacauguggcuaguugauacugaauuauacaauacguuuguagaccucuuucuucugucucuuuaauuccuuuucugcauaauuuuuauuucacuccucgcaguuucuucuuaguacagguucaugucucagaagggagccaugaugagucaguugugagaguucagggggccuagauugcucuagcccuuuuaguccuucuuaccuuacugugcaccccuugcauuuaccuaguauuaaagaauggcaaagcccugccacuauucuaaaauuggccagcuguucauuccagcaaauaaauacauuggcuguuuagggcugucccuuucucagacccaucagauuucacucuuuugcugccuucuuuuucuuacacaauguaagacucuaauacaauguaguucuuguggguuuuggugguuuguccuuauuagcuuauauuuuaggguuuuuaggacggucugccuaauuuaacuguaaauguuaucugugguuuuuuugguuuuacuaucuugugcugucucuaugugaggagucagagaaauugaaaaauugccacuacugcuucugucuucuucugacaaauaaaauuuugauaaugcaugcaauuuccuuuuggguucaauggaaacuagaaggaaauaugguaggcauuuagguuaagcaagaaagggaggucaaagaauuaauaaugcucauucuuuugcuuaaauaauuuuuuuuccuucuaugucuucgguuugauaagaguucuacagagauggaagaauuuguaaugaugaagcaacagcuccaggagaaggaagaauucauuagcacuuuacaagcccagcucagccagacacaggcagagcaagcugcacagguagggaccucacaaaauuaggauaaagagcuaugaaguccaguggguuauuacgcacaagucaauucagugagucacuuuaaaaaauccuaguagauaaaaguauaguagcauggguguugcacuagaaauuagaaggauauguaguagaagagauuaggagaugugugguagguaagugugucauuagggaacaccagaaaaccucacaauguguuauuuaccuugaugaauuuucuauagccuaauugaugacuguuucuuaguucugcauguccagaaacuuaauuuuaauagcagacagagauucagucuuuugggaauggacucaugcugaguucaaaagagaccaauaaguaaaccaaaagaaauaaaaauaauuagguucauucuuucccaaaauaauaucuaucuuaauaggaaauaaauuauaguuagauuacuuagugagccuguaaugagaaagugguguaggucaugugauuuuauguuaaauggcaccaguaugugacauucuucuucccauuuuuuucaucugucaagaccagaccauuuggauuggcauccucaacuuuuucuauuuuucuagguuucuugguuggccacgcacucccacauauuuauuuuugaaauugggucucacucuguugcccaagcuggaguacaagugguacaaucauagcucacugcagccucagucuccugggcucaagccauccucucacucaccucagcuucccaaguagcugggacuacaggcaugugccacugcaucuggcuaaauuuuuuacauuuuuugaagagacagguucucaauauguugcccaggcaggccuugcacuccugaguucaagugauccucacaccucggccucccaaagugcugggauuacaggcacuguaauuuuuuuuggggggugggggcagcggugggggaaugcuuaugaaucaugaaagauuuuuuucccugaaguaccuuuguacauagcuaauuauccauuagguguuuacuuuauuaauaauuuguaguauuaguagugccuucucucugugguuggccuacugcuauguauacaguuaaaauuguauauccugaaauucuugguuuuaccuauuagcuuuuauuguguccuuuuuaaauuuuuuauuuauuuuuuauuguguccuuuuuauguauaagcacuauauacagugcaggaugaagaaauacaaaauaugguuuuuaaccuauguguugcuaaaauauggaaagccaagauacauacauguguuaagagauucaucguaauuuaaggcuuuccgaauaagugccaaagcaagcagcaauacaaacaaaauauuuuggaaggcgaaagagguuacugugaguuugacaguuaaggaaaauuacacggaaaaguugggauuuaggcaaaaccaugauauauagauaauauuccagacaagcugggggagauauuucagugauggggaacggugugagcaaaacugcagagaaggaaaagaauauggaacaguuaugggaaaggaguuagagauguuuggcuaaugaaagacuccagugccuacacacuugaaacacaagaguccaaauuccuagugaggucacaauucagauaauaaaaacauucugaggauuuguuuuucuccuaccaaaaaagaaagccaaaguuugauucaaggugucacaaacugagauaucagcaguaaaggaccaaugcaaaauaggcaagcuaacagcuaagcagcaugcuccaccauagaucuuaaggagaugaauaagcagaugcacacacucacaaccuaaaaacaagacagaagcacugauacugagcagcucaccaucaguccauuuauuuccauuucauucuguucagagccaguuaaaaaugagcaugaucuagaaggcugcaaguaaugacagcugaaaacagcugucuggggaggugguguggauuuagaagcacaugagguucuuugguagaagcaauucuuugaaaauaagacuagaaagauagauugguauuuccaguuguagagaaucuugaauaaaugauauguuaguuugaauuuucauuuauagggcaugagaauuuuacugaaagcuuuucagccaugagcaagaaguguccaggguuuaauagaaaucuaacuuaacuucaccuuauguguuuaauaucuuaaucuuuuuagaacuuuaaaaaauacacuucuuguauauuuaaaacauuucuaguaaccaugaacauauaauuuuugaucaaaauuuauguuuaggcuaacuucugaauuugaaaauaggcuuucucucgcauuucauaguuacuguccagccuaucucucuuccaacauccucauccuugacaaucaaaauuucacuuuaaaaagcuacuaucaagucucagugucugucuuggaaaguagucugugaguuuuauuugugcaauauucggggaguguaacuugcauaguuucucugguaugugucuucaguugaguuccaugcagcaggugguccgagagaaagaugcccgcuuugaaacacaaguucgucuucaugaagaugagcuucuucaguuaguaacccaggcagauguggaaacagagaugcaacagguguguugcuaaaacucgguagaaugacugucauuuugguuaauauuuaauccaucacagccaauuuccuacccuuacccacugcucuucacuugguguuaguguuuuccuuauuggccucuuuuguguccuugucuucuguugcauaaaaauuauuuauuuuuucuuauccuuuucuugccuuuuaccccucuaaucagguuguuggugcucaaaagcugaguuuaguuggugaauuuaugugguagucaaaaauugguuucucuucaguuuucugauuauagcuaccuuugugcauuacacaccuaacccaaagcuucaaaucaaugaagucaguuuuaaauauuuaaaaaauuagagaagacaaagaaugauuuugaagacaugaagucuuuuauuagaucaguaauucuuuuuuaaaaaaauuugaguagauuuugaaaauuggcuucauuguauuugaguucaccaucuacuaacucaaaguauuuuauuucacuuaguguguagugcauugugguacugaaaggcacuucagugauacuuuauguuugaucuguuuaauuagauugaaaauuaauuagaauuaauuagaacggaaacuuuuaaguucuaagcaaucuuucagaaugcaccacuaaauaaaguuuuagaauacaacauauuauuaaguagaauacuaauuguauauguguaucauugcuuuauuuauucaacaauuuuuuuucaagugccugcccagugcaugaaacuaggagaagagaaaugauucuugccugcagagaauguucucuuggguggguaagauguacauguaccuaugcuaucuagguacagguuauuaacuguaugauuuugaaggcagauauguguuauuguuuuuucuaauuuuuaaagagacucccuaauucagggacuugcuugugucugggucugguuguuguuggugcucuggagaagacauuuuggagacucuucguugcugcuggauggggggagcauggcaugcuggucucccacucuuuaaacugucauuuucaacaccccaaaauuuaaguauacaaaucuacaugacauuuugaaagauaagcaaauacaagcacucauuuguuagcauauuaugucuaaaauguuuucuucucagaaauugagggugcugcaaaggaagcuugaggaacacgaagaauccuuggugggccgugcucaggucguugacuugcugcaacaggagcugacugcugcugagcagagaaaccagguacugccuuuuaaucuuuacuuccugccuuggaggguauucauuuccacuuucguuugccaggcaguagauauaaaagccuauuuaaagucuucagagaauugaugccauuuauucauucuuucaacaaauaccucguacuuaagugguggggaugcaguacaauuaugagcaaaacuaaauacaguucuuucccucauggagcauacauugcacuucuuuauuguugcucuuucccuuugccauuuuagaucuaggguccuaguuuaucuagaaugucauacagauugaguaugccuaaucugaaaauccaaaaugcugcaaaaucugaaauuuucugagcaccaacaugacaccacaaguggaaaaugccacaacugaccuuguggaacaggguaacagaucaaaggcaaauaugcacaaaaucauuuaaaauacuguauaaaauuaucuuuaggcuauguguauacgauguauaugaaacaaaugaauuucauguuuagacuugcguccuaucccaagauauccaagauauuccaccaucugaaaaaaauggaaaacuaaaauacuucuggucccaagcauuuagaauaagggauacuugaccuguauuauccuuuagugaguuucuuuuucaucaguuacucuucucugucuugaaugguuuuugugcuuuauguacagcccaucuuuucuuguuuuuguaaauugaccuucuguuagauugaaaugaucucguucugcaauauucucuugaguaugaagguaaucaguaaugcugaucugacuauaauccauccugccauuuucuuucucauauuguccugaucuucauucucauugaauuccauugaauuccacuuugcuucucuaguauguuaauucuuccuuacccuugcuccuuucuguguccuauauggacccaugcuugacaguuugaacuaccuuuuuucuaccccuuggauuccuuguguuccuauccugucacauccaaguagucucaucauaaugcagaauuggugcuauaguccacauucucuguuuguuuuucugggugccugugugcugcuggggagucagccaucuccucucuucuuaauuuucaacucuccuucuugagaagggcuuucucucuagcauagaaacauguucccauuuuuuuccauccuauaagaaaaagcacuuuacaaugcuuguugaaaugaaauaauguauuuauggcucaugagacuuugucuuuuuucuuagauucucucucagcaguuacagcagauggaagcugagcauaauacuuugaggaacacuguggaaacagaaagagaggaguccaagauucuacuggaaaagauggaacuugaaguggcagagagaaaauuauccuuccauaaucugcaggaagaaaugcaucaucuuuuagaacaguuugagcaagcaggccaagcccaggcugaacuagagucucgguauagugcuuuggagcagaagcacaaagcagaaauggaagagaagaccucucauauuuugagucuucaaaagacuggacaagagcugcagucugccugugaugcucuaaaggaucaaaauucaaagcuucuccaagauaagaaugagcaagcaguucagucagcccagaccauucagcaacuggaaggucaguagcugauugcuuuugaaguccacaucucuaccaucugaguggcuuguauuucauauuuucagggaucuguuaaugaaaucuguacucaaaccaauugaaccaauagaaggacugagaaaaacagcucuucugaacuucuugaugcauuuuucuugccucugacuggcuauaaucuuucuuaauauuauaauuaucauuacaauacuaaaaaugugauagugauguuccagauauuaaauagaaugcuauguuaaauaugacugaucugaaggauucaaugacugaaacgagaaggauuugaauuaguuuuuggaaaacucaggccagaucuaggugcauagguuaggagacuaaauugcauggaguuauccauaaaucugaagaaggauggaucucagugcuuuucuuauaggugaaaaucucuuuucaccugauuucuugucuuacaggugaaaauuuauccuuuaugaagguauaaaggaaacuuuuaaaaaauguguuauuauaaaaguaauaugugccuauaaaaaauugaacauuuuagaacuuuauaaauuaaaaagugaaacuuccucaacaccaauacuccaucucaccaauccucuuccccaaauuauaaccuuuacuaauauauugacauagacauaaaggaaagauuuuagaaacaauuaaguugaaaauuuguauugaauaacugaauguuagccagacaguuuuguuuuuuguuuuuuuuuuuuugugacagaguuucacucuuguugcccaggauggagugcaauggcaugaucucggcucacugcaaccucugccuccuggguucaagugauucuccugccucagccucccaaguagcuuggauuacaggcaugcaccaccacaccuggcuaauuuuguauuuuuaguagagacagggcuucuccguguuggucaggcuggucucgaacuccugaccucaggugaucugcccgccucggcaucccaaagugcugggauuacaggcgugagccauugugcccuagccagacaguuuugaagggcaucacacaagaccaggguguuacaugagcaagcuguucucuuaagcaugcugauguuuaaaaccaugugguggaaucuuggugggauccauaauaccuaagucgagagugaagaaaacaaaaacccuaaagccauuuucaagggggaaagggaaaaugaacuuguaaaaaaugccuagggcuaggccuccccacgccugcuauuccagcacuuuggggaggucaaggugggggggauuaccugaggucaggaguucgagaccagccuggccaacauggugaaacuccaucucuacuaaagauacaaaaaaaaaaaaaaaaaaauuagccaggcauggugacgcaugccuguaauccuggcuacuuggaaggcugaggcaagagaauccuugaacccaugagucagagguuacagugagccgagaucgcaccacugcacuccagcuuaggcaacagagggagacuccguaucaaaaaaaaaaaaaaaaagugccuaggccuauuuuauuuuacuuuugaaggaagugauuuacugagguguccuuugguucuugagaacauuuaacauuuagcuaauaauaauguugucauuggcaucauaauuuuaacuaaggaaacuaaacuaguaaacagcauacaguguaucuuuagaagauaauaauaacuacauuucagacuugaagcaaauauuacauuuauuuuuuuucuuuuccuuagaucagcuccagcaaaaauccaaagaaauuagccaauuucuaaauagacugcccuugcaacaacaugaaacagcaucucagacuucuuucccagauguuuauaaugagggcacacagguaauuaaaugugaacuucuuaugaauauuaacuguuugucuuugcuguaucuguacuucggugcucuaaugaggauuuauuccagagagcuauauaaaccuucuguuuuuucugccugaaaaaauacuuuuuugaggacaauucuauuugaaaggaaucaugaaaggcauuaaugcaguguuucaacaauaaagaaugagaaaauaauagauaacaaauaccauggucucagaagccuuucugauucuaaggucuuaacaauuuguaucggagaugaaucauuacuuuugcuucuguaguuaauuuucccaguucggaagucuuuuuuuuuuuugguaaacuaagauuugaucagguuuagugaacacgagucagucuaaucaaacuuaaaagucuacuauggaaaucauauuguucccauuaauuaauuaacaguaaaaaaguauauaauggccaaguagcuucuuauuggccaguauauucuuucuuucaucuacaaaaaucucuguagagagcuagauuguaaucaucgaaggcugauucaggcugauugagccugaauaucagaaugaaggcaguuaguuugauguucuuaauugacuaaugucaaguugagauaacuagauucagucaucuccauuguaagauuauacccuuccaaacucacaaacauauuggucagcagaguccugucauuccugggcuaugcuguccacugauaaaaauuuuugccucuugguuucuagcaucuaggcuuuccagucucuucuguucucccauucucgacuuuuuccuccaauguuuuguuaagacguuuuccaaccauucgaauaaguugcaagaguuuuguagcgaacaucuguauacccaccaucugaauucuaucauuaacauuuuagcacguuugcuuuaucaaaugucuaucuauuuauucaucccucugcccauccaucaguucaucuuaaauuuauaauacauuucacuguaaguuguggacaucaguacauuucucucuaaauuugucagcauucauaucauugacuauauuuuaauauuuauuuauaauuguucuuuuucuuuugagguaagauuuacaaaccuuuaaaugcacagaucugaaguauaccauuccuugaguuuugucaaaugcauacaccuguguuacccaaacuccuauucaagauauaucacauuaccaucaccucacaaaguaucccuauaccccuuuacagucauccucacccuuccccuccaaagacaacuacugauuuuucaccauagauuaauuuugccuguuucacagcaucauauacauuuaaccauacaauagguccucuuauguguaaagcuuuuacucagcauauuuggagauucauccauauugugcauguauuauaauuuaaucuuuaauauugcugagaaguauuuuauuuuaugaacaugcugaauuuuccuuuugcaugauuguacugcauuuuccuauugauggacaccuggacuuuuucaugcuuuggcuauuaugaaucaaacugcugugaacauucucauacaaauaguuauguggacauauguuuucauuuaucuucaguaaauacuaguugaggaauugcuuugcugggucauagaguaccuauguauuuagcuuuauaaggaacugccaggucuuuucccaaagugguuguacuauuuuuuuuuuccaagacggagucuuggucugucgcccaugcuggagaacaguggugcgaucucggcucacugcaaccucgaccucccggguucaggcaauucuccugccucagccucccaaguagcugggauuacagguacccgccaccacacccggcuaauuuuuguauuuuuaguagagacaggguuucaccauguuggccaggcuggucucaaacuccugaccucgugauccgcccaccucggccucccaaagugcugggauuacaggcaugagccaccgcaccuggcugugguuguacuauuuuauacucccaccuaaaauauaugagaguuccauuuguuccacaucuucuccaagauuugguggugucaguuuuaaaacauuuuagccauucuaauggguauguagugguauuucauugugguuuaaauuugcauuucccugaugacaaauuauguugaacuuuuuuucuugagauucuuagccauauguacaccuucuguuggugaagugucuguucacaucauuuccccauucuuaaauuugaguugucuuuuuauuaucaaguaggaauucuuuauauauucugaaugccaaucuauuaucauauauguuuggugaauauuuucucccaugcuguggcuuuguggcuugccuauucauuuucauuaugauaucuuuucauuagcacacacuuuuaaauuuugaugagcuuaauuauuuaucauuuuuuauuguuuuuuuuuucuguguccugucugugaaaccuuugcuuagccccaguuuaugaagauauucucuuaugcuuucuuccacaagcuuuaugguuuuaguuuucauuugaagucucugaaucucaaaugaauuuuuguguguguuguaaggugaaggucaaguuguuuuguuuuuuccuguacggauauuucguuguuucagcaccauuucguaaggagacuuuacuuuccucauuggauucuuuugguaccuuuguugcaaaucaaagacuaauacaucuauuucugaauuuucuguucuguuauauugaucuaucugucagucccuaugccaguaucacggucuucauuauuguaguuuguuguuagucuugaagucaaguauuaauaguauaaguccuccaacuuuguucuucuuuucaagauugcuuugacuauuccagguccuuuccacauaaauuauacaaucagcuucucaaauucuacuuuuuaaaaaaagacagaugagauuuugaauugguauuguguggagucuauugaucaguuuaagaauugacaacacuacuguacuuuuaaaucuacgaauauaguauaucucuccauuuauuuagaucuuuaauuucuuucagcaguguuuuguaguuuucauuggagaaauuaugcacauuauaacauuuauucugaaguaguuaauauuuuugauacuauuauagauggaauuauuuuuauuucauuuuccaauguaugcuaauauguaaguauacaacugaauuuuauuaagcuuauauucugugaccuugauaaacaaauuaauuuuauugguuuuagucucuuuuuguagauucucuaggauuuucuauguaagcaaucaugucaucugaaaauaaagacaaauuuuacuucuuucuaauuuuuaugccuccaguacacuguuuaauagaaguggugagacuggacuuucuugcauuguuucuaaucuaagaggaaaguguuccauaauuuaccauuggcugugauacuaguuuuagguuuuuaaggaauuuccucuaucagaucauccucaaucuuguagaggaauuuuucucuuaguuuuuuugauauuucuuaauuuuuucuuaauuuuuaaaauaaacuuucucuuaauuuuuuuuuuauauuucuaggcuaugugauucuucuaugaguaauaacaaaugucuaguuguagcaauccuccuaaaaauuuuucuauuuauuuauuuuuugagauggaguuucacuguugcccaugcuggagugcaguggugugaucucagcucacugcagccuccauuucccagguucaagugauucuccugccucagccucccagguaguugggacuacagguguccaccaacacccccggcuaauuuuuguuacuuuuaguagagacaggguuuugccauguuggccaggcuggucugaaacuccuaaccauaccuccuaaccauuggugaucuacccgucuuggccucccaaagugcugacauuacaggcgugagccacugcgccuggccuuuuuuuuuucuuuuuuuaaaauuuuacuuauuuuuuuguuuugagacagagucacuccaucacccaggcugggguguaguggugugaugacagcucacugcagccucaaccuccugggcuuaagugauccucccgccucagccuccuaaguaguugggacuacaggcacaugccaccaugcccggcuauuuuuauguguuuguuuguuuguuuauuuauugguggaaauggaauuucaucauguugcccaggcugguacagaacuucuggacucaagcaaucccccucccuuggccucccaaaaugcuggaauuauaggcaugagccaccacacccaaccccaauacauuuguugaaaaaaaugugcauauauaagugaacucauguaguucaaacccauauucaagaguuaacuguauuauccuuuuucuauaguacugaauuugauuugcuaauauuuugugaaggauuuuuguguucuuauuuaugaaggauauuagucuacaguuuucuuguuuuaugauaucuuuaucagguuuugguauuaaggguauggcagccucauaauauguucccuuuucuauuuucugggaguguuuccuuucuuucuauuuuaugagaguuuguaugugauugguauuauuucgguuuuugaaaauaauuuuuuaaauacuuuuuuuuaaaagaauucaccaaugaaaccaucugagucuggaguuuuaggaagguuuugauaaugaauugaauuuccuuuacagauauaaggcuaauaauaagauuuuuuuuuuuuuuuccacccggugccaguuuugguuuguuugggcuuuuuuuuuuuuuccugggguuuugucuauuucauugaagauguucuaauguucuauuuuugucauaauguugguuacaauguuuacuuuuuauccuuuuaaugccuguaagcgcugaucccugcuguuguuaauuugugcuucauuuucuucaucagucuaucuagaauuuauucagcuuuuuucccccaucuuuucaaagaaccacuuuuggucuuguuaauuuucucuguugcugauuauuuucauuuucauugauuucuacucuuuaguauuucuuucugcuuacuuggauuuacuuugcucuucuuuuuauagcuucuuaaggugaaacuuuguaucaaagauuucaagucuucuuuucucauaugaacauuuaaaguuaacacaguucccucuaagcauagcuuguuauguugugguuuuuuaaucauuucaguuuuugaacauuuuucuaaguuucucugugauuuuuucauugaccauggauuguuuagaaguguguucuaaauaaacacguuguuguagaauauccagauacuugguuuuauuucuagauaucuuauugauuucuaauauaauuucauuaugaucagagaauauguuuuaugugacuucaauccuuugaaauuuauugagaccuauuuuaugacacagcauauggugucuuggugaacauaccuuguacacuuguaaauaguguguauucuguaguuauuggauguaauguucuacaaauagcacuuagaucauaguauuguucacguuaucuuugucuuugacuuuugucugguuauugaaacauuugcuaagaggggguugaaaucuccaacuaugacuguggaauugucuguuucuccuuuuaauguagucauuuuuugcuucuugguaauuggaaucucuguuauuaguacauacacauuuauuuuucagauaaaguguuccuuuuuucacuuacaaaauguuacucuaucuguaguaauacuucuuuauuuacauuucucuguaucuggcauuaauaaaauaauucugucuuauguuuauugcuugaaugguauauucuuuucuauccuuuuacuuuuaacuuguuuuucuuuaaaguaaaugucuugaaggcaacauauaguuggguuauacuuuuuuauuucuucucuucuuugugauuggagugccuaguccuuuuaauguaauuauugaugugauuggauuuaggucuaccauuuugcuuucuguuuuuuccccucuguuuucccuucuucuuuuuuccugccuucuauucgauaauuagaaguuucuugaauuuaauuuucauuuauugacaacuuuuucuuuuaaacagcucuauuaaguauaaaaagguauacuugacauacaguaauguguacacauuuaaaguauacaguuuaaagaggguuuuguguguuuguucauuuguuuuuugaaacagggucuuguucucucacccaggcuggagugcagucacaugaucacagcucacuauagccuuaacuuccugggcucaagcaauccucucaccucagccuccugaauagcugggaccacaggcaugugccaccaugccuggcaaauuuuuuuuuuuguagagacaaggucucacuauguugcccaggcuggccucaaacuaacuccugggcucaagugauccuccugccuuugucucccgaagugcugggauuacagguauaagccauagcacccagaacaauuugaugacauauaaaaccaucacuacuaucaagaaaaugaacauauucaucaucucuagaaguuuuuucauguccucuuuuaaucuuuucccucacaucuuucccuaccuagacaaccacugaucugcuuucugucauuauagauuuuuaaaaaguuuauauaaguuguauaugcacuuuuguuggcuuauuuuacucagcauacuuauuugagauucauccuaauguuuguuuaguaauaauucauuccauuguauuguugaguauguuguaaacagcacaauuuguguaaccauugacucauugauggauaauuuggguuguggacaguuuuuggcuaauacauauaaagcauuuauguuuauguuuuaaggagauuaaaauaagaaaauaaaucuuaacuaccauugcaguuaccauuucugguacuuuucauucuucguuuguagaucagagauugccaauccuuuuauguauaguaaauauuuuaggcuuugugggucauacagucuuuguugcagguacucaacucugccauuguaaagugagaacagacauagagccaagguaaacaaaugguugugguuauguuccaauaaaacuuuauuuaugcaggccuccaaaguuugccaaacccuggcuucauauuuccaucugguaucauuuuucuucuaucugaaggacuuuuuuuuuuucuuuuuuuuuuuuaguaagagacagguucucauuuugucacccaggcuacagugcaguggcaugaucauggcucacugcagccucauccuccugggcucaagcgauucuuccauauuugccuccagaguagcugugacuacaggcaugcaccaugcuacccagcuaauuuuuuuuuuuuuugcuuuuaguagagaugaggucuugcuaaguuaccuaggcuggcugguuuuaaccuccugagcucaaaugauccuccugccuuggccucccagagugcugggauuacaggugugagcuacugcaccuggcucugaaggacuucuuuuaauuuuugugucuguguguacauggaugugugugcaagucugcuggucauggguuuuuuuguuuguuuguuuuuauuuuuguuuuuuuuuuuuuuuuugagauggagucucacuuugucaccaggcuggagggcaguggugcaaucuugacucacugcaaucuccgccucccggguucaagugauucuccugccucagccucccgaguagcugggacuacaggcacccaccaccacaccuggcuauuuuuuuguuuguuuuguuuuuguauuuuugguagagacgggguuucaccguguuggccaggaugaucucaaucucuugaccucaugauccacccgccucggccucccaaagugcugggauugcaggugugagucaccgugccuggccagucauggguucuaauaacacuuuuugucugaagacaucuuuaucucaccauuguuguugaaagauuauuuuuugcugacuagaauucuacauugaaaguuuuuuuuucuuucauuucucuaaguguauuacucuacugucuucuuucuugcauuuuguuuucuuuguugguuuuuuuuuuuuuuuuuuuuuuuuuugagacagagucucagugugucauccaggcuggagugcaguggcgcaaucucaacucacuguaaccuccacuucccggauucaagugauuguccugccucagccucccauguagcuuggauuacaggcaaccgccaccacgccuggcuaauuuuauauuuuuaguagagaugggguuuugccauguuggccaggcuagucucgaacucuugucucaagcaauccacccccucagucucccaaagugcugggauuacaggcaugagccacugcacccggcccuugcauuuuguuuuuaauaagaaaucugcugucaugcuucucucuuuuuuccugcuugcuuuuaggauuuuaccacuguuuuugagcacuugaauuauaauguaccuugacauagcauguuucuugugauugggguucauugagcuuuuucaaucucuguguuuauaguuuuggaagauuuucugccgugaauuagucaaauauauauauuuuucugacucccuacucuucuuugggaauuccaauuacauuuauauuagauuacuugaaguuguuccaaaacucauuaaugggcuuuuaauuuuuuuuuuuuuuugaaauggagucuugcucuguugcccaggcaggagugcauugaugcagucucagcucacugcaaccucugccuccgggguucaagugauucuccuuuguuucuauauuuguuuuguuaacauauuuuggagcuuuuuuuaugcgacucaguuaaauucuuugaaaaaaacuugguccuuucagauccugcugcuuugauuuguuaggaggguucgaaucagugcucagucauucgauacuccugaggcaagaccuugcugaguauucuacucaaugcccugagaaguguuuuuucacauuuggcuauauaacugacacuuccggguuuugugugagcaccaagugcuauucuuuaaucucuucagauagguagggguaguucagauagccuuggaugcuuuccucacauucauguccugcccuguacuucacugaacacuuguucagucccuuugcagaucugcaggguuuucucuuuacgugacuuuuucccaucugguauucuauucugcgaacugcagccaucuugcucuuucuugacugucagcucugucucaugaacuuagggagucuaccaggcucagccuauguucccccuucuuggaccacagccugaaaacucucuuaaggcaugaagcuuggucaguuuuagggaucacuuuguuuucugccucucucagagauaauuauccuuuguugcuugauauccaguauucugaaaaugauuauuuauuauuuugucugguuuugguuguuauuguuucagguaggagguuaaaucuguuccauguuacucagucuuuagcagaagcaaaagucaucuauuggguauugagcuguaucuuuuuacaaaaauuuuuuaagugguuauucuaggaaguauaacauauauccauaauuuuucagucuucuugaguuaauacuguacuacuucacuuaaaagguagaaucuucauaaucauauacccucacccuauuccugaugccacaguuguuguauguauuauauuaacaaaaguaauaagccucagcacacaauuuuaauauuugugcuuaaaaugguuauauauauuugaaagacauuaagaggaaaauauugaccuuaacauuuauccacauauuuaccauuuguaaugcccuuuccucucugaugaucagauaucuauuugauacuguuuucuucagccucuacaacaaccuauaauauuauaguauaggucugucugugaaaaaauuuucuuaguuuuuuucuuaucuaaaaaugucuuuauuuuacuuuuauucuugaaugauauuugcuacuggauauuauaauucucgauugacaauuuuucuuucagaacuuuuuuuuuuuuuuuuuuugagauggaguuucacucuugucacccaggcuggagugcaauagcacagucuuggcucaccgcaaccugugccuccuggguucaagcaauucuccugccucagccuccugaguagcugggauuacaggcgugagucaccacgccuggcuaauuuuguauuuuaguagagacggaguuucuccauguuggucaagcuggucuugaacucccaaccucagaugauccaccugccucgcccucccaaacugcugggauuauaggcgugagccacuguguccagccuuucuuucaguacuuuaaagaagguguuucccucuucuggccuauauuuuuucccuaacaauuggucaguagucauucgaauuauuguuucucuguauguaaaguaucauuuuuccauggaaauuuuaagacuuuccuuuuauccuugucuaugaaguacuuaguuauaguuuucuuugucauuuucuugcuugcuuuuguugaguuucuuacguauauaacguuauguuugagaaauuuuuggccauuucuuaaaauauuuuuucuucccauucugucccucgucucuucugguacuccaauuacacguauauugaaccuuuuaauauugucccacaugucccugagguuguauucauuuuuuuuuucaauuuuuuuuauucuucugucuucagauuggauaauuucaguugauuuaucauccucaauucaccaagacuuucuucugucgucuauauucuacugucaagccuaucacauugaaauuuucauuucagauauuauguuuauuaguucuggaauuucaaacugguucauuauuuuuuuuuguuuguuuuacuaagauuuccuuucuucucauucauuaugagcauauucauuuauguccuaagcauagauauaauagcuucuuuauuaaaauucuuguuugcuacuuacaaaaucugcaucauuuuauggcuagaaucuguugauuauauuuuuuuuccuugagaaugggucacucuuuccuauuucuuuaugugugaaugguuuuguuuugaauucuggaugucguguuuuguucucaagauuuuauuuuguuauuucuaaaauuucaauuacuuuuuaucagacaguaaguuggacucaaaccccaaacucuggccuaugauagagaggcaucaaaacucaguucaguuauuuuugccuuagcugggcugcuuuaagucaguccaacaaauacauugugccauuguucagucagaaauuucagcuaaguuuauacacagaauucagggcuccuccuuccuaacucuuuuucuucucucugaucucccuccucacauccuggcagcuauguuugucccaaacucuucucauucuucaagccagaaauaucuguggcuauucuauuggaauuuuacuugcccugcauacugcaaacugggaacuucccucaagauaaaagccauaaaaacccuaaauucaucccaugcuauuuauuuuaaacauugaaugaagauuucggggucaaauaugcuguaaagacccucauggcuuaaaaauucuacaauuguaugaaaauuuuauagaauaauauccauggagaauaaaaaauauauacaaagacauaaaacuaaagaugugacauaauuagauauaugccuauccuuaggaaaaccaaaaauucuggauguauaaauuaagccaagggaauuuuuauuauacuuggaaaacaaaaaacaauuuuauaaaucuucuuccuuucuuaagagguacauauuccuuugccucuauuccucuuuguggaaccucucuucauguucauucuccuucaggagagagaccauguuacuuggugacauuaaucuaaucuuguaauacuauuuguuugugaaccugaaaauguucuuucuuaugcuauagacuugggauuucuaucuuuguaauccaggcuucaaucuuaaauuuaaaagccaaugaacuugauauuugugugaaauauuuuauuucuuuuucuaaaucuuuagauaaaacacuuuucuucaaagauuaccuaggcagauaaguagauguuauuuuuaaaguauuuucauggcuggagaacuucuagaagacaaaaaugcuggaggcuaucugggcguuagugugagaauuuucugcuggagaaucauuaauuuguugucuuucuacaauuuaggcagucacugaggagaauauugcuucuuugcagaagagagugguagaacuagagaaugaaaagggagccuugcuccuuaguucuauagagcuggaggagcugaaagcugagaaugguauguauaaaagaaaaccauaauucucugucuucuuaucccacaagugccucuacuuuuaucacuaauuauguauaacauguagaauucucugauuccgugauaauaaagauuuagauaauagagcugguaacuaucaaagauaauacacauuaaacaauuagagcauaguaucaguguuuacauaaguauaacauuuugcaauauggacuauacaugcugcaggauuucuuuauaacucauaaucauuuuggaauggucaucguauccuauaggaaguauggcuugaacaggaccuuaauaagaugauuuuuaaaauagguaaaaugaagaaagaaaggacauucugguaauaaauuugugggaugagguaacagagaucaguauaaagguuuaaagguagaaacuauguugugagugagugguuuaugcucgugcuguacccugcuuagaauccugcuccuuuccuuuagucuggaugauuguuacucaucuuucaggccucgacuagcauauuaucuuuuucaggaauuugguauugguccccaaaaguuggguuaaaugauuuuuuugugcuuccauaacauccuuguauacuuuuaacauuguauuaaaaugaucuguuuauauguuugucuuuuuuacuauauuauaagcucuucaaaguuuaaauauaagcucuucaagggcaggggccauuuuuuuuuccaucuuugcuuuacccaaaacuaguauaccaccuggcaaauaauggcuacugaauaaaguuuuguuggauugaacugaacuuagcauuuuauccuauuggauugugugugaacaguuagugagaaugaagacgugucuccuuccacuuaucauaugcuucauguagacuuuauggauuuaguagcgugucguuaaugcuuuauugaucuaauucaucuuuaacugacuacuacacuuuaucaucuaggagugagaaugaauagcaaguaaagguuguaaaacuuuuauuaaacucuagagccaguauuucuaacuuaaccauuuuacaguuuuccacuuagaucuaaauggaagcuuaugcacuuguauuagacgauucccacuauuucuaauaaguaaagaacaccacaaauucagcucauuauuuaacccauucagagcacuucuuugagaccuuauccaugaugcuuauuuugcaguuuugcaaacagucuguauccuauccauguggcuucacaugguuuggagguauuauauggguuccauuccuuugcucuuuccugcagggaucacugaccuuaagguuuucuguauugguuuuugugucuggccucauagauuacuuuuaccuuguaugucauguuguuuucaacucaccuuuugcacugacauuucuaccacuguacuccuuuuucaaguaaucuugugaaaugucugaacauauauacugucuugaauucccuugucucaucuaugguggcuuuccuaugugccaggcacuauuccaguugcuggguauauagcuaugaacauauuggaggggaagacagacuacaaaccuguuuauacacauaagaaaauuucagagaaugauaaguauuaggcuuaaaauaaaacagaguauuucaaguaugccuuggagaagaggaacgcagaauuggaguagugagaguaggccuuucugaggacuuuaaaccugaaugaugaaaaggggacagccaugcaaagaggcuaagcagagagcauuccaggcagagaaaaaagcaguacaaauguucucaggugugaaugaacuugauaaguuugcagaagagaaaacagaccaguguuuuuagagcagagugaacaaaaagggggcaauacaagaagaggagguuggagaauuaguagggucaaagcaugaggguuccuguaggucacauuaagacauuuggauacaguguaaaaaauauauauauuuuuuuccuuugguguaucuguguuaucuucucagaaagaauauaagcuucuugaggauauugauauugaugcucaauauauacacauugucacagaacuuggguuaaaacucugaagacuuggauucuaaucccagcucccugaacuagcugcguaaccuuucggguugugucauuucuuuguuuccuuauaugaucauugaggagauaggauagcucccuuuuagugcuaaaauuugauaucuuuaugaacauugaagaacauuguaagugcuauauuaaugcaaaauauauauuacaaacauaguaggauuauggauaaauuauauguauuguccuagaaguuccagauuaugccacagaaauagcugcuuuauguccugcauccuggcauccuucuccuuucaaaccuuccacuauuuaguauacuucauucagguucauuaucaucaccuaguacuguucuaucuuauaucucauguaaucauauccucuugccacuucuuuaauaaggcuuucaccucucccaagcuauuuuguuuauuuuuuaaaaaauuauuucauacaauucaaauagcuucacaugcaauccuguuuuuucacacacuccacauauaucuucuaaagauauuuauuuugugacuuucagaaaaacugucuucucagauuacucuccuagaggcucagaauagaacuggggaggcagacagagaagucagugagguaagugauguguucuuaauauaaccagaacaugagcuagauuaagagaagguagcuucauaugaaaauacguccauaauuuucuaguguugccagagaaguacauuaccuauagaguaagaucuauuaaagagauucauaaugguuauuauaucucauuuauuguuacuuguuucugaauauuaaaauucauuguucuaaagcaacacaaauacaguagcuacuaauuugggauuugauaacacauuuuuuuauacuggguuaucaucuaucucaacuucuuuguucaucucagaaaaguuucucagugaagagauuagauaagacuggcauaguuuuacuaagauuaaauaaaaagggaucuuuggagaaugauccuuuuaauaaucugaaaauuacuauaagaaggguaugguugcuuaguaucauucuguugauuuaagaguauuguuagcugcguuuuguuuaguuagcuguguuuuucuaaucaguaagucagugauagaauuauacaugcccuugaggaguaauguggcuuccuaacaaaaguaucugcuuacuuuuuaaaaaaaaucaauuaggaguuuuauucugaaggaaaaaaagcuucuuauguaaggaauaucuagaaaaugaauucccaauuuccuuaggucuuaugaauagggcuugacuucagugcaggauuggcagagugcccuuggagguccagcugggagauacaaacugauuuuaaaaggauuuagcaguguuaugguacaaagaagguuuugaccaaaaagucugaaguuuuagaagaugaaauacaaguuuuuaguugggcuauuuuuuuaauguuauaaaacauuugauuacagcuuuuuuuuucuuuuuuaaaaauagaucagcauuguugauauugccaacaagaggagcucuucugcugaggaaaguggacaagauguucuagaaaacacauuuucucagaaacauaaagaauuaucaguuuuauuguuggaaaugaaagaagcucaagaggaaauugcauuucuuaaauuacagcuccagggaaaaagggcugaggaagcagaucaugagguccuugaccagaaagaaaugaaacagauggagggugagggaauagcuccaauuaaaaugaaaguauuucuugaagauacagggcaagauuuucccuuaaugccaaaugaagagagcagucuuccagcaguugaaaaagaacaggcgagcacugaacaucaaaguagaacaucugaggaaauaucuuuaaaugaugcuggaguagaauugaaaucaacaaagcaggauggugauaaaucccuuucugcuguaccagauauuggucagugucaucaggaugaguuggaaagguuaaaaagucaaauuuuggagcucgagcuaaacuuucauaaagcacaagaaaucuaugagaaaaauuuagaugagaaagcuaaggaaauuagcaaccuaaaccaguugauugaggaguuuaagaaaaaugcugacaacaacagcagugcauucacugcuuugucugaagaaagagaccagcuucucucucaggugaaggaacuuagcaugguaacagaauugagggcucagguaaagcaacuggaaaugaaccuugcagaagcagaaaggcaaagaagacuugauuaugaaagccaaacugcccaugacaaccugcucacugaacagauccauagucucagcauagaagccaaaucuaaagaugugaaaauugaaguuuuacagaaugaacuggaugaugugcagcuucaguuuucugagcagaguacccugauaagaagccugcaaagccagcugcaaaauaaggaaagugaagugcuugagggggcagaacguguaaggcauaucucaaguaaaguggaagaacugucccaggcucuuucacagaaggaacuugaaauaacaaaaauggaucagcucuuacuagagaaaaagagagauguggaaacccuccaacaaaccaucgaggagaaggaucaacaagugacagaaaucagcuuuaguaugacugagaaaaugguucagcuuaaugaagagaaguuuucucuugggguugaaauuaagacucuuaaagaacagcuaaauuuauuauccagagcugaggaagcaaaaaaagagcagguggaagaagauaaugaaguuucuucuggccuuaaacaaaauuaugaugagaugagcccagcaggacaaauaaguaaggaagaacuucagcaugaauuugaccuucugaagaaagaaaaugagcagagaaagagaaagcuccaggcagcucuuauuaacagaaaggagcuucugcaaagagucaguagauuggaagaagaauuagccaacuugaaagaugaaucuaagaaagaaaucccacucagugagacugagaggggagaaguggaagaagauaaagaaaacaaagaauacucagaaaaaugugugacuucuaagugccaagaaauagaaauuuauuuaaaacagacaauaucugagaaagaaguggaacuacagcauauaaggaaggauuuggaagaaaagcuggcagcugaagagcaauuccaggcucuggucaaacagaugaaucagaccuugcaagauaaaacaaaccaaauagauuugcuccaagcagaaaucagugaaaaccaagcaauuauccagaaguuaaucacaaguaacacggaugcaagugauggggacuccguagcacuuguaaaggaaacaguggugauaaguccaccuuguacagguaguagugaacacuggaaaccagaacuagaagaaaagauacuggcccuugaaaaagaaaaggagcaacuucaaaagaagcuacaggaagccuuaaccucccgcaaggcaauucuuaaaaaggcacaggagaaagaaagacaucucagggaggagcuaaagcaacagaaagaugacuauaaucgcuugcaagaacaguuugaugagcaaagcaaggaaaaugagaauauuggagaccagcuaaggcaacuccagauucaaguaagggaauccauagacggaaaacucccaagcacagaccagcaggaaucguguucuuccacuccagguuuagaagaaccuuuauucaaagccacagaacagcaucacacucaaccuguuuuagaguccaacuugugcccagacuggccuucucauucugaagaugcgagugcucugcagggcggaacuucuguugcccagauuaaggcccagcugaaggaaauagaggcugagaaaguagaguuagaauugaaaguuaguucuacaacaagugagcuuacuaaaaaaucagaagagguauuucaguuacaagagcagauaaauaaacaggguuuagaaaucgagagucuaaagacaguaucccaugaagcugaaguccaugccgaaagccugcagcagaaauuggaaagcagccaacuacaaauugcuggccuagaacaucuaagagaauugcaaccuaaacuggaugaacugcaaaaacucauaagcaaaaaggaagaagacguuagcuaccuuucuggacaacuuagugagaaagaagcagcucucacuaaaauacagacagagauaauagaacaagaagauuuaauuaaggcucugcauacacagcuagaaaugcaagccaaagagcaugaugagaggauaaagcagcuacagguggaacuuugugaaaugaagcaaaaaccagaagagauuggagaagaaaguagagcaaagcaacaaauacaaaggaaacugcaagcugcccuuauuucccgaaaagaagcacuaaaagaaaacaaaagucuccaagaggaauugucuuuggccagagguaccauugaacgucucaccaagucucuggcagauguggaaagccaaguuucugcucaaaauaaagaaaaagauacggucuuaggaagguuagcucuucuucaagaagaaagagacaaacucauuacagaaauggacaggucuuuauuggaaaaucagagucucagcagcuccugugaaagucuaaaacuagcucuagagggucuuacugaagacaaggaaaaguuagugaaggaaauugaaucuuugaaaucuucuaagauugcagaaaguacugaguggcaagagaaacacaaggagcuacaaaaagaguaugaaauucuucugcaguccuaugagaauguuaguaaugaagcagaaaggauucagcaugugguggaagcugugaggcaagagaaacaagaacuguauggcaaguuaagaagcacagaggcaaacaagaaggagacagaaaagcaguugcaggaagcugagcaagaaauggaggaaaugaaagaaaagaugagaaaguuugcuaaaucuaaacagcagaaaauccuagagcuggaagaagagaaugaccggcuuagggcagaggugcacccugcaggagauacagcuaaagaguguauggaaacacuucuuucuuccaaugccagcaugaaggaagaacuugaaagggucaaaauggaguaugaaacccuuucuaagaaguuucagucuuuaaugucugagaaagacucucuaagugaagagguucaagauuuaaagcaucagauagaagguaauguaucuaaacaagcuaaccuagaggccaccgagaaacaugauaaccaaacgaaugucacugaagagggaacacagucuauaccaggugagacugaagagcaagacucucugaguaugagcacaagaccuacauguucagaaucgguuccaucagcgaagagugccaacccugcuguaaguaaggauuucagcucacaugaugaaauuaauaacuaccuacagcagauugaucagcucaaagaaagaauugcuggauuagaggaggagaagcagaaaaacaaggaauuuagccagacuuuagaaaaugagaaaaauaccuuacugagucagauaucaacaaaggauggugaacuaaaaaugcuucaggaggaaguaaccaaaaugaaccuguuaaaucagcaaauccaagaagaacucuccagaguuaccaaacuaaaggagacagcagaagaagagaaagaugauuuggaagagaggcuuaugaaucaauuagcagaacuuaauggaagcauugggaauuacugucaggauguuacagaugcccaaauaaaaaaugagcuauuggaaucugaaaugaagaaccuuaaaaagugugugagugaauuggaagaagaaaagcagcaguuagucaaggaaaaaacuaagguggaaucagaaauacgaaaggaauauuuggagaaaauacaaggugcucagaaagaacccggaaauaaaagccaugcaaaggaacuucaggaacuguuaaaagaaaaacaacaagaaguaaagcagcuacagaaggacugcaucagguaucaagagaaaauuagugcucuggagagaacuguuaaagcucuagaauuuguucaaacugaaucucaaaaagauuuggaaauaaccaaagaaaaucuggcucaagcaguugaacaccgcaaaaaggcacaagcagaauuagcuagcuucaaaguccugcuagaugacacucaaagugaagcagcaaggguccuagcagacaaucucaaguugaaaaaggaacuucagucaaauaaagaaucaguuaaaagccagaugaaacaaaaggaugaagaucuugagcgaagacuggaacaggcagaagagaagcaccugaaagagaagaagaauaugcaagagaaacuggaugcuuugcgcagagaaaaaguccacuuggaagagacaauuggagagauucagguuacuuugaacaagaaagacaaggaaguucagcaacuucaggaaaacuuggacaguacugugacccagcuugcagccuuuacuaagagcaugucuucccuccaggaugaucgugacagggugauagaugaagcuaagaaaugggagaggaaguuuagugaugcgauucaaagcaaagaagaagaaauuagacucaaagaagauaauugcaguguucuaaaggaucaacuuagacagauguccauccauauggaagaauuaaagauuaacauuuccagguaaaugaguagugaauuuuuccuccuccagagguaacuucaagcaaagaaagucucuaaacuauuucuguuuccuuuuagacaaugggacuaauuuuggcauaaauguccauggaagauauauucucucucacuucugacuuuuuuuuggcaaacaacaauccugcuacaacugcaugaacaugaaaaguucgcaucuucucuucccaucuuucuauugagagauuucuguacuucuguuuuguuuuguuuaagauggagucuugcucuugucacccaggcuggaaugcaauggcacgauuuuggcucacugcaaccucugccuccuggguucaagcaauucuccugccucagccucccgaguagcugggauuacaggagccuaccaacacgcccagcuaauuuuuuguauuuuuaguagagaggggguuucaccauguuggccaggcuggucucgaacuccugaccucaggugauccacccaccucggccucccaaagugcugggauuacaggcaugagccauugcaccuggccucuguauuucuuuucauuuccauuucaacuacucuugccuggauuuuuaccacaguacucucaaauuaauugucuagucucgucuuuucuucuuccuuuaguccacauuaauucauacugcauauaccucuuagaguuauuuuuucucaaauuucaauuuucugucacuuuuuaaucuauagaacuaauaaugucucucauccuuuguauuccuuacuuccaauaggacccuucuguucuaaaacagauuuucucacugucuuucauaucaagauuaucccuuagagaagccaaacguuagcuugucuggagcaaaguagaauaaaauaggagaaaauguuacuuuucaguguugaaaaccaugucacuaaaauaagugacauauuuuggaguuuaugacuuaaauauaugaacccuuaaguaugauauaccuuuaauacauagcacucaguagauaaacauguaggugcagagaauuaauaccucuucaguaaaauauuuaacaccuguuaugaauguuaauucauuuguaaaucuauugaguacauguuauaguauuuguuccuugggaaacacaguuuuuuucuugaaaucuguaacuaaugaccuucucucuguuucaggcuugaacaugacaagcagauuugggaguccaaggcccagacagagguccagcuucagcagaaggucugugauacucuacagggggaaaacaaagaacuuuugucccagcuagaagagacacgccaccuauaccacaguucucagaaugaauuagcuaaguuggaaucagaacuuaagagucucaaagaccaguugacugauuuaaguaacucuuuagaaaaauguaaggaacaaaaaggaaacuuggaagggaucauaaggcagcaagaggcugauauucaaaauucuaaguucaguuaugaacaacuggagacugaucuucaggccuccagagaacugaccaguaggcugcaugaagaaauaaauaugaaagagcaaaagauuauaagccugcuuucuggcaaggaagaggcaauccaaguagcuauugcugaacugcgucagcaacaugauaaagaaauuaaagagcuggaaaaccugcugucccaggaggaagaggagaauauuguuuuagaagaggagaacaaaaaggcuguugauaaaaccaaucagcuuauggaaacacugaaaaccaucaaaaaggaaaacauucagcaaaaggcacaguuggauuccuuuguuaaauccaugucuucucuccaaaaugaucgagaccgcauagugggugacuaucaacagcuggaagagcgacaucucucuauaaucuuggaaaaagaccaacucauccaagaggcugcugcagagaauaauaagcuuaaagaagaaauacgaggcuugagaagucauauggaugaucucaauucugagaaugccaagcuagaugcagaacugauccaauauagagaagaccugaaccaagugauaacaauaaaggacagccaacaaaagcagcuucuugaaguucaacuucagcaaaauaaggagcuggaaaauaaauaugcuaaauuagaagaaaagcugaaggaaucugaggaagcaaaugaggaucugcggagguccuuuaaugcccuacaagaagagaaacaagauuuaucuaaagagauugagaguuugaaaguaucuauaucccagcuaacaagacaaguaacagccuugcaagaagaagguacuuuaggacucuaucaugcccaguuaaaaguaaaagaagaagagguacacagguuaagugcuuuguuuuccuccucucaaaagagaauugcagaacuggaagaagaauugguuuguguucaaaaggaagcugccaagaagguaggugaaauugaagauaaacugaagaaagaauuaaagcaucuucaucaugaugcagggauaaugagaaaugaaacugaaacagcagaagagagaguggcagagcuagcaagagauuugguggagauggaacagaaauuacucauggucaccaaagaaaauaaaggucucacagcacaaauucagucuuuuggaaggucuaugaguuccuugcaaaauaguagagaucaugccaaugaggaacuugaugaacugaaaaggaaauaugaugccagucugaaggaauuggcacaguugaaagaacagggacucuuaaacagagagagagaugcucuucuuucugaaaccgccuuuucaaugaacuccacugaggagaauagcuugucucaccuugagaaacuuaaccaacagcuccuauccaaagaugagcaauugcuucacuuguccucacaacuagaagauucuuauaaccaagugcaguccuuuuccaaggcuauggccagucugcagaaugagagagaucaccuguggaaugagcuggagaaauuucgaaagucagaggaagggaagcagaggucugcagcucagccuuccaccagcccagcugaaguacagaguuuaaaaaaagcuaugucuucacuccaaaaugacagagacagacuagugaguagcuaguucuuucuuucugaucuguuuaagaguuuuugaaccuuucuuuaaauuuauuuuuauagaaaaggauaaacacauucuuauacauauuaucugggaacgcagggaaaguauuauguaucccacagguucuguuuggucuuagagaagcacagaaacaugauuuaaauugcuaaaccugccaauaccauuagaaaaaaaaucagaaauuuccuuggcacaaaacucuccauugguuauaaaaggacuaagagguggagaacuguuuuauauauuuuauauacacaaagacauguguaaauguuuccagaauuugucauagcuuaacugaaagaaaguaaaaggaucacuuagugccuucuuacagugaaguauaaggaucauuuagugucuuguuuacaauuuagcaauagauuaucugguagaauuuggagcagaaaggacucaguucaucucauggguaacucaacccuaauuugucaaaaauaaaaaaaagugacguaaaaagaguuccuuuaaauaaguugaaaugacuuuuuaguaaaguuuuauuugcaggcugaaccauuuacccacuuccuuuuaauacccaacauuuccaaugggagaaaaagcuaaagaggcuuccuaaugcugacauuugacagcuuuuaguaggagucaggaguuuaauccaggucucccaagauucaggggcaaaacuggaacuguaugagccaagccagguugucaggauucuacugcuccuaggcucaagcaguccuccugccucagccgcccaaguagcugggauuacaggcaugagccaccacucuuggcuuguuaggggauucuacuuggcaacauuacugucuucacuuucaugauagucuguuaacucuaucaaggcuuuguauuuguaggaaaauaggccaaauaggaaauaaauggaguuuugaaaggcuaggcuuuccauuuugaaaugugacccauacccagaaucugaaaauucuaauuuuuuuuuuuuuuuuuuaauugaucauucuuggguguuucucacagagggggauuuggcagggucauaggacaauaguggagggaaggucagcagauaaacaagugaacaaaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggccgaagauuuuuucuuaguacagaacaaaaugaaaaguuucccaugucuacuucuuucuacacagacauggcaaccauccgauuucucaaucuuuuccccaccuuuccccccuuucuauuccacaaaaccgccauugucaucauggcccguucucaaugagcugcuggguacaccucccagacgggguggcggccgggcagaggugccccucaccucccggacggggcggcuggccgggcggggggcugacccccccaccucccucccggacggggcggcuggcugggcggggggcugacccccccaccucccucccggaggggguggcugccgggcggagacgcuccucacuucccagacggggugguugccaggccaaggggcuccucacuucucagauggggcaguugccaggcggagggucuccucacuucucagacggggcggcugggcagagaugcuccucaccucccagacggggucgcggccgggcagaggcgcuccucacaucccagacggggcggcggagcagaggcgcucuccacaucucagacgaugggcagccgggcagagacgcuccucacuuccuagaugggauggcggccgggcagagacgcuccucacuuuccagacugggcagccaggcagaggggcuccucacgucccagacgaugggcggccaggcagagacgcuccucacuucccagacgggguggcggcggggcagaggcugcacucucggcacuuugggaggccaaggcaggcggcugggagguggagguuguagcaagccgagaucacaccacugcacuccagccugggcaccauugagcacugagugaaccagacuccgucugcaaucccggcaccucgggaggccgagguuggcggaucacucgcgguuaggagcuggagaccagcccggccaacacagcgaaaccccgucuccauccaaaaaauacgaaaaccagucaggcguggcggcgcgcgccugcaaucgcaggcacucggcaggcugaggcagaagaaucagggagggagguugcagugagccgagauggcagcaguacaguccagcuuuggcucggcaucagagggagaccguggaaagagagggagagggagaccauggggagagagagagggagagggagagggagagcgaaaauucuaauuuuuaagaugagcucuagugaaaagauuauuaccccuaacuguagagugaguuuuuccuuuuuauuguagguaauuguauucauuccuaucucacuuaauaucccauauuuauagacagucuuuccccuuuuguaauccgaacaaagccucucuguucaguuaugguuuuuacuuccaacauacacauacuuguuuauauuuuuuaaauaauuugaguuuagcugacuuugcccugggagcuuggccuuuugucugucuuuucagaccguaaaugcaaaagguucuauucaucaggaugguaugugccucaaagcuguaauuuaugauaugcugguauugauuaucuucuaagucaaaaucuuuuuucauggagcuguuaggauagauucugaauuagcuaacuauguuuaauucagugaauugcuuuauuauucuuaucuguuauaaacacuaggcacuaaacuuugcacauuuuugucugcuggauaguuacagccaagccaacuuuuuuauuuucguguuucuguaauucagagucauauuauucuguucccaaaugcucauaacugugauuuuauuuuaaccaucaagauguaucacuccuuuauucacagugugccucaaguauuuuuauuuuccaucuucaacauccuaagauaagcucuaacacuuuacccuuaaacuguucuaauaauguugcuuccagguuaucaucucaccaguauuuucagaccaucaccauauaagucuuucugaaacucuacuguauuacugcacuacucaaaaauauuuaaaaguuguacuaucucuagaauagacuuaguauucaaacccccuuuagucuggcauuuaagacccuguuuuuuuguuuguuuguuuuuugagauggagucuugcucucucacccaggcuggagugcaguggugcaaucuuggcucacugcaaccuccgccucccagguucaagcaauucuccugccucagccucccaaguagcugggacuacaccaugccuagcuaauuuuuguauuuuuaguagagaugggguuucaccauauuggccaggcuggucuuaaacuccuggucucaagugauccaccugccucggcucccaaagugcuggaauuacaggcgugagccaccacaccuggccaagacccuguaauuuauccauaccuuuccagcguucccuuuuacugcucccuacucauacccuucauucacaccaaacugaucuacucaguaugcaauaaucacaccugguacuuccuacuuacccauauuaucuucagcagccaaaauguucucccaauugcuuuccuuuuuugagugucuauuucccacuauuuaaaggucauuccagagcucagauccucuucuuacauuucgugauugccugauugucuuuugccuuuguacuucccuaguauuuuacuuaucauuugucccauauugccuuauuguguguguguguguguguauauguuuaauuucuguacacuauuuuuuauuuccccaauuagauugcaaacuccugguaagugucaugucuuauacuuauuuguacaucuuuagcauagaacugacuaagcagaugacauaucucuaggggugccuguauuuaucuauacucuccucauucugaaaaugacuugggguagcauauaaagauauaaacaauuuuucaagauaaaauaaaagggacugagaaggaggagaaaaagaggauaggcuagaaaaagaucaaaccaggaguaagguuagugucccaaggggaagucaccauauccuguacuguguuagaaagagggauccauaguuugcucugagguuucuauuagccaucagaaagagggaaugaaaaccgcaugcaugaacugcaguauuuauagucuaggagaaaaggagaaagaaaaaucaccuacucaagacaagaauagucuuuaaguauugaggccuguaagaaauuucuucuguguucccauaaagagaacacugugcaguugugaaacauccauuacuucucuacaguaaauauaauaauguguuuuuuaggguuuuuauuuagcugucccuuaauguaagugcagagcaaaagaauuacguccaguucacuaaaacuaccacuccaaggagcuaaaaugcagucccaggcacacagcuuucugaugguccauucuaggauaccucuagucuaguaucuagacuagaggagugaguggauugcauaaaggaauauguuuuuaccuuaaaucaaaacaaaaauauguuuugggguuuggguuaaaaauaaaguuauaugacccauauuuaauuagucacuaaauucuacaauguuuggugggaaaagcuaagaguagcacuaccucaaccccauuucuucugaggcaauuugcuuucaacccuuuuagcuuauucuuucaguauuuccuguguauguaaauaucaugcuuauauugcauuuuuggcucuuuguugcaucaacuauugauuuucuuuacacuaacaggguuuagcucucuguacucucccugcuuucacaguaaacccuguuaguguaugcacuuuuuauuuauuuauuuauuuauuuauuuauuuauuuauuuauuuagaaacagagucucgcucuguugccaggcuggagugcaguggcgccaucucagcucacugcacccuccaccucccggguucaagcgauucuucugccucagccucccgaguagcugggacuacaggugcacgccaccuugcccggcuaauuuuuguauuuuuaguagagacaggguuucaccauguuggccaggguggucucaaucuuuugaccucgugauccaccugccucagccucccaaaguguugggauuacaggcgugagccacugcacccggccagugugugcacauuuuaauacaaaccccuuccucauuuucuugauguaauuuaauuuuaauuuugguuaaaucaauucagaguuacauuuuuuaugacuacaaaugcuacuagagcguuagagacauguuacuuuuauuuuccugagucuuucuguuuuucccagauuaauaaguuuuuguuauuguuguuccuuaguuuucuuuguacuuaauguaauuuaaccucagauuuacugccauuuguccacaucuccuuucaagauguuuauucccaucaauuucaucuucaggaagaaaauucuccuggaguaccugauuugcuccuauaucaaccaguggcccuguacuccuaggauacccuuucuaucccagaauauuucccuuuaccuuucuccuauauuagaucuccuauuuugucuauucuauguauuccuuuucuugguuuugugccaucuuuuuccuggaauaaaucauucaguagaucccuaagaaaugguauguggaagguaaauuuauugaaaaugucuuuuuaucucucuuaucugauugauaguuuugcuggauauagaauucuaggcugaaaauaauuucccuucaaaauugugaagacauugguuuauugcuuuuuagcuuauaugugguucacaagucuaaagcuauucugauuccugauccuuuguaugugaucuguuucucacuucccuuccccucaccccaccuucccucccuuucuccccuauucugaaauuuuuugauaguauaauuugguauaggucuuuuuuucuucaucaugcuaacuaguccuuugaaucuaagaaaucauacuagcagcuuuuuggaaauuucauuaaauuauuuuuuaccauuuuccucuauccuuuuucucuguugucuuauuucugaaauguuuguuauuuagauguaggaccuucuugauugcuucucuaauuuucuuaacuuuucccuuuuuuuuuuuuuuugcuguauuucuggaagauuuucuugccuucgucuuuugauuccaacauuuuuuucauuuuugccauuauauucuuaauuucuaaggauuuuuuuucugugucucauagacagauuuucuuguuuuuuuuuuuuuuuuuuuuuuuuugagacggcgucucgcucugucauccaggcuggagugcaauggcaugaucuuggcuuacugcaaccuccgccuccugaauucaagcgauucuccugccucagccuaaugaguagcugggacuauaggcucccgccaccacgcccagcuaauuuuuauauuuuuaacagagacaggguuucaccauguuggccaggauggucucgaucucuugaccucgugaucugcccaccucggccccccaaagugcugggauuacaggcaugagccaccguccccggccgguagauuuucuucucuuucuaaggcuaauggugguaguuuuguuuuuugacguuuucuuauaaugaguuuuucuuuauaauuuuuaauuuaugcuguaauguuucuuauuuacaauguuaucucuuaaaucuuugaguacauuacauuuucuccccugauaaucucuucuaaauuaccuucucuaguugguuuucuucccuuccuuaauguuagccauucuucaggugaagguuaauccucaauguacucuucauguuuaaggggagggucuaaaaccuuguggguaggacuuaccaacggaguuucauugcaugaugaucuuauugagcuuauugguagcccuuaucucaguaucuuuaguuuuucuugggcuggucagauuuucaagagaagacuuuucauuuccuuuguggagggaaaaggccuuuuaccagcacucuucaagcucaguaggggaaagacuucaagcacucaggaagcaugcauucacuuuauuuggaacaauacccuuacuuguaacugugccucaggugccauaguccacagagacuucuuuuaccuguccagagaauaaaauuaguugucuguugggguaacaaaaaguguggagcugaagaggguaccuauaaaugaaguuguuuucuggccgggcgcaguggcucacgccuguaaucccagcacuucgggaggccaagguggagggaucacuugaguccaggaguuugagaccagccugggcaacauacugagacuccgucucuccaaaaaaaaaaaaaaaaaaaaaaaaaaaaauuaaaagaaauugcuucuuaagcagcuuucaucuagaccuccuuaucucagcuaucaccucccucccacccccaucaccaucuuuuccagaggugccugaugcuguuaauuccugagccuuuugaagauucugcagaguaaguuccacugauucuuggauuuucuuacuaccagcuuuagauucugcuuucucagaucuguuaagucaguuaccacuuacucaucugcuuuucagcuuccaaaauuaauuuuauugcugcugauuccucuauuguuuuuccuguucuuguguuuugugcuuuaaaaaaugcuauuauuuuagcuuuagcgaugucucuaagugggugaaagagguaugugaacaagacccccaucuuugcccagauguccugauauuauuucucccuuacuaagcuuuuaaugaguauuggagauaaagaaguugaaaauauaucugaaauguagguaggcaguguuguuaauuaaaggcaagucugucaucaucacuaacuuuaugugugaagugcauuaauuugcucauuuacuucucauauucuuaugaaaaagguacuauaauuaucuucauuuaauagaugaggaaaauuagccugggcaacagagcaagacucccucucaaaaaaaaaagaagaguaugaggaacaugcauugggucacacguccaagaaguaguaggauaucuaacuccagagccuaaguguccuuaaccacugagcagcacugccuucuuuauaaucaguauccgcuaagcuacaguuaagauugauagcccuguaggaaaguuaagaacccuaacaaggacacaugacuaguucuuguuuuaggaugugaccacccacagugaagcucuaggucucuuaagucuaccccacgucagaauuguagcccuaaagugaacuuaggaccuuaggagccaggggaaggaguagaaguugcaggaauagucacacccuguagccuugauggcagcuccaugggugauuuccaccagccuagcugcauguauuucacuacuuuagagacuuauguugcagugauaugucaucaguggacuguuaggugcugguuucauguuguggugucugacuacuuaguagggagcuaccaaugacuuacaguuagaugaaugagaugugacaaauaaucauuuuacuuucccuuugguuaaagcugaaggaauugaagaaucugcagcagcaauacuuacagauuaaucaagagaucacugaguuacauccacugaaggcucaacuucaggaguaucaagauaagacaaaagcauuucagauuaugcaagaagagcucaggcaggaaaaccucuccuggcagcaugagcugcaucagcucagguacuauauauaaucccuccuuuucaacucuuuucauuuuaacuuuuuauuuugaaauaauuguagauuugggaaaauagugcagagagcuucuauguacccuucacccaguuucuuccaguggugacaucuuacauaacuguagcacaguaucaaaaccaggaaacugccauugguacaauucgcggaccacauucagauuccaccaguuuuacaugcacugauuugacuaucugugugugugguucuaugcaauuuugugacauguauauuuaagcaccaccaaaaccaaaauacagagcuacuccaucaccacaaauacguccuuugugcuacuaguuuauagucacauuccucccuucccuaccuuccucacauccuuaaccccuagcaaccacuaaucuguguucaauuuugucauuuugagaauguuuucuaacuggaaucuugcaguauauaacccuuugaaauuggcuuuuuucaugugccauaaugcccuugagauccaucaguuuuguuguauguaucaauaguucauucuuuucaguauaaauaauguuucauauuaugaauauaccacuguauucaccuguugaaggacaugcauauuguuuuuaauuuuuagcuauucuaauaauacuacuaugaacauuuguguauaaguuuuuguguggaccuaaguuuucauuucuuugggauaauugcccaggagugcaaaugcuagcucauacaauaagugaauguuuuguuuuuuaagaaacugcaaaaccacuuugcauaauggcugaacaucuuuuuaauguguguauuugacauccauauauccucuuugaugaaauaucuguucaugucuuuuguccguuuucuaauuggguuaauuuuuuacuguuaaguuuuaagcguucuuuauauauuauagguaugcauucuguguuugauuugcgguuugcaaauauuuuuucccaauuugcaguuuaucuuuucaucucccucaacagggucuuuuuaauuuugaugaaauccaauuuauuauuuucucuuuaucauucagauuugguauuuucuauuugauuuucaaguucucugcuuccuaccuccauucugcuauggcacccagugaguuagcuuuuuauuuuggauauuguauuuuucaguucuaaaauuuccauucaguucuucuuuauaucuucuauuucuuugcugaagcuuucuauacuuuuuccaguauguuaguaaucgcuuguuuaagcauuucuaugacagcugcuguaaaauccuugucauauaauucuaauauuugugucaccucaguguuauaaacuguugauuuccuuuucuuaaucaaguugugguuuuccugguucuugguaugaugagugauuuuuaguuacauucuggacauuuuggagauuauaagacuuucagucuuauuugaaucuucuguguuagcaggcuucacugacaccacaccggcaggggaaggaagacacuagguggauggugaacuccaggcaccccauucaacuuucguugauaccccuaaaaggaagggaugcccugauacugccaggaggaaguggaaguccaugcuccccacauggccuccauugauacugugcuggaaggaguggagaggggcaccucauuauugccagguggugguaaaaguccaggcuauccgcuuagccuccacugacacuauggggaaugguuaagaggggcaucuuguuaccacuggguaguacucaaaguccagaauccccacuugaucucuucugauaccaccucugcagggacaaggaagagugccuuauuaaccuuguuaugguggagggggauguccaggccccacauguugccuccacugauaccacagugggagugggggaggaggggcagucggagagaggcaccuucuuagcacuaggugauuguaagaguccaagcuccauaccuggccuuuucugacacuacuccaguaaggagggugagguguaccuuguuaccaccagccaagaauguaccuagcuuaucuaccaggucuuuguuaaugggaguggugagauacuguguuuuuuccauguuguuugccuggaguauggugguuaguaucauuaauggcucugucuagcuagacugucccuuccugguccuuuggcaagacugaguaaacuugguacucauugguguuuccgggucauggaauucuccaguauccgguuugggauaugcagaauacaaaugguaaaccaaagaacuugccaccaugucauuccucaagucuggggaucccuagcugguuugccaccaucuuucuaaauuuucuuauguuuguuuuuauuuauaaggcccaagaguuuuaucuaugcagguuaaguauuccuuaucugaaaugcuugggauuggaaguguuuuggauugcggauuuuuuuggauuuuggaauauuugcauuaucuaaugagcauuuccuuugagugucaugucagugcucaaaaaguuuuggauuuugaaguauuucugauuuucugauuaggguugcucagccuuaguuggaagaauaaggagaaaugugucuauuuuauuuugucuagaaccagaaauccuagcucuuuucuuuuuaaggaacagaacaauaauaaugcuaucauggcagaagaaauuaagauaggagcuauaauucugauuuuuuuuuuaauucaguuuuucugacaaauuuaaucccaagauuaaacacuuaguguauaaaaacaggucuaguuguugcagccucauuuuugggagguuguuacuguuuaacuuaagaugguucaugcugccuuaauaaauucauacuuggcugggugcgguggcucacaccuguaauccuagcacuuugggaggccaaggcagguagaucaugugaggucaggaguuugagaccagccuggccaucucuaccaaaaauacaaaaauuagcugggcaugguggcgugcgccuguaaucccagcugcuugggagacugaggcaggagaauugcuugaacccgggagguggagguugcagugagccaacaucaugccacugcacucuaaccugggcaacagagugagacccuguuucaaaaaaaaaaaaaauucaaaaagcuuucaagauuugauauuaaaaggagaauuaccauguuggacauugcugcugaucaagcagcaccugcuuuguuucaccaaugcuagaggacaagaggcaaaugaauacagaaaauaugaguuggaaucucaauuucuauccagcuuacaaggggccauuagaaugacaacugucaauauaguauaaauaucauaacaucucuaagagaguucuuaauguucagacacaggagauuucaaaccuuaagcaacauugauauagcaaaaugcuuuuuggaauuuaaugauuuaaacuuuauggaguaaaauuacaucuaaaagauuuucauauuuaacaucuuuauggacuugauuauaagugaacauuuaucaagcucauugcauggaguuggcagcuuccccagauaauacaagaacaaauuuuuuguuuaaacaaaugaugaugauugcagagcaaguaaaaagaaaauggcaaaacaacugaguuuugcucucuagaaauauaaauuuguuucuucuuuugaaauugaaucucaagagaaaagauaaauugcuccauuuuaaccuccauuuuucuucagggaauagcaccccagcuuuauucuguuagaaucuuaauuuaucaucagaaguuuaggugcuugcuguguccuucagaugcacuugaauuuagggcccuccaaaggugauugguaccguaucagagcaucgcuugaugccucucaucuuaucuccacaucaccuagaacuacagaaauauuaaaguguucagcuacuaguguaaaccuaagaagagcugcaaagcucuaaaggcuuauuuccugcagccuuucuucuuuaaauuuccucuaauggcaaucuaaaaggauauuuauuuuccuuauuuccuuauauaauugacccuuagggaagagaaaaggagauagagaaaaaaagauuccuguuuuuucccccacauuuucucucuuuccaccuuuuucuuagccuuucuuucuuuaccuuccagauuugaguaacuuugaagauaagcaaagugcugagguuacaggugcgagcuaccaugcccaguuacaaguauauuuuuaccugugauugugucauguuuuuucuaggauggagaagaguuccugggaaauacaugagaggagaaugaaggaacaguaccuuauggcuaucucagauaaagaucagcagcucagucaucugcagaaucuuauaagggaauugaggucuucuuccucccagacucagccucucaaagugcaauaccaaagacaggugaguaauuucaaugcugauuguuacucagagauaaauuuuuaaacaaaugaugaugauugcaggguuuuguuuuuuuuuuaagacgcuacccagaaagcaucagcuuccuacaaauuaagugcccaucugccacuauuaagugcccauaagccaccuuaugacuucuauggggcggacaggauuucuagagggaaggaauuaagcaugcgcaaucuuaggagagaaucugaucaauguuuguguccuggcaggcauccccagagacaucagcuuccccagaugggucacaaaaucugguuuaugagacagaacuucucaggacccagcucaaugacagcuuaaaggaaauucaccaaaaggaguuaagaauucagcaacugaacagcaacguaaguguuucuuguuagacuggaauucaguuucuuuuuuccaugacuggaacaagaaggcaaguagaagccaauucagcauagagucccagcuguagcauaucuuaggguacagaaguuucaccuuucucagaaccugggugcuuauuccaaagcacuggacacagggccauuucuuguccuuugcccuuggugaguccuugggaaugauuggauaaauccagacaguaaaaguaaagaagccaacuacuuuaggaagccuucccccugaccuguaucacuuguaguaaugcugaggcuacucccuaccccacccucuuaagaauuguccuccuguuguucacugacuauucaaaauauucuuuaguggcaccugcccuaguucugcccucuugagaggaacucagcuaaguagucuaugauagaacuacaagauauuuagagaucaaucagaaucagaaguccagagauuagcuuugaggagagccaagaaugcccaaaaauuguaugcacaauagugugugugugcguaagcuuuucaucacaagaacucaucaguugaccaaggggucugugauccaaaaauuaaaaagaucacuaggcuguuuucacagaugaggaaaaaggcccuggaguaguaaguaacuugccugagguguuaggacgaagucagucugaaauaaacgugaucaugcauguggaaaagcacagugccugcauauguagaggguacuuauuaaauguaguuaaauucaacuaauugacacugaaguaucagagaggagacauuugcaguuuuuaaagucugcaggcccaaaugaauuaguuaaacuguagacucuuuauugguagauuugucugggaguuuucaaagggacuccagagcagcucccauggaguuccccuuccagcaaaucagcuauuuccggaaguuccacccuuuacagcucuagccugucucuuuuuuccgucaacuaacucccgucucaggccuguuacauuugcucuccaaacauuagacucugaaucacauugggcauuugucugucuaggacaguguuuuaaacugaaauucaggaccauuaauaaaugaugaaaucauuuuggugggcaacaacuaaaaaaaauuuuuaauguuuuauugaaguaaaacauacagaaaaguaaacaaaucauaaguacagcaugauauauuuucacaaagugaagauacccauauaaucagcacccagaucuagaaucagaacauaccagaacuccagaagucccuugugucuucuguucacuccuacccacuuagaacuacauauaaauggagucauaccuuuucuuuuauauugcuucauuuauuuugugagauucauccaugucguugcauauagugucauuuuuccacucucaugcuguguaguauugcauuuuaggcauauaccacaaucucuauucuguugaaggacauuugggcuucuccaguuuggggcuauuacaaauagugcaguugguguuuuuacaaaaaaaagaaaugagguaaaaacacguauguaauauauaauaaagaauaugucugucuuuggaaaacuuuaguuuuaauuguauauauuuauauacuggguucuaagucauaaaguuguguuuuuuaacaccuuuauugagauauguaauuccacuuaaagugugagaaacacugcauaggucacugucauucugagugagaaacaguuuuuccuuuagaacucaacuguaagaaaggcaccucaggccgggcgcgguggcucacgccuguaaucccagcacuuugggaggccgaggcggguggaucaugaggucaggagaucgagaccauccuggcuaacaaggugaaaccccgucucuacuaaaaauacaaaaaaauuagccgggcgcgguggcgggcgccuguagucccagcuacucgggaggcugaggcaggagaauagcgugaacccgggaagcggagcuugcagugagccgagauugcgccacugcaguccgcaguccggccugggcgacagagcgagacuccgucucaaaaaaaaaaaaaaaaaaaaagaaaggcaccucauuccuagccuuauucagucauuaaaacaauaacuauuauuugucuuccaugagccuggcuauaugcuagauacugaggauauacauauuccuucaugagcuuagccucacucugaaugagucccagcuaaauaggagaauugcuucuugggccccagaaugagauuguaguagaugggcugucagcauagauuguucuucucuaagccacuucccuaauucuuucuucagauguucagguuuuauauuuauaguuggcccuucauauugguaauuucugcauucacagauuuaacuaacuguagauugaaaauauucaggaaaacaugaauuuuaaaaauacaguauaacaacuauuuauauagcauuuguauuguauuagguauuauaaguaaucuagagauuauuuaaaguauaugggaggccacagguaacauuguacugaacagggaaaaauugaaggccuuuccucuaagaucugaaauaagacaaggaugccuacuuucaccacuguuauucaauauauuauuagauacccuagcuagagcaauuaggcaaaaacaaaacaaaaaaaaaagcacauccagauuggaaaggaagaggucaaauuagccuuuuuugcagaugauaugaccuuauacuuagaaaaaccuaaagaauccaccaaaaaacuguuagaacugauaaaugaauucaguaaaguugcaggagacaaaaucaacaggcaaaaaucaguagcauuuauauaugccaacagcaaacaaucuggaaaagaaaucaagaaagcaaucccagucagccaugguggcucaugccuguaauccuugcacuuugggaggccaaggugaguggaucacuugaggccaggaguuugagaccagucuugccaacauggcgaaaucccuucucuacuaaaaauacaaaaauuagccagccaugguggugcacgccuguaaucccagcuacucggguggcugaggcaugugaaucacuugaacuugggaggcggagguugcagugagcugagaucgcaccccugcacuccagccuaggugacagagcgagacuguguuucaaaaauagauagauagauagauagauagauagauagauagauagauagauagcaaucccauuuauaauagcuacaaagaauuuaaaauacuuaggaaucaauuuaaccaaagaaaugaaagauuuauaaaacacugugaaagaaauugaagaggacacuaaaaaaaggaaagauauuucgugcucauggauuagaagaauuaauaucauuaaaaugacaguacuacacaaagcaaucuacagauuaaaugcaaucccuaucaaaauaccaaugacauucuucacaaaaaugggaaaaaaaauuuaauauguauguaaccacaaaaacuccuaacuagccaaagcaaucuugauuaaaaagaggaaaacugggucgagugugguggcuuaugccuguaaucccagcacuuugggaagccaagaugaguggaucaccugaggucaggaguucgagaccauccuggccaacauggugaaaccccgucucuacuaaaaauacaaaaauuagcugggcgugauggcgggggccuguaaucccagcuacuugggagacugaggcagagaauugcuugaacccgggagguggaaguuacagugagccgagaucgcgccacugcacuccagccugggugacagagcgagacuccgucucaaaaaaaaaaaaaaccaaaaaacaaaaaaacacacaaaacaaagcuggaagcaucacacuaccuguuuaaugagcaugauacuggcauaaaaacagacacacagaccaccaaugaaacaauuagaaacccagguauaaagccaggcauuuaggggcaacuugucuuugacaaaggcaccaagaacauaugauggagaaaggacaaucucucuaauaaauggugcugggaaaacuggauaucuauaugcagaaaaauaaaacuagacuccuaucucucaucauacaaaaaucaaaucaaaauggauuaaagacuuaauucuaagaucugaaacuaugaaacuacuagagcaaaacuuguggaaaugcuucaggacauggaucuagccaaggcuuuuuuuguguaaguccugaagaguacaggcaaccaaggcaaaaauagacaaaugggauuacagcaaguaaaaggcuucuguucagcaaaggaagcaaucaacagagugaagagacaauccacagaaugagagaaaacauuugcaaacuacccaucuaacaagggauuaauaaccagaauauauaagggacucaaacaauuaaauagcaggaaaacaaauaacucaacuuaaaagugggcaaaagaucugaauagacguuucucaaaagaagacauacaaauggccaacagauauaaaaaaaaauacucagcaucccuaaacaucagagaauuguaaaucaaagcuauagugagaugucaucucaccuuugcugaaauagcuuuuaucaaaaagacagguaguaacagauucuggcaaggaugcagagaaagggggaacucccauacacuguuagcaauguaaguuaguacagccacuguggagaacaguauggagguaucucaaaaagcuaaaaauagaacuaccauaugauccagcaacccacguaucuacaagaaagaaaaucaauauaucaaaaagacaucuguacucccauguuuauuggagcacuguucauaaaaaacaaaacauagaaucaauguaaguacccgucaacagaugaauagauuaagaaugugguauauguacacaagggaauauuauucagcuuuuagagguaugaaauucugucauuuguggcaacauagauggaacuggaggacauuauguuaagugaaauaagccaagaacagaaagacaaauaucacauucucacucgugugggagcaaaaaaaaaaaagugaaucucaugaagauagagagugcauugguaguuacuaaaggcugggaaggauaaaggagaggagggaaugaagagaaguugauuaaugggugcaaauacaugguuugauagaagaaauaagaccuaguguuagguaaaucaauaggugauuauaguuuaccacaaucuauuguauauuucaaaauagcuagaagagaagaauuuaaaugcuucuagcguaaaggaaagacaaauacuuaaggugauggauauuccagauacacugauuugaucuuuacaaauuauaugaauauauuacauuauagcauguauccugaaacuauguauaucuauuauacaugaauuaaaaaauuuuuuaaguaucugggagguuguguauaaguuauaugcaaauacccugccauuauauauaaggaauuugagcguccucgaauuuugguauacugggaguuggggguccaggggugguucugaaaccaauaccccauagauaacaagggaugacugcauuucuaccagcuguuuggauguuaguauguaauguaagaaugugcuagaaacuuaaaaacaugagauggaugauuagugacauaauguagucuaaauuguucccuccuauuuuguuuuuacagguauagauacagugaaauauaguagcuuauaagcuagaggagaggucagcaaacuuuuccuucaggcucagacaauauuuuagguuuguugacuguauggucuuuguuaacaacuacucaucuuugcaguuguaacacaaacgcagccauagacaauauagaaucaauugggcugguuguguuccaguaaaaccuuauuuaugauaaaagggcagcaggcccuggaucauaguuugccaaccccuaaacuagaaggaucuauguuuuuguuuuugguaugguuuggacuguucauuguggccaggaaaauuaacuuccucuuagguuaagggaagaacauguugugcccugucucagaauccaauaguugucauuguacccaguuaacugucuucaaauuaguaucacuucccaaauauuuauauccuuuccuaacuauucccaccuccucccacacccccccccccaaaagaaaacccuaugauuuucuuagcuuuccuugcuagacuaucagacuggacaccaucagauaguagauagagcucuagacuuggaaucaagaaccacacuugaguccugguuugacaucuacuagccauuuguaaacaaggacagaaauccuuucucuaccucucucaaauaagaugauacuggugaaaguacuuuguaagcuaacauugcucuucagaaugacaaacacaaaaaacaacccuacaucugaagagcaauuuucagcuaacagagcacuuuuacaaguauguauggauuaucuuguucuaauuuucuauuugcaucaaaugcccuuccucacaguugucucuagaaaacugucgucucuccucuaaaacauuguuuguuucaacuuuuuuucacaaaaacuuacaaaaaagaaucaucaagaaaaaauugaacaugcaacugguauacuggguuccucucauauaauguacaugguccuagaguagauaacuuggagagacaucuccaugguuauuaauguaccuggaggcuaaucacagcuaaaacuuaaaacuugacagccugcaagugagagaauuauaguuccagaguaccaaauucaaaucaauggguagaagcuacaauagguaaauuuuucauucaauauaaaaaugaauuuucaguuuuuuaaaugguuuggguugcuuugucaggcagugggcgcccugacacugaacauguucaagggaagacugaacgaugaccuguuagucaugcaguagaggagaguccugcuuuaagggacugaaauguuucuaccugggagaaucuaugcucucaacaguuucugacauauacauauacauguugggauuuauucuguuucucccuucuaccacauauuauaauuuuuuauucuauucucucaguaacuuauaacucuuuauggcauugaggaaucugccuaggaauauuauugcacagauuuuggggugacagcucucuccagccauauugaguucuggagauuauagucauuuguuaguaccaugaacuuugacccugagguacugccuucucccucuuauguacccagaauagccuauguaauuagauugcuuauggacuucugcuucaugguuuuucaguuaauguacugggcaccauuuaaaaaaacaaaacagaacaaaacaaaaaaaccuuucugcuacuccuccagaauuguuuucugucuuggucaaaaaaaaauuaugcuuuuuccaacuuugaaggcacacaaagugcuauuguugcuguugcugaaacaaaggucuuccauaggaaaauuagauccugaaaacucagaacauuucaccucagcacugcuuacaguacugcaggaugaugcuuauccucgccucuguuucaguucucucagcuacuggaagagaaaaacacccuuuccauucagcucugcgauaccagucagagucuucgugagaaccagcagcacuauggugaccuuuuaaaucacugugcagucuuggagaagcagguucaagagcugcaggcggugaguaaagagaaggugagagacugggagaagugugaugaaauuuagugcaaguggugaagcacuacagagcaguauggaagaaguuaauguaauuaggggucagggaagaaagugggagagaagaaagaguuaauugagaugggaauaaggucugagaaaaauuacagugaagcaauuagaagaaaaaagaucagugagauggugggagagaaaucaaaacaugaguaggaaacagugaugacugagacauuugguacucugaaacagagaaaguguugauuuugcuuuaaguuauaagaaaauuguaggaaacuuuggaucugagaacaaaacaggcagcacuguugacagccagggagaggaguacagcauugaaguuggaggagacugagaauuaguauggagacguauaggauacggaggaggaaaaggggguugggaggggcuggacaagcaagggaaggaucaaaguggcuucuggaaaagccauaagcauccacagcagacuuaacuuuuuuuuuuuuuuuuuuuuuuuugagacggagucucgcucugucgcccaggcuggaaugcaguagcacgaucucggcucacugcaaccuccaccuccuggguucaagcaauucucugccucagccucccgaguugcugggauuacaggcgccugccaccacacccggcuaauuuuuuguauuuuuaguggagacaggguuucaccaucuuggccaggcuggucuugaacuccugaucuugugauccacccaccucggccucccaaagugcugggauuacaggcuugagccacggcgcccggcccagacuuaacuuuuaagaggagaaauucaagaaugagaaucugggagaaaaaucuaaucaagacaagaguuuuauguaggugaguaaucugcuagagcagaagcuucucacuucuaaauuuggacuugagaauuauaagcggggauaguccucuguaaacgagcucucauuuugcucaaauacacuuucuuaagagcuuucaucacugaauuacuaagcuuauucuucuuccaggggccacuaaauauagauguugcuccaggagcuccccaggaaaagaauggaguucacagaaagagugacccugaggaacuaagggaaccgcagcaaagguaggggaguggcucucuaaacccuggagcauacaccagaguccagaaauugggcaguaaucuagauuuaacuggaguccuuuauauggauuuaauaugucuuguuaucuuauuagccucacagaagugaugugaggaucaaauaguaacaauaauaacuaacauuugugugugaaaaguuuguaaaacaaaaagagcaacaccaacacacacacaccacuaacaacuacucuaugauaguaaaaugaaagauaaucaguuccugaaauuucuuuagguauuuucugcagcuucauuuaaucccucuacagcuuugcuuuuaaaauauuguguuuagacaagcuucuauggauuuucuugcuuuacaaccuuaugaagacuuugaaucccuuguauuagcaacuguuuucugcaucugaugaugcuuuuuguuuuccucucauccuaaagcuuuucugaagcucagcagcagcuaugcaacaccagacaggaagugaaugaauuaaggaagcugcuggaagaagaacgagaccaaagaguggcugcugagaaugcucucucuguggccgaggagcagaucagacgguaaaggcugaaggagauagccucuguucccuuccgauccuuucugaucaaacucauguacauuuccugccagacuuaggauuucuuaagaucuuuuucucaucuugagguaguugcugcaaugaguuuaccaacauuguggucacccaagagaacacuguacuuuuggaguauaagagagucaguguuuucuaaaacaguuguucuuagagaauaauaaugauaucuaccauuacugaaagauauuuuauuucacccuaaccauaacuauaugagguagguguuggguucucuagaggaccaaauaagugacaaccucauuuucuaccugagaucugaauccauggaaaucuuuuuuaaaagauuaaaagauugagagauuaaaagacugcuuuauaaaugauguuaaaagaauguagcuuuuuauuuguuggcaaaugcacuuccuaacccugaacuuccccucccagucacagacaauguugggccaagguagaccuccuucacagaaaauccugcucuugccaaacaagaguauuggaauaacagagugaacugugcuuccuaugagcaguuugcuccaaguguaauuuggaagggcagagcuacacaucccuaguuccuuauucucaucaaaagaaucacuaugcaugagaggauagagaguugcuacaaguauuuugcugcuggaagucccuuuccacggaaaauaucguuaaaagcaggcacuuuuauuauauuuugggagaaagccaccuauguauaugaucacuuuccucagagaaugacauuucugauauuaaugcuuucuuguaaaguuuauguggcagaggugacagccccauugagcaggucuuacuugagauaccuuucuuuccaauccaacauauucacaacuucuuaauuuucaucaccuauucaggccuugauaugcagcuuugagggugggccagcuuugcuuaaugccuuguguggugucuugccaucucugccgagcauuuucaggccugugcccucaugacuguuucucuucuacuugcuauugaauuguuuagaccggugaaaccuggccaauggggagguugaucucccucuuguguaacuaaccugucccaaaccaacugagacugcaugugugggaugaugacucuugagccugugggcaagccguauuaauucaagccacaauucccucuuuagcucugaugcagaauggaaguugggguagcuaauuaagggcugccugccuaguccagguacugccauuguaauguuagaaucucacauguacucuaaagagcagguggaacucaguggcccuccaguuuaaaggcagccaguaccaucuuccucaucaauaccuacagacuucucauccuuccucagcauagccuacauugacagacugaccuccauaguaacagaccaugcuguuccagaucaaagcugcuucugaaaagcuuaucacauggaggaauagacacagaagguguauuuuuuagucagccuggcucucaggagggaagcaggaaagaaggagcuaggcugugcaugcucaguucucuuucuagacucacaaauuggauuaagguguuucuucucucccggggaaaagaauguguccugcagagagcccaagaauauuaaacuaauagauauccuuucagaaggagaaaacacaaagaguagaggcaagaguuucauccucucuucccuauugaaaaaguucaucccuauaggcaaaugcuugaucaaacgugcuguguuacaugcagcuccuuuguuuguuugacauaaccauugagugaguaauggcagcuucuucauuaaauggagaaguuccaguauuaaauaagcaaaucagcaaaaacugagccagaaggcaguggagacugccaauucaauuuaauuuuuuuuaguucaauuuaauuuuuaaaaccccacagaaaucuucuuuggaugcuuuugccuauuagccuuuaauaaaagaaaaaaauguaaugaguuucuccaagucagguguggugugguggaaaaaagaacgugaggcuugaaagacaaaguuggguauugaauucuggcucugccgcuuacuggcugugccgccaugggcaaguaauuuaaccucuguaagccuuagcacuuugaagauaauaagaccaaccucagaaccugaggauuaaauguauguaaagcacccagccuagagccugauacauagugaguaggcagucaauuccugauaguuauugucacauuuugcugcugcugaaggaaacguaucugcugguaccccccuugcauggguuuggguuuaugggagcagcuuuugcugcaagucuccuccugugcugcauuguguggcaggaugacugggaagacugggccugaucagccucucaugcuaugaaccaaugcuaugccucuuuuuuuucucaacucagguuagagcacagugaaugggacucuucccggacuccuaucauuggcuccuguggcacucaggagcaggcacuguuaauagaucuuacaagcaacaguugucgaaggguaagaggaagaaggauaaagagaggguguuuuauuaucugacagggcuggcuauacugggggcaaggagcugaggagaaggaauguggaaguccagccacugagcagcgaaugagucuaaggcuggaagggcguggaagauuagaaccugguggaauuugccaaguuguugacucugaggcaacuuuccucucagaauaccccuuucuacagugguugggucagcuuugcuuaagugcaagacuaguaggagggaaagcaacauagcccuauagggugaaaacucucugacuuucacauuuuucuuucagacccggaguggcguuggauggaagcgaguccugcguucacucugucauucacggacccgagugccacuucuagcagccaucuacuuucuaaugauucauguccugcucauucuguguuuuacgggccaucuauagacuuaguuguuacucuuuggaccacuccccucaaaacuuggaauucucucaccucuaacaucagaacaucaauuccaguggaacagucuucccauuuacaggucuucucuccaacucuucacggaaagugccugcaaaaacagagguggauacgaggacagguuggagcugcagggacuggcgagucugcuuucuucuacugcccugagccugaacgcuucugcuuaaucugagaaucacauuugguuuguugagccuaauauuuguugagauuuugcaggacccugaucuuuugugguccuguaaaagauacugaggaaugucuuucagccaagccaagaggaugguuucaauaaaccuaauaaucugaaguucaguaucauuuugauugauaacuuucuuugccuuguuugccuguauuuucuccuguuucagggggaagguggcucugccauaaacagaguucagggaaaugaacaugucaccucauaggacaucugauuuaggucucuugcagaauaggguggugaaagcugaaggaacucccuagggguuuuagcuguuagaucacaugggaggacagcaucuucuucccugccaauuucagauauaauuggagggagaauuucaggucuuagacuauaaggauagaaucccuuugcuuuugcccuugaucacauguauacuaagguauuaaguggcccaagucuuuccuuucaccaaagggcagggagaagugucuauggacagcaggguuccaauucuugucauuccaggaauaucugaauauuccuggaauguggacccugagacagugcucaggggccacugggagccaauauuaggcauugacucucagccaggagucugacuggucuaacaccacacugcaacuccugaccucuugaaguacuaagcuacuuugcuguuagugacaguuauuacaguuucucagccccauugucucugcccucuguggcaauggaaggagaauauagagaagacaaaauuaaauauagauagaccugagaaggacagccaggauagaauuccauuugugccuauucccugccuccccuccccucccccauccuaccaguugguuauuuucucauugcauacgugauguguucacugccuagccucucccuaaagaagagagaagacaagugggcugacugaucugcucuaaaucuacuguggugauuaaaucuugguuacaacauccugggaaguuuccugaacaacuguaaaauaauaaaauuauuuucagaaugaagagu

SEQ ID NO: 18109 - RNA, 53940 nt, Homo sapiens
uaacccagggaaggcaguggcaagauggcgucccuggaucgggugaagguacugguguugggagacucaggugagcggcuuacccuaccucuggggcuccagacacuuuugaguuacccaguaacccuccccuuagcuuccuucccucaacuuccuggcuccucggcccguggcugaagucccucccagggccugaagacuacacuucccaggggacuuugcuccgugugacgacgcgguggcggcggcgucgucgcgcgggugggggucgcggagcccgggucuuuugccuucgcggcuuuccgcaucggucucccaggcgaccccagccuagaguguauugucaauucuuuuauuaaaaaaaaaaaaaaaaaaagcaggcauugaguauuguaugggguucuauguuaaggguacagaaguuaguaggaccgugccuucaagagauuuuguucauuaaggaagucaaacgugcacugagaaacgugcacugagaaacgugcacuggcaagcgcuucgcauguauuaacucauuuaauucugagacaguccuguuaucccauuuuacagaugagaguagugaggcagagagauguaaaugacagaauccuuuugaacgcggaguccacgaacuuaaacgcuaaguuauaauuaugcagugacauauuggguagugguccuguuuuauucuuaacugagcuuaauuuccugguucucguuugaucuucauugaaaaccuauuauguccuagacuguacaauagagaaauuaaaguaagaguuuuauucugaagcagcuaggauuuaacgcugagcccaauuuaauccuaguguuaaauauauauauauuuuuuuaaucucaguggaugcaaaaagaauucuuuugacaccugggacauuugagaacuacagcuggcgucuggauuuccagcucccaccucacugcccuuaucuuuucuuccauaauccccaauucagcucuccuuaguaacuucaauaaaugcugaccuugcauuuuauagaagcgcuccucuggaguuggccuaagagcauguguugugagcaaagacguugugcuagaugcuuggagguggagaggcuugaaaacuuaauagaaacuaaauaaaauugugggcagcaaauauagguuaagaauguuuucacauugcccugaggauuauuugcauuaugaaauauuuuacagagagcauuauuuaauauuccccuaagaaaguugccuuuugaaacuuaaugaacauaaucacaauuuaugucgacuucauuucuaucagguagcuugaaguggugccgaaguuaauuuaauaaaaucacucaguuuuacagauaaaguaauuguggccuaaagggacuuggcaagaguaucacugaguagaauuuacaauccagaacuaacagacuucuucaugauacguuaaguggguguuuuguguccuuuauaauuccauuuucuauuguaucuaacaaucccuucauauuacaaacuguugcaacuagucaauuuauuuucuuuccaacaggcacuguauuagguucugggguuauaacuguggaauuaaugcgucauauaacagggauagaauuagcagcuacauuaaauguggaaaaguaaucaggcaauugauaagcuucccuacugcccgccuccccuguuaugguuuaguuguaaagcagaagacacagcugugauggccaggaaagugauugauguugucacacauucacuaauguuaaccuuuaugugcaaaguuaguuauugucuuuuuaucuuuuuaaaagguaauuuugucagucuccuuuuaacugcgauuuaaaaguacacagucugacaguuuagaaugcacuuuuuacacuuccucagccuuucuuucaaacccgaaaguuuauuuuuaaauaaaggccauuucccuuauaaaauuuugaggguuucacaaauauauaaagaaaugacuuagccagacaagguggcucuagccuauaaucccagcacuuugggagguugaggcggguggauugcuugagcucaguucaagacuagccugggcaacauggcaagacccucucucuaccaaaaacaguacagaaaguuagccgggcaugguggugcacgccuguagucccgcuacucaggaggcugaggugagaagaucacuugagcccaggaauuugaggcugcagugagcuaggaucgugccacugcacucuagccugggugauagagugagacccugucuccaagaaaaaaaaauaaaaagaauaaguugauauuuggugauuuguuuuuauccuauugagauauuugguaauuugguaaggaacccugaaagucucacuaccauacgguuuucucuuucuuucagagauuagggacuaguuuaacauauuaccaaacagcuguauuuggagcugacauuuauuuauauugggccuuuuuuacccccaagcaaaucaagugcauucuuuugaucaaauuuaguucuaaaggugaaaacauagaaucagaaucucccaaaauucuuaaagaaaugaaauucgccauuauucccuagcacuucaacuguucuuacuguuuaggguuucaucccuucuuagcuaauacuuaucacccaaagcaguuaauucauggagagcuauacaauucuacugccuggaaauguuuacccuaacacaauuaagcuaaacuaggccucaaguguugcaucaagcugauaauuaaguggauagauacauuccuugaacauaaacaaaccuauuuacaaauacagaaucaacaauacauccuaaaaguuacagauauuagacacaaugcaguaaauucaaugacaaauauaauuuugaguauuuaaaaaucuuaaauguuucuauauaaaaaaaguaauaaaagggaagccugagaaaauguuugauucaauuacacauacguaaaaugauuaauauauuuaauagauaaagagcucauauaaauuaaugacacuaaaaccugguagauaaagguacagaguagaucaacagagaauuuaugagaggaaaaacaacugauuugccagaauaaucauaaugauaaucuuugaucuuuaucagaaaguaaagaaaugcagacuaaagcaagcugucacucccccacugcccgccaccaccgagacggauuguugcucugucacccaggcuggagugcaguggcgcaaucucggcucacugcagccucugccuccuggguucaagugauucucuugccucagccucccaaguagcugggauuacaggcacccaccaccacgcccagcuaauuuuuguauuuuuaguagagacaggguuucaccauuuuggccaggcuggucucgaacuccugaccucgugaucugccugccucagccucccaaagugcugggauuacaggugugagccaacgcaccuggccaagaugucacuuuuauuccuuuaucagguuaacaaggaugaaaagccaacuacaugauacuguugaggugcaacaagaccugcaggcucaaguguauggcugguggcaguauaaccccaugaaaguuauuucucaaugcauaucaagaacuuuaaauguuuccuuuuaaguacugaguuuacuccugggaagguauacuaaggacauaauuuuaauuuuaaacaaagguuuaaacagaaauaaccuuucacuagcauaucaaaaauuucaaaacacccuaaauaucuaauaauaauggaagaaugauuaaguaaauuuuuaugccuacuuucugaaguacuauggagauacuuuaaauguuuaugaagauuuuggaauaauauggaaacuuuuaauaaauacuaauuaagguucugaucuaaauacuagagauaaaaaagcugcguaagaacccucaaggaacuuaaaauuaagggagugguuccaagaugaccaauuaggaacagcuccagucuacagcucccagcgugagcgacgcagaagacaggugauuucugcauuuccaacgagguaccaaguucauuucacuggggcuugucagaccgugggggcaggacagugggugcagcccacugugugugagccaaagaagcgcaaggagucagggaauucccuuuccuagccaagggaagcggugacagacagcaccuggaaaauugggucccucccacccuaauacugugcuuuuccaauggucuuagcaaacagcacaccaggagauuauaucucugaccuggcucagagggugccacacccacggagccuugcucauugcuagcacagcagucugagaucugcaagguggcagugaggcugggggaggggcgcccgccauugaugaagcuugaguaaguaaacaaagaggccaggaagcucgaacuggguggagcccaccgcagcucaaggaggccugugugccucuguagacuccaccucggagggcagggcauagccugaaaccucugcagacuuaaaugucccugucggacagcuuugaagugaguagugguucucccagcacagaguuugagaacagacagauugcccccucaagugggucccugacccccgaguagccuaacugggaggcacccuccaguaggggcagacugacaccucacauggcccaguaccccgcugagaaaaagcuuccagaggaaugaaugaucaggcagcaacauuugcuguucagcaauauucgcuguucugccaccucugcugcugaugcccaggcaaacagggucuggagcggaccuccaucaaaauccaacagaccugcagcugaggguccugacuguuagaaggaaaacugacaaacagaaaggacauccacaacaaaaccccaucuguccgacuccaucaucaaagaccaaagguagauaaaaccacaaagauggggaaaaaacagagcagaaaagcugaaaagucuaaaaaucagagcaccucucccccugcaaagaaacgcagcuccucgccagcaaaggaacaaagcuggauggagaaugacuuucacaaguugagagaagaagucuucagaugaucaaacuucuccgagcuaaaggacgaaguucaaacccauugcaaagaagcuaaaaaccuugaaaaaagauuagcugaauggcuaacuagaauaaccaauguagagaaguccuuaaaugaccuguuggagcugaaaaccauggcacaagaacuacgugaugaugcacaagcuucaguagccgauuugaucaacuggaagaaaggguaucagugauggaagaucaaauguaugaaauuaagugagaagagaaguuuagagaaaaaagaguaaaaagaacgaacaaaggcuccaagaaauaugggacuaugugcaaauaccaaaucuaugucugauugguguaccugaaagugacagggagaauggaaccaaguuggaaaacacucugcaggauauuauccaggagaaguuccccaacguagcaaggcaggccaacauucaaauucaggaaauacagagaacgccacaaagauacuccucaagaggagcaacuccaagacauguaauugucagauucaccaaaguugaaaugaaggaaaaaauguuaagggcagccagagagaaaagucagguuacccacaaagggaagcccaucagcguaucucucagcagaaacucuacaaaccagaagagagugaggaccaauauucaacauucuuaaagaaaagaauuuucaacccagaauuucauauccagccaaacuaagcuucauaaaugaaggagaaauaaaauacuugacagacaagcaaaugcugagagauuuugucaccaccaggccugcccuaaaagagcuccugaaggaagcacuaaacauggaaaggaacaacugguaccagccacugcaaaaacaugccaaauuguaaagaccauugaggcuaggaagaaacugcaucaacuaaugagcaaaauaaccagcuaacaucaugaugacaggaucaaauucacacauaacaauauuaaccuuaaauguaagugggcuaaaugcuccaauuaaaagacagacuggcaaauugucaagacccaucagugugcuguauucaggagacccagcucauguacagagacacacauaggcucaaaauaaagggauggaggaagaucuaccaagcaaauggaaaacaaaaaaaggcaggguuugcaauccuaguuucugauaaaacagacuuuaaacaacaaagaucaaaagagacaaagaaggccauuacauaaugguaaagggaucaauucaacaagaacagcuaacuauccuaaacauauaugcacccaauacaggagcacccagauucauaaagcaaguccuuggagaccuacaaagacacuuagacucccacgcaauaaaaaugggagacuuuaacaccccacugucaacauuagacagaucaacaagacagaaaguuaacaagcauauccaggaauugaacucaccucugcaccaagcggaccuaauagaccucuacagaacucuccaucccaaaucaacagaauauacauucuucucagcaccacaucacacuuauugcaaaacugaccacacaguuggaauaaagcaauccucaguaaauguaaaagaacaguaguuguaacaaacugucucucagaccacagugcugucaaacuagaacucaggauugagaaacucacucaaaaccgcucaacugcauggaaacugaacaaccuacuccugaaugacuacuggguacauaaugaaaugaaggcagaaaugaagauguucuuugaaaccaaugggaacaaagacacagcauaccagaaucucugggacacauuuaaagcaguguguagagggaaauuuauagcacuaaaugcccacaagagaaagcaggaaagaucuaaaacugacacccuaacaucacaauuaaaagaacuagagaagcaagagcaaacacauucaaaagcuagcagaaggcaagaaauaacuaagaucagagcagaacugaaggacauagagacacaaaaaacccuucaaaaaaucaaugaauccaggagcugguuuuuugaaaagaucaacaaaauugauagaccacuagcaagacuaauaaagaagacaagacagaagaaucaaacagacgcaauaaaaaaugauaaaggggauaucaccaccgaucccacagaaauacaaacuaccaucagagaauacuaaaaacaccucuacgcaaauaaacuaaaaaaucuagaagaaauggauaaauuccuggacacauacacccucccaagacuaaaccaggaagaaguugaaucucugaauagaccaauaacaggcuuggaaauugaggcaauaauuaauagccuaccaaccaaaaaaaguccaggaccagauggauucaaagcugaauucuaccagagguacaaggaggagcugguaccauuccuucugaaacuauuccaaucaacggaaaaagagggaacccucccuaacucauuuuacgaggccagcaucauccugauaccaaagccuggcagagacacaacaaaaaaagagaauuuuagaccaauaucccugaugaacaucaaugcaaaaauccucaauaaaauacuggcaaaccgaauccagcagcacaucaaaaagcuuaucuaccaugaucaagugggcuucaucccugggaugcaaggcugguucaacaugugcaaaucaauaaauauaauccagcauauaaacagaaccaaagacaaaaaccacaugauuaucucaauagaugcagaaaaggucuuugacaaaauucuacagcccuuugugcuaaaaacucucaauaaauuagguauugaugggacauaucucaaaauaauaagagcuauuuauggcaaacccacagccaguaugauacugaaugggcaaaaacuggaagcauucacuuugaaaacuggcacaagacaaggaugcccucucucaccacuccuauucaacauaguguuggaaguucuggccagggcaaucaggcaggagaaggaaauaaaggguauucaauuaggaaaagaggaagucaaauugucucuguuugcagaugacaugauaguauauccagaaaaccccaucgucucagcccaaaaucuccguaagcugauaagcuacuucagcaaagucucaggauacaaaaucaaugugcaaaaaucacaagcauucuuauacaccaauaacagacaaacagccaaaucaugagugaacuccccauucacaauugcuucaaagagaauaaaauaccuaggaauccaacuuacaagggaugugaaggaccucuucaaggagaauuacaaaccacugcucaacgaaguaaaagaggacacaaauaauuggaagaacauuccaugcucauggguaggaagaaucaauaucaugaaaauggccauacugcccaagguaauuuauagauucaaugccauccccaucaagcuaccaaugaccuuauucacagaauuggaaaaaacuaaaguucacguggaaccaaaaaagcgcccacauuucgaagacaauccuaagcuaaaagaacaaagcuggaggcaucacgcuaccugacuucaaacuacacuacaaggcuguaguaaccaaaacagcaugguacugguaccaaaacagagauauagaccaauggaacagaacagagcccuacacaucuacacaucuacaaccaucuaaucuuugacaaaccugagaaaaacaagcaauggggaaaggauucccuauuuaauaaguggugcugggaaaacuggcuagccauauguagaaagcugaaacuggaucccuuccuuacaccuuauacaaaaauuaauucaagauggauuaaagacuuaaacguuagaccuaaaaccauaaaaacccuagaagaaaaccuaggcaauaccauuccggacauaggcaugggcaaggacuucaugucuaaaacaccaaaagcaauggcaacaaaagccaaaauugacaaaugggaucuaauuaaacuagcuucugcacagcaaaagaaacuaccaucagagugaacaggcaaccuacagaaugggagaaaauguuugcaaucuacucaucugacaaagggcuaauauccagaaucuacaaugaacuccaacaaauuuacaagaaaaaaacaaccccaucaacacgugggcgaaggacauaaacagacacuucucaaaagaagacauuuaugcagccaaaagacacaugaaaaaaugcucaucaucacuggccaucagagaaaugcaaaucaaaaccacaaugagguaccauuucacuccaguuagaauggcgaucauuaaaaagucaugaaaaaacaggugcuggagaggauguggagaaauaggaacgcuucuacacuguugguggaacuguaaacuaguucauccauuguggaagagaguggggcgauuucucaaggaucuagagcuagaaauaccauuugacccggccaucccguuacuggguauauacccaaaggacuauaaaucaugcugcuauaaagacacaugcacacguauguuuacugcagcacuauucacaauagcaaagacuuggaaccaacccaaauguccaucaaugauagacuggauuaagaaaaugugacacauauacaccauggaauacuaugcagccauaaaaaaugaugaguucauguccuuugcagggacauggaugaagcuggaaaccaucauucugagcaaacuaucgcaaggacaaaaaaccaaacaccacuuguucucacucauaggugggaauugaacaaugagaacacuuggacacaggaagggaacaucacacaccagggccuguugugggguagggggaggggggagggauagcacugggagacauaccuaguguaaaugacgaguuaaugggugcagcacaccaacauggugcauguauacauauguaacaaagcugcacauugugcacauguacccuagaacuuaaaguauaauaauaaaauaaacaaauaaauaaauaaaauaaaacauauuucuuuauacagggcauucuucuccacugcaaauaaaucaacagauggcaucauuuuuuuaagaugaauaaaaauccaacauccaaucaaaaaaaaucaaaguuaauaaaaccuauaaauaaacacauguaauaauguguuuuaagugcucucuaggaaaauguacaggguacaguggaggcccagagaauaguggaugcuaugcuuaguucucccuauguggguucagaaaauacuuuauaacuagaaugaugcugacucuccaaagauuaauucaccaggccaaugggugagggaagggagaggauggguaggauauuccagacagaacaagcuauggaagcagacgcuuauguuguuuuauuguuuuuaaguauacuguguauauaaucacaauaaccaccugcucauagaaaaacuuuucuuguggaauuaaauaaaccuucauguugacaguagucuuaaggugauuuuuuuuuguagacagugucucgcucugucacccaggcuagaguacagcagugugaucauagcucacugcagccuccaacuccugagcucaagggaucauccugccucagccugcugaguagcuaggacuacagacgcaggccaccaugccuggcuaauuucuuuaaaauuuauuuuuuguagagaugcagucuugcuauguugcccaggcuggucgcaaacuccugggcucaagugauccuccugccucagccucccaaagcacugggaguacagacgugagccaccgugccuggcccucauuugugcauacuuucuagauuguaaauauaacuuuuuauaauaaaaaauaaacaauagguuccuacacaguaugaucaaagagaugaucuaaauuuuugauaaaacuagugauuuguaaagauaccaaccaugcuugucauaauggaaccccaaaaaugccguuaaaugaaugagugacuccacacauggauguagaggaagagcucauucccuuuccucuucauacaaaucucucaaugcuacccuuagaaugaauaacuagauuucccugagccuaagaaaucuaaaagaagaccaaauggugacuuaaagggccaugauguagaagagguaguagaccuuuuuuccaaaagguaagucuuggcuaagugguuggcugcuuuuuuuaaaucacuaugugggacaacuggagugucuaaauuuagaauugugaaauggugaaucccucucacugacaguauucaagcacagucuggaagacccucuaacaggaugccauggaggggaccucagcauuggugugcaggagagagggauuacuucucagaucuguuaagauucuacaacucuaaaauaggcuaaauugauuaaaucauucaaaaggaaagggauucauuaauaugaaauugaccuggaccagugguucucaaagugagaccccuggaccaguaucaguaucacuugggaacuuguuagaaaucuugggccccaagacagacccgcuaaaucagaaagucuggggguggagcccagcauuccauguuuuaacucacccuccgggugauucugaugcaaauuugagagaaccgcugcccucuaccaucuucauuuuauucagugaagcuuauauuguugguauggcauucuaacaacuaugcuuuacuuaacauuauuccuguguaguauuagucuuacucuuuccaaaacagauuucagccuugucucuuaugugacuagaguucuuguaucucuuacagguguugggaaaucuucguuaguccaucuccuaugccaaaaucaagugcugggaaauccaucauggacugugggcugcucaguggaugucagaguaugugucuuuuauauuuuaguuuuucaauaauguacuaaagauaacugcuucaaauuacaugaucaaauuacaguacuauggucaagaucaauaguaauagcugggauuuauuacauucauacuaugugccagguacuaugccaguugcuuuacaugucccuucuuauuucaccuuuuuaaaacugagauguguagaugcagaaacuaaggcagagucaagauuugaacaguuuuucugaugccacagacuucaguuuuaaucacuaugccauauaucuagaguucacauagcauccuccguaaauaauucugccuaagcuugugcuauuaagacugccaacuuucagcuagaaauauaauguaaaggcaaaagcuccuggagcuucaugucugggucauuuguuccaucuuguguuuaggaauuagguauaguuuuaauuaaauuaaauaucuucccagauaucauuggucuuugcuaaugccagcuaguucugacaagucucucaucugcuggcacaccucucuccuuugaguuaagacacacauacggaaggcaagguaguuggcuagauugauaguuauuuuccuucuguucuuugaagcuauuguuccauagcucugauuuacauugcugcugauuagaaaucuuccguaagacuaauuauuauuucuuuuuaauguaauuucuucuuugguugcuuuuaaaauauuuuuuguguuuuuuuuuaaucuuugauauuuuguuguuuugcuaaccuaugucuagguguagauuuguuuuuauucauccuauucagaaguagucaugguucucaucucuuuauuuuucagaauuuuaagccauuaucugucuugccucauuucuucuaucccuuccucuugacuuucuaugagauuuuuguucuucauaacuguuaauauuucuccuugcugccuucuggaugauguacucauaucugccuuccaguuaacuaagaaucucuucaauuauaucuaaucugcuuuuuaauauaucuauacaguuuuucauuccaaguaccuauacuuuuuaauuucuagauguuccuuuuaguucuuuuuaaaauguaaaaauuuuccaaaauguccugauccuucauuauggugucugcuuuuuauuuuaauaauuuccaacauacuuauuuuaugguuucuuuuggauuauuuuauuuuuucuggaggagagguagcuaugcuccuugcuguauaugcuacucuacuucauggaaauguaucuccuuguauggcuuguaauucuuuaagaugaucacaucuucaacaggauuuuuuuccucucccuuuggaaguccuguaugcuguauugugaaaguaucccuauacagcgccuuuucauuucugucauugccaagaccguaaggauuucaauuucucagcucagauaauguaaaucuagauaauguaaauuccuccagcaucugauuguagcacagaccuauaguuuccauuucuuguggacuauuuaucuucugucuaccuucugucugaggucccugacagaaaguuuuugccguuucccugagccuauggacaauguuuuucuugucuugucuucucucuuuucacugacugggcaccucaucaaagguccggauuucaaaaaggcaucuauagucuagucuucaucacucacucacauauacuuuugccuugaaugcuggaaaacaggucugcuauuccugaaugggcauuaagacuccaggcaccaaccccugaagcuauaucugaaucuaugucaguucccacuucucacucugauuuuaaguuuuuucuucauuucuagcauuuggggauauuccuuucuuucuccuaacuuucucuugagcuagucuucucugccucuccucucuguacucuuucucucugucucaaaauauuuuuauagcauuucuauaaguuugaaguaggagcggaccuauuuugugucauuuuuuuuucuuuuuuguuuauuauuauuauacuuuaaguuuuaggguacaugugcacaaugugcagguuaguuacaaauguauacaugugccaugcuagugugcugcacccauuaacucgucauuuagcauuagguauaucuccuaaugcuauuuugugucauuuuagccaaccaucuuccuaaauucaguggcaacuuuauuuagguuugggagacccaauagcaaguucuggacaaauuuucccuuuggauuuuucuagcuccgauucugugaaagagcaugacauauugaaaagaaacuuagauuuaaacacucaccuccugagucaauugcccuucgcuucugaaagagugaccuuagacuaaucaguuuaccucuuugaggcaugguuauaucaucuggaaaacagaggucaauaauaugugcuuuauugagucuacagguuuguaggaaggaucagagaagcuuaauaaaugggaaguuauggucuaguccuuuacaaugugaaguuguaauugaacuuuaguccaauuuucugccccuucccuuccuccugcccuacuccuuuuccuauccccacccagugcccauucuauucauguuguucaccuuuugucuugguuuucuuucccacuugucuuauugaauuagcugaaacuccaguacaauguugaauagaaguggcaccaacaagcaucuuuguuucauucccaucucaugggaaauuuucaguauaacacuauuuaguaaaguauuugcuggaggauuuuuuauggguauauuugauuagauuaaagaaauguccuucuauuccuauuacaaugagaguuuguaucaugaauggauauucaauuuuaccaguugccucuucaugauaaucaugauuuuucugauuuauuccauuacugugguaaauuauguugauuaauuuuuugaauguuaaaccaaccuugcaauccuguaauaacucuaacuuggucuugugcugcucuuuucauauaucacuagauuuaauuugcuaauauuuuucuuagacauuugcaucuaaauucauuggaaagauugucccaucauuuucuuuucuuguaaucucauuguggguuuucuaucaggcuuaugcuaaccuuauaaaauaaguugggaaguauuaauuucuguaucuguucucugaaagauuuuauuuaagauugguauuuuuuuuuucuuagauauuugaaagaauucacaggugaaaccaucuggaccuaaguuuuucuuugcgggaaguuuuuaaguaacauuaaagaaaauaauaaaauaacuauauuccuucuugugucaauuuugguaguuuauguuuuugaaagaauuuuauguaaauugacacaaaaaaauuuuuuccgucuuacuguuuuucaauaagauaauugaacaauauucccuuuuucauuucugguagaaugauuuguggcuuuucucuuacuuucuugaucagucuuaccagagguccaucaaagaccaguuucugccuuguugauuuucucuauuguauguuuguuuugugcauuguuaguuucugcucuuaucuuuaugaacauacuuucuuuggguuuaauuuagugucuucuuucuaacuuguugacaucaguaauugcuuaauuuuuuucagacuuuuuuuuagagcucuaagacucuaaaauuucuaucuaagcacagcguuaacugcauuccuaaaauuuuuuucauuauuauucaguucaaacuauugucuaguuuccauugcaauuuuuucuuugacucauggguuguguagaauaugcuucucaauuuccaaacauuugacaauguuuauuaucuuuuaaugauugauuucaguuaucuuucauugugcuuagagaacauacacuguaugcuuucauccuuugaaauuuguugagauuugcuccauguccaguuuuuuuuauuguuuuauuuauuuauuuauuuauuuaauuuauuuuuuugagauggagucccacucuguugcuccggcuggagugcaguggcacgaucuuggcucacugcaaccucugccucccggguucaagcgauucuccucccucagccuccugaguagaugggauuacaggcacaacaccaccauggccggcuaauuuuuuuguacuuuuaauagagaugggguuuugccauguuggcuaggcuggucucgaacuccugaccuaagauacucuggccggggauuacaggcaugagccacugugccuggcccgacuuuuuuuguuuuauacagaugggguugcaccguguugccccagccuagucuccaacuccuaggcucaagcaauccugcaaccuuggccucccaaagugcugggauuagaggcauaagccaccaugccgggcccuaaacucuucuuuugaauaaaagcacagauagcaaacaaaauuaaauuugaaauaaagagguuuuuuuuuaacagaaaucaaaaggcuuauauguucuccaccccuuguuauaaaaugcaccuuaccuugggcaagcaaauucuaccugucuugaaaaagcaauaggaaauacugcuagucucuucucuaugagacagaaaaacuuuuacccagagguguugaguaggccagacaugguggcucaugccuguaauuccacugcuuugggaggccaggugggaggaucacccgagcccaaguuaaagaccagccugggcaacauggugagacccccgccuccauaaaaaaauguuaaaaaauuuuuuuaauuuaguuuuuuucuuuaauuuuuuuauuauacuuuaaguuuuaggguacaugugcacaacgugcagguuuguuacauauguauacaugugccauguuggugugcugcacccauuaacucguaauuuaacauuagguauaucuccuaaugcuaucccuccccgcucccuccuccccacaauaggccccagugugugauguucgccuuccuguguccauguguucucauuguucaauucccaccuaugagugagaacaugugguguuugguuuuuuguccuugcgauaguuugcugagaaugaugguuuccagcuucauccaugucccuacaaaggacaugaacucaucauuuuuuguggcuacauaguauuccaugguguauaugugccacauuuucuuaauccacucuaccauugauggacauuuggguugguuccaagucuuugcuauugugaauagugcugcaguaaacauacgugugcaugugucuuuauagcagcaugauuuauaauccuuuggguauauacgcaguaaugggaugguugggucaaaugguauuucuaguucuagaucccugaggaaucaccacacugacuuccacaaugguugaacuaguuuacaguuccaccaacaguguagaaguguuccuauuucuccacauccucuccagcaccuguuguuuccugacuuuuuaaugauugccauucuaauuggagugaaaugguaucucaaugugguuuugauuugcauuucucugauggccagugauggugagcauuuuuucaugugucuuuuggcugcauaaaugucuucuuuugagaagugucuguucauauccuucacucacuuguugaugggguuguuuuuuucuuguaaauuuguuggaguucauuguagauucuggauauuagcccuuugucagaugaguagauugcaaacauuuucucccauucuguagguugccuguucacucugaugguaguuucuuuugcugugcagaagcucuuuaguuuaauuagaucccauuugucaauuuuggcuuuuguugccauugccuuugguguuuuagacaugaaguccuugcccaugccuauguccugaaugguauugccuagguuuucuucuaggguuuuuaugguuuuaggucuaacauuuaagucuuuaauccaucuugaauuaauuuuuguauaaggugucaggaagggauccaguuucagcuuucuaaauauggcuagccaguuuucccagcaccauuuauuaauuagggaauccuuuccccauuucuuguuuuugucagauuugucaaagaucagauguuguaguuauguggcauuauuucugagggcucuguucuguuccauuggccuauaugucuguuuuggcaccaguaccaugcuguuuugguuacuguagccuuguaguauaguuugaagucagguagcgugaugccuccagcuuuguccuuuuggcauaggauugacuuggcaaugugggcucuuuuuugguuccauaugaacuuuaaaguaguuuuuuuccaauucugugaagaaagucauugguagcuugauggggauggcauugaaucuauaaauuaccuugggcaguauggccauuuucaugauauugauucugccuacccaugagcauggaauguucuuccauuuguuuguguccucuuuuacuucguugagcagugguuuguaauucuccuugaagagguccuucacaucccuuguaaguuggauuccuagguauuuuauucucuuugaagcaauugugaaugggaguucacucaugauuuggcucucuuuuugucuguuauuaguguaugagaaugcuugugauuuuugcacauugauuuuguauccugagaccuugcugaaguagcuuaucagcuuaaggagauuuugggcugagacgaugggguuuucuggauauacuaucaugucaucugcaaacagggacaauuugacuuccucuuuuccuaauugaauacccuuuauuuccuucuccugccugauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugagauaugucccaucaauaccuaauuuauugagaguuuuuagcaugaaggguuguugaauuuugucaaagguuuuuucugcaucuauugacauaaucaugugauuuuugucauugguucuguuuauaugcuggauuacguuuauugauuugcguauguugaaccagccuuccaucccagggaugaagcccacuugaucaugguggauaagcuuuuugaugugcugcuggauucgguuugccaguauuuuauugaggauuuuugcauugcuguuccucagggauauuggucaaaaauucucuuuuuuuguugugucucugccaggcuuugguaucaggaugaugcuggccucauaaaaugaguuagggaggauucccccuuuuucuauugauuggaauaguuucagaaggaaugguaccagcuccuccuuguaccucugguggaauuuggcugugaauccaucugguccuggacuuuuuuugcuugguaagcuauuaauuguugccccaauuuccuagccuguuauuggucuauucagagguucaacuucuuccugguuuagucuugggaggguguauguguccaggaauuuauccauuucuucuagauuuucuaguuuauuugcguacagguguuuuuaguauucuccgaugguaguuuguauuucugugggaucgguggugauauccccuuuaucauuuuuuauugcaucuauuugauucuucugucuuuucuucuucauuaguguugcuagcggucuaucaauuuuguugaucuuuucaaaaaaccagcuccuggauucauugauuuuuugaagaguuuuuuguaucauuauuuccuucaguucugcucugaucuuaguuauuucuugccuucugcuagcuuuugaauguguuugcucuugcuucucuaguucuuuuaauugugauguuagggugucaauuuuagaucuuuccugcuuucucuugugggcauuuagugcuauaaauuucccucuacacacugcuuugaaugugucccagagauucugguauguugugucuuuguucucguugguuucaaagaacaucuuuuauuucugccuucauuucguuauguacccaguagucauucaggagcagguuguucaguucccauguaguugagcgguuuugaguuuccauuucuuuggcaucugugaugcuaguguuagccaguuuuguuguaaguguuagaaagaggacacauagaacuaggaagcugaauaggaagaugauuauaauggcgugaucauggaaggcgauuagcucuucuguuauaggggauguggcaucuugaaggccuaguugggcugcgugugccauuaagauauaugggacuuaaccuguaacuuaacuuugacaaaguuaugaaauaauuuuucuaauaucuuguugaaaaagucauagagguuaugagguuggcuugaaaccaguuuuaggggguuggauuccuuccuuuuucgucuagguuuuauguagacugguucuucaaacguaugguaggguggagggcagccacauaaccacucuaaguuaguggaagguuguucaauuauuagaacuuuccauuuugaagcaaaggccucucagguuaugaaaauuauuaauauuacugcuguuaaggagaugaaugagccuacagaugauaaaauauuucacgugguauaugcgucgggguagucagaauaacaucgggguauuccagauaagcugagaaugugcugugggaagaagguuagauuuacgccuacgaguauguuucuuaauccugaguucucguuugauugcacuguggucugagagacaguuuguuauaauuucuguucuuuuacauuugcugaggauugcuuugcuuccaacuguguggucaguuuuggaauaggugugguguggugcugaaaagaauguauauucuguugacuugggauggagaguucuguagauaucuauuagguccgcuuggugcagagcugaguucaauuccuggauauccuuguuaacuuucugucucauugaucugucuaauguugacagugguguguuaaagucucccauuauuauugugugggagucuaagugucuuuguaggucucuaaggacuugcuuuaugaaucugggugcuccuguauugggugcauauauguuuaggauaguuagcuguucuuguugaauugaucccuuuaccauuauguaauggccuucuuugucucuuuugaucuuuguugguuuaaagucuguuuuaucagagacuaggauugcaaccccugccuuuuuuuguuuuccauuugcucaguagauguucuuccaucccuuuauuuugagccuaugugugucucugcacaugagauggguuuccugaauacagcacacugaugggucuugacaauuugccagucugugucuuuuaauuggagcauuuagcccacuuacaauuuaagguuaauauuguuaugugugaauuugauccugucauuauaauguuagcugguuauuuugcucguuaguugaugcaguuucuuccuagccucgauggucuuuacgcuuuggcauguuuuugcaguggcugguaccgguuguuccuuuccauauuuagugcuuccuucaggaacucuuuuagggcaggccugguggugacagaaucucucagcauuugcuuaucuguaaaguauuuuauuucuccuucgcuuaugaagcuuaguuuggcuggauaugaaauucuggguugaaaauucuuuucuuuaagaauguugaauauuggcccccacucuguucuggcuuguagaguuucugccaagagaucagcuguuagucugaugugcuucccuuuguggguaaccugacuuuucucucuggcugcccuuaacauuuuuuccuucauuucaacuuuggugaaucugacaauuaugugucuuggaguugcucuucucgaggagucucuuuguggcguucucuguauuuccugaauuugaauguuggccugccuugcuagauuggggaaguucuccuagauaauauccugcagaguguuuuccaacuugguuccauucucccugucacuuucagguagaccagucagacauagauuuggucuuuucacguagucccauauuucuuggaggcuuuguuccuuucuuuuuauucuuuuuucucuaaaauuaucuucucgcuucauuucauucauuugaucuuccaucgcugauacccuuucuuccaauugauugaaucgacuacugaggcuugugcauucgucacguaguucucaugccgugguuuucagcuccaucagguccuuuaaggacuugucuguguugauuauucuaguuagccuuucaucuaaucuuuuuccaagguuuuuaacuucuuugccuuggguucgaacuuccuccuuuagcucugaguaguuugaucgucugaagccuucuucucucaaaucaucaaagucauucuccauccagcuuugcuccauugucggugaugagcugcguuccuuuggaggaggagaggcacucugauuuucagaauuuucagcuuuucugcucuguuuuuuccccaucuuugugguuuuaucuaccuuuggucuuugaugauggugauguacagaugagguuuuggugaggauguccuuucuguuuguuaguuuuccuucuaacagucaggacccucagcugcagaucuguuggaguuugcuggagguccgcuccagacccuguuugccuggguaucaccagcggaggcuauagaauggcggauauuggugaacagcaaauguugcugccugauuguuccucuggaaguuuugucucagaggaguaccuggccgugugaggugucagucugccccuacuggggggugucucucaguuaggcuacucgggggucagggacccacuugaggaggcagucuguccauucucagaucucaagcugcaugcugggagaaccacuacucucuucaaagcugucagacagggacauuuaagucugcagagguuucuggcuaugcccugcccccagagguggagucuacagaggcaggcaggccuccuugagcugcggugggcuccacccaguucgagcuuccuggcugcuuuguuuaccuacucaagccuuggcaauggugggugccccucccccagccuggcugcugccuugcaguuugcucucagacugcugugcuagcaaugagcgaggcuucgugggcguaggacccuucgagccaggagcgagauacaaucuucuggugugccuuuugcuaagaccguuggaaaagcgcaguauuagggugagagugacccaauuuuccaggugccaucugucaccgcuucccuuggcuaggaaggggaauucccugaccccuugcgcuucccaggugaggcgaugccucgccuugcuucgacucacacucggugcgcugugcccacuguccugcacccacugucuggcacuccccagugagaugaacccaguaccucaguuggaaaugcaggaaucauuugucuucugugucgcucacgcugggagcuguagacuggagcuguuccuauucggccauccuggcuccacccuccccacguccaguuuuauggucaauuuugauaaaaauuucauaugcacuugaaaacaaaguauauuuuguaauuguugggugcaguguucuaaauauguguuaaucauuuguuaaaucuucuccaucucuguuggguggguuuuuuuggucuguuuuuuucaucaauugcuaaggaauaaguauuauaaucuccaacaguaagugugaauuugucuauuccucauuuuaauccuguccauuuuucauuuauauacuuugagauuauauuacuaggugaguacuaauuuaugauuguuugaacuuccuaaaggauuuaacauuuuguuauuuuaauaugucccucccuauaucugguaauacauuguaccucgaagacuauuuugucugauauuaaaauaguuaaagccaacuuauuuuuaguuaguguuugugugguuuaccuuauuuacauauuucaacuuucaucuuucuguguccuaauaucuaugggaugucucuuauaaguaagauauagcuaaauuuuguuuugaugaccagucugacagucuuaguauuuuuauuugauucuugggccuugcccccagauauucugacucagaguugauuggugcccaagcaucugcauuuuaagaagcaucuugaugauucucuuauaggugaauaaugccuugagaaauacuggguaaggagugcaaucauauugccaaguggauaucaaaguguuuaaugacaggacuuauagagcagagguauaagacuaagaaugagaugcuaauaggaagcuaguacauauuaacgauaagacaaggagggaggggaguauagcugaugguccagagcaucuaaagaaggcagauuuuuaauauaaggguagaggaguaaugcacuagaaguagcuuuggaguguuagcaaggcauuuccuauuuucugaacuccaagguaauuagaauauugaaaagugaacagcaucuaucugagaggacauaaggagaaguuguguuuucaagguagaggcggagauuuguuaauagaaugagauugaggauaggguauaauggaauuuuguaaccauggaguaagauuccaggagaaaaguggaaauauuuggagaaggaaacaauuaggaguuuaaugauggguagaggaagcaaaagcagucugagaauaagaauaugagagaccaauuaaggacccaauauguauaguaacagaggauaacugggauauaaaugucuugaguguagcugguggcaaaguuuccaaaagaaacuuuaucucagcaguccccuguaugugagaguggagacuugauuuugucugcaaggaaugcuuuugugcaaagucccagagagcaggccaacaugagauuacuaguuaguucucaagacacugaccaaguuuuagaaguaauagcaguaauuccguuuagaaacuucugcuuugggacugggugcggugggucacgccuguaaucccagcacguugggaggucaaggucgguggaucacgugaggucaggaguuugagaccagccuggucaacauugugaaaccccaucucuacuaaaaauacaaaaauuagcugggcgugguggcacacaccuguaauccuagcuacucgggaagcugagguaggaaaauggcuugaacccgggaugcggagguugcagugacuugagaucaggccacugcacuccagccugggcaacagagcgagacucugucucaaaaacaaaacaaaacaaaaagacaaaugucauauaauuacguuacuggguuuacuggaaugaguguggcacuaauugauuccuuuaaagacagucuuaccugaauuguguuauuguggaagaaugggacaugggcugaaaaugauuugcuuuacuguucauuguaucuuaagccaguugacuucugucuuguuuuuuuuuuuguuguuuuuuuuuuuguuuuuuuugagauggaguuuuguucuuguugcccaggccggagugcaguggcacaauaauuuuggcucacuacaaccuccaccucccagguucaagcgauucuccugccucagccucccgaguagcugggauuacaggcacccaccaccacgccuggcuaaauuuuuuuguauuuugaguagagacuggguuucacaauguuggccaggcuggucucaaacuccugaccucaggugauccacccaccuaggccucccaacgugcugggauuacaggagugagccaccaugccuggccaugucuuccauuuuugagaagaaugcacugcgugagugauaacauaaguaaaaggcauuuuuaaaugauaaccuuaaguugucauggacauguaaaucacuuugacuguuguuauaauaaagugaacaguucuuuucuauagaaagaauaacuaaagcuuauaaagccuuuaccuaaauaacuugggagagcacuguuaccuguagcagcuuuuauauugcaguuauaguuuuuguuuuagugaaaccugugcgaagggaucuccagaauuaguguagauugaugaauacacacuuuucaaaacucuuagaaacaguugccucuuuuuuuuucuuuuuuuuuuaauuuuauuauuauuauacuuuaaguuuuaggguacaugugcacaaugugcagguuuguuacauauguauacaugugccauguuggugugcugcacccaacaguugccucuuuuacuucaaaucuauuaagagccaaccaaaaauagagaugauagcagugaugauguaauuguuuaaucuuaaguaccaggugaagcuaaugaguuuaauguauguacucaguaauuacuaacauuuuggauuuacuguuuaguacagagguguucauaacugaauugaaaagaaaaggaagaaaaguuuaauuuugugguauucuucauucauuccugucuuuaacuuugcugucccaagucuaaugggaguaaauacaaauacauggcuacucuuaauuaugaaaacaagacuuaaugaauuuagaauuuagucuuuucacaaacuauaaauaaggaaauugauuugucauuucuaguucacuuuaaugguaauuuaacucucuaauuuacacauugcauacaauugauauuuauugaauuccucuuuggacagccuaacaauguacagacacugggaagaaauuagaggaauagucucuaucuucacuaagcauaugaggugggacacuuuuuauugcuuacuuuggcuaggcauccauuuacauacuaauucauuuaauucucacaacaacccuaugaggcagguacuguuagugccccuauucauuuagcguggaagcaauugaagcacagaggcacuacaugacuuguccuggaucauauaguuaguaaguuauggaacugcgauucaaacccaggcagucugcuucaagaaccugugcuccugaucacuacucuguacugccucuuguuccagaacaguauuaagaaaaaaaaaaaucugauacuguucaauauaguagccaauagccucauguggcaauuuaaauuuaaauuuaaauugauuaaaauuaaaaaucuagcuccucaguuaaacaagccacauuucaauugcuaaguagucacauguugcuaaugguuaccguauuggacauuucguucuuucuuuuuuuauuuauuauuauuauuauuauuuugaaaaagagucucauucuguugcccaagcuggagugcaguggcaccauaucggcucacugcaaccucugccucccaggaucaagaauucuugugccucagccuccugaguagcugagauuacaggugcgugccaccaugccuggcuaauuguuguauuuuuaguagagacagguuucgccauguuggccaggcuggucucaaacuccuggccucaagugaucugccugccucagacuccaaaugugcugggauuauaggcaugagccaccacaccuggccuguauugggcauuucuauggcuguagaaaauuccaugggacagcacugauauagaaaacaaguguuauaguaguucaagaaaguaaguguaaaauuauccuaggcacuaaugauugaauggguggcuuaaguaaguggcuagauggacuguccccaagaagagggccauauuauaggugaaaaagaaggaaacaauaguaaguucaguucuggacauggugaaaggagguaucugugagcuagccaccuggagcuguccuggaaaugaaaugcugaagcucaaaagacaauucugaguuggaaucauauuuauagaaauaaucccgaaccacuagaacugaugcaauuucuaaaagagaaaauuuagaaaaagguugggguauauuuagagaguugaugggaaaagaggggucagagaaagacugauuaaagaaauaagaggauagccaaaaugaacgacaagagcaaagagagaugagaauuucaugaaagagggauugauuuuuaguaagaaacaguagcaauauaaggacugagacaggaaaaaaaaauacuggauauguuguaaagucucugcugaccuuugaaagugcaauggaauauuuguggcagaaaccaaauuauaugacuggcagagaggaaauagagacagagguuuaacucaauuuuucacgaaguuuagacguuaaauaaaagagugaauggguacagaauggcagggaaagugaagggcuuuuuuuuaauuagaaaaaaauaagcuugacugaaggcaaaagagcaguaacuggaagugaagagacagcaguaaccuuuacacuauucauuuguucauuucuuccuucaauacauauguuacauaccuccuugguaucagacacugugcaaggaacuggaaguauagcagugaaugagauaaauuaauuucugcuccugugguauauucuccuaguaucucuuuuucacccuucucucuuuguuaccaacucccuccuaagaccuccuaccucccuuccucucuuuaauaaugauucugcagguacaaauacuaaaccaaacuuauuagcaucuacaauauccacuguucuuucuugauguguaucauuuuuuuucuaaauauguuucugcauuuuaaaaguuacaaacaaugggccaggcgcgguggcuuacgccuguaaucccagcacuuugggaggccaaggcaggcggaucacaaggucaggaguuugagaccagccuggccaauauggugaaaccccauuucuacuaaaaaauacaaaaauuagccagacguggugacaugugccuguaaucccagccacuugggaggcugaggcaggagaaucgcugaacccagggaggcggagguugcagugagcugaaaucaugccacugcacuccagccugggugacagagugagacuccaucucaaaaaaaaaaaaaaaaaaaaguuacagacaaugaaugaacucuucaaaugaaacaaaaccuuauguacauaggucuugauuuuguuuucaagaaaaagucaaaagcugaauaaaugagaagguccaaaguggcagcaucguugaggaguacuguuccuuuuuccauuugaugaucagcuguacuguugcuuccuuuauuguuaagaaaauccuuuauuguauagcuguaaggucuguaaugacuuuaaguaucagauccuugaugaccugcuuuaaauauaaaacacacuucucauaguuuggcauuaccucccaucauguuggguucucaguauagcaccaaaguacuacuuacugugucaagagcaauacuuguuauaaugucaagcuuucccuuggaaauuacucacacaugugaaagauguaacaucauaacuagaagcuguaagcuacugauuuaaaauuguugggauucauuccaugugaauuggguuaaacuuagccaguauuaaguuggaaaggaaagaagacaccuuaucuucugauuuuaaaaggaaacaggaaaggauuugacuaggaaagguaauuugugguagagaagaguuuagaugagugagucagucuggcuugggaguaugcauagccugaaaggugcuggcuaacagguuugguacaaugcaaggcuaagaggguaugcugccuagaaauuuacauuggaugauggcuauucucagaggaguuauaguccuuuagaggaggcaacauuagguacuugaaauaauuuagagaaaaaaaaugguguacugcagugguugccaaacuuaaucauguaucagaaucaccuagggaacuuuaaaaaaaaaaaauacagacucuugagccccaucccagaaguuucaaggacaguccaggaaucuguauuuuuuaacaaacuuccuauuggcuuugauuuaguuugcucuuggaacuguacuggagaaacacuggaauucgguaaauaauaaacugaacauaauaaaaaccuggaggaugaguuauccuaaauuuauucauguauuuaauaaacaugucuaagcaucuaauauaugcuagauauuaugcuauuuucuagggcuaaaggaugaauaauacaugguccgugcccuuacacucagagucuagaagaagagauaucaguagauaaauaagacagugugcuuagugaaaugauagagguguguaggaugcuauggaagcaaauaggaggaguaccaaaccugcucugguugauuugggcccagaaggaagguaggaucagaaagacuuaacugaagucgcugagcuuuuucauaacagauaacuuacucuuuauaagaccucauacugcuuuuucucauuguuuugcuuagaaaucuugcuaaaacauauguuuuuucugcuugguuuaacuuuuuuacugcuaacuugacaugaucacauauuauaaguuauuuuugccauauaacaaaauagugaugccuucuauuguaauaugcagaauuaauuuccauuaucccaaaugguccucaacugcugcaacugugcuauucucauuuuucugucauacugucuuugaugucagucugauaauugucuucuuaaugucaauguggcuguuuauagaguagcauauuuauuuaaauuuuuccuuggccaaaaggauuuggacaaaaaaauugugaauaaguaaaaguguaaagcauuaaguugaauguaguaugugaguuuuagugcauuuuaugacaucuauuuuaacuacugagcuaucuuguuuuuuuaauuauuaugucaaagccaguagauacuuuagaaaucacauaauacaauucuuucauuuuauaggcaaagaaacugaggcuccaagauaccagggacgaucaguggcaaucaaggaguagaaucuaggccuccugauacuguaauagucccauucuaugaaagcagcaguucuuaacgaggggauuacagcagaaucguuuggagaauuguucaaaauacacaugccuaguauuuaaucccaaagguccugauucaguaagauuggcauguauauuucuuaaaaaaaauuaauucuuggaaaaugccgauguguacucaugaaccagcauacuuuaaucugcuugccauauaucauaauuuguuucugaauaguuauacaguacaggcaguaaaugccuauagagccuagacaugagaaaaagagagucuuuggagauaacugugagugagaaagucauuggaggguuuugagcaaaagagcguaugauauaacuugcauuuuuaaaggaucacucuagcuacuguauagaaaacaaacagggagguugggggaugccucuaguagggagaucagucagagaccauuauaucaauucaggcaaggagauagagacuuugaccugggugguaauaguggagauagggagaaaugaacagauuuuugacauauuuuuuuaaagucaaagaagcagaacuuguuggcaaaugcaauaaugcaauaugaaaggagucaaggaucagucuuaaguuuuuggcccaaguaacuggaagaauaaaauugccuuuuagaugaaauugccacaagaaugaguauugauagaaaagaaaagagacugaagaacuaaaccuugagacacauuagcaauuagaaaucagagagauaagaaggacccaaauggaagcugaaaagcacuagccaaugagauaggaagaaaacuagaagagugugauaucccagaagccaggugaaaaauguugcaagacacgagguggaucaaaugguggaguaaaaugaaaacuguuaauugaccauuggaguuaacaauguggaggucauuggugaccuugacaaggaauaguucauuggggucauuagggcauaaguucgauagaaaugaguucaaaagagaaugugaagaaaaggauuaccgcuaagaauagacaacucuuuggaggacuuuugcugugaaaaggaaaaggaaaguggcaugguagcuggaagaggacuugaggucaagagaaggauuuuuuuuagaugaggaaaauuaugccauguuuguaugcugagaauugaauuguguggugaggauuauccagcugagaaggaaaauuugaugguauaagggagagacgggagaacugguagaauuacaucuuuaagcaagaaaguggggaugggaucucaugcacagaaggaggauuuagccuuagggacauaggcagccuaagaaaacagcaagaaggaaagcagauuaugugggcacagauggagaaaggcagauaaauacaggaagaacagguuguagaagcuccuuucuaauugcuucugcacuaggaagcaaaguuaguuuuaacugaggauggggaagagauauuagaaguuuauaaagaggaaaaaguaugaaauaguuaucuggaagaggaaaaugguaaauuaacuguggaauugauugaaggacagcuccaaagguacacuuaaauuuagaaagaauccauucaucuugaaugcguauuuuuccgagcuccacauucgguugcuggguuguagacaugaaagaggguaaaagguggauauaaccaagaguggaauuuugucagaugaauacaaugugagagaggggcaaaggagugacuguaugauggaucaugaaauuuaugcuuaguuaggagggaggugaggcuucggaaguggaacagagagcugugaaagauguuaagauuaauuaacuauaagguccucuggaguaaaaauuauuaaaguauuaaagagaguaagcuuaaaagauaagagguagcgaucagaaagucagaguaagaugcugaaaugcuuuaaaccggaauaaggguacuuacuaguuuguuuaguggcuauauuaauuauuuuaauugauugauuuguuagguucaugauuacaaagaaggaaccccagaagagaagaccuacuacauagaauuaugggauguuggaggcucugugggcagugccagcagcgugaaaagcacaagagcaguauucuacaacuccguaaaugguaaaacauuuuuaaauuucuaucuuauauuaauggucuaagaguauagaucaucugauauguaaugccauagcaugccagacucaucuuaauuugagaaagauauaauguacucacaacccuugauuuaaaucugcauaguacauuccaguuugcguuucuacauuguaaccaucuaauucagaacauuaaacauuaaguguuucuauuuauauuauugucauaaacuaaauauugagaaauaaaaucauauuuuugguacuugacauaaaacauggaacuuaaaauguuguccucugggguugcucugucuccagugaguugaguaaguacaguaggaccauaggagucccauagucuuaagccagauaacacagagauagagggauuucuuucaucugccccuuagaaagagcccuaaggcucuuucucagcuaguuauaaagagcugcuuaagggggucuuuaugggugcagaaauuuuauccaguuauagauauucaaauaccuggagcagacuuccagauggagcuguguaauauacgacauaauuuccuuucauagaguaccuacucugugucaagagacuaaacugcuuauaccugugauuugccaauagaguuucuuucuuagucuuuuuaaaaauucauuuuuaaaaccuguuuuuacugugaaacauaauuucaacuucuguuugauuaauauaccaaaggauuuggcauuucccuccugguaaaugcauagccauuaauagacuucauuuaugcugugcuuagaucucacucaauauuagguaagcauugcauuuauucaguauguucauuccuuauauuccucuucugaugucuucccagaucaugagguguuguagacucuacaaaaagauguagagaagguucuuuucauuggauacauauuauagaauacagaaugagaugugucaguucagacccauauccuauuuagcucagaauucuaucugaaaaugucacagucuuaauaaagaaacaaagcauucauaaaugagacaaaaauaguuauaagaugaccuugauauaugccaucaucaugcaaaaagguauauacaaugguauauaugaauagaaugcauauaaauaagaaaaacaacaauaagacuaaguauagugugaggugaccucuuagagaaggaagugaaaccuaguuuagacuuauacuagagugaucaacuuguaucaguaaaauuacuugucaaauuaagauaucuaucugaucuggcacagagaagucugaauauauaacaccuuugauauuuagguauuuuugagacagagguacaauaaaaauuaugaauaaauaauagagauaaauaccacucaaauccuagaagcuauggaauucugaguuguaaacuuguaagugcugaagaagaaauccaucuaaucuauauuuguuuaucuuuucuguaccuacuauucauuagugauuugucuccuuuaauauuauugaaagaauugcauauauccuauguugauuuugcagauaagacugaaauauauuuccauuucuuaaaaguaaaaaaaaaaaacugcauuuauugaaaaaccuauuucuguguucuuucaccuuagcucuggaacauucuuccugguagaagcacucaaaguucuuuauuccaucuacuauccuuaguuuccuaagaaacugaacauaaggaucacucuauccaaaugcacaguccauauucuuagcgauaacuuucuucccuuaauacccuacauucuucccucucuaauagccuaggcuaguaauccuucagaaggaaauaaugaagugucuuuacuucucucccuuaagauuaagauauauuaucauaucacccugacuccuuucaucucagccccaccuugauucuucuagcacauguucuacaaagcaauaacucucagcccaaaugaaagagaaagaauaggggaaaaggguacucaaaugcccuuaaaagcucaaaagucuuaccuaaagauccucaguaaagucuucccuguccaucuaauagccaacuuaggccuuuguaauucuuuuacucccccguccaaaauucucacccauaguuuugccauauuuauagccuggggaaaaggaaagggagaaaauauaugccaguuuuuugcccuaaaauggagauuuuauucugcuuaccaccagucuuuacugucagauuaccugagugcaaauucugacuuaccaugugcccaaggacaaguuacucuacuucucugaacuuuaguuuucucuuguguauaaagauaauaauaauucuucauaggacuguucugaaaauuaaauuagauaacacauguaaagcacaauauuuaguacauuaguacugaauaaauauuagcuguagucuuuaauggugguucuuuauuccuuuuuuuaaaucugugccacugaugcugauuaaaaccccucauugaggaaggaagaguggguacaauuggauauuagggcaagugucagaucucuauuaguuucagacaccagaagagaugcagguuuaucuaagcuggcuggaacaagucagcuauagcuuguacaagcccuuuaguuacacagauggcuauaaaaacuguagaagccagcuaauucuaccucuucugcuuuucuuuuucaaauugacacauaccaccucuugaagauggaggaaucauugguuucauguccuauucacaaucuggguaauauagaaaaggguugggaguuugaaaccuguaguguuuugaccauaaggugauauccuaaauucuagugggcaucaaaguuuuuccucuuuugucuauaucuugcuguaauaauuaauucccugauuuuccuuucuaucuaggauuuuaauugauucucuucaguuguauuuuaguguauuucugggccucguuacauuuuguuauuuuucucaaucuaucaaaauccgugcauguacuuucuacuauccauacuucuuuacuauuuaaugucucacccacucucuuauaguggcauauuucuuuugcucuaauaacuaaaucucuuacagguaggaagcuuacauaacuaaucauuauucaaagaacuagaaaauuagacauuugaauagauuagucucagaugaucuacaggacacuauuuugucagcuaaagaauagcaauuguaucaaaucaguacuauuuuaguagauuuucauuaccuaauauuacuuuuagugaguauaaguaauauauguauguacugguaucuauggcaguacuguguacagugaagaaacaacauaacuuuuugaaugaauaauuucauauguacuugaaguaguuuugauucucuugauuaauaaagugguucuacagguaggaacaggcauggaguaggcacucaggaaguguugaaugaaguaaagaucugcuaaaaguuuaaugggauuucgucagcccuuguaaaauaaagaguuauaaaacugacagagaaagguuuauggcuauuuauaaauauuuguagagaaaauuuuaaaauaauugucucugaguuguuagucauacuagaaugcuagauucauuaagcaaccuaaugcuucuguuuacuaagcuucauuuggccaauugugaaaugaagaggaauuguuaagggauuaacauuguuuucucugauuauuuuagguauuauuuucguacacgacuuaacaaauaagaaguccucccaaaacuugcgucguuggucauuggaagcucucaacagggauuuggugccaacuggagucuuggugacaaaugggugagccaauuucacaauugguuugaaagauuguagcaaucacaggaauguacuucccugaauaacacuuuguaaaauguuugauuugcaaagauuuuucuuucaguguauagauuaucuuuuccuuuuaacaguaucuuucacaaagcaauaguuuucauuuugaugaagucugauuacucuucuuuucuucuauggauugugcuuuugauaucaugucucagaacucuuugccuaauccuagaugaugcagguuuucucuuauguuuuccucuacagauuuuaugguuuuacauuuuuauaguaaaacauuuauauaaaacauuuuaaguuuuauagguuugcauuuagauuuaugaucuaaguuaguuuuguacgagaugggagguuuugguugagguuaacguuugcauaugaaugucuaacuauuccagcaccauuuauugaaaagauauccuuucuccauugaauugcuuuugcuccuuugccaaaaaucaguugaccauauuaguaugagucaacuucuggacucuaguucuguuccauugaucuaugugucugucccuucaccaguacuacgcugucuuaauuauagucuuaaaauugagcaguaugauuccuucuacuuuauucuuuuucauaauuguuuagcuauuauaguuuauuuguuuuuccacaugaauuuuuagaaucagcuugucuauauugacaaaaauuuugguuggauuuuuauuagaauugcauugaaccuauugaucacauuggagagaauuaacaucuuuauucuguugcaucuuccaguucaugaacacaauauaucucuaaauuuauuuagaucuucuuuuauuucucuuaccagcauuguguaguuuucagcauacaaauccugugcauguuuuauuagauuuauaccaaaauauuuaauauuuuuuaagcuauuguaaauuguuuuuuuguuuuguuuuguuuuguuuugagacugagccuugcucuguugccaggcuggagugcaguagcacgaucucaguucacugcaaccucugucucccagguucaagcaauuauugugccucggccucccaaguagcugggauaccuggcugauuuuuguauuuuuggcagagacaggguuucaccaucuuggcaaggcugaucucgaauuccugaccucaggugauccaccugccuuggccucccaaagugcuggguuacaggcaugagccaccauaccuggccauaaaugguauauuuaaacuucaguuucaaauuuuccauugcuaguauaaaaaaaaauagaauugauucugagugcugaccuguaucuugugaccagaguuuuuuaguacaauccuuaggaugcucuacauagacagguuuauuucuuccuuuucaaucugugugcuuguugucuuauuucuugccuuuucgcacuggcagcaacuuccaaaaggguacuaacuaggagugauaagagugaauaucuaugucuuacuccaaucuuagggggaaagcauucauuucacuauuaaguaugaugucagcuuuagguuuuuuuuguugacaucauuuaucagguugagaacauuucuuucuaucccuaauuugcugauaguuuuguuaauaucaugaacagauacugaauucugucaaaagccuuuucugcaucaauugauauggacauguggcugcuucuuuaggcugucaguaugguggauuacguucacugauuuucaauacugguggauuacauucacugauuuucaaauauugaaccagccuuccauuccuuggucaugguguauuauucauuuuauguguugcuggauuugauuugcuaauauuuuguugaggauuuuuauccauguucaugacaggcauugguguguaguuuucuguucucauaaugucuuugacugguuuuggugugaggauaauguuggccucauagaauuaauuggaaguauuccuuccucuucuauuuuuuggaagaaauugaguauauuugguguuauuucuucuuugaagguuugguagaauuuaccaagagaccaucugggccuggagguuucuuauuugaaagguuuuuaaccacaaagucaacuucuuuaguaauuaggauuguucaaguuauuuauuucaucuuggaugaguuuuuguaauuugugauuuucaaggaauuccaucuauuucauuaaauuuuuuaauguauaucaauagaguuguuuauaguauuuguuuauuguccuuuugauaguugcacaguuuguagugauaugaccuuuuucauucugauuuugguauuuuaugucuucucuuuuucuugucagacuuguagagguuuaucaauuguauugauuuuuuuccaaagaagcaacuuuugguuucauugauuuuucucuauuguuuuuccauauacaguuuaauugauuucuacucuuauuucuuuccuucugcuugcuuuugguuuauuuuguucucuauagcuucuuagauuacuuacuggauaccuugcauuuuugccaauacaaguauuuuaaugcuauaaauuucccucuaaacacugcuuuagcugcauccugcaaauguuuaaauguauuacuuuuauuuucauuuaguucaaaauauuuucuaauacuccuugagauuuucccauaggcuguuuagaaauguguuguuuaguuuccauguauuuagaggcuuuccaguuauuuuuugcuauugacuucuagcuuaauuuuauuaugauccaagaacauacuuuauaugauuucacuuauuuuauauuugugcaacacccgguaugugaccuggguguuguugucucuguuguuucaguuuucagugucuuugguacacuaaguaggaucaaauccaugcaugcacagcuuuggcaaugagcucaagcauucacgaacuacuucaugggguugcuuucucacacuucacccugucuacagucucugccauacuuugugauuugcuggggcucccuuuuucgguccccaggccaaauuuucucaugcacuugcacaacugcaccuauguccagggccaagugguagaaggacaaagaauaaaagcaaugggaguuugccccacugucuugagauacaguuccaucagucagaaaaauuucccuucugggcccggcgcgguggcucacgccuguaaucucagcacuuugggaggccaaggcgggcggaucaugaggucaggagaucgagaccauccuggcuaacauggugaaacccugucucuacuaaaaauacaaaagauuagccaggcguuguggcgggcgccuguagucccagcuacuugggaggcugaggcaggagaauggcaugaaccugggagacggagcuugcagugagccgagaucacgccacugcaccccagcuugggcaacagagugagacuccgucucaaaaaaaaaaaaaaagaaaaauuucccuuccucuguauuuguaagcaggcguucccaaccccugguccauggccuguuaggaaccaggccacacagugggaggugaguggcaggugagugagcauuaccaucugagcuccaccuccugucagauuagcagaggcauuagauucucauaggagcgugaauccuauugugaacugugcaugugagggaucuagguugcaggcuucuuaugauaaucuaacuaaugccugaugaucugagguggaacagcuucauccugaaaccaucccccaaacaccuguccauggaaaaauugucugccaugaaacuagucucugguaccaaaaagguuggggacuguuguuuuugagcauucugcuuguguuauagccuuugccacaacugucaugaaauugcucagaagcuggcuuacaacagaaggaaaaauauuguauuucuacacuaucuccaaguauucguguguccccuuucuuguuucaugagccagaacuauaggccuucuucuggaguauucuguucacacuuuuggguuuuaagcugaguugcauucagacaaggggauauggaaggaaacugcuaauucaaugguucuucacauugcagucuuccuuaauaugcucacuauuaauuuuucagaguccucaaauagccacuucauguauccuguccagguuuuauaguugcauucacugggaaagacaggauagaguuugcuuauucugucuuaccuagaacagaaccccauuuucuaucuuuugauugaagcaagucuuucaaaggcuuuguuuucuguguggaagucuaauuguuaugugaaaccuaaauauaguauaaguuugaguauauauauguagauuccagcaagaccuaauaaagaauaagcacaacuaauuuaaaaccuauauuucaaagccucauugauauuuauuuccuaucucaauuccuuucaucacugaugucuucauuaaccuagcuuguucucuauuuucuacuaaaauuucuacuuaagaaacuuauccuuaaauuuaggguuaggagacagcauauucauaucagaaagaaaucugcauuuuugucagggaauucaguaaaaguucuauacccauuugcauuuugacacuacaguuucauuuugauucuauagauaaaccugcaaauguauaaaacaaccuuaauacauuggugugcuuuguuggugcauuauuguauagcaucaaaaaauuuggaaacaacccuaguguccgagcaacgaaagauucauugaauaaauaauggcauauccacauacuggaguaguauucaauguuuaaaaaagaaucaggaagaucucuaugaacuaaaauagaaagaucuacagaggguacauuauuagguuuaacaaaucaaaaugcagagaauauauaucguauaccuccuauuguauaagaaagaaaagaaauaauauguauuuauauuuggauaaagaaucagugaaaaauaagaaacuaauaaaaaugguaaccuauagggggccaggggagauggguggauggguacagugguaggagcaagacugcuuagcauauaucuuuuauaucaguuugaguuuuuagccauauuuaaacaauuuagguaaauuuuauauuauguaguuuuuaccacaauaacuuuuuuuaacuuuuuauuauagaaaauuuuaaacauauguaaauacaaagaauggaaaaugaacucccauauacccguugccuaguuucaacaauuaucaacauauagcuagucuuguuucauccauaucucuacccacuuucuaucuucucccacucucaacuggauuauuuugaaccaaauguuaaaacaucauaucauuucauccauauauacuuuaaaacauaagggcuuuuuuuuaacaugacaccauauaauuaucacagcuaaaacuuuaauaauaauucuuuaauaaccaaauauuauuuuaauuuccccaauugucucauaaauguuauaauugauuuuuucgaaauaguaucuaaauaagguccacugguuguauuugguuucuuaaguaucuuuuaaucuuagguucucccuuuuugguuguuuuuuuuccaaccuccuagcacuuuauuuguagaagaagauggcuguuugucuuguacaguuuccuauauucuggauuugcugauugucucccuguauugucuuuuaaacuuguuucucugaauucuaaaucuucucugaagugauaauuaaauauaguggucugaaagaugcaaguuuuuuugucuuuauuuuuccacccaguauuaugcauauaauaugauaccuggcugugugucucuuugugauguuaaggagcuaucagccuuauccauccaugauaaaguucuucagaaguuuaccaaagaagauuucaagauuaaauuuuaaauuggaugcugcaagauuuuaugaaaaaguuaaaaggaaagcuaaaaagagaaauaagagagcaaacuauauauguaugcuuuauaugugucagugugcaaggaauugugcaagacuauaugagagauguauguacaucaaagaugauauuugauagaagauaugcaaaacuuuguaugugagacagaaggaaacaguccuaaaggaaagacacucucaaaacuucauucccuaacaaagcgaauuguagcuuugaaccaugucucuuuaauuagaguugcuguugauaugaauaaucaaaggucuugaucaugcuauuauuggcuuugaugcaauaaauagaaugguaauauuuuugugagaugggagguuguauaguaaaacacuuguguuccgaggcugaacaguuugcugaggcgcuguaagauuauugugaagggcauaaauacuuaguaacuuugcccccuaccccaauuuagaauuucuguaagagaaagaaaaguaguguuaaaggaagaaaaaaagcuaugcucgacuggguuguagugauuggauuaugcaauauugauuuacugucauaaauugugcacaaccagauuuugcugacuguuguaaguugagcuuauaacgugucagaaauccaaaucuguuuuauuucuaauaugugaguagaauuuaaauuaauucaacagcaauggccucuguguucuuuucaguaaugagaaguaucauuuacaucaccacucuguucuuuggauaaauaaauuuuuuaaaaaauaaggauuguaauagccagugauccaaggccacuaacccuaagugguucuuauugcccguccucuaucucccauggcucucauuucaggaaacaacuacuugguacuaaguucuuuccuuuuacuauucauuuugcauuucagcuguuuccuuccauuuccauguguuuaauccaccuuucccaggcuauaguaucaccuauauuugauuuauucuaggcuucagcuucccuauuucuauuuucuuauucuucuuauuucuuuacuauucagacagaaauguguauuguagauauagaauuaaugcauaccccaaaagguacccaagaagcuugccauuuucucuucuagcacaaggcuugagugccaugcuaggcuuuuggguuuuugcuacgaugaggcuuaaauccacucucugcuucuacucugaaauauuccugagcuguuauguuaaccuuagaagacacagcuacauuggaaguuaaguccacugacuguaauauacuugaugggcacuuaguuguucaauuauucaguauuguucaauauucaauaaaaacaugggaccaaauuuugagaaguuagaugaauagcuggaaucugaugaugaggauggauugauaaaagaacaaguagauggaagaaguuggaaggaaaguagguuuguaggugaaggcagcaaaaaucaguuaauuuucaguaaaauaguguaacuuaguugcacuuaaauauuacacaucuacaccagaaagauacauucuauucaccucuucauuauuauuuaucacagggauuaugaucaagaacaguuugcugauaaccaaauaccacuguugguaauagggacuaaacuggaccagauucaugaaacaaagcgccaugaaguuuuaacuaggacugcuuuccuggcugaggauuucaauccagaagaaauuaauuugguauguauuuucacuaaugcaugcuuguauuauuaucggguaaagacaaaacugaagacauauucaaauaauauauucuagugaaagaagcuuuauacuugaaaucaggcuauuuggauucuagucuaaacguagucaagauuggaaucaacauaucuagacugagagaugugcacagucacuucagccuuuuauguuggucuguuggaauguuccaacuuuauucuaugaauaauuuaaaucauaggcuucuuuuuuugaaacagagucucgcucugucgcccagacuggagugcaguggcgcguucucagcucacugcagccucuaccuccuggguucaagcgauucucaugcuuaggccaccugaguagcugggauuacaggcauguaccaccauguccagcuaauuuuuuaaauauuuuuaguagagaugggguuuugccauguugcccaggcuagucuugaacucuugacuggauuugcccuccuuggccucccaaagugcugggauuacaggcgcgagccacugcaccuggcccaugggcuuuuucuugagaaagguuuuuaaaaucacaccaaaauuaaaauaaauugauuaaaguggcacuauaagcauauuauucuugcuuuuaaaaagccucuuagcuucuuaaacuacaaauuuuaccuuaaagggcaacguaacaaauacaugaaaaaauugcaaaccuuaaacuaggagugcuucauaaggacuaauuuauguacacuuaugcauauauagaggauugagucccuugaugagauaacuagcucaaugagaacugagcgcguaaaaaagcuaagaaaugguugucauguaagccuguuaggaucccagaaaaagauccuggccagcaauuucagucauggucauguuguucacaaauaggauuucugcaacugugcacuggcauuccagaaaugcagugguggugguguaauaguacuagugagcaacauuuauugagcacuuacggguugaaaacuguuuuaguuauuuacauacauuaucucacaugcaucaucuucacaaucaacucuauaagacagguacuauuacuauccucuuuuuaaagauaagaaggagagacguaacaagaccaaggaaguuuacccaggucaauuaggguauucagauucagagccugugcucuacaguuaagccucuuuugcacuuaauuaauccuucaacucaccuugagaauuuggcagcugaaaaaacucuuagaaaucaucuagaccaacaguuacccaaaucugauuguguauuuauauuaccaauaguaccuauggaaaauuuugaauaaccgucccacagcuggagcuuuuuauucaucaagccuggcaggaggaccaggaaucugcaguuuuaacaaauaacucaggugcuucugaugccuuuauucuaugaaucaauguuuaugaacacugcuugguucagccccaccucuacccccagcuucugccugccauuccauuguuuuuuacauucugcuuugcagcggagagccccucauuuuucucagcugccacaauggaauauuugaugugcauaccccagguagucagcacugaaccaugauauuccaaaggauucuugcuauauagauauauaauauucuuguugaagaagugcugagauuacuuugaacauuauuuccaaagagaaauuuaccauugaaaacacuuaauuuguuucagcgcuuacuuuaauauauuuuagaauguaucuguuucuagugccuguggguuucucugauaaucgcgugcauguguguguguguguguguguguguguguguguguguuauuccuacuugccuuacaaagccaaggccaucuuuuaacugugagucagauguaaagguacucagguagugagacuuuagcacauacagucuccaaagaguucaaauauaacauguuuuuggccuuuaucaguguacagcuucaagaacacagcacacauaacaauaggagagggucagagaaugcagggaagaaaaaaugaggaggaaaauugaauacaagaguuucaaaaagaaauagcaaucagaaauucagcaauuaaauauaaagccucaaauaaaaacuaauguaacauuauuagugcuaacaucaguuacuguauaaauuuccuuaaaacuguagaaaaguaagaauuaacaaauguauacaucaaagguggaaucagaguuaauaaauaacugccugaauacaugcaaauuguuuaaauuauaaauaggugaaccauuacuuauuuucuaaaauccuguuaggcuuauuguacccuguaaaaacuuuucucuguuacguauuuacuuugaagcgaucauauugaaguaucuucccuaguuaauaguccuuucucaagcucagucaagcuauuuggagcuauuaauuuucaggcuuuucccucagccaugauaaauggcagauggcucuuucagcucuaaauuucuuaucccaaaaaucauaguguuucucuaggcuggucgaccugaaauuauggaaccauagaauuaagguuuuggggguguuuuuuuguuugcuuguuguuugcuuuaguuuuuguauuuaguacuucagcucuauuuagaauugucucaaacuuuugacauucugaugacuagcuaaucaauaucuauuuuauaaaacauuucuaccacagaucuaagguuugucucuuauaugccccaauugcuguagaaauguguucaaacacuauuucaaauaccauaguuagugcaaugauguuucagucuacauaauccauauauggaauuaucuuuauugugguaagugcuuguugugccugaaaauucaaucugcuagcauuuucuuagauugaagagaggaggacuaauauuuuacuacccaguauguccagguauggauuauuuaauuuuucacaaaaaucccgugaaauaaaauauuguuauccccauuccacaaaucaguaagcccaaauuuaaagguuuaguacccuaaccaguguuacacagaguagaaauguugggauggauauucugauuuauugcuugcuggcuuugaagaccccuaauuucuaguacucugugaucuuugacaacuuuguuguagccucucuuuuuugugguuuuagagaauguauuaucauuucuggcuaaaauuuaaagugugagccuugaaauguugcauaugaauaaaauaggaggcuucauuagaaaggaaucaugugggccuggagauugcaaaaacagaauaaauguaauaauaguaauuucaguaauuucuaggggcacagagggucuauagcuaaaagacaaaauuucauacuugcaaaggagcuuacaugauagcccuuauaguuuggucuuagguacauuucagguaaaaaucaaaguacucuaucucucaaggucacaagucaauggugacaagcaaaaaaaaaaaaaaacagcuagacuggaauuccagcggauaguaggccuuuuaagguuuuaaaguuauuguaaugauuaauguuccagaucguuuugucccuucugggcccauuuuuuuucccuauaauaaaauuccaucaaagaguaguaauauaucuuuauuaucaaacaauaguaguagauguuuauuaccaaaaauaauauaucuuuguggccuaccaaaagauguaguaccuugcaucuaaagagaaauccuuggcaauuguucuguuuguucuuugcaccucuaaauccuuauuuucuugcuuucuccgauucauaugaacugcauaguacuaaauuaguugagcacuggugauuaacuaguacuaaaagugaaaugcuuacuguuuuucauggcucucucucucugguuuucgggguaaauguagguaggucacuccaguaguaccuugguuuugauauuaguaaaauauuaguaaucuugucuuccucuaugaauuauuugaugaugaauacacugauuugguauacucuaaaauuguuuaaauuacaaagauuaagugaccuuauuuuccuuuaauacuuuccuccuuugugcaccauaauuugaaaauuauuugaauauuuugugagaguauugugccuaauaguauuaugccuacagaaauaugcaacaggauaaguuaugaauagcaacgagcuuggguuuccuaacuuucaauuguggaucuuauguuuuaucuucuaggacugcacaaauccacgguacuuagcugcagguucuuccaaugcugucaagcucaguagguuuuuugauaagguaaugguuucaauuaaguuauuuuuaaacuuaauuuauauauuaugagaguuuaaaauuuuuuuguagaauccuaugaccuuuauuuuuuuguccaaaacuucacagccuggaauaauccuuguuuugaucucucuuaucuguugguauaauugcccaaggccugcugacguauuuauuccaucaccaguguucucuaaguaaagggcaaaagcuacuggauuuaaauggggguuuuaaaaagauaucuaauuccucucuuuaaaagaauuucuacuuacccauuuucuagcucuuuuuuucacuuauucacccucccacccccauaaaggcacugaacugaggagauucugcuuaaagcccugaguucuuuuugcucuccuagcuguuaauauucucuacauaaauguuacuguuaccuuuuaagguaaugucuucuugauuuccuaguguuucccucucagaaauauuugcauuccaauuauugacucucugcuaacauuguuuuauuguccucagcuggaaggaaaauguagaaugacucagcauacugguaaauuagagcacucuuugucuuuccuucacaaagccauacaacuuuauugcacauaguauugaccaaguuuaaguuguuuguccaaugcucacauugcauaguaagguaaaacaggaugucuuucugcauguauuauugaaaaagguuaauuccuguguuauauuucuuuuuaagugacaucuccuaagaaaaucaucuuccccauagcucuucuuuaucaaucauuuuuuucuuuuaacuauuuagggauuuaauaauuggcccuuuuguucagcauuggauaagccccaccuuuagauaauuugggauuuaauauuuggccuuuuuaucagcacuagauaagcuccagcacccuccucgauuaauauuaggccacuaggaaaauuuugcuucacugcaaaacuucuuaacugauaugugggaaauaggguacagaugugccuagaugcugauuucccucaguucucagagcagccaggguccucaggguggggggguugggugauuggcaaccgcuuccauuuucuccagugugcuauacaaauauuagcauuuucuacgugugccaugacaugaaaaauguugugcagcacugcaaggagccagauuuuuugcccacauuguuuucaaacuuaaaauauaagaauuuccauuugguuuagaucuauggccccaucaauacaaaauucugucccuuaugagcaacaucuuauagaucugcccugaccuggaaagaucccacaguauguuguuuaaauuuaaaauuuuauuaguucuaaaauuaaaaaauaagauauacuaaauuacauccuagagaaacuggguuauugauugguauaauccgaguugucaggcaaggcuuuauuuuuuaaaaaaucaggaguacacauugcaagucagggguaaagaauuaugaccaaaaccaaaaagguaacuucucuuuuauugccugaaucacaacaaaauguauguggguuaggagguuggccagaccuccagacugaggugguugccugaaaccaaaggagcugacaaccagauuucacccaguuuucuauacaucaguucuuccagaauuuagcauaaagauuuauucuccagccgggcacggugccucacgccuguaaucccaauacuuugggaggccgaggcgggcagaugacgaggucaggagaucaagaccaucauggcuagcauggugaaaccccaucucuaguaaaaauacaaaaaauuagcugagugugguggcgggcgccuguagucccagcuacucaggaggcugaggcaggagaauggcgugaacccaggagguggagcuugcagugagccgagaucgcaccacugcacuccagccugggugacagagcaggacuccaucugaaacaaacaaaaaaaaaagauuucuucuccaaaaggaagucuaacuccuucuccagccucuuucaacuaguaguaauuccucacgcuccagaauaaucagauuuuccuguccugccauagagaggaaagggaaucagucuccuucuugguuuuugugggauuguuuuaagauguacacuaaugauaaaccaacuuuucuaccucugggguaagugaaugcaacuuugcccuggugucuuguggcuaaaaauaauccagcuauagucuccaagacagcaagaaucuggaugaauggcugucgcaccagagagagcaagcuggucuuggucuuggaucuggaugaauggucuugguguugaaucuggaugaauggcuguggcaccagagagagcaagcuggucuguucucauucagaggaacucuuagcugcauaauuucagauuugaaugucuuagaguucaucuccagcugaucuguauuauuauccgauuaacuuuucuuaucacagcaggucuauguaaagaaaauacagcuauuccucaacuugcgauaggguuauaucucaguaaaccccuuguaaauuggaaacauuguuagucaaaaauacauuuauuacacccaacuuaccaagcaucgcagcuuagccuagccuuccuuaaacaugcucagaacacuuauguuagccuacaguuaggcagaaucaucuaacacaagccuauuuuauuaaaaaguugugaauggcucauguaauuuauugaauacuauacugaaagugaaaaaagugcccauuguaugggcacucaaaguacaguuucuacugaaugcauguugcuuucacaccaccauaaagucaaaaaaucguagucaagccauccuaaaucagagaccauuuauaauacuuccucuguaaccauugcaguuucucaagugucagaacagaauuuauuauucuugaaaauguuuuucaucaucuggaaacauggugcucuuuaggguuuacagcaguuuugggaaaaaaugaaaacauggugcucuuaaacuuauuacauuuggacauauauuuugaggguuucuuuucaauaauggugauggauuugugcagauacaucugcugcuugaacauguuuuuucuacuuaucaaaugcagguaauucugaaacuacugaaguaagggugcaguuaguuaaaaaaaaguagacaauuuacaacagucauuagacugcuuuugauguugugucaucugucuauauugaggacauauagaauuugucaccacuuacuauagggauguggugguuugcuauguuaaacaguccccucuuuaagaaauagacaagacuauuguagcaggcaagugcuuuuuuuauuuuauggaugcuguuuaguaccuuuugggacugacugcuaggaaacuuagagucagauuugcugucauacucuaagaauugcauaggaucuuauaucauucuaucauuauuuaguuuuuguuauucauuuauuuuuugaucuaucauuaaugcguuuuggaaugaggcaggcuuuuauggaaauacucucacaauucugaucucauuaacaccagauuuuuagcugacuguacuacaugucuacugcuauggaaaagauucuuaguuuggauauauuccuuuuaguaccauuaguggucguugcaguuagccacuuuuugcagguaugugugcuaagccuuuaaaaucuuuguuuuucacaggucauagagaagagauacuuuuuaagagaagguaaucagguugguaucucuuuucuugauaaaauagauucuuaaauuuugauaggugauuuccaaauuuaaguucagaaguaguuuuaaaaaguuggggaaagcccuuuauaggcacaagcaacugauuuccuucuauccuguuaaauacaaaaggagaaaaucagaacaaagggaaaauaaggaucuaggaaacaaauauaaucuaggaauaagauuacauuauaaaauagaagaagaaaauaauuugcuugggacuccaagaguauacguucagggucugucacaauacaaauaauuucuauaaaagucuaguagguauuaugagauuuaccuucauucuuucugauuuagaugacacuaucaccaauuuguugggaaauguuuuccauuuggguaagauuuauuuuuauuauuuaaucugugguuuucugaguaaaaccucagaaaguuguuuuuuuaagaaacagcaggcugacauacagaaauggaaaagaagggaaaaauuacuauuaguauuugaacuuuuauugcuugagacuuaaugcaauuaucuuucuugccuacagauuccaggcuuuccugaucggaaaagauuuggggcaggaacauuaaagagccuucauuaugacugaauuacacucauccuuuggaagagugagcaagcaguggcaguuuuucacagcucaucuugcuguguucaauuauuaccaucacagccuuuuaacaaaaucaucuuaaaaugcuacccuucagccuuacccuuuaauggaaaaaugaaaggaagugacaauacgggagguccaaacuuugucccuguucucuguguuccuuaccuuucugucccuguguauagauuauguaaaagccuuguguaaauaugagauguugucaaaaugaugcaguaaaugagcaaugacaguguacugcagagaaaauuuacucuugccuagaacuggaggguuuuuaugggucuguaauuuucccacacucauugcugaaagcuuaauuaaguacuucaaaaacguaucuccauuguuuuaccuucuugaggggaacggucuuguuaaccagcccugaguugucuaccccaaacaaucucugucauuuucaaagaugcaaaaugguguuauuuaauugucuccaccauugucacacacaggaaugccuaauaauagcaacccuugucucccucuucucuccuuugcaaauggcucagugacuggaagaggcggacuaauagccagaguuaaauauaaauacaaauuaauaauacauagagaacagcaauaccagaaaaaaagaauucugguaaaaugaugugaaaaauugacagcucccucacucuuaagguugcugcuauauacagucuagguuuucuguuuggaaauagguaggguaaaaucuaagaccugcacaagggcagugagagacauuuacagccuccucucuauuuguuuuuuuaaggaaaagucaacuccugaaaugucccuuagcuauaaucagaaaacuaagaauauuauucugugucaacaauguauuuauggagagaaguaaaaauaaguuccacagcaacacauuuacaugaauuaugaacuaggauucuuggauuucauaaucacuccaaagcuuuuuggggaugguguguguguguguguguguccguaauuguucaucauuacuuuuuuuaaccuaucuuuuugcuugcuuaaucuucucugccccaguucuuccugaguauaugaauuugauuucuaaaaacaauuuauucaacacucuaucacccguauucucucucuggcucugcugcaggucucugcacuccugauuuugcuccauacuuuuaaauaacaauaauaaauauac

SEQ ID NO: 18110 - RNA, 713 nt, Homo sapiens
uuuuuuuuccaaaucaauaggucuuuuauugcaucauuuaaauaucacaaguaggucuuaagugucaucuggcaucuucuuucuguagccagguaacucuuagaucuuauucaucagccugcugaacaguuccuuuuucagagacauagauaccauccaaaaauuuccugauauccuuguuuuuaacuguuguggcuugcugaaucaaagccgcugaauuugaaacaagcucaaugucauuuccuucaaggauuaauucaucuuucugggcuugagauacugaacaagcaacaccuggucucauccgaacccugcggauguauuuuucacccaagaaauuucggauuucaacaagagacccauucuccuggauaacaacguugauggggaagugagcauacacagaccucaucuuguaacggaagcccaguguaacacccuugaucauguucuguacaugacuacaaauaguccgaacgguagccaguuccuuucuguuaccccaccauuugucaacccggagccucuuuuuuuucuuuccaagaaggcugaguucuacauugaugugauugaagucccuccgcaggguuccucuggggcccuucacgauaacugugcgucccuucagaguaaugucgacauuuucuggaaugucgacagucugauugcugagaauagucuucauucucgcaguagacgcagcaaagaaagcg

SEQ ID NO: 18111 - RNA, 713 nt, Homo sapiens
cgcuuucuuugcugcgucuacugcgagaaugaagacuauucucagcaaucagacugucgacauuccagaaaaugucgacauuacucugaagggacgcacaguuaucgugaagggccccagaggaacccugcggagggacuucaaucacaucaauguagaacucagccuucuuggaaagaaaaaaaagaggcuccggguugacaaauggugggguaacagaaaggaacuggcuaccguucggacuauuuguagucauguacagaacaugaucaaggguguuacacugggcuuccguuacaagaugaggucuguguaugcucacuuccccaucaacguuguuauccaggagaaugggucucuuguugaaauccgaaauuucuugggugaaaaauacauccgcaggguucggaugagaccagguguugcuuguucaguaucucaagcccagaaagaugaauuaauccuugaaggaaaugacauugagcuuguuucaaauucagcggcuuugauucagcaagccacaacaguuaaaaacaaggauaucaggaaauuuuuggaugguaucuaugucucugaaaaaggaacuguucagcaggcugaugaauaagaucuaagaguuaccuggcuacagaaagaagaugccagaugacacuuaagaccuacuugugauauuuaaaugaugcaauaaaagaccuauugauuuggaaaaaaaa

SEQ ID NO: 18112 - RNA, 56898 nt, Homo sapiens
cggagagagggguucggcggcgccaggacucccgcgggcuccccggagcaggggucggaaggagggggagcgggagccgcgggggccgcugcagcagaagggggaggagaauggggaggagcugggggggcaggcaggcggggaaggagaggucuuaaggggcggcgaggggaggucgcauuuccuccgaggcuggcgaucggcggagcucccaccuccgcuuacagcucgcugccgccguccugccccgcgcccccaggagaccuggaccagaccacggugagcgcagggcgcacggcgcggaggccggacucuucgggcggccgggggugcuugggcggccggagcgagccugcgggacccgagcaaguuucccaggucagcgcggggcccggcgccuucagacucgcucucuucucucuuccgcagauguggaaacgcuggcucgcgcucgcgcucgcgcugguggcggucgccuggguccgcgccgagguaggcgaggggccgaggaguccgaacucgguccccggggccucuugggucugcgcgcugggcgggugggcgcgcguccuggggaugcucucccgggguggcgcugggaguuucgguccuuggggugugcugggguggagcuggggcaguaaugcugcuuacgaaacuuaaaucuuuaaagcaggaaaaguaguucgggccguaagcgggagccccgccgcggcuaacauggagggagagcggggaggaggagaggggacgggcugggccgacggggacgaggcggcgacuggagcagcagcgaguucaaaaaggcgccucaguuccguccuucacuucagaggagacugagaguaguuggggacuuuucccucccaagucugucuccugggggcgggggcagaggaaucgggauucuucuuuuggggcaaaauuaauuuuccuuucucucuuuuaaagugagaucaugauucucugaaauguauuuucuucuuugugaaguguccucggguuuuguguuaucaucugggcaauguaacggccuuuucccaaguguucccuguaacguugcgcaaguguaagagaagauccauugcucugcucuuugggggcucgaguuuccaguuaaagcauuucagcgcuuguuuuuuuguaccaauuuuuucaacucuaacgaccuuccugagacacuacaaacaaaccaacaaacucuuugcucagaagccgcuccauuaacucaaagguuuauggacagaaaauaaacaauucuaaauuccccgggcuccagucuccaggaaagugaggucagaaacuaaacauuugauaauuauggcaggaaauauggaaggaauuaaaaagcaugagggagaagaaauggaaugcacauuacaaaagaaauagcucccuggugggugguuuaugcucccuguuugaauuuuuuccuucauauuacaguuuaaccacacccuuagcaucgcagcuugacucugcccaaaaaagucauaaaugcauacaaggucuucacaauuuuuaaaaaauacgcauuguacugaauucucauuuaauucacuacuacguuguugauugagguggaaacucaaucaacuguuuuuacugccaaugaaauaaaaguagcuaauauuuauuaaauaucugcuauguuguaauaaaauuccauuuuaaugacagauaaauugagucagcgaagguuacccaaugcucucagcuauuaaaugcuaagggugggauuugaacccaaacagucuggcuccggacccaaggcucuugaccauuaacccacaccacuuccaagcacaaugguuuaacauuuaccaaguacauuuuuguuuaccacacacugggcuguguacguuaccugcaguuacuucuuuuaaagcucccaaacccuguaauguagguuuuauuaucccgauuuuacagaggaagaaacagguuuaaggagauuagguaacuugcccagggucauacaacuaguuagcucugaagcaggaucugaaccuaccucucuuaccuuuggagcccaucuugaacuccaggucugcuucuuauccaucugguuuuccaggguuugcauuugagagcguaucccccuucacuggcugauguagcccugguuaagaaacauuucuccauccccugcuguggcccucaaaaggcaguugcagaccagugauggaugaggugaaucccugguugguuuuccagcaggcucaagaauugccagccagugugugaaaucacucagugaacuggaaugcaaauaugaggugugaggaggcuguugguugacuuaccaggcuguguggcccaaggucuggaaucuauucuaggcggccugcaagacacacaccccucccaacccccuuccacacagggaaaacuuaucccugguaggaaguucccccagcagcaauuuccugcuggagguagaagagcauccagugcucucacauaauucccaggcaaacuacagggaagaaggcaaaauagagaaguacugagaugugaaaacagagugcguugggggagaaaagaggcugugaacucacaguguauggaaaugguuacaaugaaaagagugagggguagguaugagcuagguuacauuucauggcuccagguuauuaaggauuauuaucuuuuaauuauuccaaccuccuggugccuggccaaguaagauuuggcaaguuuuuaauccauuuaauaauaauauaccuuuaacaauugaugaagagguacauuaacccucucccuaugggaauuguaauuuggauuuuuuaaaagccuuuuaucuuguaguuaauggugcuugcuguuuaaauuucuuccuuguuaacucuaaggacagucugcaaaaauggucacaucaugauauuuacaguccuuagugacaaucuauuuuaguaaacuucaaaucgcuaaaauuguacaaauauuguugaacuuuuuagaaaugaaauuuagaaaauaaauugaggcuucuuggugcuuucugcuuuucugcgaccauaaauauuuaauucagcauauuuuuaaacaauuuaaucacuuuacaaaucauguugauauuugaagaagccagagccucuguaguaaaccagaaucagaggugcucuccacuugggaaaaggugauugucaucaguauuaaugccagucuaugucaaucccauuugguuagauucacaaagcuauuaacaaaagucauaaaggagccugggcucaguggcucaugccuguaaucccagcacuuugggaggccaagacgggaggacugcuugagcccaggaauuugagaccagccugggcaacaucgugagaccauaucucuacaaaaaauaagaaaauuaccugggcaugguagcacacacgccucuggucccagcuacucaggaggcugaagcaggaaaaucacuugaacccaggagguugaggcugcagugagccgugauggugccacugcacuccagccugagcaacagagugaaaccuuguauuuaaaaaaauagaaacaaacucauuaagcaaagugucauauuguuuugaauguguuccaugguguccuacuuccuuggcaccucaggguugcuuucugauugcuucuucucuuucuuaccugcucacucucuuacuacucugucugcagcauauaccuucagccagccucccuccagauucugccacauccaccugagcacacacacccaugcacucuguagucugcuugaaagaagguacuggguguagcauaugucucuagauguguguagauuaacaugugaauggacuaggcagagagggcagcagcagagggagugccugcacuaauaauuacacagauaucccuuuucuagauucucuggggagaggacugugugagccugcucaucuacucuuucccaucccccucccauugggaauuacuacaguucauugagaaguguugaugguggaugcauaguauggagccugggaaaauguuaagaacacaggcgguagugugugugcccuugaagcucagucaguggauaucugucacucuaacauggcaggcuggagagaacccuguggcccaacugccugcuuuaggaagacagcccuggcaaguacccaagcauacccccacucucccuugguggaugucucugcugucacuaugauucccagcauuccaggucuagaaauucauuaugauaagucacauguacaguuaacugauuuguaguucagaauccucauuccaguaagggauccaugcuugacccaugaacuuugaguguauuaccuaagagagaacaauagcaauucuacaaauagauguacuucacuuagcucuagacaugcaauacuagaagauuaugagggcuuuguccugaggccacguuucuuaaccucaccguacccuauuaucggcauuguacacuagggguuauauuugggagcuccucuauguucuuuagaauuguucugaugguagacucaaguaagccuugcaucuaacccauaucucugacugcaucuucuuggugccacaacuuguauuauuaacaaagcuaaaaagaucucuaaaaugaucucuugcuuguuuauccuuuggcaaauaagcuacuuguugcaguucuaaagaccauugcuggaaauugggguguaaaacauagcaggggcugugcagacuagccagaacagaagggcaagcacccagcauaggaggcccuggccaucgcaaguggcuuuagaagguggacacguuacaguuccccuagaagucucuggauugggugacagaaaccaggacuccauccccaggcucauagaagcaaguuggagaggaaccaugaggugaagaucuggucaugggcugaaguggauguaaugauccgagaggaaaugccccaaagacgaaaagaaagucuuugaagucaguggggcagagcaacacaugcugccacaagaauaggaaguaaaggaugagcuguaaauuaccagugaucacauaugagaauugaaaaugucauggauucuuugucuuaguccucuucaaauaacuggacaucuggcagaauguuucuaacagacauaaauuuuauuagcuuaaugauaccaguuaauagggaaaaaaaguacauuagauagguucacuuuguaagccagaugauuaauguccucagagggcaaaugcauacuuuuuguuuaggaugcucuauucugacuccugcgauuuuggcaaggggugcuuucucugagaguaugccaugaauggcguggccuucccuucacuguccucaucgagccuauccccugcugcagcugagcgcaccugguacucaggucagagucacagugaagcacaaggcauggucucugcccucacauuauuuacagucuagugguggguccaggugcuuuaaaucguggcagcuacaguuuauauuauuauaacuacauaguaacuaguagcuuuauacuuauugcuguuuuuuuuuuaauuuacauuaauguagggccuuccuuuguaagauccuuuuaugguagcaaaaugcacaaaucuuccauguauagcuucaugaacuuuuacaucuggcccauguaggcaccaugcgacaagacugagggaguuaguacagaaagguaugaaccuguauguuaccaugaaguuacauacaggaaaaguuaccaugaagaaaaugagggauagggaugaucuaggguacauuucaugacucucugcccaaagauggcuaucuuuuaaucugucucuucucuuggugucuagcccagguaacauuuagcaaguuuuuaauccauguuuuaacaacagcaaaccuucaauaauuaaugaaagauaaauuaauccucucuauaugagacuuacuauuuggauguuauuuuuaacauuuuaacuuguuaacaauaaauggcuuuccuuguuagcuacaaggaugugcagcaaacacagugaaauacagccuuaauugacauuaauccauuuuaguaaacuuuagaucugcuuuggggagcuuucuugacuguuuuguggauggauagauauuccagggcucacuguaaucuauauugaauuccacaaagaacucaaaucauucuguuagaccacuuugcccuggucauuauuacuuuugaaaggacucuacauaagaugucagucauguuauuuaugacagcaaaaaacuuaacauugacuacauagucaaccguaggagaaggguuaaauaaaucauggaacagcuguaugugccaccaaaagcauuuacaaaaacauuuugaagcgccggcaaaugauuauaauuuaauuuaaaaagcacacaccccccagcuuuauucucacgacuguaaaaauuuauagaaaaguacaacaaacaaauguguuagaaauuaucuguagguaguggauuuaugggucauuuuauucuuugcucuagucuuuucuauauucucuaagcuuuuaauuggcauauuuuauuuucauauuuuaucagaaaauaacacauuaacuuuuuuauuuaaauaaaauaccacauauuaggagaagggaaaauuccucucgaaaaaaggaggggaucacaagaaucgucacgaugucaaggcacuggaugaaauauccaaggggcaggacuucagggauugcuuaaggagaaaaagguggggugguaaauggccuuucagagauggcacagacguggcauacauauuaccauuacccucucccuuacccaugacagacauuucuaaucaaucauagaauucuuuccuacugaacuuggagaagguuugaaaauccuacucagcaauauucuagguagccacuagcaaucagagucuauaugagaugaaagcuauuuaccaucccugcuggaugguaaaucaguccaauuugacaaacauugacacaucuuuagccaaaauuaagauaauuagaagacagaguuugggacuguaugaaacugacaaaaacaacauaggguaauagaugauagaacuggguuagcaaauggaugaaaugucaggaaaauagcacuuacaccagauuuuggcccaaguuucuaagcucuuuggaugaaucugaacaccuuaaaguaagccagaccuucuaacauuggcccagucaacaaaaauauaacgagaauuuucuuggcuauucugaugaaguaaacaguugcucuugcuaaaguucuaagagcugcugcugucauagauaacagcuuuugcauuagccuggcaauaacuugcuaauagaaugcucuuuggguaguuggaguacaaaauaauucccauaaaucuucauuuccugcuuugguuggaggauuuccauuuaaucuuuucacagacuuuagaugcucauuuggaagccaucaccaauaaacuauucccaggauuagucugaauguaugacccccauaugucccuugaauaauccuggacaccauuugugaccaacuaagcuguugacaaacaggucauaugauacaugacaaaagcuaucacauguugcaggcccagauuuauaugugcaugcaugugugcaugugugugugugugucaugggauauuggcuugaauugauguaaggaaaacgucucucugucuuucuauacuuuuuguuguuucaagauuuaaaauccuaugucugaggcaaaauuugucuuuuccccugucuuuccucuuauccuucaaugacaguuaauaaguguaauuuauggaucuacagaagugucaggcauuaugcuagucaguuugcacauaagcuacuauuaggaagagugugggacuaaaaagccuuaccauacagaucccuguucugaaggagcugcuaccaccaucgcugcuuggccauuaggggucagauguaaggcuuuagcagaaauuccccuuccucaccucuuggcacuacuucagaaaauccugaaacauggcagugggauagauggccccugccuucucagaauuugaaagacuccacuugggcagcuggggcccuuuucagccuguccaccuaaucaguauguccaguagauggcagcuuuuuguguggaacuuuuuuuuuuaauuuauuauuauuauacuuuaaguuuuaggguacaugugcacagugugcagguuaguuacauauguauacaugugccaugcuggugcacugcacccacuaacucgucaucuagccuuagguguaucucccaaugcuaucccuccccccuccccccaccccacaacaguccccagagugugauguuccccuucacuuuaucuuaccuugugaccguucugggggucugcuguuuuucucuucccauuuuucuuugucuuuucuuguucucauuucugggugucuccaagucugcuuuuuuuuuuuuuuuuuuuuuucuuuuuugagauggaguccgcucugucacccaggcuggagcacaguggugcgaucucggcucacugcaaccuccucugccuccuggguucaagugauucuccugccucagccuccugaguagcugggauuacaagcgccugccaccacacccggcuaauuuuuguguuuuuaguagagaugggguuucaccuaguuggccaggcuggucuggaacucccacccucaagugauccacccgccucagccucccaaagugcugggauuagaggcgugagccacgaugccaggccuaacucugucuuuuucauagacucuguaacaaacccauuuuguuauuaagagcaacgcuguagaacaaugaaagaguccaacuuagaaguccugcugugcccuuuucugggcaccuuuuuaaagucacauaaugucucuaacuuguaucuucaguuaagagcgagggcuuuggggcaguggacugaguuugaauucuggccuuguccagcugugaggccuugugcaaguuacuuaaccuccccgaagucacuuuccuuaccaguagaaugggaaucauuccugugucucuaccugucuacucgauuagaucuuggaaaaggucuccucuacucaugguguauagucaacaccaaaaacaaauaccugcaagagaugaagggucgcuuauguuuuugacucuguaaugauuucaccaggagaauccucaguauacaaguaaacauccacuaggcauggucuuuauuugcacagccuuugugcuggcucagguuguuacucugauuacugauuuuuccucgagaggaaguauaacauaauggcuuagcgcucagaccuggaagcuagauuaaauccuagcacugcccuuacuagccaugugaucuugggaaaacuacuuaaaaccucucugagccuguuuccccaucucuaaaacgggcuuaauccagaguaucuaccccauagguugguugugagaauuaaauaagcucuuacauguaaagcagaguguuuuggcacacagugugcaguguuaguugguauuaucaucuucagggcaucucuaggggacgaacuccaaaagccaugggugcguguguguguguguacauguguguacacacguguguuugcacacacauucacgcacguguauauguguguucauggcauacagaagucuccuugcuucuuuuucucucuccagagauuuaauuaucaccuucuuuuuuaaagagaaaacuaggauauuuacuucaguggaugcuuuaaggcccagaauuuauaucagaacccuugcuucuacugagcuaaucuugcccuuaaacuucuauguaguguuucuucugugaagccacaguucuaucauuccuccaggaagagauugaaguacucauggagcaucuccugugcagaggcaguaggaugggaagccagcauagguucucccuaaagguagagugagugaauggaaauaacugggaagaaaacagaaagaaaaggcaaaaaaagagguauguaugaagguggcaaacagauaucuuggguggucauuuccauuuugcuguggucuucauagcauggccuguuaccaggcaauaaauuucaaauuguugguguggaaaaugugauaaugcaaaggaauaggauccuuugcuuucauuauuucaaaaauaagugccaauuacucucaaagacaggguaagaaguauuccuggagcaagcuggaauuugucccuuugggagccaaggccacagcuucugguacuuugcacacagaccugcagucccacuagggaggggcugcugugucugcagccaggccgaugccagccucacaugcccaccccuuccuggcccuggagccagcucucuguaccacuccuuauguugcucuuugcucuucccuucaucuuucuccucuauuuuccuucucucaccauuacagagaggucauccugaagugucugggcugcaguaggagcugccaaacauucacgaaccaccacguucacauuagaugcagagauaaaacugcacaaagucucaauacacuauuuugcaucacucaucugggacaaaguaaaauuuuucaaagucaacucaaaagaggaaaacaaaagguauugcaaaucuguucucuguuaggcacugaguuagugcugguggauaagagaccuugugcccaaagagcuugcaguccggaggggaggcagacaggaacacaggcucaaagugaugcaaugugagaaguauugggacagggcugaaaaccuaacccagcacgaagggcucaggagcgcuuccaggaggaagugacccaccagcugagcucugaaaaaugacugauagucacugugucuuguggaaguuugaaaaccaaagacacuucugcuagguaacauccacucagcauuguagagacccagccguuuaacuuuccagguaacaucaguuguuauauggcuaugugccuggaaugacacuucagacuuggccauucuggccacauagacauggcaggcaugaccuccauuuggaauuagguccauuuacuucugagucacauuggaaugcaguuuuuacaguggagcauuugcagccuaaugaucagugacuuaggaguuuuggggguuuuuuuuuguaccaguuguuuuguuuuguuuuuugacacaggaucuugcucuguugcccgggcuggagagcagugacacaaucuuagcucacugcagccucuacauccuggcuuaagcaauccuuccaccucagccuccagaguagcugggacuacaggcaugugccaucaggcccagcuaauuuuuguguuuuuaguggagacaggguuucaccuuguugcccaugcuggucucuaacuccugggcuuaggcgauccucccuccucagccucccaaagugcuagcauuacagucgugagccacagugcccagccuugggggauguuuuaaggcaauuucuuuguucuucagauguauucacaacuguuccgcauuaaauaaggccaaauggcaagacagcucuaaaacgccagcagaguugcuagguaggguuguacagacuguucacugcacaagugugucauguaccuguguguggcacagggcuugucugcccacccacaggaaggagcacauuuuuuucuaacugaugugcaaagcuccccaaacccaacguuaucucugagucaugugauguuuauuagacuauggcagucauuucuacauuugugcaucuuauaaguugauuucauuuagacucuugcaaaguuuuuguacuaggccuccaucaaaagccaguucuguguuuuuguggauuuuccucauagauaagcagagaugauagacauggaaaucuuaaauaucugguuucuuguacccacagugugcuacuuugggcuguugcacaagucagucuaguuugggaacugugauuccccaggaauuaaaacaaguauucccagcuuccuucugauugcuggauuagcagaauuuccucagccuccagcugaauuccagccccugggaagaaaugucuuagaguaaacccccagccuggagccugucagagguugugucauguguuugcauuagcugagcaaaacccgagcaggcuuuccggccuugcucucgccuccucccugcacgccucuccgcugggagaggccaguuaaagucuagacacugucugcuuggcucugugccuuuuuagcacaaucugcaugguucuguagcucuuacuuugguugucuguccucacucguuuccccaguuuucuuaguuaggcuuaaacugucccgggggacuggcaacgagucgcacacauaggaaacaggugagugaauuuaugagacugucaggauucagcugccuugaaagguucagagugaagauagcagcagugcugacugaaacuguggcugaguuuacagacaucccuggugugagcuggcuucaaacgaaccuccauuuacuggccagagaugggcugggaugaauaacucaggacagacaguggcaccccagguaaugagcagccaccugacuccucaucugccaaauauggggguuagaguaggugggcucuaaaaugcagcuuugaaguccuauucauauaaaaggaggcggauauucuaggcuagacugucaaaauauucuacuuaauggaauugggauauuugauuaacucuuauggugauuuacagccuagugaagaacaguuugaaagauaggcuggcucaagaaugagaaaacagagugaauaaaaacaggaggcaucuuguguccuuuacuuucucucgccauguagugaguggaauauaaacaguacggcauguggcaccugaacagucuucaugcccaggaaucccaaaugcuguuuacucuacagaaaggaaucacuugauuuuccacuucagaagccaaccgcucaacaacacuggggaagaaaugaagaauccugggucuccuuguagucgaucaagaaauuuuggggggaaaaagggaagacaaccccuaauucagagugugcaguuugggauuuauugaacuuacuugaaaaacaaaagcaaacaaaacuuuuucucgcuucuguaaauguucacauuuucuuuuaaaaauaaugaugcaguauugcaaauggcuuacagaaauaguugucugaaacuauugcguggacccuaauuuuguuuucuggaauccuucuuauuacuuucucaucauguugccuggcccaugaucaggauccaggggcuccugaacaaguauuaaugaauugccugcccugcuccccuggcccugaucucuggucagaucaggcucuuacuacagcccaugggcacuggucuuuggcuuugacccaaugguuaaaucaagugacuuguuagggugaacacaguaaggaaacagaggccaaugcagauguuuuaguccugcugaaaugcuugguaccuugccuguacuccaguucccgaaucucacuagaaaaucccaaugugcuaaaucgugcuauugauccugacuggggagccagccagcucaauauuggagguggcuuuucuaguaaggguacaguacagguuagaauugaauuaaauuuugcugugccccaggguagacuauaugugugugugugugugugcauggauaugugucuguguacauacagaauacacaaggagacaugcacacacacacacaaauagacacugacuuaaauuucaccacuaggagaacauggccaucucccuauagcucuaauagugagacuuuucucacaaaaauuccuguggaauuuguuuuguuuuaauuuaguuuaguguuugacuuauguuauacugcccugauuucuuucuaagccuaggcacauaaaccagugcuuauuuuuauggugugaaguuugccuguuaaugaauuuaauaagugcaugucauucauucacucauucccuaccauauuccaaaaauaagacauagguuuucccucccuaaucccacagccaacauauccuauuagcuucuguaaggguugggcuaauuacauguauuuuuagcuauugagagggcccaaguuuguaguuuguggcauaacauuugugacagagaaaaagaaaauggacgggaccucaaagaugguccgagaaauuucugauccccuucacacauauaccuggcucaccuaaacuguagugugaaauugauacaguggaauuucuaucagagaggcuaaacacuauugaaacagaaauacagaugcucacccugagcaaagacucagacauacugaguucccuuuacugucagggucccuaccaggagggcccagcauggcuucuugguggcccagccgagcucacaaaacuugcuuugggauggaggcagauguaugcuugccagucauucacaaauacucggagcacgcagcuucgcuucucccagggcaccaccaucccugguuuugcacuaugugcuauaauuauggugcuacagggacaggcugaguccuauaucagaagcaggaaauucaccuggcuucucccuagagucccagcagucuuucaggaaugugucuguuugugcuuuguuccccuuccucuaguuuucccuccuugacauuuucuauuuucuuuccuuucuuauccuauguggccuuggucuugcugacagccacaugcagagaugcagauuuucugguuuagcuauuuauuuuaaggagaaagacauucacuuuaugcauuaauuggugucugccuccuguuccacagaaggguaauuuucuguguggcaccaagggcuugauagugaucaaagaaaaccccaguucccaguaggaacacacuucaggugugaguccauuuuggguuucucaaucuccuuucuugggagaugaaacuagaagggagaaugggacugggaaauguuuugaguagaggccagacauucaagucuuggcuaaauguuggguauaauaauuucaguacucacugcagacuuauuucuuaauaaaacuccccaagcuacuuguggaccauguuguuuuaaaggauaguuacaaaguuaaccgcuuccucuuacagauacaauuggagaagagucuuuguguuuuuucauuuucuacaaaggaacauauauaagcuagauaauaagaaaccauguugggguuguuuuuguuuauuacguguccuauuuuagauacuuuuuuuuuuuuacaaaaauaaacugugauagggauaugaaauccuguaaaaacaaccagcgcuugaggaugacuaccccacuauguuggucauuuuacagcuuagguaauugcguuuuuccuccaaauuccccauacacauuugaucaaauagaagucucuucauuuccuguuuaaguugcuccauggaauugcuguguggauuagagagcaagcuggguuccuccccaguggcuguguuuccguugguugauuggguuauuuuccagguaaugcuauaauuauuuugcccaguguaaauggcauugucguguagugacugaaauuacucauguuacaguggccuggaauguaaagacuuccucauucuccagugauuuguuguuugacucugacuccaggaaaaagucuuuucucugccuaggcugaagugugugcauguauuuggggcucagauagauagcugaggcucuagacugccagucugugggcucagaugugacaguagccauauucagaaagucaugacagucucugagaaagagacaaaaguuaggaauuguaagccuaagaguguucaaagcauguaaugaacuguccccaaaugguucuuguccuagaaguggguagaacaaauaaggaggaggaaaauagugaugaggaagacuggaagaagggagguggugaugcacgugggaaacucuguuaauuuuaguggguuaagcaaaugcagaugaggcaauugagugaagaauuucuguuaagugcuucaugagaaaauacugugagugaacacugcagauguauaugaucagaaaagauauaucacuguuuuuuguuuguuuguuuuuguuuugagacagagucucgcucugucgcccagacuggaguguaguggcaggaucucggcucacugcaaccucugccuccuggauuaaagcaauucucgugccucagccucccaaguagcugggauuacaggugccugcaaccacgcccggcuaauuuuuguauuuuugguagagaugggguuucaccauguuggccaggcuggucuugaacuccugaccucaugugagcucccugacucaaccucccaaugugcugggauuauaggcaugagccaccgugccuggcuguuuuuuguaaguaaauguaugcucuguaagcacaacucacaaaugauaauuaaagcuguaaauuaaaauggcaccuguacauaguguguggcaagggagaugaugucuacaaaggugccucccacaagguaaguacucaauaaauaguaguugcuauuguucuccuuguuguuauggcuugaauuccaaggaacgguaauaacaccauagggagagacaugaagagccuagacccaaaguguguagugagugaaguccauauaugugcuggguuaaaugguuuuuuaguuagaggauguuccagaguuuuacaaaguucgugugcguuuaugacucuagaaggaaguauaauaaguaauguuucccaaacauuuuaccacagaacaccauuucaaaaaaggccauaaauauuucaaggcuaguguuccauggacagacuucccaugaacaggaucuauuuauaugugaccccaggucuuaguggccuugcugaacucaccucauaaacuaaguuuccucaggaaggcaagggacuugucuggacccagagccugucucagagaagauccucuugguagugacucuagaauggaccaucagcauggccaugugcacaccuacccagaacuggcugggcuuuuggauaucaacuuauguacccaggaauuuucucuuuuauuuuucacuuucucuguucauacccagucuaucagcaaguccugccuucuguacugucagaauguaucaccucuccauugacuguccucuguccccaccgccaccacccuagccaagcugccaucauugugccuggacuauugcaauagcaccuagcugcucuccgcuuucucucuccugcgaccuggcucuuucuguacaggacagccugaguaaucuuuguaaaacacauaucugaucaugccacucccugagcaaaaccccccagugacauccauugcauuaagaauaaaauacagacuuaucaguaccuuuaaaacccuacaugcucuaccccuugccagcuuuucccagcuuaccucuugcugcucuggcuuuuggacccagugcuauggcuacacuggccuuuucucuguuccaggaauguaacaaauuccacccugcuucagaaccuuugcacuuuucuacuuucgucugaauugcucucauccuucaggucccagcucaagaaagcauucccugaccacucaaucuaaguggugcccucucucccagaguucugucauacauacucuauuuuccucuaaacuuacugaucacaggcugaaaugaacuuguuauuuuuguuuguuuauucaccuuccucccucuagagcauguacuccuuuagaauagggcuuugucucucucauucugcaauggaucucuaauaccuagaaccaguugugcuuaguguauaguagaugcuuaguaaauauuuuuugaauuaauccacuagcuaaauggauuaauaaggccaaaugucucauauguaauacgaagaggugccuacaaucuuuguaucuuaaugauagucaucucugugccguauuuugcaagaauguugugcaucugggaagaugguugacagcacuugcccgucaacaguuugcuuaaucuuggacaugauaguagugcugggcuugcuuaaucagacaccuggauucuaagucucucagucccaggugaaguuggaaguuaagcagaggcuagcugaauaguaaauauuuuuauuguuuccuuccaugaucagcaauuuuaauauaacuuggcaccauucccagaggaagcuaaugucccaaagaauaugaaauaaagcauuaaauucuguuguugguaauucuuugcccauagucacuagucaccuuugucuuuggaccucaccuuuugcugaagccuuuacuuuuuuggauccuuccugcuguuacucuuucucucugguuucauuugaauggcaacugugauguuuccaguauggauaaaacaaagcaaaaggcauucagugucacuggauuugcacauuaagaucucagaggcgaagucucauucuggggaacguuccaccgcuaacacaguggacagcauugagugaagucccugggggccaaccaccuccacuuaccuguggccuuaacuccuuaagucagaguucccggacuuaccauagcauacuacuucauuuuucaguggaguugggaguuccucagggugaccccaaacaguuaaauauguggcauuucuccaguguuuacacaguuaaaaugaaggauaccagagcugugagaacaauauuguuacaugauacuuggaaguguuuuuaccacaaaugauaaucuauccauagcaacuaagcuaguacauuuuuguguagaguuucuaaugcaguccuuggggaaaaacagaaugaacaaaaaaggaggucuuugugcauuguguacagcuugagggucucggaggguuuuaauuucugaaaaaauaggggggaauuuguugcagcggaacggaauaccuggcagucccucauuggugggccuccugucagccaaggccugauuggccagcauaaguagguuuuacagcuccuuccccccagcugugacaucccaacugcuucaaggaaagaaugcaaggcaggaaugucucaagaagaauagaaugugcauguuuucauugacuuuaaucucaaggcacugaaacuguguuuguguguguguaauauugaaagcuggcaguaagagaguguagcagucaagccaagaaaauguuuuaaaaagguuuugaaaagauauaucuaucucauugccaaauuuguccauggauuuguaugcccccaaaaaagcauauuuagcuaagagaaggcuccaaauauguacagcuuaauuagcccuuuugucauuguuucugagcugagccauaaaaagucuuacagagaggaaguaccaaacauuuuaccuuucuuauagaggagaccagaagggugaaaugacuuguccacaggcauugaaaacagccagaauucagccuaagugcccaugacgccugccuauuuuugaaggacuagguccucauuacucaguauccuggucccagaugcagccugacaugcugccuugccuguauguucagauaaucucuauugacuucaguuauacaccacuugaaaaguauuccaaguuaaagaaggucguccucuuucuccucaaacccuccuccuccgaugcagugaggucagaacucagaacuauuuuuauuuccuuuuuucucuuuuucuuuuuuuuuuaagagacaggaucuugcuauauugcccaggcuggucucaaacuccuggccucaaggaaucgucucgccuuggccucccaaagugcugggauaacaggcgugagccaccgcauccagccauaacuguuuagaacugugcuguucaaugccgauagcuacuagcugcaguggcuauugagcacuugaaacguggcuaguccaauuuagauguacuguaaguguaaaagacauaccagauuccaaagacuuaguaugaaaaaagucuaaaauaucuccauauuauugauuacauguugagaugguaauauuuuggauauauuuucuuaaaauaagugauuacacuuaauuucaccuuauuucuuuugaguuuuuaaaagguaccuuccagaggccgggugcgguggcucacaacuauaaucccagcacuuugggagaccgaggugguggaucacuugagguccggaguucaagaacagccuggccaacauggugaaacccugucucuacuaaaaacacaaaaauuguccgggcaugguggcaggcaccuauaaucccagguacucagcagauugaggaaggagaauugcuugaacccaggaggcggaguuugcagugagcugagaucaugccacugcacuccagcaugggcaauagauugagacuucgucucaaaaaaaaauguaccuacuagaaaauuuuaaauucuguaugagauggguauucuauuucuguuggacagcacugcucuagacaguugucacuuaaccauagccacacauugucuugaguuaucucuuauuagauuguguuguucuguuauuuaaaauugcauauauucauuccccuagcuucucaccuaagcuacaagcuccuuagagacacagagugugcuuuacuccuccuugagccccuggcacuuggcaugauguuugguauguuuuugauuguccuguauauuacuuauagauuucaucuauuuccauguuagauauugauaaggaaaugcagauuaauuuguguuuggauuguugcuuuucuuuucaaaggaacugauuuuauguaguucuuaguuuguuccacaaagauuaacauuccucuaaacuggacuauuaaaauccaggggaccuguagagggugccagaacuuccugacacccaugccuaguagagaacaaugguguuaaaauugaugcuuacagguuuuaaggagccccuccugaccaccccagaaaucuugagaaguuccaaacucagcucagaaacuugugcucuacuuuucaggaccugucugaguaauaggugcaauaaauuaggcauguuggcccagggacucccagccuuaaaccaggguugagaagagggucaccaccagccugagucaaugaguaacugucaggaacuccuaccagauggcugugauucccaaagucucugagaaaauucuaggagacgcacucugggugggccuuacccuuuaaacauccugcaauuuuguaacugagccuguggcugaaccacaugcucauaauaucuaggcuggcuagcuuaugccuaaaacauagucauuucugcuggugcucugggagagccugaucuuucccugauuucaugacuacaggaucccugugccacuguuuucaguucagauguuaaagaauguguaagaaugcacuccuggaaaccacuccccuucaggggcagauauauuaggucucacugcuguggaaugaucccacuccacugaccacuuuauugcuguaaacagugaauagggaacuaucucccuuaggugacaaagugugaaaugaaugauugucucuuuagaggaguaguuggaaggauuuguaaugaucaagacuuagaagcaaagauggucccaucugcugaggcuccccagcuucccagcagcagaacccuagaaaauccuccuguggcuguugaaucaagggagauuaaggcuacaaaaggcaguucaugcccagagcaguaaauuaggguuugucuuuccuagguuauuggguuuggguuugggucuuuugaguauugaaaaauucaugcccccuugaaaauccagucccaaaauuuauggauggguuucugggggcccauagauaccagguuagcauccucacucucuaaaauaaaaaccacaaauuuucccaucccauaggcagccuaguaauuaaggugaccaugugucacaguuuaggccuguuguccaagugugucuguuuaaaagguuuccuuuaacucucaaauguccccauuuggaugauaaaauauauggcugaaggccacacucaugggugcuccagagugaugcauaaauuaaacuugcagccucccucacugauccucacucagcuccagaaagccccagagaccagagauuacucuucagcacaaacucuccucugagaguuccucauuccuuccuuuggaugcccucugaagggagcccuugaugugcauuugaaauugcuccaggggugggaauggggauuaggaggaauuugagggagagggccuucuagagccugggcgugggcaagcuggaggagccagccaugaagcccaagcaugaugaacaccacuggcauuuccuuggaagacuguauuccucggacuccagguuuuccccacuuucuuccuggccagcaguugcuguggcaacacaaugucugagaacuucuaauuacaucugucugcuucuccuagaacccuacugagccacacauauggagacuucauuuagcuuugaguuucuugcuggguuuuaacccugucugcauccuuaggcuagagaauaauugccaggaugcuggaaccuuaacugcuuugcagccacacuacccccagagauucccaggacuuugucccuguuuuuuguuguuguuguuguuguuguugcuguuuguuuuuugucugagacagagucucacuccguuacccaggcuggaggacaguggugcaaucuaggcucauugcaaccucugccuuccagguucaagcgauucucgugccucagccuccagaguagcuggauuuacaggugcaagucaccacacccagcuaauuuuuguauuuuuaauggagagggggguuucaccauguuggccaggcuggucucaaacuucuguccucaagugauccaccugccuaggccucccagagggcugggauuacagguaugagccacugugcccggccuguccuuguuuuuaaaguggagacuggugcuacuuugcuaugcugggucucccagauccauuuuguuucagucaacccugacaucccuacuauccccccagccuccaccauuguaucagauggucucaccucuugguugggcaucacaguucuuacuaaugugcccaauccaaggggagauaaaccacgugggcacaccuaaggcuuugcugucccggcaacucguguuucaguguauuccagcccacugcaaggucagccuaguggaugagacagaggggaguaguuagagauccccagaauauuuugggaguggaggagggguagagcaaggcaagaagcuuuuuuccuggucuagaaauguuggccagccugucucccucuaccucagaagacaguguaagggcgggguuccucagaagaguucacgcaaagcacuggccucagauaauaagcccauuuccacaguuucuccugccuucucacuugcuucucuucaucucuacuucccccuaguauaggcccccaagguaucaggcagcucuuuggcugccccuacccuauacucagaaaucucacccaauuuugcuuugcucugagauaccccacauucccacauuaccuuaucuuccucuucaccaaauucucauucucucagcaugucucaguuagguuaaauauuuaaacuguggacaaaggaaaugacugaaagccauuuucguccuccguugcucuucuaccucauuaacacacauaugcaugcacacacaugcacaaacacacucuucaaugucuuucugugggccuaagacaaucucuaauuagugaaauuccaggcugaauauauauggccuggugguggagggcagggucuuuaggguauuuccucaaagaagaccaguucugggagggagcagccccaggaaaggaguuggcacagguguuguuccucucugucccuaucccaaguccccagggcagugugguucaauccaccuuuuuuugcuuucaacaaagguuaauggaguggcacaagguauacuagguccuacaaaaggauggacaaacagaaucuuuguccucuaggagcuuguaguucagccagaaagacaaaauccacacagucaguucuguuuuuaaaaaaauaaaugaucaaaaugaguucauacaaagaggaaucaaaguucagagaaggaagggggaauucauaccaguagaaaguaaaaggucacugaggauggagugguguaacuugacccaagccuugaaggacagggagaauuugggcaagccagacaacaaaucagacuucccagauggugacauuauuuuuuuagguggucuugugggacauucucugccuaucugaagguuaaagaagcaucugacaauuccucaucaugcugacauuuucaaaggcuaaugaguucucauuucaaaacauagagccuugggagcccuagacccuuuuuuuaaauuuuaguccacuuacagcuuaaaucugcuguggcuaccugcucugcuuacagacacuucccaaagcuuucaguauccagggucccuaagaaguggaggguugcucgaagugaggagcccacagaucucgaggcuacaugaacaaugaagucacccaggagagaggaaaaacgcccugugccauaugccaaagacuuuguuaacagugcccagguagaaggcaguaggugacagugucgggcauccaacucagugccagggcauguggaccaccgucgagaauaguggcuuggcuugcagguuuagggggaaucaugugcaaauugggguaauggaaagcagccacagaagugauggggguacuguuccagcucagggaagcaagcaagcucucugccacaguggauucuauucccagcaggucugugguaucaggaaccacccagggacuacuuaaauucaguggcacccaaggcaaaaauggguggaguggagaacuagauaccucuuaggcgauauccaucucaucugccuuccaccauaucaggggaauaaauccuacauuccacuuggaacuccaaagaaugcaaauccuaauggguucagggcuugggaagcuggggguggguggagggugggcuugcaugggauggagggaugggaauguguagggauguuggcccagauguggcaggcacugcaggggaugcuucuaaaacugccugucuugagaauuuucccacagcugcccuagagcuuucucccuucuuugauuugaagguacugggauuuaggugugugggaauuuuuuuuuuaaacuuuugaucaaccauuuuccuugaacuacauguggaaauaauuagagcaugaaugcugaguaaaugugagcccuggcagccccagacauacuucagugacagguucuuggcaggaaugaagaauugugaaucgcaugugaauuuccuuuagccuuucucuccuuucuuuucuucccuuuucuccuugcaaggcaaaugcaaguagaauaaaaaauuuauuaauaguauucuaggggaguagaggguuccacccaguucacuagaaacaaaaucaggacacucaauugggguuccauuacugcuucccugauucccucugccaugaucugggagggaaugaaaaggcauugcuuaugagaauccuuugacuaugagagccaacuuuaauccccccuucagaaccuagcaacacccucaugugacuguauacauaaccacuuucuuuaguuuggccauuuagguuagcuuccuugggagagugaaguuugauauucaggaacaucugaagugguaaauuccugagcuuucuaauuaauagaauucuuacagcuuaagggacuuaggcaucaucuauaaccucugcauuuuauagcugaggaaacugaggcccagagaggucaagcaccuugccccaugucacaccauauguuagaggcagagauauauccagggcccauuucaguccuccugcauuaauucuucuuacacaggacaucacugccucugccuggcuuacacuccagguuacuaguucagguuucagcagaaguuuaaaagcuuuuuuuuuuuuuuggcuguuuuaucccgacauuugccaaaugauuucucuuacauggcauucaucauccauuucugggagcucucuaggcuuccugguuuuccucccaauucucugaauguuccuacucuacucucggcugcuuugcugucagaguucucauaccauugugcaggcuguugacugcaugaggaggugacaggggcugaaauccaaacuacacucugcuagccaagccccauacccuggccaugugcugcaucuccuggagagaaaggugccuuuucugauuugcacagagaccccuugugggcugcucuuccugcugucugugcucccccuuuuccuuccacgcccuagccgcccucggccuuccaugcccaccuuuuucuccugagcucauuuguuccucugccucaauuucucaccccuacacaggugacgcccagauaugcaucuuuagccaauauuggcagcugucggugggauguuucacuguccuugagacgcguccauaacugacucaucauugcccaccccacccucacgggacaccuuucccagacuucauuucugauagagacacacaaccaacccuccaggcccuagaagccaaagaucuggcagccccccagacucucuccuuccucucucuauucaggauguugccagaccucguuauucuguagagaucucucuuggaucccuuccuucuauaaccaugccaccacuaguguagaugcaacugucaucaccccaggccuguuccaacugauauccuucugccugcccccaauuccgccuuacccauuucuugccaugugccacuguucaaauguuuuucuuaacacucuccugcucaaaaaccuauagauuuuccauccacauccuaccuuucuuaagagcucggcucaagucccaucucuucuaugaagucccaucuccuggagucggccccauuacuuaggacugcauuggccuguauucuuguuucaucagcucaacuagguuagacacuccuguggugggggcagccacauccucugcuccuuuuuggguuuuuuguuguuauuuuuagagacagggucucacucugucacccaggcuggagugcaguggcaugauccuagcucacugcagccucaaacuccugggcucaagcaaucuucccaccucagccucccaaagugcuggaaugacaggcuugagccacugcacccaggccucccuuuuggguuuaugccacggagcuugcgccaugcucauuacagaccguucucuuuuuuuguuuugcuguuacaggcauucaucaaauagcauuuugauggguuuaaaucauuuuccuuggccauuacugaagaagacuggaggauuuauacucucuacauuggccuucaaaguggacaagucuuagguagacaauuggagaggagaaaauaagaaccauauucaaaccuaacaagcuaauucagggcagauaaauggucuguauuagaaacuuccacuuggacuuuccuaagaaaccgaagggugaaauuaugaaacuaguggcagccuuacaaaaacauuuuuuaggaagagugacaagauaucuugggaacuccuaagaaucacucugaggaguguugcuuucauaauggggagcccgaaagacccugucaguagcaguggagucacuggguguuccuguguugagaaggcggugugguaugucacaggggagacucuccaacucgucacuguggaccaugagaacagaagcaccucucucaaguaccggaguuggagccaccugggucugacucuuaccucagucauggcccagcucuugaagucacagucuccucagugcaaacagggaugaaucccugagccucacagaucuuugugagaugauuuucagcccuauaugaacaggccuaacauguuucuaacucuguaagugcuuacuauacugcuauacuucugcuaugacuagacaagaccauugcagaacacaggaaccgaucauucuauagaaaccaagcaucuagugugcuaugcugugucugggccaccucaagaaagcucuaagcauaggcagcaugaggcauuccagagaugacaugugagcagcagugaaggagagaggcuuccgugugaagguggccugagccaaccuagauucuucagucugaaaagacacauagagaaugugacagaaucuguaaaauaauaaagaaaaugguggagguaaacaucacugucccauuugaaauuugaauauaguaauuuccaggcacacaauacgcaaugaguaguaaaaggaacauguuauaucccauaagcugugauagaggcuaaacauagaaauuaaucaaaggguaauuaaauaauucuugauugaccgggcacaguggcuuaggcuuguaaucccagcacuucggaaggccgaggcagguggaucacuugcaaucaggaauucgagaccagccuggccaacauggugaaaccccaucucuacuaaaaauacaaaaauuggccaggcaugggggcgugugccuguaaucucagcuacugggaaggcugaggcaggagaaucgcuugaacccgggagguggaaguuacagugagcugagauugugccacugcacuccagccuuggcaccagagcgagacuccaucucaaaaaaaaaaaaaauuauugauugacagcuucauaauagauuuuuuuaaaucuuaaagcuaaucuucgucaggcgauauaucucuuaucuggaugucauggagccuggccauacugacccaaaaacauccgaagugccacuguuggcugcugcacuaaccugaagagacuguaaaugacauuuuaaaauaauuuuuguuuauuuuuaagcagcuuuauugagauaucacugacauauaaaaauugcauauauuuaagguguacaaauguuuuaauguuuuaauauucauauauauggugaaauguucaccauaaucaagcuaauuaacauauucacuaccucuacauaguuaccauuuugugugugugcauguugagaaaauuuaauuuaugaucuauccucuuagcaaauuaaaaguauacaaacaguauuauuaacuaucaucgccaugcuguacauuagaucuccaaaaauuacucaucuugcauaaccgaaacuuuguacccccaaaugacauuuaauauacaaaccauuuguugagcauuuucucaggcaguacacuguggugggucugggggaagcugaagugugcaaggcucuuagagucuacuugagauaagccauaugugcaucagauauugaauaggacucucucuaauagacuaaggacccaaaagccauuauuggaaagauuuuguuuaugaagaaaauaauagggcaaauggggaguuggauuaccaugaagcuaauuaagcuuugauuucagaccuuuuauuugcaagggucuugcaaggccauuuacccaauuugcauuuauaauuguauauuuuuuuagcccucccuaaaccauuuaagcuugaggccccacaaaaccaggguuuggcccuagugcauuaaccuugagaugagggacugauugugagcacauauaaggaagggaaacuuauagcagggacugcacacaugcagugcccccugccacacacaucagaaccacugcuagaaaucaccagucccuccuccucuguccauagcauaugcaggauguaccaacacauuucuuuccagaaaaaaagagagacuugaacaaggucaugagauacuccagcaagguuucaagguccugaagcgguuuugcucuuucucucugcuuuucucaggccugugcuacuggguuccagaagagcugccugggagcaaccagcaucucaccccauacgccccacugcagaccucccccugcucuccccaguucugugaauuccuuuguccccagcuccaugguauucuguguauaucugaggggcccugguguuccugugaaguuuccaugacuaauucuggcaaagcaaagagagccuuucucacgucaacaaagccacucugucgcagaauaguggcaaguagagccaaaauuccaccuuggcauaaguagagcuguucuuuuuuaaaagaguuggaaggaggaaaagaauggaggggacagagccggcccacuucauguuagugaaaugaugguauauuaaacugacaguuuuauggcuuugcuuauaagcuuccuuuccugccaaagcacacuguucuuccagaaauuauuuuacuucagaagacuuuuuuuuaaacauucaacguguauuuuauguucagacuuaauucugguuggcccagagacucagaugcacgaucaccucuacugguaguuuugcaaauaacuugcuucuccauuugcuugcaaagaucuuuuuugauugcaaaaaucauuuccauuuuuuaagaccuuggauucaagacauuuccuggcuuugauuuguaaagagguagagugguuuaguggaaagaggcugggauuaaagucuggagaccuagggccaggccucaauucuacaacugugagaucuuggaccagucacauguagcugugagccucaguuuuauuuucaccauaggaucuuaaaucuagaagggccucagagguauccccugccugccuaucuaaaaagaaucaaaaaugacaguaaaauuacagaucaaccagaauugcugugcaaguaugaauauugccauucaauggcugaccguugcucagauacuuucuaccuaguaaaaagucaggaauguucccagucugucuucuaccaaagggaguuugcaaugugaaaauuaaugagaccaaaucuccagagcuuggcuugcaacacacgaaaugaaaacaacacggagacuggucaggaagaugaugcagaaggauaaagcuagaaaucugauguuucuccauugcaggcagauauuuugcugauuuuuaucaauauaucugaguguccacacuuccaaaacacacccucuacccccacucaaaucaauuacauucucacagguacauuuagacuuauagguucauacuuuugugauauuggaccugccugugaccucauacuccuagaaaacauccaugugccaaugugguuaucuacgcauacaugaaguccucauacugcuuugggaccucauuccuaaaaucauuacagugguagaacaaacacuucuauuugcaagaacugcauuguaccuugugaccucacccugugccagcccuuggaacuguccccacuccccaaagcucacugccuugauuguaccccaagagggaaccuugaggcucuggagucagacuggccuuuguucuauuccugagucagcucucacuaguuauguggccuccaugcgucacagagcuuuccugacucuccgaugccucugcaucuguuacaugggacuaaaaauacagagaccugcacagagguugugaggacagagauaucugcagagccucacucagcugaaggugcuaaaauuaacauuggcccuggguccuaggcccuugucauccccgacuagauuacagucuuaaaccuggccgguuuuccugcuugcagccucucuccauccaggcugccuugcacuuugaaucagaauuucagaaaggacccaacacaaauuaacauuccaaagcaccauauccaucauguuaccuacccaaucccaaaccuuccaagguucucacuucucauagucgcuguggagagccccucaggucagccaucgagcgccaccccucuccccaucaucaccugccacccugcuucaucucccucuuccucaccacgagaaggguugaacccaugagcauguucaaccccucucaagguguucuuuucccccacucagaaucaguuucucaguagauggguaagacuacccaccacccuaagcaacuuucuaggcaccucggggaugcaccugacacucccacucccagagaagaugaggcuuggagaagagcuuucaauggcacaaagccuaucucucuggagaaaauuuucuucauuguugauuucugcaucaaagcaugccugugaauggggaucacuggggagggcuaugaggcugcaggugagaccucccccacauugguagaucccccuacccauguuuuuggagcagccacccuauucuuccaccuccugcaccacuucuuguuccgaggacagagcuggguggagcugcaggagccaacacugcgcuucugcauugcagugcugggcugugcaagacagagagagauugccaccuauugacagacgugucaccugcaaagaggaaugauuguguaacuaguggcuccccccuucucugugugcucuucaaacgggccuuuuguuuuuuccauucagugaguccuucuguucucuauuaucacugcagugcaagggaggacagggaaaaacggggacaugacagcccaaggugguagugacagcaucucagugggaaaguugucugaaaauaaauugcccacuguaguaauagccacuuucaguuguguggcaggcacugugcugccugcaguacaucccguuuaauccucacaacaacccucuaagaaucaguacucccaguuuucacgaggaagcugagguuuaaagagagcaccuggcccacgaccagcaaguaaggaauagaggugggauguggguaauuuaaaccuaaaucucugacgcacucuuaacgcacauucucccgacacuugcuaauuaugcaacucacacccccaucauaauuuccuuacgucaucuggauaugaaaauaaaucaaauauaaacugcuuucccuuugggcagaauucuagcucugccacuuucuaguuauuuaagccucugcucucucaccugugaaauggggcuaguaaugaugucuaacuuaaggaguuauugaagagcuuaaaucacauauaauaaaaauaguaggaugccggauauuuauaaaugggaguuuaguuaucagugguugaagauacgaguuggaauccuagcuccucucauuucuagcuuuggaaacuugggcaaguuaucugaccuuucuggucuucaauuuccucaucuauggaauaggguuaauaauaauauaccuauucuugcaggguuucccuauaagacaaaaucauguguaugaaaacauuuuguaaauuguacuauucaaauauuaguuguuauaacucaaaaguuaucuguuucuucaaauggauuuuugagaacuauuccugaaaaaugacuugguuuaauucaauccguuuuuaauacuuacuaaaaacaacaauguaaguuaaaaggagguuccauacaugccacaggcuuuucugcaaguagcucuauaaggcauucccaugaauaacagguuucauaugcagcuuguuuuacaguugguacuuccacauguaucucacugaaucuccgcagggcaggguuggcauuuaccccuacuuuauagaugaggacaugugagccuuaaagaaugaaaauuacuaguuaaggacagagacuagugaguggagguuuguggguguuugccuguggagcugugugcgggugucuuugagugcaggcaugugucugagcaugcuuuuuuaugcauuuguguguccauaacucaugggaacaacucgucagcaaaaaccuuuuccucuuccuuuuucguguugccuuacauugucaggcacaguuuccacaagagggcccugccuggagaauauccuugauuuuuaucuccacucucuguuuaggaaaacaaaagcucuccaauccccgcggacuucugggaauuacuuccucuuucuuccccgccugcuagcuuucuugaauucgccuuagcaacauucaaaaaagaauugguuuaucaacagcaugugaaccaaugaaaugugagcugagaacggcuucuagaccaaugggagcccugcaugaccagcaagcuggcuugggacagaaaauaaugaccuggaguuugcagagcagccucuggguggcagcagacuagcuguauuggauacagcaccucagcucgaaagccucuucuuucuuuuugcuuuuuuccccuaaucuugaguauaaaacauucaccaacuauaagaauuguacuguuacaagacuugugggugugaguucucugcauaaugugguagacauggccuggaggguggacugucugguuccaucccugccuuaccccagccagccccaugaccccaucgugccuccugcagucuuuguugguuuugucacagcaucuagcccaguagccuugagucuggaggucuuucgugauuuugccugcccagccagucaggaugagaagcuggggaaaucacauucuccuucaugcaaccaccacuaccccuggguugaguggugaaugagguggggcuggcuuucugccaccagugaaugggagggaagggaugagccaccaacagaucagugccugucaauacccccacauucucagguggcauacacugagaccauucccugccuugucaguucugcugcacacgucugaacaggggaaugccugacuagcaaaugauuugagaauaguucuacuuucaggcagcuucgcccucuuaaucuugaagacaguggcagacauggguaggggcuaaaugggaccauagcaaaaauagcgaauccacguuuccaaugguuuagccauccuucuuuugcccuuugagaugauaaugccuagaacaccauucagucagguuuggguccuucagauagucauaguucuguacaauguuuccauuucugccugacuuacuccucucacccuuuaagaaucaguuaagaccuaguaucuucagaaaguauccuuugaaaaauucucacccucuuccuccccuccagcucccuggugauccuguucuugcacuuccuguguuguuuuccaaaugucucuuucuuugugaguuuccucugagagucauggagcuuccugaggacagggucuguccuuuguaucuccaucucagcguaguguuggcauaaaauuggugcucaacaagcauuuuuagaagaaaggaagcaugcaagaaaggaacucuugcucuuugagaaacauauuagggacucagaaguaccugaaccugggcugaagcaguaucugggaguagggcacuagcuguuggaggcaacgucuccaacagcuguuuaagacccaacaucuagcuguuuaagaccaugagccaugacuccagagcaaagcccaagccugaaagauaaucucauuaugggcucauuccauaauggguucaucucagucacacgguuuccuuuaugauuguauguuuuaggaagagcuaaggagcaaauccaagaucugugccaauguguuuuguggagccggccgggaaugugcagucacagagaaaggggaacccaccugucucugcauugagguaaguccugaugucgggagccagaggacaguggccaaggccaaugugguaccuugcggagccacccaucagcaggcagugccaaugauuucauucucuuuauaaaagcauucuucaucccccugaaaaacguggaauucuuauuccagauuccugauuuuuaaagcauggauauuuuuucuuuuaaaaaaauuuagcuuuauaagauuuuuuaauuaaaaaauaagaauuguuuuauauaagucaaauaguacagacauuuacacaagcauaaaauuauaaucuucccccauaacccuucaaucccuuagucugaaguaaccagcguuaacaauuugauacauguuccacauguuuuucuuuucuauguuacuauaagcauaggguuuauaugcuacuguagacauaaugguucccccuauuuuaugcaaaaaugggaucaugauauggauauagauauauacaguuuguauucuuuacucauuaauuuaucagggacaacccucuagaucagcacauauacuuuuaacucauuuaacucauuguaguggcauaauguuuaguaauauaaaagaacuagauuuauucaaucauuuucccauagauggacauucaguugguucuuuggguuguuuaccacuauaaccaauaacauccuugugcaaauacccuuauaugccccugccuuuauuucuguagcauugauugacaccagggcuugcuaggucagaggauaugcaaauuuuuaaaaacaguagaugagaugcaggguuuuuuuuuuuuaauguuuuuuuuuuuuugaaaaacaaacaugaauauguauuuauuccauuguauaaaagcaauaauuuagaaauuaaaagaacguugcagagaucucuaaauagagcuaaagauuuuuuuucuuucuuuuuuuuuuaauuuauuuauuuuuuauugauaauucuuggguguuucucacagagggggauuuggcagggucauaggacaauaguggagggaaggucagcagauaaacaagugaacaaaggucucugguuuuccuaggcagaggacccugcggccuuccgcaguguuugugucccuggguacuugagauuagggaguggugaugacucuuaaugagcaugcugccuucaagcgucuguuuaacaaagcacaucuugcaccgcccuuaauccauuuaacccugaguggacacagcauauguuucagagagcacaggguuggggguaaggucacagaucaacaggaucccaaggcagaagaaguuuucuuaguacagaacaaaaugaaaagucucccaugucuacuucuuucuacacagacauggcaaccauccgauuucucaaucuuuuccccaccuuucccgccuuucuauuccacaaagccgccauugucauccuggcccguucucaaugagcuguugggcacaccucccagacggggugguggccgggcagaggggcuccucacuucccaguaggggcggccgggcagaggcgcuccccacaucucagacgaugggcggccgggcagagacgcuccucacuuccuagaugugauggcggccgggaagaggugcuccucacuuccuaggugggauggcggccgggcagagacgcuucucacguuccagacugggcagccaggcagaggggcuccucacaucccagacgauaggcggccaggcagagacgcuccucacuucccagacgggguggcagccaggcagaggcugcaaucucggcacuuugggaggccaaggcaggcggcugggagguggagguuguagcgagccgagaucacgccacugcacuccagccugggcaccauugagcacugagugaacgagacuccgucugcaaucccggcaccucgggaggccgaggcuggcggaucacuugcgguuaggggcuggagaccggccuggccaacacagcgaaaccccgucuccaccaaaaccagucaggcauggcggcgcaagccugcaaucgcaggcacugggcaggcugagucaggagaaucaggcagggagguugcagugagccgagauggcagcaguacaguccagcuucggcucaacaugagagggagaccguggaaagagagggagagggagggggagggggagagggagagggaguuuuuuuuuuaauguuuaaaaaacaaagagagccuuugauaaauacuucuuuuguaggcuggauucugacaaguucugccacuaaagugaacauaaauaccuuggacauucuguuuucugucaaaacaacccauagccuggaaacacgucuuucugcaaauuaaauacaaccaauuuaguccccagguuaaggauccugauuuguugccccagaaaggaaguuuucuaacucagaaaccuaaaagccagauccuacuggggauccauuagcucugggagguccucacuggcaguguaccuggccacagugugguggcauaagccuggacuuaggaucuagaaaccugauccuaaaaauuguacaacuagaugugggugagcugagaccaaaccugaggucucaggagaugcugugaagacagugcccacauuugguuuugcccguugcccagcacauagugagcacuccauaauaaauauugguucacugaaauuuguguuuuugguauccucaacuaaaacuggaaagguugggcugccauccacuuccagugcucugugcuucuuuuuaccaucugcucuuucuuguuucaguuccuuucuuuauuggaucugagcuaaauuuacuuccugcuucuccccuuuaaaaaccauagaaguccaaagaaacugaacuugccugugaucuuggcaccuucagcagccaaagcauaaccuaguugccauaugaacuuuguuccauuucccuguccauaaugauucucuguaguacuucacaaagacccaggcaacccuacuccuagcuucacaacaaaggcuugagaucaggaggaaaacaaaguguucccccaauaguauauacagcaagagauccuuacaguuaggcugcagaagaauuggagugugugugugugugugugugugugugugugugugugcgcgcgcgcgcgcgcgcgcacauguguguguguuugccugccugccuaucagccucuccacauucccagcucucagcucuggcuguuuugugucauugaauguuggaauauuaagggaucuuagaucuucugagacauuaaauuacuuuuuccaaagugacagagaauucaaauuucuggcuuuuaauaaaacgcccuuucugcucauuugauguggggggugucuuuguuuguuugggcugcuauaacaaaauaucugagauuggguaauuaauaaauaauaagaauuuaauucucacaguucuggaggcugggaaguacaagauugaggugcaagcagauuugaugucuggugagggccuggucucuaacuuccaagauggcaccuugcauguggcauccucacauggcagaaggcagaagggccaaagggccaaaugcuguaggaagacuguuuuauucacuucuuaaccucauccacaagggaggaguccucaugaccuaaucaccuccuaaaggccucaccucuuaauacuuuugcauuguggauuaaguaucaacaugaauuuuggagggaucacaaacauugaaacuauagagggugucucuuucuucacugaauagaagagaugacccuggaccaggauaggcaugaagggccauaggcaacugagacagggucaguuggccagaacugugacugccugugcccugaugggguagaagcaccaucucuggugguggagaguccccuuacaaaauggcucugugugugugugugcauguaugugugugugugugucugugugucgauauccauaacugcacaaacauucucuuuugggucuguuucagcaaugcaaaccucacaagaggccuguguguggcaguaauggcaagaccuaccucaaccacugugaacugcaucgagaugccugccucacuggauccaaaauccagguugauuacgauggacacugcaaagguaaggugugcucucaccacugcaaggcagcuuuagccacggggagccaaggaacagagcaguguggccuggcugaccacauggucuuuccuccacgaccacagccucucaaagcuguggaaagcgcccaguugguuggaguugcauccucuugucacuuaugagccugcuggguuugcccuggauggcccaggccucugcccaggguuugcuauaucagauccccauggggguuuucagcacugucugcagcuggauaguagauaggguggaccccaucaguaaaucaguaacaauaagaaaguuccuuaaaugaauuauguaccuuuuuagaaaguagguaaguuucacuuuucccaugcuuuuuaauuugggcaccucucaguauuguuuccucuauuuugcacugaaaccacugccauuagaauaagaaggaagaagucccacacuuguugcuaauuagauaccagcccccugccaagccauagcccugcccagccccucucagccuugcccuuccuugaagaaacaagaagcuguuucccaggugauugucuccacuccauucccuguccagaaugauucuccauuugaauucucaaaaucccagugaccccucaaugcaacaggaggagguaugaggccagaaggguaacucaguggcccuaaauugucagacaaagcaggagacagaagauccucauaccugggcccuagaagaaggaaaggaagggaaaggauucaagacaaaaugaugaaaagguuacaaacauuccccuacauguagagcagcuguaauccuagaaauacagaaaaauuuucuuuuuuccuucacuucgcauuacacguuuucucuuuuugucuugcagagaagaaauccguaaguccaucugccagcccaggugagugccuauuuuuucuacugugugcaucucagggaggacauucuuuucaugauagaaauuuuguguuccacaaucccugccaagcucauaagaucuucuaugcaucagaauugugucccagaacuggccacuccucaacacagcucagaaaagcugcaaaacuacauuuguguauguguuugccaauugaagcagcugguugggucagaauguuggcuguguuuucccauuuuuccugaguagugauugaacugcauaaacaggaaagccacugaguucauuuuucaacauccuauaagacaugcucgugucaugggaccagcaaauagaaggcacaacucuuuuugaaaggggauaacuggaaaugccaguaagacuucugugguuuucuauuagugaucacuaaaauuuuaucaugauuuauaguuacagagcuuuuuugcacauacuuuccuuagauucucacgguagccuuugugaaguagaucuuauuguaauuaccauauagaugaggaaauugaggcucaaagaggcuaagugaguuuucuauaucacacagcuaguaauuggcagacuggggaagaacucccagauuuucauuccccuggcccagugcccuuuucacccacagcauguguugucuuccaggaauucucuuuugccaaagcuuucucuccucugcuuccccauccacucaacucucagcacccccuguuauuuccaguggacaacagcuguccagagcagggcuucgacguagcccucacuggccuucacauucuguuguucauaauaaaggaugaugcaggugguauacaguuguaaguggggggaaguuuggauggaccuaguuggugagaaagggagaaacuggagaaaaucagaaaucuaguagcauaaaaacuguaauauucucauuuauucauguauuauuucagcucaucuuugagucaagagagcugcuuuauugauuuuuuccccuucagcuuccuaaaguuaaugaaaguauccuuuauuauuuuucugcucuaguuauuucucacauaagcagcaaaaucucucuguuucaauauucucaaucuuuacaaauauuuuagagaugggugcuugaauccugggcuagacuuuuuccaguuguguacccuggaugugcuaauccuaucucccuguguugcugggaugacauaugcagaaccaugggcacggaugcucccacacagugggugccagauaucacugggguccuccccugacugcuccagcugacauccuccacuuuccugcaguuguuugcuaucaguccaaccgugaugagcuccgacgucgcaucauccaguggcuggaagcugagaucauuccagauggcugguucucuaaaggcagcaacuacagugaaauccuagacaaguauuuuaagguaauccagagguaggaggaagacuauucaggcccauagaaagggaagcuuccuccucccauugcccgaucacaccuucccagaccacaggaaauguaaaccugcacagacacccugaguuuccucaucauagaucauucaugaagcugugaaaguugccuucugaccagcuugaucagugggaguaagcaguggagucuuugggaucuaacacacaugugcugcugccuucaggcagugaaagccacaaaggucuuggagaaccugucaguuagggccaagcucuguccccuacucgccaugacaccuuauggaucuggcuguuaauacaaaauucccucugauugcacccagaccuggaccacuuuggccucuuuccugccuaguuugacauuucucuaagucauuaacuugacugccaauggcuuggagagagucuucauaugagaagaaucaauggacuggcauuucauggguccagagauuguuccugaacuuagauauugcuguucccaaucauaauuaguugaagagacagaguguuccacuugggagcaggagagaugcuauuuucacaaagagaaaugaaggaagcuauaauauuuagugauggcucggguuaucaugccaugcagaucuuucacagaacuugagaguuagaagaagcaauuaagggcauucuuacagcugauugacaagaacagacacacacacagguacaucacacucagaauaucacacucagaagcacagagaaggacacacuuaaacucaaaacaugccagacacgcacacacacaccacauacagagacucacaugccacacagagacacauccuacaugcagacacauucagauacccacauuuccaugcaagcaccaaagcccucuucacuagguagaugccccagccaucuacucccucacaugcuuccagggcccaacccagccaggacucaggagcaacuucagacacaugaaggacuuuucuuggcagcucugaggccaccuaauguggccaaugccagucuagucuguggauuucucuuucugacacuauagaacccgcagaugaagaaauacuggguuggcuucaaauggauauuuggucauuuaagacuucacuugugucauuuuuacauagagauuucucuccucuauggcagauacuaaaucucuggauuccaaguuuuugagaucauacccagaugaaaaagcacagccuuucuugcucuguccucucucucaaucacucccacauuacagagcccuuagaggaagaaugguuccucuucuacagaaaaacacaucauagugcugagccaggagacuuggacaggaacagaaaguaauguaaagaaagugacuguucaaaagcugagcgaaugguaaagguaccugcagggccugcugugugugagcagugacuuugcccugcaauuacagcauaggagguguggggcccaggacacuccuucccaggggccacuuaggacguuguaaccauuuuuuaguggcccuuugauggcacucugccucaggcaucacugacaccugcuauuagauuugauucccaagaaccuaugccacauuccccucaacacaucuccaucuccuccagcaguaacucacuuuuacaggcucccuucugaaagcuauaaggcccuuugggaaaguagcucuucucuaggacauucucacaaccaggcaucuaagaaagcuugaucaugacugacagacacaaaauccccucuucccagacacucuggcagugucuaacaggagaaaacagguuucauuuucuacuuuuugaugauuaucagagucuuacaugcugcugucuucaaagggagacugccuccuccuaggucagcagcugccuguuggugagaggucugauaucucaaagagacuguuaugaaccaaugaaaugcuccccagcccagcuggcauuucuuacaucaaaauuguucaaaaaccaaauugaauuagaauuugaauaaggccaaaaucugacuuucaccauaaccagugauguagucacuguuucuuaggugaaagcguaacagaaugaagaaagaaagacccagguagaaagagccuuccaugcucuuggaauuuggaaucuaauccauuccuaauuucaucugggugugaucucaaucccuguggcuccugauggccagggcugacacuugagccagccuucuuaucuccuuuacccuggcaccacagcccacacagccccagcugcugugcacaagcaagugccugucucagcccaucuccucugaagagucuccaaacuuacauugauaagccccaagaacagaucucaugacauacaucuuuucugccuuuccacaacccuacaguuagauagaggaaaaguuuuguuaccucaaaugcugaaaucugaaacuuuuugagcaccaacaugaugccauaaguggaaaauuucacaccugaauucaugugauggguagcauucaaaacacagucaaaacuuuguuucaugcacaaaaugauuuaaacuauuguauaaaauuaccuucaggcuauauguguaagguauauaggaaacagggaugaauuucauguuuacauuuggaucccauccccaagauaucucauuauacauauuuaaacuuuccaaaaucugaaaucugaaacacuucuggucccaagcauuucagauaagggauaaucaaccuguauagagcuggggaaagaggcacagagagauauuaugucuuuguaacugacuggcugaagagaggcucaauaaauuagguugguucaugguccaugauuaggaccucacaggcagaccccccaggcauuccaggcuauuucuggggcaggcaccagaauucuguguuccuguggauucuacauacaacucuggccuggggaggcccaacuggacccucaugaguugagaaagcacaugggcuggaccuucccccagcugcaggccuuauucuaguccuacugaaguguguguacacagcacugccuuuugagagcugccuggacugugguugccagguucauggugcccacuugggccauguggcacugggucuguagcuagugcuggacguuuccccucccuacacucauuccaucaucaggcccugaugacacuggagucuuugaggguugcugucauuuacccagcacaugcaauauuugaacucaagaaagcccugugcuacuaacaauggcccccagccaaacuuauuuaauuauuuuccauuaauuaaucaagacuucacaagguaaacagggaaguuucgucagggaaaauuguauagugaauaaaggacaucagagaccuguuccuaggaauuaggacaagaaugauaaguacguacuaagcaaaggccuaauaguuguuucaugcacaccuucauuauacaacauuagaguggaacaccugugacacauggcaagcaggagaggagaguuguuagcuacaucuuccccuucuaucuagaaauuuggauagauguuucuuccagaaucccuugcaccaucuggggagccaucuugaaaguaacauggggaagcugauccuuucccagggcagcagcaugagggagccuagggaaaggauuugggaggaagggggaaaauguuauugaaauuuguuaggagagcagccauaugcaacuuggaauuugaucagucuugauuugacacccuccuccugcagcuagugccugggugucuugaauggucccagauggcugaggucucaguuuagcaucuugccauagagaacagugugugagcuuacugcacuccucacuuugugcuugugggaugccagcugggucaugagggcagccugagcuggaugaucugaggaccugugcacacaucugcaguggggcccacagggcagaggagcgggaacuuugcaugaugaccccugucuguagcuuauugcuuugaggccuuugccugaguucucacugaugugaucaguuacgggcaccaaagugaaaguuaagcacugagaacaggacaaggaggcuggaaucaagcaacaagauuuggaauccuauaauuccaaagugagcucagagggucaucugcauugcugcuguuccugagcagcucauuagaaacauauucugggaccugcuacagagauucugauucacagcgugcaacuuuaaacucuuguuacauguucaucagggcuugagaacaugaugugcagguuggucugaacccaaagguauagucaaaagugucuacagggcagugucagagauggggccacacagcaugcuuagggaccccagaggccucaguucagguugccuccucugcccaggcacuuuuccucucucauugugggcacagguaccuucucugcaugucccagggauuagagcauuuguugccaaggcccucugaggucagggcaggguuggaauguaucaagaacaagaugaaucagaggcaggucagcugaguggaguaaugauggaacagggguucugcaaaacaucccugaacgaucuugucaugcccuuucuagaacuuugauaauggugauucucgccuggacuccagugaauuccugaaguuuguggaacagaaugaaacugccaucaauauuacaacguauccagaccaggagaacaacaaguugcuuaggugagaggaaccgagaggucagagaaugauccacaagggaagacuaacugagagaggggacuuaaacccuuucccaccugcaaaagagccaccagugagagaaugucacguaaaaagcaaaaugggaauucuguccuguucuauucuaugaaaguaugaauuaauauauugaguaccacugauaucuaaucaaauaguuauuguuuuuggucagaacuugcaaggacuagaagaauauaauuuuaaaauaaauugccaagggcacgucagagcaaguuauuucugaauguugugggugauguuuuacugauuaauuuucugaaggaauuacaguaauguauuauuuaacuauaggucuaaaauagcuuuguucugauuuuuagauaauuagugcuauuucaugucaauugcccuaacuguuacagauauaugcccgucuacuuuuauggcauuauuccagaaucaauauuaauaaaaacuaaucgcuaagaaacuuuugaugugguuucagcacaucgguaagaauuaaaaauaggaaaagcaugucuuuuuuucaaaagaagugcauugcacaguuucuagaaggauucuucuuuaauaauagucuaugaccuuaaaguauagguucuguaaauccuucauauuuugauaaucugaaauuauauguuuuauaauuucaacguuugagccucaugauaucccagugaaggagggcuucuuguccuccuuuuacggaugggaagacaggcucagaaaaguugaauaacuaacucaaguccauuugaguaguaagugauugagccagggcucaaauacagcccaagaaagaagugauggagcugaguuuuuuuuuguuuguuuuguuuuuuguuuuuuuuuguuuuuguuuuuguuuuguuuuguuuuuguuuuuuuuuuuuuuuuuuuuuuuugagacggagucucgcucugucgcccaggcuggagugcaguggcgggaucucggcucacugcaagcugauggagcugaguucuaaaagcuuuucugaaaaucucuuucuagaaggaugauaauggugauucuugcuugaacuucauauucuuucaaauccuauauuccuuucaugucaucugucauaucucuucuguuuugauuuuccuaguuugguugacuugacguguauauaccauggggaaaagcaauugcuaguggaagguaugcaggcagugaaaacauuagacaaaaccauucacgaaacuuuagucaucuuaagggggggaacauuuggacagccugggugaucugacauucauauaacaaacuaaagguuagaugccugcauuggucaggauggauaauaguuguguugggucaguguagagagaggcuguuuuaguuagcagucaucuucuuggccuccuguggaggcccuggguguaugugguccugaugcuuacuuccuuucuucugagcgaagcugaggucuugcuaacacauuucuccuguguuuuguuucaggggacucuguguugaugcucucauugaacugucugaugaaaaugcugauuggaaacucagcuuccaagaguuucucaagugccucaacccaucuuucaacccuccugagaagaguaugccuaaccuaagaaauagagagcuguagugaauggaggcauuuuguaggagccaagauagagaggauugguggaacucuccagagcuagcugagaaaauccccuuccaugauucuaaacugggccccagcccauucuccccauggugaaguuagggccccacauucuuuagguugaugguaguguuugcucagauauagugcuucugagggacaggcaggucuugucugggaaaaaaggguaaggugcacagacuguagcaaagaugcccuguuccacccucacagcuaaacuguugccccguauuucuggcccaacagagugugcccuggaggaugaaacguaugcagauggagcugagaccgagguggacuguaaccgcugugucugugccuguggaaauugggucuguacagccaugaccugugacggugagcugugcuucaagcagaaagaaaaaacagcaaggagagagcuucaugaaaucagcaugagagaaguugggguggggaugauggagaagagggcgguggcugggagcaaggaacccaggcagacccacaccuguaagguuggagccccaaguggggagcuuugagggcagaacauuuaucccauaggcauucaguuugaaaaucacuccagaggcuuggaauaagagaggaccaagacccugggcaaaaguaaaugauaauggaauaguaacauuauggaaauaguaacagugaaaguaguaauaauggaauaauaauuaaaaauaguaauuauuuaauaauuaaaacauuaaaauaaaaacaauaauuauuauuuaauaauaaucaaaaauaauaauggaauaguaacagugaaagcaaauacucagcaaaaaccaugugccaggcucucuucuaagcacuuuacauauuaacccauugauccuuauaacaccuuaggaaaugguaaaagacuagugguuggaagacaaaaugacuucuccuugccauacccagcagaaaaagaaaauauguuuguagacccucuuucaacuaacagagauggguaaucuuuuuuaaaaagagaaaguugagcuaguugagauaugugcaggguggucuggggagacagagaaaucugagaguuuguggggcagugugaggcuacaggguauguuggaaccacuggagucccaucuggguccugggcuacaaugaugccaaagaucaagagggacucuuaaagccgagcccuagcaaagaaccagggauauucagaguggaggcaagacagagaaggguguugaagccaggucugcaacggagaauugccuuaaggucauuuggaaccaggccgaaaaguuucaccagcuagggugaaccuaaaguuauaucagccaggcgcaguggcuuaugccuauaaucccaacacuuggggaggccaaagugggaagcccaggaguucaagaccagccuugccaacauagcgagaccaugucccuacaaaaaugugaaaauuaggcaggcgugauggcacgugccuguagucccagcuacuugggaggcugaagugggaggaucaccugagccugggagguugaggcugccaugagccauagucacgccacugcauucuagccuggacaacagagcaagaccuugucuuaaaaaaaaaaaaaaaguuuauuuuaagaaguuaacugugucaaggaagagcuggcuggaaccuaagauaauguucaggaagaucagguuaaaugguaacuaggagacagaggucagaaacccaggaugaggcucuucuagacaaggauccuagagaacagcaacaguauaaauggcccaguacuaucuaagguaucacuggucuaccgcugcccaggaccaagucuguuuucaguguggaacgacagcaaaccaauguaacuacagggacaggugaaggaacaggaagaggcuguuuagagacuagaaauuccuacaaguuccuagaagucaagaccaagccaggaucuccagaccaaacacagaguugcuacugaaaccaacaaaacacaucucaaaacagucaguggccuagccugccucaaccaugaagcauccuauacuugucuucccuaaacucccuucaguaccucuccgcuucuaacugcugcuguucuggcuuuguaaagguagcccuccauuucuaaggugcaggcaguugguaugcaguuggcuuauagaauaagcauggucauuuggauaauaaucucuaucacaugcaucagacaaaauucaaaugaucagcuucaugggauguugcccauuuccacagccacucagcuaugggcugcucauccucccuggaugaccaaguccagaacucuauguggguauaacauggagcaacccauguuagaugguggugccccaggggccugagcacguauggauguguaggccguggaucuaagaggaguuuguggagccagcauucuggggcauuuucagguuaauaccugagaguuagcagucugaucuuagaucacaaaucaaaaugggacaagcaagaaggggcaucaaaauuugaagccaggaggaggcagagccaagggaaacugcugugaagggaagguugauagcaauguuuggaagauauguccuagaaguguuuccuaauggucagcauucuacuugauaagccuagagauuucauccuaaaccuaguaaaucagaauuugcaaaagagcagcuugggaaccuguguaguuuuuguuuuuguuuaucacugugcaaguuucagaaacauugcuagaugaaaugguugucaacccuggcugcacauuagaaccaacuagaaagacuuguaaaaaaauacugguguccagaucucaccucacaucaauuaaaucagaaucucugaagguggaacuagacagcuaucuuuucaaauguucuccaggacauuuugaugguauaugaaugacuugagagucauugucucagagaaaucuccagugucaggauccaaguuuucaccauaacuuuuuuuguagggccagcuucuggcugggaugugcuaagcaguuaaaggaacaaaggccagagaggaguugggguagauugcuuuguuacaauguguuaccuuggagguaucaauuacacagggccccuucaugccuucauacucagaaaauguggguaauucaccucuccuuccacaaguuaaaugggagaugaauugagagccucuagguagaucuuggcggauuccucacuggcuuaccacagcugcuacugcucugagcuuugguucuucuugcaggaaagaaucagaagggggcccagacccagacagaggaggagaugaccagauauguccaggagcuccaaaagcaucaggugaguggcagccuccgugcugguucagguguugcuguugccaucaggcccuauaccauucaaacacugcccagugccccaggagaccaaggaggcucucucugcucaauacaguacaucuugagugauaccccaucaccuguacuaucaaacugugauacagacaguucccugauaaaguccucacagggcccaguaggucucaacacauauagguuacagcucggugaguggcugcauaaggcaaaaucaggcagguggugauuugcaaaugagguggaagugguuugcaaaugagcgugguuuaaggaaguguguauccugucaugaccaguguccagacccaaagacugugagcuccugaaagcaggcucuguaacuugcucaucauuguacccuugcagucucacagggccugguauguagucagcacucagugagcaugaaagcaguggauuugggccacagcagaaaggauuuaaguucaacaucagucuggcuagaaaauagccugggguuaacaaagagucuccuucccagagacucaagaagauaauaagaauuuuguucagguucuaugucauuaaguuaaaggcuuccuuggggaaaggguucuuagcagaauagugaugcucugacauauuguggaacuguugaacuccuggcccauccuccuacuggcuuauuauguagucuuaauacaggauauugcaccuuccauuaccuguccguagaccgaauguaguaguauuagccuucucucugacauagaaguuuuuaaggaauauaauggucacaagaacugcuaaacuauugauaugaaauauuugacaugaguaaacagaacuauuacuauuaauaguaauugcccauuuauugaucauucuuaaugugcauuuugucaucauugucacugauaguauagaaaucucaugucgguuguuuaagcagaagcaaaagcuucuagucuuuugcuuuucaaauuucaccagucuugagucuccaaaugaguucaaucccaugaaagagaaaaaaacuucauaggaauuacuuucgucuagaauaucagacaguacaguuaucagacaguacagagugaauuauaguagcuaauauguuuaaguuucuguguuugaugugaguccccucagagcagaugcugaggcaaggaugcaaguacacauaguuuauuugggaagcaaugccaggaaacaccagagggagauuugggaaaugaguccagaaagagaaggaaguaaugaagaguguguauucaggcauguuaccacuguuaacaagugacucuuaauccuauuggggaucucugggaauggaauaacagugccugaguggggaugaagcugggcuguuucuacaagaacucccauuagccauuggcugagggcugcuacugggaaauguuaauucccuggcauuuguggccuaucaguguguguggacagagugggcuccagcagccagagaaaggccucaggcagagaugcaggugcuggcaguagguaggaagucaugccaguguacaccaagacauuaaacacaaaggggcgauggauggaacaccagugucugcuagauaucaggcaauguugucagguuuuaaaaauuuauuucuuuaauugagauaugauucauauaccauaaaauucaccccuuuaaaguguauauuccuaagauugucaaucaucucacuacuaucuuaauuccagaacauuuucauuaucccagaaagaaaucccauacccauuagaaguaacccuccauucucaucuuccuccagcccuuugcagccacuaaucuacuuucuaacuauaaauuugccuguucuggacauauuacagugguaucauacaacaguauagccuuuucugucuuugacuuagcauaauguuuucaagguucauucuuacagcaugaaucaguacuucuuuccuauuuauggcugaguaauauuccaugauacgaauauaccacauguuguguuauccauucaucauuuaauggauauuuagguuguuucaauuugggggcucugauaaauaaagcuguuaggaacauuuucgcacaaguuuuuguguggacacauguugucagcucucuuggguauuuaccuagaaguggaauugcugggucauacggugacuccauguuuaaccuuuggagaaauggccaaacugguuuccaaagcuacugcaccacuguacaucuucaccauagaguuccaauuucuucacauacucaccaacgguuuuguuauugcuauuuuuuauuuuagcuguccuagcgggugucaagugguuuugauuugcauuucccgugugauuaaugauguugagcaucuucuuauguccuuauuggccauuuugugccaggcacuguuguaagagaugguacuuuauuacugugguuuugcaguugaagacauugagacacagaagauuucauaauaugcccaaggucacccaaaaaguagcacagccaugguugaagcucaggcagucugccuccagaaccuguuguacuuaacacuucuuuggacuuguuggauuaagaacaucuuguagcauuuccauuuaacaucauuuucuucauccuuaaaaugggaaccauaaugucugaucugcuuguuucauaggaguccaaauggagucagcuuaauucaguaaacagccccugcaugaccaugucaugaauaggccauaguucuuguucucaaauuguucauuguccguggaggagcccgacaaguaaacaacuaaaauucagcauaagcuuguaaaugccaaugcuauauagucuugaggaacagauaaauuccaacaguuguuuaauauuuccaugacgccuauuuucucuugcaucucaaaggaaacagcugaaaagaccaagagagugagcaccaaagagaucuaaugaggaggcacagaccagugucuggaucccagcaucuucuccacuucagcgcugaguucaguauacacaagugucugcuacagucgccaaaucaccaguauuugcuuauauagcaaugaguuuuauuuuguuuauuuguuuugcaauaaaggauaugaagguggcuggcuaggaagggaagggccacagccuucauuucuaggagugcuuuaagagaaacuguaaauggugcucuggggcuggaggcuaguaaggaaacugcaucacgauugaaagaggaacagacccaaaucugaaccucuuuugaguuuacugcaucugucagcaggcugcagggagugcacacgaugccagagagaacuuagcaggguguccccggaggagagguuugggaagcuccacggagaggaacgcucucugcuuccagccucuuuccauugccgucagcaugacagaccuccagcauccacgcaucucuuggucccaauaacugccucuagauacauagccauacugcuaguuaacccagugucccucagacuuggauggaguuucugggaggguacacccaaaugaugcagauacuuguauacuuugagccccuuagcgaccuaaccaaauuuuaaaaauacuuuuuaccaaaggugcuauuucucuguaaaacacuuuuuuuuggcaaguugacuuuauucuucaauuauuaucauuauauuauuguuuuuuaauauuuuauuuucuugacuagguauuaagcuuuuguaauuauuuuucaguagucccaccacuucauagguggaaggaguuugggguucuuccuggugcaggggcugaaauaacccagaugcccccacccugccacauacuagaugcagcccauaguuggccccccuagcuuccagcaguccacuaucugccagaggagcaagggugccuuagaccgaagccaggggaagaagcaucuucauaaaaaacuuucaagauccaaacauuaauuuguuuuuauuuauucugagaaguugaggcaaaucaguauucccaaggauggcgacaagggcagccaagcagggcuuaggauaucccagccuaccaauaugcucauucgacuaacuaggagggugaguuggcccugucucuucuuuuuucuggaccucaguuuccucagugagcugguaagaaugcacuaaccuuuugauuugauaaguuauaaauucugugguucugaucauugguccagaggggagauagguuccugugauuuuuccuucuucucuauagaauaaaugaaaucuuguuacuagaacaagaaaugucagauggccaaaaacaagaugaccagauuugaucucagccugaugacccuacaggucgugcuaugauauggaguccucauggguaaagcaggaagagagugggaaagagaaccaccccacucugucuucauauuugcauuucauguuuaaccuccggcuggaaauagaaagcauucccuuagagaugaggauaaaagaaaguuucagauucaacagggggaagaaaauggagauuuaauccuaaaacugugacuuggggaggucagucauuuacaguuaguccugugucuuucgacuucugugauuauuaaccccacucacuacccuguuucagaugcauuuggaauaccaaagauuaaauccuugacauaagaucucauuugcagaaagcagauuaaagaccaucagaaggaaauuauuuagguuguaaugcacaggcaacugugagaaacuguugugccaaaaauagaauuccuucuaguuuuucuuguucucauuugaaaggagaaaauuccacuuuguuuagcauuucaagcuuuuauguauccaucccaucuaaaaacucuucaaacuccacuuguucagucugaaaugcagcucccuguccaagugccuuggagaacucacagcagcacgccuuaaucaaagguuuuaccagcccuuggacacuaugggaggagggcaagaguacaccaauuuguuaaaagcaagaaaccacagugucucuucacuagucauuuagaacaugguuaucauccaagacuacucuacccugcaacauugaacucccaagagcaaauccacauuccucuugaguucugcagcuucuguguaaauagggcagcugucgucuaugccguagaaucacaugaucugaggaccauucauggaagcugcuaaauagccuagucuggggagucuuccauaaaguuuugcauggagcaaacaaacaggauuaaacuagguuugguuccuucagcccucuaaaagcauagggcuuagccugcaggcuuccuugggcuuucucuguguguguaguuuuguaaacacuauagcaucuguuaagauccaguguccauggaaacauucccacaugccgugacucuggacuauaucaguuuuuggaaagcaggguuccucugccugcuaacaagcccacguggaccagucugaaugucuuuccuuuacaccuauguuuuuaaguagucaaacuucaagaaacaaucuaaacaaguuucuguugcauauguguuugugaacuuguauuuguauuuaguaggcuucuauauugcauuuaacuuguuuuuguaacuccugauucuuccuuuucggauacuauugaugaauaaagaaauuaaagugau

SEQ ID NO: 18113 - RNA, 36126 nt, Homo sapiens
caguccaggugagcguucagcgggccuccuugcgcaugcgcugaagggggcacccucucguuaaggcccgaauuuugccucuucugcgcacgcgcuccuuuuaaauuccccaccugucagagagaagcaggacuuccuguacuuuuuagagcgacugccggaagugacugcggacgaaucggcguuugccgaggcuggcauagauuuggcugucuccgcucauagcugcuuuuggcgcgaaagaugccgggucugguugacucaaacccugccccgccugagucucaggagaagaagccgcugaagcccugcugcgcuugcccggagaccaagaaggcgcgcgaugcguggucagugcgcagccggagagggcgcggccgacgagccccgggccgcggccugugccuuccggugccucugcccuacggccucugcccucugccuucugcccucugcccucugccuucugcccucugcccucuuccuuccccccuucccccacuccuccucccugucugccccccccccccgccccgccccgccccgccccauugcggcgcucuggagauaauuauugggccuuguagguuucguggucgggucucuguugacuuaucccguagcuuaguaccgggaaacgauggagagagaggagaacggcaagcuucaaccacucauuccuuccuacaaauguguguugaguaucuguuauggguuaagcacugcguuagguccgaagauguagacauggauaaagaugcaucuugauauaaaggagcuuaaaguuaauggagacauaaaccagugacuuguauacgacgugguaagggcuaugauagauuuguuaagaccaaacaggaaagguuuucugguaauuucuaaggcuuucucccaaaauuuagagacaguaggacacagaguguauuccuuacaguucugaagaguuacgcuucaacccuuuuaagacaaccaaaaguugaaaaucaaucagucuacgacgcaggggacaaaguauuaagaauaguucaucuagauugucaauccacaaaagauuuguucucauuuuauauagccucucuuguggagcaaaucucauuagaggacguccucagauaacgugaaugugcaucucuuccucuggccccuuuugucuucccagauaguagauauaagaaagaaaucauuagugguauaaugggauaauaagaguguaggagcucagugcuuuuauuaauccucaguacuuuguaaauaauacggguaggauugaaagacuagucugaacaaauuguuccagugguaacaguaagugcuguugaaccuugaaugguaugacagcaugauuaagagucugggauccacagucaagguuugaaucuuaauccacuaacuuggugaccuugagccucaugugucuguaaaaugacucuaauaaaagaaacucccuccaguauuauuguaaagguuaaugauacaagccaugucaaguggcuaacacaguauacauggcaauaaaugaucaaugaaugcuagcuauuaucuucacaaugaucucacuaucccaggcaaucucccauuugcaggcagcucuugagcuauugaaggauggguagaguuuccauggaaggagaaccuauucccuuuguuaaauucccuuugccucgauugccucagaccacguggguucuccccaaauauccauagucaggagucaguuuuuccuuguaauugaauugggcuuaacuugauuauuugcaaaaucacauuuucaggccuuagaaauaaagcuguguaguccuagucuuuacuuugugaauuuuacaaguaaaauauucuuugaucaucaugaggggguguuuaucucggucuccuggcuaccagauguuuuugauguaauuagaaguagauuuauuugguuguguuugaauguagggcaaaaucagaaaguuaauuucucugugauaauaagcaaaaaauugagcuguucucugugcccuucauuuagcauaaauauuuuacucaguuuauuucuuuauagagcaguguuacuccuuggauauugacuagaggcaauauuuaauaugcgugauuauuucuuaucagauuucccccccaaaaucacuuaucuguggaaugucuucauaggcaugggcauaucauaagaucaaauaaaaacaaagcuguuugagguaauagcguuuguuuuaauuccagcuacauuccauuauacccguguuuugucucacuccccaucacuaucaugcauacuuaauaaugugcuuaaugcauauuuagauaacaaguacauuuuguuuuauaguaucaucgagaaaggagaagaacacuguggacaucuaauugaggcccacaaggaaugcaugagagcccuaggauuuaaaauaugaaaugguaagcuucuugcuucaaaguuguguauugcuuuacagauuuagcaacaauugggcuacauucucucugaaagguaguucaccugguuaaucuaaaaugcuuaaguaucaauuugaaaaaaccaugauuuuucaguucccaaugaagggaguaaauuaugucaguaaagacagucauuuagcggauuggggaaggggagaauugagcuuuuaagaaaggguuugacaaaagccuuuaggucccauggcuuuaggaaaauugacugagggaacuaaaagaaacauauucucuuucuuguuucuaauaaauauugugggacuucaguaaaugcuuuuuuuuuuuuuuuuuugagacagggucucacucuguuacccaggcuggggugaaguggcccaaucacagcucauugcagccucaaccugggagguucaggugauccuccccucagccuccuaaguaacugggacuacaggugugggccaccgugccuggcuaauuuuuuguguuguuuuuuagagaugggguuucaccaucuugcccaggcuggucucaaccucuuggacucaggcaauccuccugccuuggucucccaaagugcugggauuaagaggugugagccacuaugccuggccaagaaaugcuuuuaaguagggaguggguaucccacggaaguauugcuuucugaaaaaugaaaauggaauuguagcaugcuuuauucgaauaaaacuaaagccucaggccauuuuuuuuuuaauuaaaaaguaaacuuuaaugucaaaaaugcaaacuuggggaagacagaaaagaucacacacaaggcugucacuucacacuuggaagguugcacagcggccgggcagaggugcuccucacuucccagacguggggcagccgggcaguggugcucuucacuucccagacagggcagaagccgggccgaggcacuccucacuucccagacagugggcagcugggcagagacgcuccacacuucccagacgguggggcggccaggcagaggcgcuccucacaucccagacagggcggcagcugggcagaggcgcuccucacaucccagacggggcagcagcugggcagaggcgcuccucacuucccagacggggcagcagccgggcagaggggcaccucacuucccagauggggugguggccaggcggagaggcaccucacuucccagacgggguggccggacagagguacuccucacuucccagacagugggcagccgggcaguggcacuccugacaucccagacagggcggugggccucaggccauuuuuaaaagaacuuggaacucuuaacccauuuuaagugcugaaagggaccuuaagugguauguguccaacaauuccacaaacaaaugauacucuuuuguuuggaagcucuuucuucaguuaucaacuuagcucacccccucaccccacucccucuuuacucaggucucuuucaaaagucuccuuauuagagaggcuuucccucaacaccccauguaaauuacaucccuuccccaucacucuaucauggugcuguccuaagaccuuucugugaagauggaaaugcucuguaucugcacuugccagucugguagccacuagccauauguggcuguugagcacuugaauuguggcuggugagagugagguacugaauuuuuaguuuguaaaaauuuuaauagcuacauguggcuaguggcuacucuauucuauacacugucaccugcaugauacauauauuuuuaauuaccuguguugcuucacggcagcuagaauguaagcucugagaaaguaggaauuuucuauuucauuuacugucauauccccacuaccuauaacagugccuggcucauaguaggugcuuaauggaggauuguuaaaugaaugaauaaauaaggaaauuaaagcuuauaguuaugaaauggcccccaagguggguugugcaguaucagaacuggagccucagucuccaugccgauucccucugcuuuuugccccuacccuaacuuccacaccacacuaccacuuuuaacuuaauaacagcugagagagaaugccaaagccauaugccaauauauuaguacuagagagccuggcuucuuucccuugcaccucuuuccugccucuuuggaauuucacauauggccagucuuccucacugagcuauaaaaaaggagggauaaggaacuugucgcaagcugauaagaaguuacuguguaauggaaaacagucuaggcugaaaguccugaggcuuuguuuuuauucuccugauguuuaguuuaucauguuuuuaaguuuagcuacauuuagcuucaucaagacauuacuccucugaauuucacuuauuauuuauaaaaagagaaccauaauacauuuugugauucuauauauaguaugguauaucuacuguuguguaaaugauauacuuaaguugcuuuuagaauagaugguuauuuaaagaaaucccauaaugaacuauuuuauaaaauaaguaaauuugaaggggaguguguucuuaaaaaguauguguacuuuauuaacuauuuuuaaagaugcaaccuuaacauuuguacaugguuuccuuguucaugaucuaacucccucgucaguuguguaagcuguaggcuugugcugaacuugccuugauaaaaaggggugauuaaauaaaaagaaaugcuaauuuuaggaauaucaaaagcuuaucuuggacuucaucugaaccacaaaggugguacaauuguuauaaguggcauauauucaaaaguaucauaugauaucauaguuuucuuuauguuaucagggcagagagugagaauuauguuuguguacuucauuuguguguaaaagaaaaugcaaaagcuuuagacuuagaaaaucuacugcuuaacugauuguguggucuugggcagguccuuaacuuucuguaccuugguuuccucauccguaaaauggagacaauaauacaugcccaaacuacuucauagaguugugaugauucaauguaaaauaaaucaucuguaaaaaccagaacagaauagcucauaccuuuagaguuguggauagcagacauucaguugaggucuguuaaguauaugacuugauuauuauugaauccugguuacaagaagaacaaucugaauccauauaggacccuucugagaauucaaacugccauguuuuucauuuucaguguaauaauauuuugggaagaggacuggguguuggauccuuauuggucccagguguccuauuuccccaaccuccauggggaaauggaagcacagugaagucaaaaaagacuugcucaaguuaggaguggauagugguagaauuagauuagaguuaagauuuuuauauucucuaaaucacaggcacuuuacacuucacgccuuguacuuaaugagauuuuauuccaacauauucauuuuuaggauugcacauaaucuugaucuucaaucuuaaaaccucauuaugaaugcuaauuagaaagacuuguugcggaaauguacaguugcauauaacccaguaaacaggccauuggcuggagggugaaauccaacacaacugucugcauugcuauaagauaaacuuaaccuaaaucgguauuucuuagacuguuagaucacauuuuucugagaauagcuucaaaggaaaaauauuuugcaaacuuagaucucucuggcaacgaucaugaaaguuccuuaauucaaaaaccuuuguagauuuuaauguuauuccuaaguagaucuuaauuguaccucaagugcaguagauugggaauaaaucuauuauacauuuuuuauaccuuaccugaaaguaggcuacauucacccagugguucuuacccagaggugcaccucagaaucaucugaagaauguuuuccagaauucacaacuugggcccuggucugcaccuguugacugagaaacuccuagaugauuuucaagugcacuccucuuuaacaaccacuggccuaaguugaagaugaauagcagggauaaugcuaggcauaaaguaucugaaaauuuaguaguagcaaaggcagagacuugaaaacucaagaaaaaauagguaugguggugauuuuagacaauuuuuuucuauuuuaugacugcugcuuuuacugaaaagaguaauuagaagaaccuagaaccucauuagaaauaugaggaaauagauggcuacuaucuuccugccuuuaggagacagaagaagccuaaagaaccuauuuuggagacuaaagucguugaaagaaauuaaaggacuaguacugaauaguggugauacucaauauuaaguuuaacaacuuaacaguuggaugcuuaaaauaugcugaauuguacacacacacacacacacacacacacacacacacaaaacugaucauguaugaaaauaucccaagauaauccagaaagaauaauuucugccauucaaacauuuguucauucagcagauauuuauuaagacccuggaaaauacugaggagagaaagauuaucccuccagucaaagacuuuacauccagagauauaaucaaacagguuuaaauccagggucuuccaccacacagccccuuuuguuauguagucagucgcaaaagucguaacaaugcuaugggcugcuauaauugaaagguugaauggcuucguuuuugguuaucuuuccaaacuuuucuauaaauguauucuuccuuugagucuuuuagaaaagaguuuagauguuuguaucuugaugugguuuaucuuuauuuaaaccaaaugaagugaacagcuaaaugaaggaaauauuugcauuagacuugaagaguuagcuaccccaauuuaauuaccuuccuagcauuguucucaaucuucugggauaggcacugggagaggugugagaagccugguauugacuugacuggaucagcaacccuaucuaugcuacucucccuuuuugauuuuuccaaaugaauauuaaaggguugcccuugucuugccuuugggauuaagugaguaacuuuccacaggaagugccuuggguacugagcugaccuucugccuucuacuuuguggaucuucgccaggcauacuugaaucagcaaagagggguuugcaggucuuguuucuugaauaucuguaaaaauaacugcuuuagccuuuuuuggaggauauuuuugagaaauauguauuucucaaacacacacauauguauuauauauauauacacgcagagagaguuuuuacuucaaaaacuuuuaaagaguaaauaauaucaugaauaauuucacuaauguuuuuaguuaggcaaaccuagaauuuuaaaauguugauuuugaauuuuaugacugauuuggaauaauucuggcaauuaguuaauuacucaucugaggcauucauuucuaguggucuuaauucccugacuccauagaucuggcaugauguuugaaaucugacuuucuaaaauaaauauuuuucuguagguggucugcugugugaauaaauaauuccugaagaaugaagaagauuaauuuugggaguucuuugacgaacuuugauauguggaaaaaguauuuauaauuuauuguaagaagaaaguaaaauauuacuaguggaagaucuucaguuguguuucuuuuuuguguuccucauuugcucacguggcuuuuucccccaaaggauauauaccaacaaaucuuguaacauaagguucuuauguucuuauuacuaugucauucugggaacucuggauaucuguugucaggagaaagcagauacugaccucaaccaaugaaaucuccagaauuaggugcauagaaguaaaauaacccuuuaccaauucagaaucagugugguagccauaucaucucauucaacacucuuuuuuuuuuuuuuuuuaacuuucuuaaagguaagaacaagccuuuagucuuauuauuuaaaccauuauuguuauucuuuacuagcugucuuuuggaaaaguuaguuuagauuuuggaccagauuaggguaauuuggcuuagaagaucucaacuguuuggcauuaugaaucuguacauggguaguuacauuuuaaaauagacuaggaucuuaaguuucgugccuacaggguagacaguugucucuuauuaauuagaaacuaauuagaaauuagaauuaauuagaaauuaauuaggcuagagacugaauugguauuaaaugucacuaaucaaacagcucagugcuaugccauggugaugccuggaguugaacagagugugauuuccuuaguauagcaaccuugucauccucguagcugcugaugggcuaaugaaguaugaucauauucugcuuguaaguacauugagucuaaaaucucaagaacaaaagauacugagaacauaauuaagaggauguauaauguucauguaucauugugugaugggaaaagucccuccuuuauaaaauaaggagcugaaucagaugauuccuuaagauucuuuccuaauucauuaagagcauggcuuugauguaugacagacuuagguucaauagcuggcuaugugaccucaagcaaggcauagcuucuuugggucuguuuuucucagcugaaaaaaaaaaaaagguauagaaguaauaccuaacuuacgagauugucaguacuaauuaaaaaugauguauacacaguauuuagcacuguuauuagcauucucuauuauuuuauuguuuauauuuuuacuugaauauucauuuggauauaauacuuuuaguaagcacuucaugauuuacagagauaaucuaggugaagaauagaaucuuggacaauuaagacagguaugaaccaacuucccacccaauacagaucuuuggcaggugguuauccaaacucugcuugaauauguccuggaacugcaaaaaagaaaacaaaaaaaucgauaaccuuaucacccauuguuaauuucugauauauacuagucuagacuuuuccuaugccuuuauacauuuuuuaaaacaaaauaaaauuuuuuuucuaugcuacauauuuuuaaugagguuauaacauuaucauguuuugccccuaagguauuuuaccaucagugaguauaggucuguggugucauuuguauugacuauguauaaauucaucugugacuuaaccauaauuuaaccaauacccuauuuuuucuuuuugcgcauuuggacauucauucauuaaacaaauacuucauauagagugccuucuguaugucagaugccguucuaggaauugggucucagucuggaacaggauauaugucagauaaccuaaauuccgaauuuuuguuuguuuuauuuuguugguugguuuaauggaaacauaauaaggaagaaaucugaaaucccaucagucuacaauaggaccucucuucgaugacauucucaccucugucucucucucucuguguguguguguguguguguguguguguguguguguguguacaccuuuuacuuucuuuuuuuuuuuuuggcuacucugauaacacugcaauagaagucuccuuauggaaagucuuuacaaguguccuuuacuaaucacuucagcuaaggaugggccagaggccaugcguguuuucaaggcuuugagugaggacugcccccaagugaucucuagaaaaaauauauccauuuacaccuuagugucugagagcacugauuaaucucugagcaacacaauuuuuuuaaacuuuugccaguuugguaugcuugccugauuuguaagggaacugaaagcacccuuuuuggccucugcaacacuuaaaaguacaucucacaagacccucugcccacccuuuccuagugcuuaagucuucccaaagaugagguacagcauuucgguaauaaugaaaagagauaucaccacagucacuugaaaagugaagaacuuggccuccuaguggguaacaaccacauucuaaugcaccucuuugcuaagcccuugcucuucacaauaaugacaacucaauacggauauauucacacuauucucucuagucccccguuugucuaaccuugaaauguuugacuugaagguugaugaaaacaggaucauauccuuaaguaaggccuaucuugggaauacuaugucuuucauaggucuaauaugaccuaugaugugauggaaaaaccaugguccuuauuuuacaggugaguauaggugcuuggagaggauaaggaaaucacccugauccaauagcugguaaccugcgagguaaguugaagcccgguguucuuugguguacuaguuauccaguauaaacaucauguauuuguaguuauaaauucacuuaaugcauacuuagugaaggucuauuauuugcagggaacagcccuaguguugauaauucaugugugaaucagacacguuuuucaagaugagaggcuauuugauucaucacuuacugaggacauacuauaugccaacuauacagaguaguaaagaguaguaagacauagacucuacccucaaagagcuuauagucuaguggauauauguauauaaaccguagaaauauaaaguugaaugcucagugguaugguggauauuccaagaugcuuuccuaaacagugcaugugugauuaugcccagcguuuauuucuuuagguauuaaaaacugcuagauauuccaucuaugucaauuauggugcuuuugauagcaaguaauagaaaauccucauaaggaaaacucacauagcuggaaguccaguuagagucagcucuagaugugaugauaucauagggucacugauuucauccaagacucaaguuauuuucaucucagcuuucucguccaggacugaugaagcccgucaugugcuugcuuguuaaaguccagcggaagagagagaaaccauucccugggcauggacucuuaguccccuuuuuaaaggucugauugagccaaauuagguuauauguauuuuuauggaccaguaauaguuaucaacagaauaccuuaugcugauuggcuuacacaagauccgcccccuucaucccaccccugcuuagauccaugugcagguuugauaucuggacaaaacaaauuccgucacaauugaggaagagguaaauggauauugaauagacaaccagauuuccacuacaccaucuuguucaccuaacaggucacccugaacagucaaauugaguuuauggaggaauuccucucauaguuugcucaaacuuuagaaagaaaauuauugguagagcaaaauaauucugauguucaguuuuuauagaaugugacaauuagcagauguucagagaacuguucccugaagaguuguccuuagugagaucugaauuaggaugcuuucaacuggaagcaguagaauacccaacuacacugacacaagcaauacagaaaaguaauuuaccucccuguuaggaaguuuggaaauuaaaagcuccugguuugagauaguggcucaguggugcuuucaagaacuuagucuuggcugggugugguggcucaugccuguaaucccagcacuuugggagacugaggccagaggauugcuugaauccuggaguucaagacuggccugggcaacauagugagaaccugucucuacagaaaauaaaaacauuagcucggcauggugguacaugccuguaguucaguuacuugggaggcuggggugagaagaucgcuugaacccagaggacugaggcugcagugagccgugauugugccgcugcauuccagccuggcugacagagcaaggcccugucuuaaaaaagcaagcaaacaaaaaaaccuaggcuuguucuauuuuucugcucuuuacccuucucauccuuaggcauauccuaucucaugacuaugguaacuucaagcauuacaucgucacgcaacuauucaagccuggaugaaagguaggccugcuaucuaccagggaguauacuuuuucccagaagcucccccacguacuuccucuuacaucucauugcucacaggucuacuuuugugccagucgcuaucaaggggaaugagauauugugcuuggcuucaaccaaucuuaguucaggcucuggcaacuuggggaaaagcccaccuuccuuaacauauuacccaagcaaaauuagauuugcauaaacugaagaaaaaggggaaauggcuauggaagacaaccaauagugucugcuuaaguucaacuugacacuauguguccagagcauaaaauuaugccucuguucuauuuuaguaucuauacuaggaaaguguuaaccccaagcucaguguuucucaaacuguauguggugaagaaccagcuuuuuuccccucaauucaucacagacccaacacuaggaaaaugaaauaaacccauauagauuuaaaaauaugcuauacaaacccagaauuuuuguuaguucaaaggccauaguuucucugugaaauugcuauaaaaaaugucuaaagucacaauuucuguccuuaccccagcaugaaccagcauggacaaguaacaaacaguuugaagaccaggcugaguucaugaccacacuuguugacucuggugacuucauaagauggcccccgccugccucgccugccucuugucugcugcuccuuuugauucaccuacaacaagcuguucucuguuaccagaauaugccacguauuuuguuuuacuucugggacugacuuuacaaucuguucuuucuuccuggaaugcccuccucuagcuggggaaaaccuacucaucuuuuuagaccagauuaaaagucaccuucccugugauguuuucucguggaaaaaaauauuuuuuuaagagacaguggucucacuauguugccuaggcuggucucaaacuccugggcacaagugauccucccaucucagccucccagaauacuaggauuauagacauaagccaucacgcccccaaccucaugaauuuuaguuagguuauagcaguauaguaaaagucccuauggauugaauuauuugcucccucauaaguguuuuuucuuugaauccuaaguacacuuauuuuauuggauuacaguuucugagucaguauccgggauagacugaaaguuucuugaagugauaauugucuuauucaucuuuauauccccuguucuuggaacacauagucuguccugaauaaaugccuauugaauugaaucagcucaacaaaugagaaaacuuauguuucuuuccuuuuuucuuucccaguuguuuuuuauuguguucugccuucauguuuguguauuuccuuauaagaacauaccauuuugacagacaauacauuuuuucuuuccuuuucuaucaaaucuggacuuacacaagacacaacuuuucauuguuguguucugaucacagguccuauccugugggcaucaaugucacuauuacugcaggccacuauuacugcaguguaaugucacuauuacaugcacccaugauucucugacacguaugccacccuggcaauguacucaaauuuccagcagcaauagaugagcuuguauaugcacacauguaaacucccaaaaguaccugguaggauguuauuaauauacuguagagaauauacaauucagagacacacugaccuaggcuuuaauccuuauucacauacugacuagcuuugugaccuugggcaaguuccuuagccucucugagccugcugcuucuauuaaaacaaaaaauagguauaguaagauaacauaaaacaauagcugcuugauaaauguuaguccccucugcugagauagcacauauguggauugacaggaaagcaggcugagugcagucuggacagcaggacaagugaaccauagaguuaaugggucugccugucucuuuaaugggucagggccaaccuauuuggcaggucuccuaagaaagaugagcugcuuugaaauuguaucuugggcagagcuuugguugcuucuucauuucuaugcuucugacuucccugcuuacagcuggcagggacagcuacucuggaagcucaggggcugcaugucugugauagaaggaugagcagcugcugcuuguuaaaguagggggguuguuugggaggcaggcaagugauguaaaaacaguauauggaaauccccaaaccccacuguuaaaaugaugucagggguccaaaucauguccauggagugaccucagugacauuucuucuccaaauacucuagcucuuuacugauuuuuuuccucuuaacuuagaaaggaggaaauaagguauauauuuguuggucagaugauuuuaaugagguuaagaaaaaacuggcuuccuucaacaugccaugcauuuucaugccucugugcccgugcuucugcuguucucaccacuagaaaugcuguucuccccacuagaaaugcuauucucccucuaccugccuggugaauucaaccccuaaaccucaaauuagaggccagcccuucuuugcaucuucccucccugaugccacccuuccuucuaggcugccaccauccuucaaaguuaacuugguuguugugcuucacauacugaacugccuuuguuuuuugaggucucuuuacccuaacagggugaaaguuucucuugaggaucuuugaugcccaagggcuuagcucauaaaaggcacucaauaaauauuuguugagugaaaacaucuccuucucaccauauuugacaauuuugaauuucucauaaauuuucaucaaguuauagcaguauaguaaaaguccuuaugaauugaguccuugauuaguucugggagguuacugagcaccccgccuguacuucaggggcgauaggaguaaugggaguaagugcuaacccagcagcagggaggaagaaucaaggagucauuuggaauccagagagucacauuucuuuuucuuucuuucuuucuuucuuucuuucuuucuuucuuucuuucuuucuuucuuucuuucuuucuuucuuucuuuccuuccuuccuuccuuccuuccuuccuucuuuccuucuuucuucuccuuccuuuuuuuuuuuuuuuugacagaaucuugcucugucacccaggcuagaaugcaguggcacaauuuuggcucaccacagccucugacucccagguucaagagauucuugugccucagccuccccaguagcugagacuacaggugcccgccaccacgcccagcuaauuuuuauacuuuuaguagagacaggguuuccaccauguuggccaggcuggucucgaacuccagccucacucaggugauccacccgccucagccucccaaagugcugcgauuauaggcguaagccacugugcccaacuaacauuucuuagccuaauguuugcauacuccagcuuuaucucuuggcagcccaaaguagauuccuagguucaaccagaaguuccuugaaaauugucagacuucauagaaguguggaguugggagucauggaucuaguacuguacuuccacuuacuggcaaaccccuugggacagaguauuaaguuugacagacuuggguucaaauccuggcucugccacuuagaccaucugugggagcuuguuaccucucugagccucaguuucuuccagaucuagaaggagaauaauauuuauuuugaaggauuguugucacaacuaacuuauaaguguauaaaaugccuaaucuagguuuggcacuucauggguguuuaauaggugggaauuauaauuuggaagcaccggagugggugggaugaugaucugggcaauguauuauuauuuguuuacuauuaccagauccagauauaugcaggggaaagccagcuuagaauucaaaaagccacuuuacauagcuacuuuuguuaaauggaugucaaauaaauacauaaugauauuugcagugugacuuaauaaaggccuucaggggguuuuccagcuuucacuguuaggauuuuuucugauaauagucccauacuuuccuacucugauguguccucacucagaagcacugucuggcucuccccaaagggagcucgggacaguuuccugccugagguguucaggugaauucugugcucacuuuuccuuucucucuccuugucugucucucugacccugaggucuuaucuuguccucugggagguauguuaagugcucugccaggcugccugugccuggccuguuuuuucucacugccaguaccucuuggauuccaauuccaaacaugguauccaucuggggucacccuuucuuccggugccaagagagaacacauuccaaauggaacacaaaugugccucccaugcuggcucuccucauucugcuugggaaaaacagagagcaggauguggccgcaucaucccacgcugcuggacuuuucaguccuguagugcuacuuucccuugggacuauuuagguuuuucugcuaagaaccaaauuugaagacucccaagaaacauggaaccaaggaagcuugccagagcucugcagggagagccagagccuugcugagacagcgggggugguggggaggagagagggggggagagggggagagagagagagagagagaaagagguuuuuaaauucuccaugaaguguacuauguuccaucauuccuucccaaagccaccggaagcauuccuucuaggaaagguggagucgguagugagaagccggaggugagaagaccccugagcggauggauucauucauuuucugaauuuccuaugugaggacaguauuagagcccagugaggcuuugagaggccccaaagaugagcgccaacagcagcagagugggccagcuucucuugcaggguucagcgugcauuagguggaagcaggauguggaaggggcugucuaccaccuagccaacugccucuuacuccugggcuucauggggggcagugggguguauggaugcuucuaucuuuuuggcuuccugagugcagguuaccugugcugcgugcuguggggcugguucagugccuguggccuggacauuguucuuuggagcuuccugcuggcuguggucugccugcuccagcuggcacaccugguauaccgccugcgugaggacacccucccugaggaguuugaccuccucuacaagacgcugugccugcccuugcaggugccccuacagacauacaaggagauuguucacugcugcgaggagcaggucuuaacucuggccacugaacagaccuaugcuguggagggugagacacccaucaaccgccugucccugcugcucucuggccgguaagcuacucuauccauugcccagaauuucuuuccccagcccacacuucucauuuccuagugugucccuuuccauuucaugucccuuuccauuucguguccccuuccauugagggaaggaugugacaagucaaacaaaccaaaauagauuuuucuaagagugggguugcuuccucuuucuuggcauuuuccaagaagaaaccaguucaugaggcaucuugguuggcaagaaugauuguaugugcacuugcugcuggaaggugugcagugcgugugucuugagccugggccuuaaauaaccccucuaccaucaccacacacauaucagugugucaugccuaagcugcagcaauaucucuguaagcuuugaaaaacuaacauuucaauaagguuaaucuguuccuuacucaaauucaacauuugcuaagcaccaacuguauucagggaacaaugccagaaaugggaggucgggauagcggggugguucucauaaccccuguucccugccaaggcaucaagcaaacagccccacuuguguuugggguagcuguauguagccagguagggagagugaauaccccuugcccaccuuuccauuuccaguuguucuauugagguucuugaagacuaagaagucaaguacaguacuguaaaucugagggcccaacaaugggagaagagaagugauacaccuaucucaucaaggcuuuuguggaagcaccgccucuuuuggagaaggcugacagucagauaugggcagaaauggucuuagucaggaucaguguaugcccagucaaccuggaugugaauguugggcauugauuucuucugagaaaacaucacggggcucugugcuacacacuuaguaggcaauuguggauuuuuuuauacugcccuaguggcucuugagccccacaacccccacuccaccagcuuucuugagaccaggagaaugugauagaaaagguaagauggcaauuagaaggcuccaauuccaagaaaaaaaaaaaaaaaaagcaaauccagauaauacugccaaccacacaauggagaaaaaaguuugacaaugaugcuaaugguacuacaacuaccacuaauaguaauaauacguguuuguguauucauuuauagaaccugaaguaucauguauauauguuuugauuuuguuugaacucagagguccuggauagagugagcuaggaggggagacauuuugugaggguacauuucauuucauuuauuggugaacugaaaguguaaaccaaugcgauuauuuguaaacagauauagauguaaauacaaauacauauaacuauugugaaaauguuugcaccuauaguuccaugcuuaaagacaauuuagggaacuugcucauucaugagacccaugauguuauagcucgucuguucaaaggaggaaauugagagcagcagaagugcucccuccaguguagggugcccauuugcuggaagcauguaugguuacuguauaguucaguuaggauagauuuacugugaacuuguauaagaucacuucccagugaaggggagaggggggcuugcccuugguguagcuuuuccugguauacuuagcaucaaaaggcugagucagaaauuagacaauuuugauuuuuuuuuuuccugccuuucaagguuuggaguaagaguuuuguuaucuuucagugucacccugucucagcuuugcugagcuggacauagaggaaaaggcuucuagucuaugacugggcucuaguuuuaaaggagaaucacugaaccuugggcugguuacaguaagggaccaaacaucucaaagcagcagacaagaacuuugugccaggaaguggggacucuugugcagacuuccacaucucacaugcacacuguucucuagaguccuucacucaaaccucagaagucuuuuuguuuuguuuuaauaaaggaaaccaaucucuuucaaaacucagagagggaaagugacuuucucaaagucuaucacccuguuaagcagcgcuuaacuuagacguuucucucauauaaaauucaaaacacaaacuuccauauauacaacccccugagcaggcaacuaacuaucuaagcuauucauuuaggagaagaucauccaucuuccaguagaucaagaaggaagaagaaacagaugauaaagggcacagcauuccgauuuaaauggcuucagcgagccacgaagaucauuagacauuaucuacacucuacgguugucacucuuugguggcuugccuggguggccgaaauccucgccuaaggagcugacauaugcugcagcagcgccauucucuucugcugucuuccuuugcuauggaagcuuuucagugagguuuugauccccuuuuauggugacacaagugaguuuguuccuugguuuccuuuguucauuuauucauccuuacuuucuugcuuccuucuuuccuucuuuucccccuuccauacauauuuauucagagucuugaauaaagcuccugucuuccagcuuuagguugucagauaauaggugcaauuguuuuuuuaauuggugcuggucuuugguaauuuguauacacgcauguauaccuaggcauucauuaagagcaaggcucaggagugcugauaucccauuggccaggacuuaucacuugccuaugccuagcagccagggaaguagagaaauguugauuuuuuucucugcagucauguguccaguuaaaaucuagcaccauuaaggaagagaagaaagcagauacuggagaacagacugccacacuggauuucccaggucuuuguucauucucaucuuuaucugcuucucaauacccuuugcaucccucaaaauucagcucaaaugucaucuccuucgagaggucugcugcccaaagagaaccaaucuuucucucuccucuguuacuguuccacaauagcaccuaucacauugacuugcagccaguuauuuaugugccugugacuuccacuaaauugugaaauccucaaagacaaagaccagauugugcccaucucugcauucccagaucuccagaaacaugagagaugcuccagaaauauuuguuuagccaauaaaccuccagaaauaauggaaggauaucucccccaaaugaacaagguguaccuuagagaucuuuuucaucuucccccuuugccuaauagaggcaccccuauugccugauauaacucacuuuagaagagagguuaaagaugaaacucugaguuuucugggcaggggucggguugggggaaggauaaagcccauacuggauucuaaucuucuuccagauguggccucacaucugaaauacacucccuguccucaggcaucaucaaugacaugccaucaguucuaacaaguucucauggaaugcagucuuuuuacccugcaggggcagagcacuaggcuagguacagccacaaggguacaaaggcaccaagcagcaauaguaaggcuccuaaccccuuaaguugugaaaccaagccuguggucaugggcaagucaagagcaguuaaugacuuaagacuuaagacuuaagaauauucauaaaauuaaagcaaauaauucggauuucuggcugcagccacaguaacccacucuagccaacagaagggggaaaaaaggucuuuauuuaaaaaaauacaaggauuucuuaugaaacucaaggaaagacaugcaccuaagccucagguagugcuagaaacaagaacauguccuacuaggacauuuuaugugauuucaaguuuauuuucucuauagccaauugggacccaugcuuuucaaagucugaguuacgugauaaaaaaaaauuuuuuuuaguuccuucagggaggaguguguuaguuuuguuaauaaugccugauaauuguccccauccaaggcaugauuuacacgcaauuccauuuccaaauucccagggaaggaguuugauuggcucagcuugagucagguguucacucuaggaccaucagcuggauagggugcaugggaucucauugucuaaagaaacaagcuguuauugucaccuacgguuagagagguccgggaaagggucaugcuaggagaguccacuaccaucuacccaaagcuguaguaauaggguggcaacaugguguugugcuaagaacauagaauuuuaguuccgccacuugaucgcuauguagccuuaagcucgccacucaacccuucugagcaccaguuuccuuagcuauaaaauacagaaaagaauaaucuaccuugugguguugugaacauuauauaagagaacacugguaaagugucuagcagagucuggcauaugguagacuugccacuuccuucaaagucuacaaagugguuaaauguaagcaugaaucuucauguagcuaaugggaagggagaaaggagaaucuguggagcagcggauccaacagaacuuucugugaugacagaaacguucuagaucuauguuguacaacaugguagucacaggccauauguggcuauugaacacccauauuguaauuagguaaggaacugaauuuuuaauuuuauuuaauuuuaauuaauguaaauguaaacuuaaauaggcagcagcauucuuuucucuuuuuuugagacagaaucuugcucuuuugcccaggcuggagugcaguggugugaucucggcucacugcaaccuccacccccgaguucaagugauucucuugccucagccucccaaguagcugggauuacaggcacccgccaccauaccuggcuaauuuuuguauuuuuaguagagauggggguuucacucucuuggccaggcuggucucgaacuccugaccuuaggugauccaccugccucagccucccaaagugcugggauuacaggugugagccacugcgccgggccagcagcagaguucuuaagcaguaguuucuaucuuggcuacacauuagaaucacuggggagauguaaauacuaauaauauccaguuccuaccuagagagauucuuguuuaauugcucugggauaaggcccaagccuaggugcuuuuuuuuaaaagcuucccugggacuucuacucugcagccugaaauugagaaccaccaguaaggagaaggaggaggaaaaaugaggguucuggaagucucaauggguuccuuuucugaacuacuugcaugcaguaauuaggcuggcuagucuagcuuuggguuuuaccaugcuuuaggcaaaguauuucuacaggaagauucauguuaaucagcgacaccuaacuucagcauagguggcuuggagagccauuuuccuuuucccacaugaucucuucucuucccuugccaggguucgugugagccaggaugggcaguuucugcacuacaucuuuccauaccaguucauggacucuccugagugggaaucacuacagccuucugaggaggggguguuccagguaacagggagccugguggcagcaccgccucaccccaucccacuguagcccagcaauauccgugccuccauguuuccccucuuacaucuguccuucgcaccccugccagugugaagcuacaggcgggggcacucuuccucugaaaagaguuccugggcuccuagccauaggugagguaggguaggaagaugcuggccccuggguagaccauguuacuuguaugcuuaaacucuucuggaagacccuagugccacaacauaaaaacccacacuuguuauaggguaacuuaaaccuuuuagugcucucuagucgcauuuccagcucucccuccuucauauuuuuugcucauacuagccaugcugaaccacuaguacuucccuaaacacaccacauuguuuugcagcucuaugccuuggccccuacucuccccucugaaaugcauuuccccuucuagaugagaccacggaaccucacuuccacugugaagccugcuuccaccccacagccucaccagcuuccaccccacagccuagcacuccugugugccuguucuaguccuuuuacuuaugcuaacuggugcacaucuugcugucuguucuaauaaucuggucuccuuucugucuucugcacagugaacucugaaguacaaaucuaggcuuuucccucucuguucccagacucuaaaggaaaguaccuggagcacagcagcuguucaguaaagaauugcuugccgggcgcgguggcucacgccuguaaucccagcacuuugggaggcugagguggguggauccugaggucaggagaucgagaccauccuggcuaacacgaugaaaucccgucucuacuaaaaauacaaaaaauuagccgggcaugguggcgggcaccuguagucccaacuacuugggaggcugaggcaggagaauggcgugaacccgggaggcggagcuugcagugagccgagauugcgccacugcacuccagccugggcgacagagugagacuccgucucaaaaaaaaaaaaaaaagaauugcugaacugguuugccacugggcagcuggugucccagaggacuccauggggcauucacauacaugcuccaaugcagguuccuggcugccuggccccuacucuucuuaucucugccaaucccucaggcuuuggucacuuucuuuguagcucucacuuauugaauggcuagcauguggcaggcacuacguaucauauugccucauugauucucauaacaacucuauggguugaauaugauuauuacuccauuuaacaacugaggaaacuaaggcccaaaaacaucaaguaauuugcccagggucuucagcuagaaagugacaaagccaaguugccuggaucuaccauuucuguucuuuauuaaaaugggaaggucaccagaagaguagaguuuacacacacacauacacacacacacaugcacacgcaugcacacacgcgcacacacacucacucacccuuuuaaggacuccccugccuggauaguuugcuggaccuggaaacacuggauuccaugugucuccuacuacuuuuaucagggagucccucaagccaacauaugagccaaccccggaacagacacacaccgggcagugcuaccuggcagggccugcuucugcccccacccugacacuuggcucugugaugauggagccugagaggcaguccugaucccacugccagggucaccagccacagauccacuuccaucauguuccuacccugaccuccguccacacacccucccuaacuaguccagaaaccuucuucaggaacucucucaggcacaugagaaccuccaggagggcucagucaggaccugagccagcuggaccaggccucuuucugacacugacacggaggaacaggugguggguaagccggguguccuccccuaaguuacgcucaagaggaagggcuguaaccucacauggccucucagccuggaauguagguauggucauguuccucccauuuauauuuuuagcguguaccuccuuugggaguaaugagagccacacauuugcuauuggcuguguaaagucccauuuccucuuugcaaaugucaaguguuaucuuaaguuagaguucauccuguccuugccuuuugcaauuacauagucuuuguugacugagagcaauccacagugacagccuaaauuauaauucacauuguaccuaauauaaaucaaucagcauuccagcacaccucucgacaauucaauuaagucagaauucauuguguguucggcacugugacacucauuagucaccaagaacacagcacaggagggaucacacagaaaucaucacuguuuuucuaauuugcauccuaucuuacuggaccuaaguccuauuuacauagguuaucucauuuaauucauucaaccaacaucugagaugaguauuaaaaaaaaagcuaaauacuugucaaaacguuacaacagauaugucuauauauaugggagaaccaaucaagaagcagauuucaggaggaccuuuggggaaggauuuuauacaggacaugagaaagcaacauuagaggcugggcgcgguggcucacaccuauaaccccagcacuuugggaggccgaggcaguuggauuaugaggucaggaguuugagaccagccuggccaacauggugaaaccccaucucuauuagaaaauacaaaaauuagccagggugguggcaggugccuauaaucccagcuacucgggaggcugaggaaggauaauugcuugaacccgggagguggacauugcagugagcugagaucacaccgcuguacuccagccugggugacagagcaagacuucgucucaggggggcgguggggugggggaagaaagugacauuagguuguuuugcaauauacaagauuggcugucuucccuugauucauuuauucacuucaauaauauuuauugaaaacuuaguauauaccaggcacuguuaaaaggauuugaaauauaucagugaacagaacagaugaaggucccuccccucaugcaauuuacauucuaaugggggagacaaaaagccauaggcauaaugaauaaguaaauuauauaauuuguuagaggauaaucacugcuaguuuaaaaaaaaaaaccuagaguagugcaagggagaaaugguggcaauuuuaaauaggguggucauggaaauccuuguuaagcagauaacauuugagcaaaaaccugagagagaugacaggugaggucugugaauaucugggaaaagcauaucagacagaggaaagagccagugcaaaggcccugagguggggccaguguguuugaugcacagaaaggaggacaguggaccuggaauggagagaggaaggggagggaauagcaggagagaaaguuggagaggugacgagguagcaagaucauguagggccauagcauauauugucuagauacagccaaaaggauuuucuaaaggguuggauauaguaugugagagaaagagaagaucaaggaagacucuaaggcuuuuggccugagcaacuggacagguggugcugcugucaacugagacaaagaaagcugcagguagagcugcuuucgggggacuaggaaguucaguguuugauguuagguuugcaucaucuguggacauuugaauggagaugcugcauaggcaacuggauauuuaagucugaaauucaggaaugagaucugggccugagacauaaauuugggaguugguuguaugcagaugauauuuaaagccauuggauaggaugagcucaccaagugagugaguguggauggaagagggaaugguucaagagcggagcccugggauacuuuaguggugaggaguuggagaggaaaggaggaagcagcaaaggagcuugaaaaggaacaaucaugagauugggcaaggaguguauggcauccugggaaccaagugaagaagauauaucaaagaggaaggggaaauugauggaugccaugaaaacugaccaucagacucagcagcuuagaggucauuggugaccuuaacaggaacagucuuuguggacugcuagggacaaagucuuauugguuuaagagagugagaagagaggaauuggagacaguuaaguauaaacagguuuuuuuuucuucaugaguuuugcuaaaaagggaagcaaauuaguggagugauagcuagccagggaagugaauucgagaaaaagaauuuuuauuuguaaaauuuuguuuuauuuuaagauggaagaaguacagcauauuucuaagaagguucacagucuuuguguuuggcuuuaagacauuauuuacauucggcguaguucuugcucaaacacaugugcuucauauuugguacucugauuucuuguuugggaauuguucauaaguacaucuaagguacaggccauggcagaugugacaacuacuugcugaacuauuaguaauggacagauuguauuauuuucagaauucuuucucaugaggcaagagagauuaaguaauuuaucugacaucauacaacugauagagguaaagcugaaacaugaaaccacuucuggccucgauaacguaguuuagguccugauugcagugcuagcaauuaguggagaaaaguugagaggaggaaaugaauaaaggacgugggggagggguauagcagaaaggaaagaagagaagaggaggguaaugggagauccaguaggcaauacaggaaugaaaaggauuauauauaaucucuaauaaagaauguuuggaaagcuacccuacuuuaaauuugacaauucauauaaagugcuuaacacaacgccuggcaccucuugacaaauauuagcugcuaacaucauuaucaucaucauuuccacugucuccauccacaaaaauauaucaugaacucugccagcccaaaguauuagggucaauuagauuauuaaaaauugugugauucugcacccuuuuccugcacuguccuaagcauguuuccauuuuaaccccagcuuuaccacuuaucauuauuuuaacaaggauuuaucaaacaccugcugcaugcuaggcacacguuauugcuuauuucccaugcaagcguaauuuagcuuugcaucaugggcacauagugaguacucagaaauuccuagaugaauaaacaaauggagaauggggugcccuuugauuuucuacccuuuagaguuugucuuccgcuaugcccuuuuucugauuucagucaucagauccuuuugguuacuugaaauggccaaguuacgagcaauuucguaacuugcucguaucccaaccugaaucccaggcuugggauccugauguagcuuggcauaccucaucagaagcuuuuucucaaacucaacuuuccaacucuuuuuaugucccuaccccaauaucuuacccuuccucauucuuaaaaugaauaguugucagcauuucaaccacucuucagagcacaagaaggccccuucuuucucuaucuuaaaaucauaagacucagaacuuucugcagucauuaguggcauuagccacggaaccacagaauuacaguugaggaaaguggauguggaaacugaggcuucaggaggugaugggugagugagugaauggcugaucccagggcuccugacacaggacccccccauaucagugcacacaagugaaagucauccacuagaccuccuccaggcaaggccauagagggguacucccacacagcuucuucaguaaaaguacagcuguuugccaagugacugaaugaucucugugcucagcauggacaaauuuucuaguuuaaacuuuuauugucugcuucugaccccucucaggucacucugacugcugagaccucauguagcuacauuuccuggccccggaaaagucuccaucuucuucugaccaaagagcgauacaucuccugccucuucucggcucugcugggauaugacaucucagagaagcucuacacucucaaugacaagcucuuugcuaaguuugggcugcgcuuugacauccgccuucccagccucuaccauguccugggucccacugcugcagaugcuggaccagaguccgagaagggugaugaggaagucugugagccagcuguguccccuccucaggccacacccaccucucuccagcaaacacccccuuguucuaccccuccagcuaccaccaacuuuccugcaccuccuacccgggccagguuguccaggccagacaguggcauacugggugaggacuccaccagucuggugcuggaggauuuugaggaggugucaggaucagaaucguuuauggauuauaggagugauggggaguacaugaggugaagggagaacuaacaugggcacagccaccggcucaggauccuauguaaguacucagaaggcagccgcugcacauuccugucaauggcuggccuuaacucagcuuguuagggcaaaaaaaaucauucguggaacauuuccucuuagaggacucacagaaaguggcauuaacccaacuuugaagauagcaacucacuccgggugcaugcaaggcaugaagggauuuuaaaaacucauucguuauuaacuugauugcauuuuagaaagugggcugguugauacguugagcaggaagguagauugcuguuuuuuugcaaguuuauucuaauagcugaggccacagcuggggcuuaaggggcuuuuauuuguggcaugcauuuuaaaagaaaaagaauguggcaggguucuaauucugauugcuugucuuuccugauacagagcccguccuggaaagcaguuguuauuuagccuagacugggcaggcaucucuguuaaaacugcauauuuuaaagaggauugugauuaugagcuaauagcucggggaggaaaauguccucaucuugcuuuccucucacccaguggagaauguguuuguugaucacacagacagaggacuagauacugcuaugauuaaauguuacuaugaucagauagguauauggcagccuggcuuuccccagucacccacaccugugggagguaggaugugcauaaauccuggagggccuaacagugcgugcaggauuucccucacagaauuucccucccagagagucuacaagaaaggcugugcccagugguucugggaaauugcucucauguuucccuggcugcccucauaauacugugauguuuuucucuguaacuccacccaaccaugauguaggccugaauuuccugaggaaaaucccauuguucccaauuuggaaggcgccucccaugguucuucagaaagcaccaauaaauuaccugagaaacuagcccagugaggaaggccuccagaguacaugaaaugaaugagugaauguuugucuauuuugaaaaacagguuauauaaaugaugaaagaggccauagagaugacugaugaaagguuagagauuuaguuuuguagauauggaauuuacaaucuccuguguuaccagcauccuuagaaccauaguucagcucauucugagguaauuccaaggaucaaucuaacaccccagaucacuuuguugaguuccccgaagugugcauugacaacucugaucacuccuuucccucugugcagcuguucgccuuccuacucguucauccugcauccacgcaugcuccuuauguccuauggaucccucuugguccaacuugcccauccaccuauacacucucucuucgacucacagcagcucucuguuuucucauguuguucuuccugguuuucuucucuuuucuugguucuauuuuucucuucuuucuucuccaauuucuucucaguccuugauugccucaguuugauguucuguucuuuuuuccuuuucuuucuugagacagggucucacucugucacucaggauggagugcaguggcaugaugucggcucacugcaaucucuaccuccaaaagcucaagcgauccucccaucccagccucccaaguaacagggauuacaggcacaugucgcugugccuggauaauguuuaauuuuuaaauuuuuuuguagagacaaacucuccccauguugcccagguuguucucgaacuccugggcucaaauaauccuccugccuuggucucccgaaguguuaggauuacaggcaugagccaccaugccuggccaguuugcugcucuuaaguguccauuuucuaugucuucucaguucauuucucccucuucacuugucucuuguuuucuuccauuuuauuguucauauauuuaucucuccuauuaccuccuuuuuucuuuuucccaccuuuuuugccuugcuguaucuauucuuccuccuaaacacccuguacccccaucuuauuaguuuuuaauccuaacucuuccaaagaucaguacuuuucccucugccuauaaagaaaaccauucaagugaagguguaaaauccccagcuuuaggaauguuuuccaaacaucaggaggcaggcagcaugguaaaugagaaagaggccaggacugggaguccaaaguccuggcuucuaugucuggcuuugcuacuaaucaaauaugugacuuuuugcaaaccauaccucacuaaaccuuacuuucuucauuugagcguguuggaccagcuguccccaggaacccccuuggauugaucugagaaggcaaggauaaguuuuucaaaggaagaaaagaggaguagucaguccgcaguacaguagacacaagccccaggacaucugagugucuuucagcaagaacucucugugauauuucacuacaauuucucuggcaccuugggacucuccucagcccuugugguggugggucuuguuuaacuagcaguucccuccauucuaugccugugaagaaucuaucaccuaccaugugauuacagugcagauuuuuuuuuccuuuuccuuuucuuuuucuuucuuuuuuuuuuuuuuuuuguuugagacggagucucgcuuugucacccaggcugcagcgcaguggcgcgaucucggcucacugcaagcuccgccucccggguucaccgccauucuccugccucagccucccgaguagcugggacuauaggcgcccgccaccgugccuggcuaauuuuuucuauuuuuaguagagacaggguuucaccguguuagccaggauggucuccaucuccugacguggugauccgcccgccucgggcucccaaagugcugggauuacgggcgugagccacugcgcccggccuacagugcggauauuuuaugagagaggagaucacaacucaguccccaagcccucaacccuuaauacauacuaucguaugaaaugccucuuuccaaauucagccuuuucuaaaacucaagaugagaaaacugcugaugaggcucacuuucuaaaauaccggaauuugcaauauagggagaauaguuuuucauguuucuuuguuuaagcaauagagagaaaggaaacuuaugucguuuacuuuucaggccauagagguuuucagaacaacuugaaaacaugaucaaauuagccaaacuucugauaguuuucaauguagucugugaucaugggauaauuuagccucaguucuuuuucugaaauuguguuuugaauguuugauuugacuuauuuaccaucaaacuugcuauaagguuauuacucuaaugaauaagcauauucccuuaauugggagcaauuuacuauuauuucuuucauaaaguagggcaccauucaccaucuauuuccuggcucuuuaguuaucaaaauguuaagcucauugcuauucaucccggcacagcacuuauaugagaggcaugaagcuggcugaauucugcaucauuaggaaugacacagccucaucacauugacaccagugcuugucucucacaccaauccaaauuaagaccaacugaaaauagucagaguuuccucuggagcuccuuuuugaagagacauauguuuuuuagucuggugguacccaaaauugaacaaaaaaugggugcugcuucucuuaauaggcaaaacuaugcugcaggauaauguauucaugcagggucuuccagccagaccccaaaucaucccucccuucacuagaauuuuucuguuuaauucgauggccacucuccacagggauccauucugugucuuauuacaggagaugcucaaugaaugagggacuuaucuucuagaaaugcagcuccgagguagucuguugagugaaauaaugaauccauuaucacaaaauaaauugaaagcugucugacauuuggacaauuuuuauuuuguuucacauuguucugaaaacuauacuguuucuuuucucccuauuauuuaaauaagcaaaugaugaacagauuacaaaauugaggacacucgagguaagggaaggagccccucgacaggaggaucaggacauaguaccaagggcaagagaaacgauucaauaaacacuauuuacuauauauuuuaggcaugguucuagguaaucacaugauaaguaguugaaagaacugaaaauguuuuaucugcaagaaaagggcaaguguaauaucuucaaauuuuagaaagaauguaaauuagaauuugacuuaauuugguguaguucuugugggcagaaauugaauugaauaggcugaaaguuauaagaaggauuuuagcucaguauugauacuggauugcucauggguggugagaguuacucaucacuggaagaguucaagcaggggccauaagaaaucucagggauuuuauaaggugauucaugcucugggaaaaggaugccuuggauuauugugucaggguaacuucuaacucuaggauucuguguuucuaagaucuggacucuagucuugccacucaccugccaucaagaacauguuccucaucugcaggacaggaccaagauggcucugucuaccuuaccggguugcugugaggcgugauugugauaaaauacauaaaggcaguuuuuaagcucugaagcacuaguuaaauguguagcguauuuuaagauucuguuguauguacaauuguuuagcagucucucucucuuucuuucucuuucuuuuaucagagauagaugauuuucccucuuauuuccaccaguuuggcuuuucagggaagguggcagcuggcagaauccccugacaacaaaagguacagcaaaaaguggaggccuaaagaaaacaugugcuagcucuuuagccccugaauagcuaagucacaugucagccugcucuccuucaucuguuugggaggaggcagauuagagucacacugucaucaugcucuuccccucagaagcagcuguaagguuuuugguagcugucagugcuagcaaacagugcuuuucucacagaacuacuggaaagaguccuggcucggaaaacuugcucuugaaaguggcacggccagagcaggggucucuagagggucgugccaccucuaccugccacagguuccauugucggucagguaaguuagaggcagcaguuccccaccugcccucuggauaacagcagccuggggcugcuccugagucauguuuccacuucugucuuacaggccucauuuuccuacccaucuuucuguaaaaaugaaagucaggagucuuaugaaacuuaccauuauucaauacaggcuuuugguuuuuuucuuuaaauuagauaggguuagguaagaaguagaguucuauagaacguucauaggaagcaacaaaaguugaucucuuggucucuacaauaggagaggauugggcuagauaccuucaaagcugacuugcccuaauauucuaguaugaaaugauucgaagguacaccugccccuaucaugucaggcagugaguacaguuaaaacauugggaauugguaaaggaaagaaaaaaacugaaaagaacccuuugaaguuagacaaacuguccagagacauagugcuaaaauccucccucuuuuucuuuccacagcuucuagaauuccucuccagagcuacucucaaguuauauccaggggacaggccccuuuggcuccaacccacacgccugaacuuuaaggaucauuggacuaucuucucuguggccagcgcagcucucuucuguguucacagaauggccacugauaggcaugccucuuuucccacccacuggaaggcucacaggcaaggugagagaggacacagaaggugccaacacugucgcuacaguaaggaccugaagugacuuugagaaauucacccucacaaaccuuccuucaggagcaggcauugguagugcagaggcacagauuccguccuuuaccagcugcagaaucuugggcaaguuacauagccucugugagccucaucgguaaacaguggggguuaugaaacccaccucacaggguuguugugaggauccaaugaguugauuuagguaagcaccuagcacaugccguggcaccaaguaagcacucaauaaaucacucaacuccuuucccuauguuguuucuuugcauugucugaaaggaucaauggagucaaagauccagcuuuucacuggugguuauuuuuuauuuuucaauuaagauucaaauuuauggaaguggaaauuuaaaaaccucguuuucccuuaggcugugacauucaacuuacaaaucucuuuuucuguugaugaaccuaguauuaaacaauaguuuuuagagggacuuuuacaaacuuaguuaauuagauuuucuuaaacaucuuaaaguagauuuauaaauguaauauauucuauuuuccuuuuucuuuaaauacuucaacauauauuucaguuaucuauugcuguguaauaucaaucccuaaaauagugacuuaaaauuguccuaauaauauguggugcucaugagugcgggaccugacugggcucagcuaggcgguucucacucaggguuucucauguuguuucagucagauaguggcucagucuagaaucaucuguaaggcuucuuuacucaccugucugggaagacucaaacagaugagggcugaaacagcugggaauccuugggcaucucucccucucaauaguuuuuucauuuuuguuguugugugcucuuuguaugacuauaccacaauuuauuua

SEQ ID NO: 18114 - RNA, 8584 nt, Homo sapiens
cccaugcccuuuacagcuugccccugcaaguaucucugagucuuuaccugaagacacuaagguuugguuuguacaaaggguaagccaagaauuaccagggaguuagcaucccuggcagugguccucaaccagugucagauggaagucaguggauaaauaccccagguuugcuugcccuucaaaugggacaguucugaggaaugcuuuaggcagaggacucagauggcagagugccaaccgcccacaguggaaaccugcucauuaacauaccccauacuagcucucuucccuuccugguuucauuuccccauucucauaucgguauuuccuggaaucaucucccauauaaacugcuugcauucagaucuuugucucaaaguccacuuugugggaacccaacuugagacaaacagaaaaaacuuuuagaacaaguagaugaugaaaaugaagacucaaauaugaggucaugagauuuuuugcuugcgagacgcugacccuaucaauugagcuaaaggacucuucaguguaagaaaagggauagauucuggaagaacaggaugagccugaaaaaacugagcuuaaggugcccaagggacuuguuaucucaaaauucccugaguacaagguuaagacucuugacuuuggaaaaacugaaaagaaauagcagaaaaggaaauacacaaaagaagaauccaucagaagugaacaucacgucucccuaaagggaaauuacagugucuucuuuugacccgagagaauauaaagcccuagcugucucuuccagccgguuucuguauucuaguuucucauaguuggagggacucacuccuuuaaaaccauacauaacuccccaccagcagccagcaauggcagcuguagaaucacugucuccaccauggaaaaaggcucggugggcaagcuccuuccaggagucuccugcagcaagaacagcaucguaggcaaucaugggggcaucgugcccacugcugccaccccagccagaguagcucagggagguguagaacugaucccucuccuucacaccgaaagacucagggaagguaggggcugauucuccauccaaaaucccucuaaguuuuagguaauuuucccauuugguuuggaaguaggaccuguagaaaggaaaaaaucuagagucaauugaaaaaaauaaagugaaaagucauaacaaaaagcaccagauggaugugugaacagagaaaaauccaacauaacuucggcuucuugcaguaauaucauaaacuauuuaaacaucaaaauuauuucuauauaaguaccauucauucaauacauuuuucauaaggaucuacauaaauaaggcauugauccuguugcuaaauaaagagauacauaucaaguuaaaggguaagaaauacagguuuguuuucccugggagggucgagaguaaugaccuuuuaaaggggaacuucaagacaucacaacugugggugacuucagcagaaagccucuuuuuauucuaagaaagacaaugugaagugaacucacgagaaggggaagauguggccuuaccacuuauuaguuagcuaguggaaaaacguaucucuggaauuuuaaccaaggauuucaaaauauuauuuguauaccaagacaacacugaaaaagcaaauuccaggaaaguaggaaauaggcaugaaaauucauggcagaauaggauagccacaaaaaugacaggauuccguguaagagggaaacaccacagcugcccuauucauugagguauccacuuggcuacuuuguagaaucauuacuggaagggaacuugaaauccuuagcagauggguagaaagggggcugggggugaaaaccaugaggguugcugugaucucugaauacaagacauauaugugcagguggauguacacgcacagauucaaccguguuugagcagggcgugcgcuuacagacucaccaguguugaagauuuuccucuacaaaguagccugauuggacaauguacuuuuuagcuucugguagcagcuccaucaguccuuuuccccacugcaaggguggucugcuauucacagcauaggcuguaaaaagagcagacgcaagggcccccagguagccuguugggugguggugggucauccgaccacucucgaugcucacuuggaucaguguguccaguuggcuauggugugggaaccugagaccgaugcacauggcccgcauggcagccccacagccgcccucauggcuguugaagggaauccuccagccauugggcuugcccggcuucagcugcauggcguugugcaccgaggcaccaccuggggaagagucggauaagggauggggguuagcauaaccaaagcaaaggccccagcaggaauaaauaacuaaacucugucuccaaguauuuuugauggaaagggagagccaaaaaauaugaugaugcaugccccaaaacuccaaaccccacccaacaaugugccuuucuuuauguauaacccuuggcaagauaacgcuaauaaaggcagcagacucauauagggauccuuggaaucuuuaccagucauuacugagacaucacaaaaaaauuaagaaguaaguauauuguucucuuuuuuaaguaaauaagccuuuuaagcucagagcuuaagaaacuuccucaaaaucacauaaucagcuaguuaguggcuggguaaaauccaucagacuccaaagcccaauuccuuauggaguccaauaagaaccuuacaauuaggccgggagcaguggcucaugccuguaaucccagcacuuugggagguggaggcaggcagaucacgaggucaggagaucgggaccauccuggcuaacacggugaaacuccgucucuacuaaaaauacaaaaaacuagccgggcguggugacacaugccuguagucccagcuauuuggaaggcugaggcaggagaaucguuugaacccgggaggcagagguugcagugagucgagauugcaccacugcacccuggccugggugacagagcgagacuccgucucaaaacaaaaaaccaaaaaacaaaaaacaaaaaccucacaauuggaguuccugaacaucaaaaagaaagaaagcggccaaaaauucuacagugaagcccugggcucagaugaggagcaguggauucagggaaacaaugugucuuuggugagucacugaaccucugggccuuggcuauccccucgugacagugacguaagcaggcuugucccccgaccuguccuacuggggaccugugaauacgcaugcgaaccaagcgauggcagcaacauacgauggaguguggcacugcuguuccuuuacuggucaguguuuucacaaaaauguucauggauggcacagguggacaaaaaaaaguuuccacuugcuaaacugaugagcuaucagaugccgagaaaggaugaacagagauuggcaucuaaagccaauccuuggggugacaagggccccuugguauggugaugggaagcuuucaucaggagguguuaugugcugaauugaguccccccaauucaaaugcuguagcucuaaguaccucgauuuggagauagggccuuuaaagaggugguuaagcuaaaauguggccuuuaggguaggcccuaaucuaaucugccugguguccuuacaugaagaggaaugcaaacacacagaaacaccagggauacaugcacacagaggaaagaccaugugaggacacagcgaggaggcagccaucugcaagccaaggagagaggccucagaagaaaccaggccugucaauaucuugacuuggauuuccaguuuccagagcugugagagacaaauuuccauuguuucagccacucagucuaugccauuuuguuauggcagcccuagcagccucaaauaggagagguaggucagaugggccagagaaaaucaccugguggcccaaguggcucuaacaaguugccgaagugggcaagaaccacuugugagcgaaccuguggccagaagucucuacaaaagccuuugcauuuuuuuuucuugagauggggucucacucugucgcccaggcuggaguccaauggcgcgaucuuggcucacugcaaccuccgccucugggguucaagugauucucgugccucagccuccuggguagcugggauuacaggugugcaccaucacacccagcuaauuuuuuaauuuuuaguagagaugggauuucaccauguuggucaggcuagucucaaacuccugaccucagaugaucugcccgccuuggccucccaaagugcuuggauuacaggcaugagccaccaugccuagccgcauuuuucuuuaaaaauaaaaaauauacauuuuucuuuuuacuuauucaucacagaaaacuuagaaauacaaguaaguaaaaauaaaaaacuauaaauacucccaucacccaaauauaauuaguaacaucuuuguacauguucuucaagaucuuucucaacacagaaauacauaucuauuuuuuaaaaaaaaguuuuuuuuuggccaggcaugguggcucaugccuguaaucccagcacuuugggaggcugaggcagguggaucaacugaggucaggaguucgaaaccagccuggccaacauggugaaaccccaucucuaccaaaaauacaaaaauuagccagacgugguggugcgugccuguaaucccagcuacuugggaggcuggggcaggagaaucgcuugaaccugggaggcagagguugcagugagccgagaucgugccacugcacuccagccugggcaacagagugagacuccaucucaaaaaaaaaaaaauuuuuuuuuaacuggccacucaaaaaaauuuuuuuuaaagacaggcuuuugcuauguugcccaggcuggucucaaacuccuggacucaagcaauccucucaccuuggccuuucacaguguugggauuacagguguaagccacagcacuuggccccacagaucuauuuuuuaaaggacaguagguucauaacauacauacuauuuuauaaccuauuaguguauaauaauacuuuucaauauuaguaaauauuauuugcaaauuuuaaauuuuuauuaauauuuaaauugacaaaucaauuauauacauuuauuuaguauaaugugaugauuugauauauguaaacaaugugggaugaucaggcuaauuagcauaucuauugccucacuuuuuuuuguggugagacauuugaaauuuacucuauugguuauuuugaaauauacgauacauuguuauugaguagagucacccugaauaauuuuaaaugguugcaaaugugucagcuuaauuaauuaugagagauuuagguucuuucuauuuauuucuuuauuuuuuagagucaggguauugcuuugucacucaggcuggaaugcaguggcacgauccuagcucacuguagccucaaccucccgggcucaagcaaucauccuaccucagccccccaaguagcugggacuacagguaugugccaugacaccuggcuaauguuuuaaaaauuuuuuucuggaguuguaguccccagccuuuuuggcaccagcgaccgguuuuacagaagauaauuuuuccauggacgggguugguugggggagguuuugggacaaaacuguuccaccacagaucaucagacauuagauucucauaagaagcccacaaucuagaucccucgcaugugcaguucccaacaggguucaggcuccuaugagaaucuaaugcgccacugaucugauggaggcagagcucaggugaugaugcuccuucgcccaucacucacuuccugcugugugcuccaguuccuaacaagccacggaucaguaccugucucuagaagagggauuggcuaccccauucuagagacagggucuccguauauugcucaggcuugucuugaacuccuggguucaagugauucucucaccuuggccucccaaagagcuggaauuacagguaugagccaccaccauggccguuauuucuauuuuuaucacauuuacaaacacuauugucucuguuauuuaaaucuccaucaacauucuuaaugauuuccucaaggcuguuuuauucuuugcccuccuugcaccucccaccggcugugcucaccuggugcccgcccauccaugucuuccaugcagucuugguaaugcuuagcaaggagguaauacaguugagucaacuuaggggcuuucccagcuuccacaagagcuucugcuguggccaagugcaucacugugucgucacuaacucuccaccuucccacgucuagggcauccaagccgcccagcugggccaacugccgguguaucuucuccccauccuggaggaacucccacuucccauuguaguaccccagggcaucuccagcugcacucagcaccauagcagccacauacuucuccaucagucccucacaauugcugggcucuggagagggugucuuuguggggaaauuaagacaaaggaaauaggaugaggagcaagaagaaucagaaaaaacaacgacucuagcuauguuuuauugagcacucacuacuugcagacauuguaucaguggcaucucauguaauccucaucacugcucuaugaggaauauaaagcccauuuuauguaugaacaaauggaggaccauggagauaaugcaguuugagaaauguucagugacuugucucaggucacagagccaauaaguggcagggcugggaucccaacauagguccaucugacuccaaagucuaucaucauaacuacaacuguaucucuugccucuuggugaguaguaagcccacuaaauucugcaagucaaacccagcucaucauuugcucuucuuagcugggauuuggccuuagaagugcaaggcuuuacacuuccuauuagugucacaauguguaguucacaaagcaccugcacauucauugucucacuaauagggagggauuacaguaugcauuucacagauaagaaaaugaaggcucagauaagcuaaauucacaaaacaagaggaguggaaguacuggaacccaaaucugauuccagccaagccaggaugcuugguaucacaccacucagccucaguccagaucuucuuaccuugggcaaccucuuggugccucagccuccacauuuauaaaauggcacugauuuuaaaaaguaacaaccuccuggauuuguuguuaggaauaaauaaauuaaauuucauaaaguuggcuggacgcgguggcucacgccuguaaucucagcacuuugggaggccgagguggguggcucaucugaggucaggagaucgagaccagccuggccaacagggugaaaccccaucucuacuaaaaauacaaaaauuagccggguaugguggugcaugccuguagucccagcuacucaggaggcugaggcaggagaaucgcuugaacccaggaggcagagguugcagugagccgagauugugccacugcacuccagccugggcgacagaccaagacucugucucaaaaaaaaaaaaaaaaaaaaaguucuuagagugcuuggcacauaguaagcuugauuuuugacauauuuguauuauucauauacaaccagggaaaauggguguucuguuuuagaacuagaacauuuucuccccacaaccuuuccuucgacaguaauguuuaaauauuguuucucuuagaaaugaucagcuucuagagaauucgaaucucuauuaauaauauacccaccaugaaugaaaucccugguaaagcgcuggcuucccuguuggugcauuuccuaagaaccccccucuuucagccaauuccucaggguucccuucucccuguggcuuucaggucaaagcccuccaucccauccaggccaauacuuuuauaagggucuggcagacuagcucauucuccccucaggugaaacuuuucccuccccuccacuuaucuaaacccuauuuacccaaggucuaguucaagucaggaggcuuccagaagugcuucugcagcugcacugcuguuggccauggaaugcaggcuggagagccccuggagaaggaguaaacgacgaagauggaugcguuccacuacccaguuacugguaaugcugaguuucugagcucacaaaggauauuuguaaauguuauuuacauaguuuauuauuuacagugaagccuaggcacugagauucugggcuacuagaccugacagacacccgggacagcgguuugcccaucuguaaacuggagggggaaguggggagguauaggcucucggaaguuccguccugcgcugcgauuuucagacacuaggccaagacacucugcuucuuggccucggaggacuaacuuuaaccccccauacccucccucucaauguccucauuguccuuuccguaauuccuucuggcuccacccuaaugugugcuucugugaauugcaagcugggaugggggaagaagaccggcaucuuuuuucgguuguaaauucccuuuaacguucgcuuucagaacgcuguaauuacuuaacuccucugaacuuucacgggucacauucucguacccgaacuauacauucagaacuaagau

SEQ ID NO: 18115 - RNA, 8584 nt, Homo sapiens
aucuuaguucugaauguauaguucggguacgagaaugugacccgugaaaguucagaggaguuaaguaauuacagcguucugaaagcgaacguuaaagggaauuuacaaccgaaaaaagaugccggucuucuucccccaucccagcuugcaauucacagaagcacacauuaggguggagccagaaggaauuacggaaaggacaaugaggacauugagagggaggguaugggggguuaaaguuaguccuccgaggccaagaagcagagugucuuggccuagugucugaaaaucgcagcgcaggacggaacuuccgagagccuauaccuccccacuucccccuccaguuuacagaugggcaaaccgcugucccgggugucugucaggucuaguagcccagaaucucagugccuaggcuucacuguaaauaauaaacuauguaaauaacauuuacaaauauccuuugugagcucagaaacucagcauuaccaguaacuggguaguggaacgcauccaucuucgucguuuacuccuucuccaggggcucuccagccugcauuccauggccaacagcagugcagcugcagaagcacuucuggaagccuccugacuugaacuagaccuuggguaaauaggguuuagauaaguggaggggagggaaaaguuucaccugaggggagaaugagcuagucugccagacccuuauaaaaguauuggccuggaugggauggagggcuuugaccugaaagccacagggagaagggaacccugaggaauuggcugaaagagggggguucuuaggaaaugcaccaacagggaagccagcgcuuuaccagggauuucauucaugguggguauauuauuaauagagauucgaauucucuagaagcugaucauuucuaagagaaacaauauuuaaacauuacugucgaaggaaagguuguggggagaaaauguucuaguucuaaaacagaacacccauuuucccugguuguauaugaauaauacaaauaugucaaaaaucaagcuuacuaugugccaagcacucuaagaacuuuuuuuuuuuuuuuuuuuuugagacagagucuuggucugucgcccaggcuggagugcaguggcacaaucucggcucacugcaaccucugccuccuggguucaagcgauucuccugccucagccuccugaguagcugggacuacaggcaugcaccaccauacccggcuaauuuuuguauuuuuaguagagaugggguuucacccuguuggccaggcuggucucgaucuccugaccucagaugagccacccaccucggccucccaaagugcugagauuacaggcgugagccaccgcguccagccaacuuuaugaaauuuaauuuauuuauuccuaacaacaaauccaggagguuguuacuuuuuaaaaucagugccauuuuauaaauguggaggcugaggcaccaagagguugcccaagguaagaagaucuggacugaggcugaguggugugauaccaagcauccuggcuuggcuggaaucagauuuggguuccaguacuuccacuccucuuguuuugugaauuuagcuuaucugagccuucauuuucuuaucugugaaaugcauacuguaaucccucccuauuagugagacaaugaaugugcaggugcuuugugaacuacacauugugacacuaauaggaaguguaaagccuugcacuucuaaggccaaaucccagcuaagaagagcaaaugaugagcuggguuugacuugcagaauuuagugggcuuacuacucaccaagaggcaagagauacaguuguaguuaugaugauagacuuuggagucagauggaccuauguugggaucccagcccugccacuuauuggcucugugaccugagacaagucacugaacauuucucaaacugcauuaucuccaugguccuccauuuguucauacauaaaaugggcuuuauauuccucauagagcagugaugaggauuacaugagaugccacugauacaaugucugcaaguagugagugcucaauaaaacauagcuagagucguuguuuuuucugauucuucuugcuccucauccuauuuccuuugucuuaauuuccccacaaagacacccucuccagagcccagcaauugugagggacugauggagaaguauguggcugcuauggugcugagugcagcuggagaugcccugggguacuacaaugggaagugggaguuccuccaggauggggagaagauacaccggcaguuggcccagcugggcggcuuggaugcccuagacgugggaagguggagaguuagugacgacacagugaugcacuuggccacagcagaagcucuuguggaagcugggaaagccccuaaguugacucaacuguauuaccuccuugcuaagcauuaccaagacugcauggaagacauggaugggcgggcaccaggugagcacagccggugggaggugcaaggagggcaaagaauaaaacagccuugaggaaaucauuaagaauguugauggagauuuaaauaacagagacaauaguguuuguaaaugugauaaaaauagaaauaacggccauggugguggcucauaccuguaauuccagcucuuugggaggccaaggugagagaaucacuugaacccaggaguucaagacaagccugagcaauauacggagacccugucucuagaaugggguagccaaucccucuucuagagacagguacugauccguggcuuguuaggaacuggagcacacagcaggaagugagugaugggcgaaggagcaucaucaccugagcucugccuccaucagaucaguggcgcauuagauucucauaggagccugaacccuguugggaacugcacaugcgagggaucuagauugugggcuucuuaugagaaucuaaugucugaugaucugugguggaacaguuuugucccaaaaccucccccaaccaaccccguccauggaaaaauuaucuucuguaaaaccggucgcuggugccaaaaaggcuggggacuacaacuccagaaaaaaauuuuuaaaacauuagccaggugucauggcacauaccuguagucccagcuacuuggggggcugagguaggaugauugcuugagcccgggagguugaggcuacagugagcuaggaucgugccacugcauuccagccugagugacaaagcaauacccugacucuaaaaaauaaagaaauaaauagaaagaaccuaaaucucucauaauuaauuaagcugacacauuugcaaccauuuaaaauuauucagggugacucuacucaauaacaauguaucguauauuucaaaauaaccaauagaguaaauuucaaaugucucaccacaaaaaaaagugaggcaauagauaugcuaauuagccugaucaucccacauuguuuacauauaucaaaucaucacauuauacuaaauaaauguauauaauugauuugucaauuuaaauauuaauaaaaauuuaaaauuugcaaauaauauuuacuaauauugaaaaguauuauuauacacuaauagguuauaaaauaguauguauguuaugaaccuacuguccuuuaaaaaauagaucuguggggccaagugcuguggcuuacaccuguaaucccaacacugugaaaggccaaggugagaggauugcuugaguccaggaguuugagaccagccugggcaacauagcaaaagccugucuuuaaaaaaaauuuuuuugaguggccaguuaaaaaaaaauuuuuuuuuuuuugagauggagucucacucuguugcccaggcuggagugcaguggcacgaucucggcucacugcaaccucugccucccagguucaagcgauucuccugccccagccucccaaguagcugggauuacaggcacgcaccaccacgucuggcuaauuuuuguauuuuugguagagaugggguuucaccauguuggccaggcugguuucgaacuccugaccucaguugauccaccugccucagccucccaaagugcugggauuacaggcaugagccaccaugccuggccaaaaaaaaacuuuuuuuuaaaaaauagauauguauuucuguguugagaaagaucuugaagaacauguacaaagauguuacuaauuauauuugggugaugggaguauuuauaguuuuuuauuuuuacuuacuuguauuucuaaguuuucugugaugaauaaguaaaaagaaaaauguauauuuuuuauuuuuaaagaaaaaugcggcuaggcaugguggcucaugccuguaauccaagcacuuugggaggccaaggcgggcagaucaucugaggucaggaguuugagacuagccugaccaacauggugaaaucccaucucuacuaaaaauuaaaaaauuagcugggugugauggugcacaccuguaaucccagcuacccaggaggcugaggcacgagaaucacuugaaccccagaggcggagguugcagugagccaagaucgcgccauuggacuccagccugggcgacagagugagaccccaucucaagaaaaaaaaaugcaaaggcuuuuguagagacuucuggccacagguucgcucacaagugguucuugcccacuucggcaacuuguuagagccacuugggccaccaggugauuuucucuggcccaucugaccuaccucuccuauuugaggcugcuagggcugccauaacaaaauggcauagacugaguggcugaaacaauggaaauuugucucucacagcucuggaaacuggaaauccaagucaagauauugacaggccugguuucuucugaggccucucuccuuggcuugcagauggcugccuccucgcuguguccucacauggucuuuccucugugugcauguaucccugguguuucuguguguuugcauuccucuucauguaaggacaccaggcagauuagauuagggccuacccuaaaggccacauuuuagcuuaaccaccucuuuaaaggcccuaucuccaaaucgagguacuuagagcuacagcauuugaauuggggggacucaauucagcacauaacaccuccugaugaaagcuucccaucaccauaccaaggggcccuugucaccccaaggauuggcuuuagaugccaaucucuguucauccuuucucggcaucugauagcucaucaguuuagcaaguggaaacuuuuuuuuguccaccugugccauccaugaacauuuuugugaaaacacugaccaguaaaggaacagcagugccacacuccaucguauguugcugccaucgcuugguucgcaugcguauucacagguccccaguaggacaggucgggggacaagccugcuuacgucacugucacgaggggauagccaaggcccagagguucagugacucaccaaagacacauuguuucccugaauccacugcuccucaucugagcccagggcuucacuguagaauuuuuggccgcuuucuuucuuuuugauguucaggaacuccaauugugagguuuuuguuuuuuguuuuuugguuuuuuguuuugagacggagucucgcucugucacccaggccagggugcaguggugcaaucucgacucacugcaaccucugccucccggguucaaacgauucuccugccucagccuuccaaauagcugggacuacaggcaugugucaccacgcccggcuaguuuuuuguauuuuuaguagagacggaguuucaccguguuagccaggauggucccgaucuccugaccucgugaucugccugccuccaccucccaaagugcugggauuacaggcaugagccacugcucccggccuaauuguaagguucuuauuggacuccauaaggaauugggcuuuggagucugauggauuuuacccagccacuaacuagcugauuaugugauuuugaggaaguuucuuaagcucugagcuuaaaaggcuuauuuacuuaaaaaagagaacaauauacuuacuucuuaauuuuuuugugaugucucaguaaugacugguaaagauuccaaggaucccuauaugagucugcugccuuuauuagcguuaucuugccaaggguuauacauaaagaaaggcacauuguugggugggguuuggaguuuuggggcaugcaucaucauauuuuuuggcucucccuuuccaucaaaaauacuuggagacagaguuuaguuauuuauuccugcuggggccuuugcuuugguuaugcuaacccccaucccuuauccgacucuuccccagguggugccucggugcacaacgccaugcagcugaagccgggcaagcccaauggcuggaggauucccuucaacagccaugagggcggcuguggggcugccaugcgggccaugugcaucggucucagguucccacaccauagccaacuggacacacugauccaagugagcaucgagaguggucggaugacccaccaccacccaacaggcuaccugggggcccuugcgucugcucuuuuuacagccuaugcugugaauagcagaccacccuugcaguggggaaaaggacugauggagcugcuaccagaagcuaaaaaguacauuguccaaucaggcuacuuuguagaggaaaaucuucaacacuggugagucuguaagcgcacgcccugcucaaacacgguugaaucugugcguguacauccaccugcacauauaugucuuguauucagagaucacagcaacccucaugguuuucacccccagcccccuuucuacccaucugcuaaggauuucaaguucccuuccaguaaugauucuacaaaguagccaaguggauaccucaaugaauagggcagcugugguguuucccucuuacacggaauccugucauuuuuguggcuauccuauucugccaugaauuuucaugccuauuuccuacuuuccuggaauuugcuuuuucaguguugucuugguauacaaauaauauuuugaaauccuugguuaaaauuccagagauacguuuuuccacuagcuaacuaauaagugguaaggccacaucuuccccuucucgugaguucacuucacauugucuuucuuagaauaaaaagaggcuuucugcugaagucacccacaguugugaugucuugaaguuccccuuuaaaaggucauuacucucgacccucccagggaaaacaaaccuguauuucuuacccuuuaacuugauauguaucucuuuauuuagcaacaggaucaaugccuuauuuauguagauccuuaugaaaaauguauugaaugaaugguacuuauauagaaauaauuuugauguuuaaauaguuuaugauauuacugcaagaagccgaaguuauguuggauuuuucucuguucacacauccaucuggugcuuuuuguuaugacuuuucacuuuauuuuuuucaauugacucuagauuuuuuccuuucuacagguccuacuuccaaaccaaaugggaaaauuaccuaaaacuuagagggauuuuggauggagaaucagccccuaccuucccugagucuuucggugugaaggagagggaucaguucuacaccucccugagcuacucuggcugggguggcagcagugggcacgaugcccccaugauugccuacgaugcuguucuugcugcaggagacuccuggaaggagcuugcccaccgagccuuuuuccaugguggagacagugauucuacagcugccauugcuggcugcugguggggaguuauguaugguuuuaaaggagugagucccuccaacuaugagaaacuagaauacagaaaccggcuggaagagacagcuagggcuuuauauucucucgggucaaaagaagacacuguaauuucccuuuagggagacgugauguucacuucugauggauucuucuuuuguguauuuccuuuucugcuauuucuuuucaguuuuuccaaagucaagagucuuaaccuuguacucagggaauuuugagauaacaagucccuugggcaccuuaagcucaguuuuuucaggcucauccuguucuuccagaaucuaucccuuuucuuacacugaagaguccuuuagcucaauugauagggucagcgucucgcaagcaaaaaaucucaugaccucauauuugagucuucauuuucaucaucuacuuguucuaaaaguuuuuucuguuugucucaaguuggguucccacaaaguggacuuugagacaaagaucugaaugcaagcaguuuauaugggagaugauuccaggaaauaccgauaugagaauggggaaaugaaaccaggaagggaagagagcuaguaugggguauguuaaugagcagguuuccacugugggcgguuggcacucugccaucugaguccucugccuaaagcauuccucagaacugucccauuugaagggcaagcaaaccugggguauuuauccacugacuuccaucugacacugguugaggaccacugccagggaugcuaacucccugguaauucuuggcuuacccuuuguacaaaccaaaccuuagugucuucagguaaagacucagagauacuugcaggggcaagcuguaaagggcauggg

SEQ ID NO: 18116 - RNA, 6343 nt, Homo sapiens
aaaagauuguuaaguuguauugcuacaugcauguauguggauaugauugccauaggguugguucuugaggcucaaaugaauuaauuuauauaaaaugcugaauaaugcuuggcacaaggugagcacucaaaugcagacugcuauuaucauuaaauucugugcuuuaacauuuucuuguuaaaucuugucucuaggggaagccaguuuauuaggaaccauuugcagauggaugacaucaccuguuacugggagaaccucuugagugaauacucuaaauuccugucuuauaauguaacgagaaggaaagguuaugaucaaauuauucccaaaauguugaaaacugaacuauaguagucaucauaggaccauaguccucuuuguggcaacagaucucagauauccuacggugagaagcuuaccauaagcuuggcaccuauaccuugaauaucugcuaucaagccaaauaccugguuuuccuuaucaugcugcacccagagcaacucuugagaaagauuuaaaaugugucuaauacacugauaugaagcaguucaacuuuuuggaugaauaaggaccagaaaucgugagauguggauuuugaacccaacucuaccuuucauuuucuuaagaccaaucacagcuugugccucagaucauccaccugugugaguccaucacugugaaauugacuguguccaugugaugaugcccuuugucccauuauuuggagcagaaaauucgucauuuggaaguaguacaacucauugcuggaauugugaaauuauucaaggcgugaucucugucacuuuauuuuaauguaggaaacccuaugggguuuaugaaaaauacuuggggaucauucucugaauggucuaaggaagcgguagccaugccaugcaaugauguaggaguucucuuuuguaaaaccauaaacuguguuacucaggagguuucuauaaugccacauagaaagaggccaauugcaugaguaauuauugcaauuggauuucagguucccuuuuugugccuucaugcccuacuucuuaaugccucucuaaagccaaaaaaaaaaaaaaagacaaagccucuuaauaaauuuaauggaacuauacauagaacagcagcucuuccucacccuuugcauaccuuuaauauuuuuccuucuuaaauuggccacagcaggggucauucacacucucacugucuugcaggaaucacaagaagucuucauaugugaacgugccauucaguugguaguuaagagcauucaacuucaaauauauagaagauauuuguuuuagugcaaauccaugauggagugccucccuuuuccuuuuuucacuuuuugaaaaagauguuuuggguaguaguuuaauaucucagggugcucuuucuaacauaguaaaaaaugaagaaaaauguuuagauuaaaacucuguagucugaugacuuagaaccauccuugacccuuaggcccaaccuuuccacagagaaaucaccucucuuccuuugucuuuuaagaacuauuugguauuaacuaguuucagaauuaguaaaugugagauucagucacauaauuaucagacauuccauuugucagaaauguauuuggcuuuuuaaacuccuuuccacaaaaguuuaagucuaaugaccuucuuagagaaguugagcaugccuggcaagaucauuucauggaauaagcagauguuuaaaguuggauuuuuuuuuuuuuuuuuuuuugaguacuagcaaugcacagggaccguguucuuagguucuuagucugugaaucuagcaauaggcaguccagauuucugagucguacuaugguuuugccuugucacugugaggcccuacuagguguaagcauucucucugaauuuuaauuuccucucauuaaaauaggaacaaaauuugcuauccuuuagauuaggagcugaagauucauuucccugggaauguuucccauuuagcuucaaguuucagcucaaacaucaccuucuuucugacuccuuucauucauuccuccaggcaguaaggggcuaccauaguacuuuguuuaugccuguauuauaugacaucacuguaguugcuugacuguuucuccuacuguucuguaaacuuauuaaugggugagaaucuaauuuuacucaucuugauggcuucaugauccagcacagugccucacacaaagaacuauuggguggguggauggauggauggaggaauggagacaguuggcuuaaccagauccuauauacagauuauuacuggcuccaaaggaugaguagauaagaccauaagaauuggaucaauguaaauccucaccugcccuuugaagagccaauaagggcaucuuugucuuuaaauacagcaaauguuauucagauuuuguacuugucuaucuguuuaccucaguguagaugauaugaggaugguauaacuauguaaauuguuuuugaaaauaauuuguuuccccacaacuuuugaagguuuuauuuguuguuguuauuacuaguucagucccaaacuuacccuuuccuuuucagagagcuaauggccaugcuuuucuucaaggaaagaauaauuuauuugaaugaagugggauacuugcauaacacaaauaaugcuuugucuuuauuuauuucgggaguguuaucuaugugcugucagugacccaccuuauucuacuauaucaguucagauuuuccuaguggucaagaacagaaacugccucuagcuaguuuaagcaaaguaacuuacuagaaggacaugagggcaucucguggaaucuaaaaagguuucacagugguuagaaggauagaagcaagggcaccuccaggaaucucagcaagaauuuugacuguuuccagggugcuacuauaaugcaguuccauuaccuauugggcucugucucagcucaaaauucccaaggacaaaaacuuuaauggacucauuugggucaccuccaagaguucccuacacuuaaccccuagacugacuacaaacaagagcacaaacaggccagacacagugguucacaccuguaaucccagcucuuugggaggccaaggcagaagaaucacuugagcccaggaguucaagaccagccugggcaacauggugagaccucggcucuacaaaaaaaaaaaaaaaaaaaaaaaaaaaaaaaaaaaaagaggcaggaagauagcuugaguucgcaauguugaggcugcagugagccaugaucaugccacuguacuguacuuccaccugggcaaugggaauaagacccuguuucucaaaaaaaaaaaaaaaaaaagcacagauacacaaaagucuaucuuuacaugcaucuaaagaugcccucucuuaggauaaucuuacugcauccagagguaagguguuguggauggagcagagaguuauauuuacaagucacucauuuaauacuuaccagauacuucuuaagcaucuacuaugcacagagacaaggaaaguuuacaagaggcucccaaaccucaaggggcugugccguugagaugauaaacaauaugagaggcaucauacauacguggaaggugauuaaggcaacaggagugccaauuauucaugaagacaauguggaucuggaguuuagaggaagaauaaacuuccaacuggagcagaugggaaacuuuguggagguaaaaauuaauuuauaccaugaaggauaaguaaaugaaaugguucuuggaguucucaaaauucauucucucuccacauguugaaaaguuuuauaucauauauaauguaacaaaauguaaaauacguagcaagggcaguacuuggugaaccuggcagggaagggaaccugcugaccccugagaaaaaaauucacugugagggaagaaacuauuagguucuauaaacagaauucagcaacaagggcuguugguggaagaaugguguuccaggcaguauggugauugcacugaaaucuuucccugaugcaguuacucugcuggcaaacacauguccuggggacaagaaagccauaugugaaacagugguccaguaaaccccauaacaccuuuuggcuuagaccaagcuuguccaacccauggcucacgaacugcacgcggcccaggaaagcuuugaaugcgccccaacacaaauuuguaaacguucuuaaaacaugagauuuaugcauggacuuuuuucuuuuucuuuucuuuuuguuuuuuguuuuuagcucaucagcuacaguuaguguuaugugugggccaagacaauuauucuuccaauguggcccagggaagccaaaagauuggacaccucuggcuuagacuguauugaucggagaaccuucaaaaagagcagacuacagccuacagggcugggcuugguggcucacaccuguaaucccagcacuuugggaggcugaggcaggcagaucacuuggggccagaaguuugagaccauccuggccaacauggugaaacaccaucuuuacuaaaaauacaaaaauuagccaggcuuguggcacaugccuguaaucccagcuacucaggaggcugaggcacaagaaucacuugaacuuaggaggcagagguugcagugagccgaggucuugccacugcccuccagccugggugacgaagcuaagacuguaucaaaaauaaaauaaaauaagcagacuacagaggagggugagcauuucccuuguucuaaaagaagguaagccguaagggauuggggaaguaggaaaugugggagggcucagauggaagagcagcaacagugcgagcaguagccaaaggagaggggaguuuuuugaguuaucagguggcaaaaggaacauuacaaaugagucuuccguuacccaaaugagaaacaaguuauggaauuuaaaauuugccuguuaauauuaccucaucuacaggcuagugaauccuggggcauuugaguuguacauaagugauugugucaguaucuucccaacacccacccaaacccuccuacccauuucaaguccuccuucaccccagaauaauucuggggucaucuuaugcauuuagcuuuuucuacauauagguuagaaacagacuguacagccauuuucuugggcuuucaggccuugguaacuuaucuuggugcccacuucuaccuaacaugggauaagcaguaauccagagccagaagucaggagaucugaauuauucaacaaauauuuacugagcaccuacugcgguucuagguccuggagauacagagaugaauauauuuggucugugaucucaaggauaguuuauugagacagauuaauaggaaauuaugaugcaguguuguaagugcuacgaugagugcugaaucaaaucucauaucccagaguagucuucauggcgcugucacuaauugagcuggucacucuagucagucacuucucagggacuuauguguagcauuuccagcuaucaaauuccuaaguccacuuacuguauucuacuacaguguggcaguuuugauugacaacuagaaaggaaucaaggaggugaagggauuggcaaaaugaauaagggaguaugcuuguuaacaaggauugaaugaaauuacacgaauauugagaauauuuuaaaugcauucauuuuaaugaaaacuguacuucgaagcauauguuagcagagguuguagugacggcaaauuauacaaacacuugauagaaauuccagaaauucuccugccuuuugagaagcaguaggcauaugaacuaaagggagugaaauccaccuuaggaagaccugccaaaaagcugauucuucaaaaaaguguucucgaaaucuuaguguaacuggcaccaacacccauccccaaugccucguuuuuuuuccagcagaacugacaagguacaaacggaccccgcccagccuggaaggcuucucuaauguuggcagaguagguuggacuuguuuuugcacaaaucgccuuucccucuuucccuacuccacuugcacugaauauugcacuuucuuccuuacugaagcgggauuccugccuuuuuuuuuuuuuuuugagacagauuuucgcucuuguugcccaggcugcagugcaguggugugaucucggcucacugcaaccuccgccucccggguucaagcgauucuccuaccucagccucccgaguagcuaggauuacaggcgcccgccaccaugcccggcuaauuccuggcauuuuaaauacgauaaauuacuucaaccuaugaccaccucaagcugaauauaaguagccgcagacaccguuugcaugacccaggaaccacaaacacggagcgaaggccugccgggaccacgcugagcuucacuacuggcagccaacucacuuccg

SEQ ID NO: 18117 - RNA, 1087 nt, Homo sapiens
uugcauaacauucacucuuugugcuauaaaguuaugaagguuuugaaagagagugucuggcaucauacagaauaguuucacgcuguaaaaauccccucuccuuuaucuauucaguccuuuccuccuucccccaaacuccugaaaaccaauggucuuuuuaccaucucuacgguuuugccuuuuaaagaaugcuauaaaauuggaaucuuaaauauguaaccuuuucaaacuggcugucuucacuuagccauauauauuuaggguuuccccaugucuuuuuaugucuugauagcucacuccuuuuuauugcugaaucuauaauauucuguuguauagauacaccauaguuugcuuuugugucgauucaccaauugaaggacaucuuaguuaguaauggguucuuguacuuaugaauaaaguugccauaaauauuugcaggcagauuuuugugugaccacaaguuuucaaaucaguugaguaaauaucuaggaguggaauuguuggaucuuaugguaagauuagguuaaacuuuguaagaaacugccaaacugucuuuuaaaguggcugugucauuuugcauuuccaucagcaaugaauaaaaguuccuguagcugcacauccucacuagcauuugguguugucaguguuuuguuauuuuagccauucuaauaaguguguagcagugauucauuaauguuuuaauuugcaauucccucauauaugauguugaacaucuuucuacaugcuuauuugcugucuacaucuguucuuuuguaaagugucuguucagaucuuuugcccauuuuuaauuggguuguuuguuuuuuuauuguugaauuuuaguauuucuauuuuuauuuuggacauaagaccuuuaccagauauguguuuuaugaacauuuucuucuaguauguggcuugucuuuucauucuuuuaacaauaucuuucauggaguagaaauuuuugguuuuaaugaaguccaacuuauuauuuguuuuucuucaguggaucaugcuuuugauauugugucuaaaaauucaucaccaagcccagcguuaccuacauugucuauauguuucuucuaga

SEQ ID NO: 18118 - RNA, 15050 nt, Homo sapiens
ccgagccgggcgggcggaggggcgguugggacggcgcggggaggcgggcgcgccgcccgggccgcggcgggcuguggucacaggugggcggcugcggcgagggagcggccgagcggagcccgggucccggagacuccugccgucacgcccggggcuccgcguagcagagaucgggagacgcgucugugccuccggggaagccgacccaucuccccuccgccucuuuggcugcaguugcaccuccggccagagggcagguaacuucccuuccaaggucauucuccuggcgggguggugcgcgaggcccgcccacguccuccggauuggcgggggcgggagaggcgcacccugcaaggggcccgaccaguugggcuggaccgcgaccccugagcacugccagggagccuggugugucagccgcugcuagcgggcauaugcuucgccuuucccuauagccccgaggcugaguucccaccagcgcccaggcuuggagcggagaccgcucggcccucccagccugcacccgcaggugagcgcaaccgcccgcgccccggcugucccggacgcguggucggcugucgccauaggaacggcuggugcccagacggcgccugcccaggcugggaaggggcggugaaggcagcucagaccuccaagaacccuggagcccccuguguggccaggcggagccacagaagccugaugaaaacgggacccccucccccucucucuucucauuuuugauugcucaggcguuggagguuaagcagagagagagaggcguggaccuauuuacgagauguaaguuguguucuuuccaccuuuaccuucugagggcuucuuacgccucauggugacaggugcaaaucaugacacagaagggcaguaugaagccugugaagaaaaagaaaaccgaagaaccugaauuggagccccugugcugcugcgaguacauagaucggaauggggaaaagaaccacguggcuacuuguuugugugauugucaagaucuggaugaagggugugaucgguaagaacagagcauuucuugacgcuggccccaucacccuucugagaacugccauguguacuuucaaccuagccacccagaaugcuagaauuugcucuugauucuauuuccaagcaucuaaaaugagaguuggcuucugugucaagugugaggauuuuagaaagauggauuacgcaguagugcacagcugucugucugcucuguuuuauaggauauuauuuuucguuuaaagagagaugagggagagaacaggcaguuuaaagggauaguaggcaaguuaguauaaaauaaaaugcaagccagcagaaucuguaaguuuaaaaugaacacaauaguuccagaaaguuccugccuucucagaggucucagcauuuagagacugacuacuugggacuggguggcaccugaccacagagggccuuguggguugaaauuucauuuuccugcuguuaguacuggucuugccccuuguuucuggggaggaacuccagccagaaggcauguaucuccccuggauucacaguuuucagugcgaccagcaacacucuugauugaucauacuguauuuggcuuuuauuuuccaagugauggaaauuacuauccaaaaagagaauuuuuaacaucacugaaaaaauuuggugucggacagugaauaaucugguuuuaauccauuuucugaguaauuauauauuuaaaaaucacugucaauggaagucauaaugugggaaggauagggauguuggaaacuugcuuuucccauuaauaauuauuucugguuaaaaaagucauugcaacugccaauuuguugacuuagaacuugauacauuaauacagccaugaaaagcauucccuggggucugcagucuaguaccagccuugacuauuaaaaacccagugaacccuuugucguucuuacuugacaguguacuguguagucuuuuuuauggaugucuuugaauauagguucuuuagauuuagucugaaaucuauacugagaaaauagagcacuuugcacuaaugaauggagaaaugaugcuguuuccauaaccaccaucacucaagaccgcagcucuuccauuaaccuugcuaacucuuccucccuccuagcccuggagaccuuggcuguccccugaggcaucuccucugcucucucuguaccccucuccucuguguuuccaccgugccugcugcucuguaugauucccaauuaguuaucucuaaguucuagucuuaccuuuaaaaauugucuaaaaucaaaguuaccuuuccuuaaacucuaccuuuucuuacuagccugucuuaauuuguucaggcugcuaugauaaaauaaauaccugagacuggguaauuuguaaacaauauacaucuauugcucacaguucuagaggcucagaaauccaagaucaaggcacuggcagauucagugucuggugagggcccuuuuccucauagaugacaccuucuuggugugucaugacauggcagaaggggugaauaagcucauagggcucuauuauaagggcacaagucucauucaugagggcugugccuucaugaccuaaucaccuccuuaaggucucaccucugaauacuauugcauugggaaugagguuucaacauaaugaacuuuggagggacacagauacuuccuggcucccuaaaauuuauguccuucucacaugcaaaauacacugauuucauccuaauagccccaaaagucuuagcucaucccagugucaauucagaagucuaaguccagagucuggucugaauaucaucauccaaaucagauauggaugaguuucaagauacgauucauccugagacaaguucuccuccacaugugagccugugaaaucaaacaaguuaggugcuuccacaauacgaugguaggacaugcauagaauagacauucccauuccaaaagggaacaacaggaagaaaggaguguuacugacagguccuaacccaguggggcaaacaauguuaagccuuaauaaggcuugagaauaaucuuggacuugauguccugccuucuggacacacuggguuggcgguugggcccccaaggcucuggguguccccgccaccacagcuuuguugcgcacagcccacacugcagcucucauggguuggaguuccuacaggugccuccagcucucccaggcuggaguuguaugcuuguggcucuacggggcucuugggggugacccuguccccacagcuccaagcaggcauugccucaguggggucucucuguaguggccccaccacaaugacagcuccacugggcagugcccuagugggggcucucugugguggccccaccccuguggcaguccucugccucggucccgaggcucuccagggcauccuuugaagucuagguggaggcagccaggccucuacagcuccuacacucuggaugccugcagcauuggcacccuguggaugccaccaagauuuaccaccuaugcccuucagagggguggccucuauggcauaccuaggcccaguggagccacaccuggagcugccauggagggugcaccagaauguagggagcagagacuucagauggcacucagcaguacacccugaagccccaugggugcccugggcccucuuaugaaacugucugcccucaaagcccuggcacuucagguuuguggugggagcagcagccccaaggaucuccgaaugccuucaggguccuuccauugucuugaugacuggcacggggcuaauccauacugaucucaucuacauccuugcuguucucucccaaacaugcuuucucauuuguuacaauauagacaggcugagaauuuuccaaaucuuuguuuuacuccccuuuugauuaugaguuuugucuuuaaauuauuucucuuuggcugggcgcggugacucacaccuguaaucccagcacuuugggaagcccaggugggcagaucaccugaggucaggaguucaagaccagccugaacgacauggagaaaccccgucucuacuaaaaauacaaaauuagccaggcgugguggcgcaugccuguaaucccagcuacucaggaggcugaaguaggagaaucgcuugaacucaggagguggagguugcggugagcugagaucgcgccauugcacuccagccugggcaacaagagcaaaacucugucucaaaaaaaaaaaaauuucucuccugcauuuuacccuaagcauuuaugagaagccaugcagcacccugaacacuuugcuuagagauuucuacugccaaauauucaguuuaaucacucuugaguucuacuuucuaccaaacaguaggacacaaacacaauuccacugaguucuuuuuauaaguguccaggaucaccuuucuucuaauuuccaauaacauguuugucacuuccaucugagaucuuaugagaauggcuuuuacuguccauauuucugcgagccuucuguucauuaccucuuagggauucucgaagauugaggcuuucucugcagcucuccucuucugccagaaucacccuugacaguuuguucagauagucuaggauuuuucccagcaugcacuuccacacucuucuaaccucuacccguuacccgguuccacagcugcauccacauuuuuagauaucuguuguagcaacauccuacuucuuaguaccaauuucuguccuagucuguucaggcugcuguaacaaaauaacuuaggcuggguaauuuauaaacaacagauauuuauugcucacaguucuggaggcugugaaguccaagaucaaggcagcagcagauucagugucuggugaggucuccucagcuucauagacagcaccuucuugcuguguccucacaugguggaaggagcaaacaggcucccuuggaucucuuuuuuagaggcauuaauuccacucaucagggcucugcucucaugaccuaauacccuccuagaggccccgucucuuaauacucuugcauuggggauuggguuucagcauaugaauuuugggggcauaaacauuuagaacauagcauagccuaagugugcaaaacagucaaccaauaucauuccauucaccaaguucagugauuugacucauacuaguuugaucuccauucuucucuauguagcccugucccugugggacuagucuacucccugggcucaugccagguaugugcugcacacauuucuuuccacuggaaggccuuccuuacucccucucuauucauacacaugcuagcuggacaucaagguugagcacagaucccaccuuuuccacaaagaccccucugaagacuccacccagaaguauugaugcuagucugagcacuccuuauaauguuugaucacaagaguuuauugauuauugcugcuuugucacuuaccuaauaguucuuaaauucccauguuguccucauaacuagauugugauuuguuuugagauucuuaugaccguacaggucauaagauguaaacauuacuugcagcaugugucuguaccuauguauuuguuuaggggagaaauaaucuugacuuuaaguuuuuaaacaucuuguuccuauuuuaaaaaaugacaugugaaucugaaaagcuuaauuuaguaguaaggaaguaaaaugcuuggucuuugguagcuuuuaucguuuaucccacuguuuggcauucaguguucuguagcuuuuaauucaacaaacccacaugaagucccuccucuuugugcuuuuucugaauagauggauuacauguaaaucuuuacagccagagacuugugaaagaaucauggauacaauuucugaucgccuccgaauuccuuggcuuaggggagccaaaaaagugaacaucagcaucaucccuccgcuuguccugcugccugucuuccuucauguggcuuccuggcauuuccuccuggggguggugguuuugaccucccuuccugugcuggcacugugguacuacuaccucacucacagaaggaaagaacagacccuguuuuuccugagccuuggacuguucucucugggcuacauguacuauguguuccugcaggaagugguccccaaagggcgugugggucccguucagcuggcgguucuuaccugcggguuauuucugauacucuuagccuugcacagagccaagaagaauccaggcuaccucagcaauccagcaagcggugacagaucucuaagcagcagccagcuggagugccugagcagaaaagggcaggagaagaccaaaggguucccuggggcagacaugucgggcagucucaacaaucgcacaacaaaggaugaccccaagggcucuuccaagaugccagcuggaagccccaccaaagcgaaggaggacuggugugccaagugccagcuggugcgaccagcccgggcauggcacugccggauauguggcaucugugugaggagaauggaucaucauugugucugguauguuggaaacauuuggagacuuggaaaguguaaauucauguaaaacucuaguuacauuuuaucuucccuugugcuaucccaaaauuucucuccuucccagcuuuacaccuuguagauauuuguggguuguugugauguucccacuuagucaucaguuuuucgaguuucacaaauuuaguuccuucagucauuuccugaaggagaauaacagaaaacuugugggguuuuuuuuuucucaauuuucuuuugaaugacuccucauuuaucuuuuccuuucuaauagagaaauaucuacaguugaaugauuuuuuaaaaaaagaauugaucagaaacaguauaagcauauuucccugugcuauuccuuuuuaaacauaaagcucaagaaaguguaccccuauuuuuaggugacucuuuuguccccuugccauacauacuuaaucguuuuugaugcuaccgaugauuuccacuuaacauuauugaaucgaggucccaccagauaaacucucuauuugauuauuugcagagaaaugggcuuuuguaccugccaguuggccaguaacaaacgaagguacauaaggcuccguaaaauaugaagugcaauguuuaaagauaauguugcagcuucacuaaauacaucuaaacuaaagggacuauaauuaauucagauaugaaugcuguaaguagcauguuugcaguuuauugcucuucaggcagucgugaucaaugaauuaaugcuuuucgugucuaggauucugguccuguagcguaccuccuccucagaaggggaugcaggagagggugagggugcagaaaaggcugagaggcauuggcgugggccucaagugcauggcucaagugcagggcagcucuuuucuggguccuugucuuuagaaguaaacagguguuuucauuuuuagauguucuacuucugugucuucacuuauucgugugugugugugugugugugugugugugugugcguguguguuccauuuacaaaugcugguuugcagaaggcucaccuaacagcagauaugugcccacuggagcauccuggcaugcaguggguagaaggcacucccucuacauucugccccacaaauggccaugacacagaacuguuuuuaccugccaaagagccugcauguuaucaaguuguucuucccccuacgcuauguuucuaaccucuuuggaucuuuauauuacucuucauauauuuaacaugaauuuucccauacuauguaauacuucugauuuagcauuuuuaaguuuucauaauucuauuuaucucccuuuccuuaacauggugaggacaauguuagaucuccauagcuggguaauauugauauuuaggaagauuuguuagccagguucugcuuuuuauacuuagucuuguccuuaaacugacgauaugauuccacuuugcgaagaguagagaauauaagacugcauuccucagggugcaaguuuuuaauucccuaaaauugaaaaauaagagaacuucuuaauaacuggaauuuacauuuucccuauuuaaaaccuugucuuggcugggcgcaguggcucaugccuguaaucccaacacuuugggaggcugagguggguggaucaugaggucaggaguucaagaccagccuggccaacauggugaaaccccaucucuacucaaaauacacaaauuagcugggcaugguggcaugugccuguaaucccagcuacuugagaggcugaggcaggagaauugcuuaaccgggacccgggaggcagagguugcagugagccaagaucgcgccauugcacuuuagccugaacuacagagcaagacuccgucucaaaaaaaauaaagcuuucauguuuauuauguaaguuauaucaagaacucuuaaaaauguguuugcuuuuuuauuucucuaugcuguuuugaggauaaauagcugcguuggagaaucaaaucaucaagcauuuauacuugcccuuuugaucuucuugcucaccucgguguaugggaucacacugaccuuggacaccauuuguagagacagaagugucuucacagcucuuuucuauuguccuggaguuuaugcaaauuacaggugagcaguggguaccacaguauggaggcccccugggaaguaauggguguugccauugacagggacuauuacuacuugguuaggaguucucaaucaaaacauaggccaggcuauggaaaugcuggguaucccuggaauugccagcaaaauugugcauuggugauguguguuuuucaagggugcuguuaaaaggauuguugaccuuuaaaaagugaagaacuaguucucuacaaacaggaccaggccuaaucagggacuuccagagucaaaugaccacucauaggcucaaaagucgcaacagugaaacagaaacaauaaacaaaaacuagcagccccagggcacauaugugccuauuuugucauaacgaucagaaaccuucucacuuuacugcugcuuucugauguuuuuuaguccaaucuuaauuuacugcuuccgacccuuuugagaugugcucgacaucucuauaaccuugcuuuucuuucuaaccucucuugguuuuuccuguucuacuuucuuucuuuuuuuaaucaccacugaugauuacugugauauguaggucaaaauuuccuuaggccccuuuauagauugugaagauuuccaggccauggcaaaauuugggauucuuccgcuucggccucagcgcccccucccugaaugcuggggccccccucugcccaugcucuuuauucccuucccuucaucauccucucugacauaagugcucugggguaucugugguuuggcccuuuucuuuauucucacucuucauuuucagaacaauccuugcuuucuuuacaaaguaucccuuuguggcauuuguuuuuauuagccuguggacagaucuccccauugucauccuagaaccagacaccugugggcauuauuagaauagauuggucuuccucagauuaaguuuccuuccucacuguguggagaguaucuccagcaugugaaugaaauucucugcuaacgcugcaggugaggcccguccugaagcacagcaugucugugcacucucggugcggaggcgagggaaccgaggaauacaguccugccauugcuucucacccugcucugugcaggcgauucacagcaccucaucuuuuugguuagguccuuggauuuaauagucuuugaggucccuucagcuuuuacaaaugaagauucugaaugaacuuauuucuaacuaacucuuaauuugcgaauguuggaaaaucaucaaauggcagaggcuaacuggcagccugucucauuagugagccugagaggagcuucccuaccuugugugauuguguugggcuuuaggagggugaauuuggaaugucucgguguuccuacauccagguaagcacagggcugcugggguugggagucguccaucgucuuuucauuccucagcauuggacuggaaagaauggagauuaguaacuuuagcacuguuccucggcauccaccugcagcuuccuagaagacauuuauagcagucccuuggugccuuuguuuucucaugaguuagauguaauuuacgaauuacuuguuuauuuaacaaacagguguugaacgcuguuaugucaggcagcgugcuggguguguggaggguacaaaaugcaaaaaacagucccugcuauucuaguguaauauacuagaaaauaggcaccaguaauuauagaauaaacacacacauucuccuacuuaagcagguuauuggcauucugaguaucuuccaguucggaggguuggggaagaugccaaagucuuuaguaauaaguaaaaaaauguguaaaacgugagaaugaugacaguuuucugaauuugacaaaaacggcagcccugacagccuuuuucccucuccuagcucggcucuguccuucaccugcgugugguacucugugaucaucacagcaggcauggccuacaucuuccugauccagcugaucaacaucagcuacaaugugacugagcgggaaguccagcaggcccuccgacagaagacugggcgccggcuccucugcgggcucaucguggacacaggccaguacaauaggggcuuccugcggaacuggcaccaguucuccacccugggcacacgugcauuccaccacccugccgaggacauugucugaagugccuucuauguggcucucugagggaugauggcuccuccuuccgucucccuuccauuuuacacuucaguguccauuucuauccccaguuucuuaaaggcauuauagggccaugcucagguuuagagacuggagugggaagaaguuaauuuuucugacgccacaacuuaagagacuuuuauacugaggcaguaaaaguagagccauuccuuuccagucaccuuuuuaauugacucaguugccugaacuugagaaggauguggauugcuaaugcacaaauugauagaagcaauucccauccauuaguauggaggaaagaguguuggauuaggauaguuucuagucccucuuucgauucuuaauagccaugugaccccuagcugagucacuuucccaagucucagggucaucugcaaagugggguacugaugccugcccuggcuaccucacagagccgucaugagggucacgugagggaagauggauguggaaagcacuaaaaaacaacucaagagccauggaaauacaaaguauuaggaaaauauuaugauggaagaaaaacguuuauagucuagaauauugaagccaauauuauuaggguaaucaguuuucagcauauaccuuguuguacaguuaugagaauuucuccuucuuauuagacaugaacuacucaaacagagaagaugaccagauggauugaugcuaaguugucucaucuugaaaagacaguugacaacaguuauaaagauaauuauugcuaguguaauguaguguggccaugaguuuaggugaugaguucuucuauuuauauuuuauaaauucugcuuggguuucuuauaaauaacuccaacaggcauucauguguuuuuccucuucccauguuucaccagguaaggugcuagcacacuugugacuguggcuggaagaggagaacagacacuccuguggggaugcuuuacucucuuuucugguaggaaggcugaguaacaucacgggcucgauuauuuucuucauguauuucaaaugcugucaguuauagcacuaaauugugaaaaucagccuucuggcauucacauuauucugguaugaacuuugaggaguugagugacaucuucccacuuaacuugcacauuaauucucaauuaccccucccuaaauaacaguaucucacuaagagagaagaaacaggguauaugugguuuccacuauuaauggauuacuguucuucccuggcucuuccgacaauaacaaguuguuucuuuaaucauaucuuaaaaccgaaaauguauaaaagauuaaauauuuauguacaauggguuguucuacuauagaauuaagaugagggaauuucagaugaggaaaauacccuuuugaaauguuaguuuugaacauguacuguugugcaaucccaaagauaauucaugacuccuuaaauuugccuuggcuuauagcuuaauauagggaaaauauugccagcguuuucagucauucugugcaugcugcuuuaagcaagagauuuauauuuguugagaggaaauauugcuacuuccugcacuuccacccucugcagccagcaccgucccuacuguugccauuaauuggagcuguccuuaagauggucaccauauucuuauucaggcuguugucauuuuccccagagaugguuuguuuaacgaaugauaggcucugugccuggggauguuagcagacucugggguuuguacagugaugccuucucccuggcccagagcugaauauucaucuagaauuaaaguuggauuugauauaacaaauuucuuucuauacagguuuuacauaagagagacaguaauaaugucaaggauagccugugugggcagaaauugguagucgugcuuuugaaugucagcuguagagccaacucugauuaucuagccauugaucauacaaauugauagaaacauuagucaguaauuuuagcuucuugccaaauuguucacaacaucuaaauguaaugugaugugaugaagauaaguaguacaaagagaccaaaauaauuugggagaauuaggaaugaugacaauuuuuuuuaacaacuuaccucuaauaggguuacuuggaugagccaacuccgcuuccuucccauggauaggaagggacucuguguauuauucagguuuauuggcacgaagauacuuguuuuaaguuccuugagaacccaugauggacaguugacagaaugcuuaaaccugucaaaagaugagugaucuugugugggaaaagccuucccaggcgucuguaccgaaaggagcagcaaacaaggggcuaauccaugagcaguguucuguaggcucugugacaucuuugguuuauaggauuuuggagccuuuuaugaucuggaacuauuugagggguuucauuauaggccuugguucucuccaggggccagaugaguuuauuguggaaucuuugaaaggacaaggccucugugaaugaaucagucccagggaagcauuuggugguggcggcaguggaggauugcccggugaaccuauaaaucagcagucucuugggcagaggagcaagccccucgaacaugauuucaaacaagcagguccucuucucucaucucacguccuuagucucuguuaaugaacauacuggauguggaguuuaauaaauuaccuacuaucaucuggccacuuagauuauuaucacaccacuguggacuguuccuggggggagaagaacagaccgauuugaaagauucaagggagaaagauuaaggaucaggauugcaugaaagaagaaaauccuucaauauuuaaaauguuucuuacaauacccacggagcacuuuuaugguuccagccgagcguuccugaaaugaacugaccauuaacagcgccucuuugauagguuacccugaugcugcuaaaguaaagccuuaaguguguuuuugggacaacgugcugcuuauuccaccucagccacauauguguuuguguuuaggauauuguaaaucuuugcuaaguaguguuuuccuuggugaaugaagucauuguugucuucaaguguaccaucugccuagcaaaaaauugcuacaaacuuucucuuaugcaauaguccuugguacuucuaauauuuuuagcaagagacaauuuucuguacuagaaucuuccacugccagaaaacacagugccaguaagguucuacauaccacugaccaucugcuuaauagacauguauuuccuuugaguaggacauuagcuuuugauuauaaagcucaacuaguauaagcaaaaauauaacaucuagaagcacaguuuuagccaggauguuuaaaaauuacaguuuugugagacuuaagggucuuuuuaaccuagguaaguuuauaugaccuaacuuaauuguagccauauucugguaccuuccauuuugaaaaguagagguugcuuaagcaagcaauggauaauaagagacuuuuccugaggcaccuguuuggaaucugguuuucucagcggcagcuugacaugugcacccuuuuguauuaaacacugcaagggugaugcaggggagcaggaaagccauccuaaacucacuacugaguacgauucaguauguuccuguggaugucugcugugacuaauauaaauuucuugcagaaucagcuacacuuaauuauguugcugauagacaagcauccacgcuucagcuggcacuaaguguuuucauuguaggaucagcagcagguuaaagacugaacgguuagugaagacaaaugucuuaagaggcugcgaugucuagguugggcuugugacuucuuaguggccuagccuucuugauggcaccuugaaagugaacuucuagaaaucuacauuuaaaaggcaaagcuuuaaaagcagagcuagucuauucuaguuacugaugcaacuaaaauucuguauuucuuaagauggagccacugacgagaugucacaguauagagccugcagucucaacucauugugauccuaauggucugggugauuggaugguuugaguuguuagggauuuugaguuuuucauuuuauugcauaucuggguuggauguuagacuaaaggaaacccaggaauauuuaccugguguuacauuuaauauuuaauguaacuggucuagcaacauuaagggggauuucugaagccaacuccggaggcugugggcugcacauuuugcacuguuuuuauauacuuguauucauauccucuuaucaccucagacucagacacaaggccuuuuacauggaaauuuuacaaauuacuuccauuuauguaaaauaacguccugugaccaaguuguuuaaauggaaaauaaagugcuuucuuuaaggaaaau

SEQ ID NO: 18119 - RNA, 72008 nt, Homo sapiens
ccuugccuguuuuuagccccauagaaccuagcucucccgcacauuuguagguuguaauaaacaacuuuuuuuuuuuuuuuugagacaaggucuugcuuugucguccaggcuggagugaagugguaugacuguggcucacuacagcuuugcccuccuuggcucaagcgauccucgcaccucagcuuccugaguagcuggaacuacaggcguguucccacgcccagcuaauuuuuuaauuuuucguagagacgggguuucgccaucuugcccaugcuugucucaaacuccugagcuuaagcaauccuucugcuucugucuccaaaagugcugggauuccacuacuaaagauuuguaaacaaaugaauagagaugaaagcaaauuaagugauaugugaagucuggugaggagagcaacaucuuucuuuuggagaauucucgaggcaccggcuaaugcuauaugccuauucuuuuuuuuuuuuuuuuuuuuuugagacggagucucgcucuuucgcccaggccggacugcaguggcgccaugucggcucacugcaaccuccaccucccagguucacgccauucuccugccucagccucccgaguagcugggacuacaggcgcccgccaccuggcccggguaauuuuuuguauuuuuaguagagacgggguuucaccguguuagccaggauggucucgaucuccugaccucgugauccgccugccucggccucccaaagugcugggauuacaggcgucagccaccgcgcccggccugcuauauaccuauucuuuaauaauuugcccugaaccuugcagaggaaccucucucccuuagacucaggacccgagauaggcuuugggaggcgccugcgcacugggcucgccggauauacgcaagggcguggggcggagcucugguaacccaggcaacagcccggaagccgcuggcuggguuaaccuguggcgcgcuccgcgguuccggcgccugaaguuuuagcugcgguggcggcggcagucgggaccgacugcaaggcagguugagaugauggaucugaggcuugcagcucgcagucccaacgagccuuagggaccagggcuaccaaaaggguggggagaacggugguggcaucugucuguugccugggauccaggcgcccgguuggggaauccuuacuucaggaagcgcagccgcggcucuguguuuugagagugcaaguacgugucagggugcgugucuggguauguuugugcguggcgccagagcaccucgaguaugcgcgugcgcaccgcuuucgggagcuuuugcacagagcugguaauugggggugcucgauuguagcguugggggaguucaccguguagcaggagagaggcaaacuauccagggugcuuugggaccgggagcgucauuuaaaucgauggaugucagaggggcuucucagaaggcuccuccugugaguuuugaggaguccguggaaguuaacccaguagagaagagagugagccuaaugaguguuccaagcagagggaaaagaaugguugcaacugugugugaggcgagagcuugguuuuaggauuugcgggagaugugagagaacacuggaaagaaaagucagccgggccauaugggggagagggucugaaugccaagcugaguuggauugcuuuugacaguggggagccauccgaaucuagaggaaguagguaaaggguucagaucuauucucuauccauguauuuagguaggauugauucaacaguguuuggaaagaguucuuguuucucuuugaucaguuuuccacaccagucagaguggauuuacuaaguccagucauaacuaucccuuuuaaaauucuucagugguuuccuauggucuuagguguucagauugcuguggcucacaagacuacaaucugcugucugccuuucuuccuuuaaccucucacccucucagaucuuuguuaauugaacugaacuucucaaacucuucguaaaugcauuuucccuugccuggaauauucuuuccccugcuucuaacuuuuauucguauuuuagcucucagugcaaacauuuuuggggguauuacagagaggagaagcuuuuacuuacugcauagaguuaguuagguacuuucauggcacacagaauuuacuucccaugcugcccuuuuguuguaaauacuuguuuaauugcgguccucuuagaaacucuuaacucugcaagggcauagacuauucuacuuucuuguuauaucuggugccucgcuuuuagauggugcuucaaaauauuaguuacauuaauagauggaugaugaagucagugagugaagagugaaagggagacuaauuagaauaaugagagccugaacaaaaauauuuuuaguagagauggagaagagcgggcaagagagauuuuuagggaaaaaguuaauagauucuguuaucugauucacuaagagauaaggaacagaggugaugcugagguuuuaaauuggagcaacuaggauuguaauucuguaaauucagcuuaauugaacauauuuaucgagucaaccaguuauauaucagcaaguagagauuugggguaugaugaugagcuguauuuugauauacuguauuugugauauuugggagauguauauaguagguaguuagaaaugagcauuugguguuuuuguuuuguuuuuguuuguuuauuuuaagagacagagccucacuuugucaccuaggcuggagugcaggggcgccaucguagcucacugcagccuccaauuccugggcucaagcaguccucccaccucagccuccugaguagcugaaacuauaggcacucacugccacuccuggcuaauuaaaaaaaauuuuuuuuuuagagacagggucuugcuauguugcacaggcuggucuugagcuuccugccucaagcgauccuccagccucagccucccgaguugcugggauuacagaugcgagccacuguguuugaaguuuugaggaaaggugugaaucauugauuugggacucauuuucacaguguguuuguuuguccauacauucauagcuuugcucaagggaguuggugaggucacugagggaggaugugaacugccccuuugugaucaagaaagcagcuccaugagagcuggcaccauauuagacuuguuuacuaauaucuuaguuuauuuaguuuacuuaguuuacuuguuuacuuguaucucuaaugccuagccagugccuggugugugcugcacucccccaaauaauuauugaaugaaaggagaggguaucuaauggaaagacaagaagaaugagaacugagauagaacuggguggaaauccuugauuaaauuguuuguguggaggaggacaauagagccugugaagaaaaggagaaaagaauagaagaggccaggugugguggcucacgccuguaaucccagcacuuugggaggccaaggcagguagaucacgagaucaggaguucgagaccagccugaccaacauggugaaaccccguuucuacuaaaaauacaaaaguuagccgggcaugguggcaagcgccuguaaucccagcuauucaggaggcugagggaggagaaucgcuugaacccgggagguggagguugcagugagcugaggucgugccacugcacuccagccugguaacagagcaagacuccgucucaaaaaaaaaaaaaaaaaaaaaagaaagcuuuucagugcaaagguggggucagaguuuuuguaauuaauaaaacuuggagguagaacuaaggauuaguaaauacaggugcuaaaguguaccuuuucaugaagcuggauggcaagagaagggcaaagaugggauagcagcuuaacuauaccuguguuauccuacuguacacagguaguaaauuaccacagauuuaguggccuaaaacaauuacuauuuaucauuucacaauuucuguggguugugaguuuggacauggcuuaguuagauucuuugcuuagggucuuccaaagcuguaaucaagucguuggccaguaugcauucucaucuggaguuuuagcuucugaauaaguaaaauauucuaaauguaacuugaaauacuuuuccccccauuuuuaagaguaacauagguccauuauagaaaauuugggaaauauaaaagcaaacagagguaacccaauucuggcaaaguuuuccagcaugugcuuuacagucagucagaccuggucuugagugucagcucuuggcucugccuguuauuauuuguauaacuuugagcuauauacuuucucuaagccucauuuuucauuuuuuuugaauuuuaauauucuuaauauuuuuaaauuuuguuucaaguucuaggguacacgugcgguaugugcagguuuguuucauagguaaacgugugccauagugguuugcugcaucuaucaacccaucaccuagguauuaaaucuagcgugcauuagcuauuuuuccugaugcucugucucccugcaucccccugccaucugacaggccccaguguguguugcuccccucccuguguccauguguucucauuguucagcacccacuuauaagugaguacaugugguguuugauuuucuguuccugcauucguuugccaaguguaauggcuuccaguuccauccaugccccugcaaaggacaugaucucauuccuuuuuauggcuuuauaguauuccaugguuuauauguaccacauuucuuuauucagucuaucaaugaugggcauuuggguugauuccaucucuuugcuauugugaauagugcugcagugaacauauauguguguguaucuuuauaauugaaugauuuauuuuccuuuggguauauaugcagaaaugugauugcugggucaaaugguauuucugguucuaggucuuugaggaaucgccacacugucuuccacaaugguugaacuaauuugcauuuccaccaacaguguaaaauuguuccuauuucuccacagucuugccagcauguguuguuucuugacuuuuuaauaaucgccauucugacuggcaugagaugguaucucacuguaguuuugauuugcauuucucuaacgaucagugauguugacuuuuuuucauacguuuguuggcugcauaaaugucuucuuuugagaaguuuguguucauguccuuugcccacuuauuaaugggguuguuuguuuuuuugucaauuuaaguuccuuguagacucuggauauuagcccuuugucagauggagagauugcaaaauuuuucucucauuuuguagguugucuguuugcucugaugauaauuucuuuugcugugcagaagcucuuuaguuuaauuggauuccauuuguuaaguuuugcuuucguuacaauugcuuuugacauuuucaucaugaaaucuuugccuguguguaugugcugaaugguauugcuuagauuuucuucuaggguuuuuauaguuuuggguuuuacauuuaagccuuuaauuauccugaguugauuuuugucuaugguguaaggaaggggucccguuucaauuuucugcauauggcucaccaguucucccaacacuauuaaguagggaauccuuuccccauugcuuguuuuugucagguuuguugaugaucagaugguuguagaugugcagucuuauuuuugaguucuccauucuguuccguuggucuauaugucugcuuuuguagcaguaccaugcuguuuugguuacuguagccuuguaguauaguuugaaguaggguagcaugaugccuccaacuuuguucuuuuuguuuaggauugucuuggccauaugggcucuuuuuugguuccauaugaauuuuaaaauaguuuuuucuaauucugugaagauguuaaugguaguuuaauaggcauaguauugaaucuauaaauuacuuaaaaaugccaguauggcuauuuucacuguauugauucuuccagucucauuuuucuuauuugggaaaaggguuaauuguugucacugacaucauuauccucaacauuuaaauacaauuuuguaugcuaggcagguguauuaguucauucucaugcugcuauaaagaaauacucgagacuggguaauuuauaaagaaaagagguuuaauugacucacaguuuugcaggccucaggaaacuuacaauuauggcagaaggccaaacagaagcagguaccuuuuucacaagguggcaggagagaaagugagugcaaacaggggaaaugccagacacuuauaaacccaucagaucucaugagaauucacuaucaugaaaacagcaagagggaaacugcuccccaugauccaaucacuucccacugggucccucucaugacacauggggauuauagggauuacaauucgagaugagauuuggguggggacucagccaaaccauaucagcagggguucuaagcacuuauauauuuaauuaguucuguuuuauaguuagugaaaaagcugggaugugaacccagacagugauuccagacuguauucuuagccuuuauacuauauugucucucaagacagaacaggcuucacaggguugugggaucaaaugugaagcucuuagcagagauaagugcuuuauuaauaaugccuauauucuaacaucauugagaauauacuauacauacaguucuguauucuacuuuuuauacuucuuauguauuuuccugucauuaaacauuuuuaauuuuaauggauacauaauucaucauauagguauacugacauuuuaugacucuuguuuuugcagaguaaauuggagauauaagugguuaaagaucuaagugguuaaaauacauuagauucaugucuuugaauaacuauuguuuuccuaucuuuuaaaauaacagcuuuauugagcuauaauucacccuuuaaaguauacaguucagagguuuuuagucaauucacauaauugcgcaacuaacauuacuaucuaauuucagaacauuuucuucacuccccaaagaaacacuauacccauuagcagucacucuccauuauaugcucccucuagaugcuggcaaucacuaaucuaugucucuguggauuuacuuauucuggacacaucauaucaaugauaccaaacaauagggggccuucuguguuuagaacccuuucaagauucauucauguuguagcauguaucaguacaccauugcuuauuauugccaaguaauaguccauuguguagauauaccacauuuuauuaauacauucaucaguugguggacauuugggaugucucuacuuuuugucuguucaaaaugcugcugugaccuuuuauguacaaguuuuuacguggacguauguuuuuaguucucuuggauguaaauaugugaguugaauugcugggucauguuguuacucuguguuuagcuucuugaggaauugccagcuguuuccaaagugcccacacuauuuuacauuccaugagcaauaugugaggauucuaguuuuuccauauuuuugucagugcuuguuguuguccgucuuuuugauuauagccauccuagucggugugaggugguaucuugauuggcauuucccuaaugacuaauuauguugaacaucuuuucauguguuuauuagcugucuauaguaucuuccuuggaggaaugucuauucaaguccuaugcccauuuuuaaaucggauuuuuuaaauugucgaguuguaaaauuucuuuauauagucuggauucaaguccuuuaucagauagaggauuugcagauacuuucucccauucuauugguugucuucauuuucuugauugugccuucgaagcacaaaaauucuuaauuuugauuacguccaauuuauuuuuuucuuugguugcuugugcuuuuugugucauuucuaagaaaccauugcuuaacccacggcucacgaagauuuacucuuauguuuucuucuaagaauuuuguaguuuuagcucuuauauuuaaauccaugaaucaauuuaauuuuugaauauggugugagguaggaguccaacuucauucuuuuucauaugcguauccaguugucccagcaccaucuguugaaaagacuauucuuuccccguugaauugucuuggcacccauguugaaaaacugaccauaaauguaaggguuuguuuuagacucuuuguucuauuauauucuguaucuuuuuaaaugguacuuauggcucugcuacuuacuaauugugugaccuucaugguugguuaacuuuugucucucaguuuucucguuuguaaaaugaggaauaaauaguaaguaccucaugggguuauugugaggauucaagaaaauaauguuuaaagagcuuagaauagcaucuggcuuauaguaagcacacgguaucuguuagcugaugccaucauuaccaccguggcuaucaucaucauuaccaucauaaaacuuaaauguuauuuucuaacuuguaugugacuuguuuucuuuggcugaaauuguaaaugcugaaauuagauaccauguuuaaggagugaauguucuuguuaagagagaguacagagugcaaggaagauugagggcaaacucuuaagaaauacuuguauuuagacauuuuuauuauaguagacaaugauuuuuuuuuaaaaaaaaguacuuaaggaaaauacuagaguccuuguuuuagacuaauugggaguaagggggucagcuggaaaguccuguaauuauuuagguagguuaaaagugucugcaauaguagucauguauauguauugcuuuuuaaaagucauauauauguauuguaaaauccugguguucggggacuaugggucuuuuucuaauuugguguaauguguagucuagugugcuuagcauugcuguuuaaacaguggcaaacuaauguuggcaauuuaaaaauucuaguuuaaaaucaauaauuauuaauuuguuuaucagcaauagaaaaaaaucaauaauuagcaccauuuagcauuaugugacagauauauuagaagugauaucauaccucauuuguucucuaaaguuuagcuacuuuuauuuucaaguaagcccauauguaccugguagugauuuugaguguuagagugcuuaaaaaagaacuccaacucucuuuugcccuuucuucccuucaccuuacauucauauuguuagcuugugacugggcuauuuucuacuaauuguaaauuuguguaacugaugacaaagcuuaugacgaaugucuuaguucucggcuuuaggccauaauuucugcauuccuagaguucuuuuuuaaucaaauauauaaguuauugacuugagaccucuuuuauuauaauuaucaguaccaacauuuauuaguuguaaaauaaaagaacuaaguauuuugauaggcuguuccuuucaucaugcuuaaauuuuucuucuggcauuuuaaaauuuguuuuuuuuuucaggugucuucccccacucuggugaugcuuauuguuuuuucuuguauuuuaaaaauuugaugugauuauuauuccuagaugucauuugucagagugaaccgcugugguccccgaguugguguaagaaagacaccgaaaguaaagaagaagaaaacuucagugaaacaagaaugggaugugaguauaggugggauaguaaauaauguaacauuacucuggagaaauggacacagugauauggcccuagucaugcaagaugguguucugaauggggcucaucacguaauaggguggaauagguuucugggcaugugauauucuaggucuuggagggaaaagcagaauccuuugggggagguuuuuagaauacacacauccaggcuguaaccucuauauccucugaagaauuggaauccuaaggggauggggagcauauuuuaaaaaacgucuuuucacuuugacucugagaacucacugcauaaaggcaacucuagcucacuggugucaaugaagucugugaauuuuucgguaccuuuuuuagguuugcucagagcaaccagugauaucauaaccaugugagugccaguuuuggcugaaaaaaauaggugaccuuugcucucuuaucccaugaauugcucaauuccagagguugaucgguuucagaacaaauguucucuugugguauaagacaaggcugaaguaccuguaacaugugauguauggcuccuaaccugaauauugccugguguuaccaaggggauuuauaucuuuuuuuuaagagacagggucauguccugucacccaggcuggagugaugugaugccaucauagcucacugcagccuuaaacuccuggacuccagcaauccuccugccuuagccuccugaguagcuaggaccagaggcaugcaccaccaccccuggcuaacuuaaaaaaaauauuuuuuguagagacagguccuugcuguguugcccagguuggucuuaaacuccuagccucaagcgauccucgugccuucgcuucccaaagugcugggauuauaggcgagccauugcacccagcuagauuucucuuuugugaccugauacuuugguuuggaccaugagacuuuaggugucuuuacuuuccauugugaagaguaacuaguuagggauuaguuuggaucucagggauucuuuuggacuuggaaucuucuuguuugcaaccuaccauguuagccagauauccugggcaaacugacagccuuugaaguggggcagcgggacuucucuguguuuagauuguuuuguugcugucugauuggcuauaaaauuuuaauaacaaggaugugacucuaagguaaggaaacugauaaaucggaaaaaaaaaauaugugauaacauauuuuccccuucagagugguuacuuugagaaguuuaguacaguugaccuuugaacaacaugaguuugagcugcacggguucauuuacgcaugaauuuuuuuucaauaaauacaguuggcuguauccugggguuccaccucuacaacgaaagguggauugaaaauacaguguuuucaggauguaaaacccagauauggagagccaauuaggugggauuugaguauguguggauuuugguauauguggguguccuggauacugugggaugacugcauuuauuccaauaugccacuauugcuuaaaacuuaauugaaaucuaucauuugaaauugcauuaagaaccuuccucauuuuaucugcagugcuggaaaaaucuuuuguuuuuugaagguagacugaacuuggaaaauagucauaagucauuuggaguaaaugguaaaugauggagaagagaucaaacugauuauuacugucuugauaaaaauagugaaacauuuucugaaauggcuuguagauuagauuuaaauggaaugucaaaagaaaaugguuuuaagcaaugguuuuaguauugauggaauuauuauuuucuuccaugagaacaaauuucaagccuaucacuuacuuguaugccugaguuuuuaaaugccuauuaaaaacaauucucaugauccuguaguuguaccuuguaccuuucuuuuccuuuucccuuuuuuuuuuuuuuuuuuuuuuugagacaaggucuugcuauguugcccaggcuggccucagacuccugggcucaugaugagaucuuccugccucggccuccugaaccuccuggguagcugagacuacaagcgcacaccaccaugccuggcucuuguaccuuucuaaaucauuguaaaaguaauaacaguuuucauacagaaaagccuugagccaaauauaaaucauggccaaaaaguuuagucuuugaucagaagccauuuuugacuguucguauuccucgucacuuagaaguaaaacuaacuuguuuuauuuccugccuuaccaaaucuguguagcaaaauggcugaaguugcuuuggaaagggccaaguuacaggguugcuacuuagagcugugcagccuguguaccacacaauuucaaggggugcuauuuacacggacucugauauuaaugguaacuuauggaguugugcagggugguagcccugccaugauaguuuagugccuuuuaauuuaacugacuguuuuuacauuuuaugaaauuaugcauugcccucaaauuucaucuuccauuguaguagcaucuaugcuuaagauguuugcagacacaaauugaaccucucuauagugaucacacuuucuuuuuuuuuuuuuuuuuuuuuuagauagaaacucgcuuuguugcugaggcuggagugcaguggcacaaucuuggcucacugcagacuccaccuccuagguucaagugauucuccugccucagccuccugaguagcuggaauuacaggugcccgccaccaggucuggcuaauuuuuguauuuuuaguagagauggaguuuugccauguuggccuggcuguucucgaacuccugagcucaggugguccacccaccucagccucccaaagugcugggauuacaggcaugagccacuguacccagccagugaucucacuuucuuuuaggaaccuuuagcguuacguuguggaauccugggauuccauagacuacagugugaaaacuaaaacuuuaguuaaacuuacucauuuugaauauauacuaccauuuauucauauaucauauauucauuuugaguauuuucauuguuuuacuauaguguaugacugcuuggugaauacaguacuuauuuucuguaagacaucuaaaauuagucuguuauuuucuauaaauaggacaccuaaaacuaauauguguucauaucuaaauugagaauacugguuccuagaaagaaagaauuuuugguccuaggauuuugaaaccauuuuagccauuaaaauccaauaaauguguauauuuuauaagaaaacuuuuuuuuuuuuuuaaagaaaggccaccuuuuuuuacagaauaccgugacugaucuaaccguucaucgggcaacucccgaagaucuggugaguuuaauaucaaaacuuaagucauuuauucaguguuuuauuugguauuugacuuguaaccuuuagaauagaaacuauaggcacuuccuggaaguuguucaguuauguuuaaucuuguuuaugucuauauaaaaucaaaacgccuaucuucuggacuuccugauuugagcuaggaauaucaauuaguauguauuagaguuucauuaaauauguuggguuuauaguugaaaucucuucagucuaguacugccugauauauaucuaucuaucugccuuuuuaaaaaaucuauagauaucuucagcauuauuuauuacuucccuauacaaacauauuguucuagucaguguaauaauuucuguguauuuccaugucugagcccccauuccuuacuuggaacaguuucuguaccuucuucucuacccguucaaaucuuaccuuacuuccuuauccuaguucaaauccuacuuuuuuuuuuuauguuuccacuuagguuuuuuuuuuuuuuuuuuuuuuaagauuuauugagauauaguucacauaccaugaaauuuaccuguuuaaagugugcaguuuggugauuuuugguauauucagaguugugcaaccauugucacuaucuaauuuuggaauguuuucauuaccccaaaaugaaacccucuacccauuaacagucacuccuugugcccaguucuucccaguuuguggcaaugaccaauguacuuugugcuuuuauguauuugccuauucuggucguuugauauaugcggaauacaacacguggccuuuugugucuagcuucuuugucuuagcauaauauuuucaagguucaucccuguuguagcauguaugucucugcccacugcagccuccaccuccugugaucaagccaucuccaccucagcaucuugaguacuugggacuacaggugcaugccaccacgccuggcuaaguuuuguauuuuuuguagacacaggguuuugccgucuugcccaggcuggucucgaacuccugggcucaaggaaucugcccaccucagccucccaaagugcugguauuauaggcaugagccaccacgcccagcucauaguaguucuuuauuccuuauaauugccaaauaauauuccauuguauggaucuaccauuuuauuuaucuguuguucaguugguggacauugcauuguuucugcuuuugcauuguuagguauaaugcugcugugaacauucauguacaaguuuuugugugaacauguauuaucaguucuuuuauauguauacaucuaggaguaaaauugcugagucauauaauuucuccauauuuaacuuucuaaauaauugucaaacuguucuaugaaguggcugcaccauuuacauccccgccagcauguaugaggcuuccaguuuccucacauuguuacugucaccuuuuucauuuuaguucucuuaguagguguaaagugcugucucauugugguuucaauuugcauuucccuaauugauaaaggauguuaagcauccuuuuguguacuuuucggccauuucuacuauauucuuuggagaaaugucuauucaaauaccuuagucauuuaaaaauuggauuauuugugcuuuuauuguugaguuauaaaaauuauguauguauucuggauuugaguuccuaaucagauauaauuugcaaguauuuucucccauuuucuuaguuguuuuuucaguuucuugaugguguccuuuaagcagggaaguuuuuaauuuugaugaagucaaauuuaccuguuuuuuauuuugucacuugaguuuuuaguaucauaccuaagaaacuguuaccuaacccaagguucacaaagacauacuccuauguuuucuucuaagaguuuuauaguuguaguucuuauauguagaacuaugauucauuuuaaguuaauuuuucuguaugguguguggugggaggggggcccaacuuuauuuuuugcuaaaggauaaucauuguccaaacagcauuuauuggaaagacuauucuuuccccauugaaugaucuuggaacucuuguugaaaaaucacuuguccauaaauauaaauguuuauucagcacucucaauucuauuucacugauuuauaugucaauccuuaugccaguaccacauugucuugauuacugucguuuuauaguaaguuugaaguccuguuuuugaaacugaccaacaguuaucuccucugaacuauuacuaccuaacuuaggcauugaguauaugacaucuaauguauaucauuugucuuuauaaggaugugcccaaucucaaugggcagauuguuaaugcuuuugagagauacagaccauaucuuauacaucuuuguguacccaggagucuuaauccuaguaggugcucauuaacuauuuacugagaauaauaauuaugcccaacugaguuaauauuuuuuaaaugaaaaauuucaaacucaagggaaaauggagauaaaaauagaaauaacuacuauguacuguucacccagauaggauaguuauuaaaaauuugccacaguugcuucauuuaucuuacccuuuucuuuuuucucugaaauauuuuaaagcaaauuccagagaacacaucauuuugugcuuacauauucaguuugcauuuuuuaaaaauguaagccuuuuuuuuuucaacauaaccacagugccauuauuacauccaacaaaaguaaauauaauuauuuguaacaccuaauaccuagcccauauucaaaucuccucaguugucuaaaaaaugucaucuucauuuguuuuuugugagucagaauccuuguguaauacuuguuauugucucuuuaauggauugauuuuuuauuuacauggugaaaacucaguaguacauuuuaucauauauguucauguucauaguucugaauacuagaguacuuguaaaaucaaauaucuaauuuuauuucuuagccaccuuagugaaccuuagugaacccaccuuagugaacccucuaacacuugagaucuguggcgcguaucucuucuuguacuucaggaacucuauuucccugacuucuguauuuucagugacccacucccacaugaggccauugaagggcuauaaacacuacauuauuauuucuugguaguagugugaugaucaugaaaugagugugucuuugccaaagaugacucgguggauuuuguaccuuuuacauugugcucaguuaguguguguauauguguguauguguauguuaaaaaaaaaugcugguuuugacccaugaauugauuuuaucauccauuaagugagucccaaccugugguuugaaaaacacuaguuugcuggauagucuugcagaaaaguaguagaaauuauuauuucuuucuguacaucuuuuagguagguuuaccaguucuauauacugcuuucuuuaagaucauuuuugaaaauuuaggggacugaaaauuuuggcuaugaauauauauaaacaugcacauauuggaccagaaaaaguuuaaaaagugaugaacuagaguaggugaucucaucaucugaauaggcaacuucuuugugucugaaacauuccuuuauguacuuuucucuucuguauagguacgccgucaugaaauacacaaaucgaagaauagagcauuaguacacugggaacuccaagaaaaagcuuugaagagaaaauggaggaagcagaaaccagaaacuuuaaaucuugagaaaagaagauugucuaucaugaaggagguaaugcuaaacugcauuagaguuagaaagaaaaaaaggagauaaauaggguucuuuguuuuucuucaauuugauucacguuggagagacucuaguaaucacugcauucuuauucaauaaucuacauguggacuucaaaaaaagcaacagaguggugacuggagucugguuuggugguuugaauuccuguucuacuacuuaccagcugugugacccuaaguaaauuauuuaacuuuucagccugaauuuucucauauuuaaaauuauuauuugcuuguauugcuaugagauuucagugauauaauacuuacaaagugaauagcacaaucuuugcuuauuccucuuuuuguauauaagcugcuauaauaauuuuucucaguaaagugauuagcacaaucuuuucuuauuccucuuuuuauauauaagcugcuauaauuauuuuucucaguuuaacagcagugcuguuagguuacuuugaaaaaaaaaugauguuguaugcuuguccaacugaguaauaagcaacuugucuuuggcuuaaccuuuugccagacgugggguguucagauaaguaaucagauauguagggauaaacaauaugggaaauaagaggaaacuacagcaaauaaccuuuuuaaauuugagcugaagucauugugaaggaaugugcuuugucuguaguguugcuccuuguucauauugaagcuuauguacagcacuuagcugucugaccuuucacggcagcuuugaaucauacauuuucuuuugaggaauuuguuaggcuucuuauugaaauaaagucucagucuuagacaucaucaggaagaauaauaucucccaaauaaauguuuacaugagcuugagaaaagaacaguggcuugauugagagaaugcuucuuuacagguaaguaucuuuuggugaucuuggacaagucgcauacauuuaaauguuaugggguaauucucagugaaaggccuaaaaacacagaucucaccacgaaaaaaggcagccugcuuggauugcaucagacucugggcuuauuuuccuuucucuagugguuccugcucauguccugaauuucucauacaaguuauagaugugguagaaguagguguuuaaagaaggguggugagagacgaugagugauguuucuuugccuucuuuuuguagaucugcugccucaggcacuaguauagugguucucaacucucacugcacauuagaaucagucagggucaagaagcuccauuaaaaaaauauauaacagcuggguguggcagcucaugccuguaaucccagcauuuugggaggccaaggcgggcagaucaccugaggucaggaguucaagaccagccuggccaacauggugaaaccccaucucuacaaaaauacagaaauuagcugagcaugauggcgggugccuguaaucccagcuacuugggaggcugaggugggagaauugcuugaaccugggaggcggagguugcagugagccgagauugguccauugcacuccagccugucucaaaaacaacaacagcaaaaccaaaaaaaaaaaaaagcccuaaagauuagcuggguacaguggcaggugccuguagucccagcuacucaggaggcugaggcaggagaaucgcuugaauccggguugcagugagcugagauugugccacugcacuccagccugggcaacagagugagacucugucucaaaaaaaaaaaaaaaaaaaaaagcucucuuucucucucucucucucuauguauguaugcauauauauauaacuauaucuggacucuauacccagagauucagauuuaguugaccuaggauguggccccauguagguguuuuuuagacaguuccuauguaauuugaaugugcugcagggguugagcaccucagcucucaucaggauucagguauuuucucucuaccagcauaucuugggauaauuuccugucagugcuuagacaucuaccuuuucuuuuugauggccauuagcauauagauguaccacaauuuauuuauccugugcuuuauuggugaacacuuagguuguguguuagaguauaguuuaagcuucuggaaauaaaaaaauacccuccuauauguuuugcuuuaaacaaacaaauuuguuucuguuuauuaaacaguugagaggaaagugguagcugguagggaacucugcaguccuuuauuacacagcuucugucucugaauacaaaauggccauagcagcuucauucagcuauaugccagccagcaggaaacaggaagaacagugcaugcuacuccuauuacaugucacccagaaguucuggcauauauccuguuggccagaaagucaucacauggccauucccacuuacaaagaugguugggaaaucuagcuauguaauuggcuaaaaugcaggaguucugcuguuaaaggagaaaccaaaagaacauugcuggauacuuaaguaguacugucaguuacccacagauugucuucuaccuugcuacuaucaauaauguaauaaauauccuugaaaauguuuuuggguacacauguaaguauauuuucaggauaaauucuuaaaaguagaauugcuuagucaauggauaugugcaucuuuuauuucaauguugguaaauuugcaacgucucuguuuaagggaugcaguggaccaaaggaagaagccuccuuagacauauucacauaagcuucaucauuauguauuaaagcuaacaggacccauccaccugaagcuggacucccagauuaacauaaauuaagagaaagcucuuuggccagcauaaucuuagauuucauuugcuguaagauguacccaugccaugggaaucaagcaaauuaggguucccucucacucauggagaggcuuucaaaaagaucuuauaaauccccaaaauguaauaacuccuaaagccucuuuguaauuucccaauucuaccucaugucuuuuacugugguacaaaagggcuaagaugacgaguuucugauaaugucuuuuuuuuuguagagacugggauccuuugaaaauccaacauguguaccaccacuuacagguuuaaguuugugcucugcaaacucauuugaggaguaauagauagaguuaggcuuguagagaucaguuuaccugucaaauggaugggcuuuaugagaggaguuauaaaucuagaaagaagaaguaaaagccaauacacugaucuuugaucacucaaaccauuuuucccaagggcagggacuaaacagggguuuccagucuuuuggcuucccuggggcacauuggaagaagaagaauugucuugggccacacauaaaauaaacuaacauuaaugauagcugaugagcuaaaaaaaaaaaaaaaaaaaaaaaaguuguaaaaaaaaaaucucauaauguuuuaagaaaguuuacaaauuuguguuaggccacauucaaagccauccugagccacagguuggacaagcuuggacuagcagaaggugacagauaaugguuuuuacaugagaccucauuauaaucaauaucaggucucaauaugguuauaagauuauaaucuucaugugucaauuccaucucuuuauuuugauaggucaaugcuuuuaaaaaauaguaaacucuuaaaauuauuauuaggaaauaagcuuuguguaauuuuucugguauagugaaagauuauacucauucauucacauucuuuccuaagcucauaauuccuuguacuugcaagacggcuaaguaagaauagaaauuugguuugugggauaauauaauuuaaguuauagcaaaauucugaaacaucucuagagugguauauagguuuucaguguuuccauauccaucuaccaccccuguggggcuggggaaggguuguugacugggacuggacucucagucuucugggucugaugugcucuugaccugauaccauuccaaagcuuacucuuuguagaaggaauaaauucagggcuuucuucucacugagucagccaaccugcuuggcuauagccggggaagaaggggaaaaauuaagaaugugacucuugcuauuuuucuuucugugucuuaaaacaauaacugaggucacauuguguauguauuugauucuguaguauagagaaauucugguaagaguauuuguuaucagauauuuuaucaauuugagucaaguguuggaaacugagcaguuuccagguacuuuuuaacuugagaaugccaucuggugguggugccgagagaauuaucuggcuuuuacucuagccuguggccuuacuuuuaauuaugaaaguuccuaaguugaaagugcauaauccagaggcacuacuguaauguuacuuuuuguguucuuaccucuccaggguaaaaaacugauuuguuuuuaaacacagaggccucacauuuuuuguuuaaugcuaaaacucauaucuuaugucauguuuuuaaaguuguaggucaugacuugacacauuaguggauuacauuaguggauucugaauucacucuagugguugaaacaccucuaaguuuauggcucaaagauucauaucuuucaucuguguuuuucaaacuauggauuauaauuuguuaaugaauugugaagugaguugcugccaacauuuaaaaaauagaauagaaauuaacaagaaaauaucagugguucucauggagcaagguuaauuaaaacuuuuauuuuaauuaacuuuuuauuuaauuaaaacuuuuauuuuguauauguguauguaaauguggugggucacaauugugaauauuucuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgcuaccacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccaauugugaauauuucuuacuuuggauuucagucagguauuggaaagccacuaauuauugucuuagccccaucuacugguucuuaaggauauugcuacugaagguuuuuaggaagguagccuaugguuauuuucaugcuccaggccuuuuuauggucuuuuccuuugcgauuugaaaaguaaauauaaucugaauaauaauauuugucauuaacacaugucuagauucuuucugaucaauaccagaugcaagauguguuggagaaaucugaucaucuaauagcugcagcaaaagagcuguuuccucguaggcgcacagguauucaauucaaacaaaagcuucucuauuuuauuaacuguagcccacaguugacuauuuggaagaauuuaaaguccuuucuuaggcaucauauuauuuauauuacaaguauuguaggguggauuuacaaggguuguuaggguuagagucauuauaaucuguuuccuuuccacuaagaauauuaacuacuuguauuacaaauaauucagcuaaggaaaaguaaauuguuuuaaucuacuaaaauaugguguaaaguacaggauuuuguaauuuuaaaaugugacuugaauaaagcuuaauuugaaaccuaaagcaacuucagucucucucuaagaggaacuuugccucuugucagauacacgcauuauuuauuuuaauguguguguaguucauuguuuaucuuaaucuucuagaaacaucauuaguuuuucauguaagguuugaauuccggcuuggcaaucuauuaguguuacucugggcuaguuacuuaaugucugugaguuucaguuuacugaucuguaaaauaguaauuguacuuauaggguuuuaugagaguaaaaugaguuaauauauguaaguacguuuagaacagugccuggcauauaguaagcacuacauuaaugugagcugcuguuuaagauuuucauaugaugaugcaaaccaauggcaguauagagcuugugaagucaaguuaauuaaaugaaacaaaucaucacaacuucuuuuccuuuugcaggguuuccaaauguaacaguggcuccugauuccucucagggucccauugugguaaaucaagacccuaucacccaaucuaucuuuaaugagucugucauagaaccucagguaauguguuccacucacagcuauaacacucaugcugaaaggaaguuuaaguugauauaggccuugugguaaauauuuuaaaaguuuaaauaucaacaagugcuaguugugguugcuagauuugcucuuaaguguauugcacuuucugugaguaauguuuguaucaaacaagacuggauaauaauagcuaaaauuuacugagugcuuaccuaguagguguauaugcugcuuuauccccauuuggcagaugaagaaauugaagcugagaaaaauuaggugacuuggccaagaucacauaguuugcaucagagaugggauucaaaucuaggccauguggcucaacaagacugccaccaucgaucauuauggagacagcagggagucuuuccacuuggagucagguggaucuacuuacuagcuguuuguucuugagcugauuucuuaauauaucugggugggcucagaauguguuuugcuucuucguuuuuuguuaaaugggacuagaauguaccugauaucauuguugcauggaucaggugcgaaaaguuauguaaaauuccugguauaauaccaggaacauaguacuuuguaaauguuagucucuuuuaauguauuaggauauuuaaaaaauagcuucacaagaaacuugcaauguaucaacuaguuauaugggagaauuguauuacaguaguaaaacauuaauuggcuguauucuaaccuaaugggaauucuuaauuaaugaaaauguuuagaauuuugagauaguaaacuuuuuuuaaagcccgugaauaauuuaauacuaaaauaagacaacuuaugcaugacuaggacucaguaccuguuuaaugaaauuuccuaaguuauaguuucuaugaaaaaagaagagaaucaucaauuagagggauauuccuagggaguugcaagguccagaaucauaaaagauauauuaauuauauuguuucauacuuccaaaggcaauuaaguaaaauguuacacauauuuuaaauagccaaaaaccuuuuaccauauuuccggcaaaaaccauuuauguuuuggcacuuaaugagaaguuagcuuucagauagcuggaaauuuaaucacccuagaauaucuuauugcuguaguauguucaacugaagauuuuacuuuuauuuaaauaaaucauaagugaagugugcccuauuuauuucagucauacuuuaaguacuuuuucaguuaauuggagccuguaaacaaguacacgauguaucccagcaacauggaauaaagcagucagauuuuauucuguugaagaguccauucgcacacuugagcuuauuaccauuaauacagcaguagaauuucaaauuaauguuacugauacaacuaauuuaccuaccugguuuaaguacuuucucaauuuacagcugauagcagaugaaaaacagugaugugagccucucaaagcagagguagcagagaaaaauggcagugagggaggagagagaggauaccugaauagauaagcagaggaccacuauacaucagaaaggaaauugguguugcuauagauaaucuuuuuuuuuuuuuuuuuuuuuuuuugagacggagucucgcucugucgcccaggcuggagugcaguggugcaaucuuggcucacugcaagcugugccucccggauucacgccauucugcugccucagccuccugaguagcugggacuacaggcgccugccaccaugcccggcuaauuuuuuuuuuguauuuuuuaguagagacgggguuucaccauguuauccaggauggucucgaucuccugaccuugugauccgcccgccucggccucccaaagugcugggauuacaggcgugagccaccacgcccggccugcuauagauaaucuugagucaccaagaaaaaaugaauuguaacugcauuacuuaaguucucuggguccuaguuucuucauccauauaggaauuagugagacuaaaccuacucacuuauucaucauguaauauuucagaucaugcacuagaugcuaagauacauagaugauuaaggcaugucucugucauuggauuagggaaauagcaggaguugagguuagagagacaaguaggaccuagguccugaaggacuaaggacuggaaaguaaaaguagagucacugaaggauuuuaaagaguggagucaugaugagauccaguauaguguggaagauggauuggggagggacaagacuggagagagggucugguuagaagacuuaggugggcaucuuagaaguggugagggccugacccaaagccaugccaauagggaaggaaauagaggagaauagggauagacuugagagugguuaaaaugagguagaguuggcaggauucgguggccgauaggacaggacaagugagaaagaaggauaacuccucauuugcuggcuugagcauuugaguagauggugacacuguucauggucuuagguaauauuggcaggaacaaaguuucuggaagaaugguuggagggcuuagaaagcuguucagcuuggaccuauugaguagggauuuuuuuuuuucuuuuuugagauggggucuugcugugucacccaggcuggaaugcaguggcacaaucaugacucacugcagccucuaccuccugggcucaagcaauccuccugccucagccucuugaguaggugagaccacaggugcacgccaccaagccugccuaauuuuuguguuuuugguggagacgggguuuugccacguugcccaagcuggucucaaacucuugggcucacaugauccuccugccuugcccucuuaaaaugcuaggauuacagaaaugagccacugugucuggccagaauagagauaucuuauaggcaguugaauaugaaugucuggggcuuaggacagaucugggugugaagauagagguuuggaaauuaauagcauuucauuuguaauuacagcuuuggaauuagauaaaaacauucagaaaguggaucagaugaggggagaaaagguugauauaggccuuuugguaaauauuuuaaaaguuuaaauaucaacaaaugcuaguugugguugcuagauuugcuuuuacuuaaguguauugcacuuccugugaguaacguuuguaccaaacaagauaagacuggauaauaauagcuaaaauuuauugagugcuuacuuaguaggugugaugugacuugagucacaucaucagauacaaggaaaggguagaaaaauaagaucaguaaaggagauugggaaggaauggccagaagaguaggagaaaaucuaagaaaauacaguauuaugggaguuaaaacaaguguaucaaguagcguuuuuuuuuuuuuuuuuuuuuugagacagggucuugcucuguugcccaggcuggaaugcaguggcacgaucacaacucacugcagccucgaccuuccugggcucagguuauucucccuccucagccuccugacuagcugagacuacaggugugggcuaccucaccuggcuaauuuuuaaauuuuuuuguagagacaugguuucgccauguuguucaggcuggucuucaacaccugggcucaagugauccacuugccuuggccucccaaagugcuagaguuuuaggcaugagccaccacaccuggccaaguggauuuuaaaggaaagaaaugaguggucagagaaguaagggaaggcaaagacagaaauauccauuugaguuagaaauaaguguguugagguugaccuuguagagagcaguuugaguagagcaauagggcagaagaagcaaaguugcagggcauagguggugagugaggaggguggaacaacucuuucaagaaguuuggugguagaagaaagaagauauauauagcuuaagguaaguauagggucagguuaagaugggagaggcuugcucacauuuaaauguuggugaacugaagccacuacagagacagauguugaaaaugugguagagagauaggauaauugauaguaguggaaggaugugagaagauuuguguucuacaacauguggagggcuuaggaggagggaacucucuucuguuaugacagaaaaaaaaaaagaaagucugaguauauauauaaucaacuugugcuauuuuuauuguuguguugagacaggcucuuaaugauguagauggugaagaagaaggaacuguuaauagccagucaggagaaagugagaaugagaaugaguuggauaacucucuaaacucucagucuaacacgaauacagacagguauguguauauggcauaaauauuuacaacucucagguuuuuuccauggccauuucaauguuugccuauugcaucauuuuuuauuaaaugggaguuuauuuuuauuuaaaaauuuguuuauuuugguauuuccaaauaauuugcagggauaauauaaaaagcucuuguauacucuuuacucagauucaucaauuauuaauguuuuccacauuucuuuuaucauuuuaucuccuuucugaguaugcacacacaugcaugcaugcacaugagcaccagucgccugaguaauauacauuguacccaauaugcaguuuuuuauuccgcaccuaccucccgcccucccccuucugagucuccaaaguuuguuauaucacucuguaugccuuugcauauccauagcuuagcuccuuagcaaguaagaacaugugguauuugguuuuccauuccucaguuacuucacuuagaauaauggucuccagcuccauccaaguuguugcaaaauacauuauuauuuuuuuugugugugaguggcugaguaguauuccauggugugucuauaccacauuuucuuuauccacucauuggucguugggcacuuaguuugguuccauauuuuugcaguugacuaacauacauuuuuaaagaacuauuaggaaguaaguugcaugcuucauguuccuuuaucccuaaauaauucagugugugguucccaagaaaaagagcauucauucagauaaaaucacaguacaaugaucacaaucaggaaauuacauugauuuaacacuauuaucuaauccauagaccuuauuuagauuucuccaguugucacaguaauguuuauuuuguuuuuuggaugauugaagaacuaaucguaaucacuuauuauauuuaguuuucaugucuuuucauuuuuaaaaaaaaccuggaaucuucuaaaaucuaaucuuaguguuucuuugccuuuuaugacauuuuuauaguuuugaagaaguacagggcaguuauuuuacagaauucccucuaguuugacuuugucuuauaaguucuucauuauuagacucagcuuacuuaugcauuuugggcaggaauaucccuaaagugauguuaaguccucaaugugucauaucaagaggcagugacaccuugguuuaauuauuggugcuguuaacuuucaucauuugguuacagugaugucugccacguuccuucaauggauuauacuguuuuaucuuuuauuuauuuugauguuuauuugucacauauuugggagcuucuucaaguaauuccuguguccuuuuaacguaucuucuuuaauguuuaauuucuggcacaacauagcucuuauuauacuuucucuucccuggaaucaaccauuucuucaagaauccuuagcucauuuuauuaaagaaggguauuuaaaaaccaagcucuaaguauuagaugcguuuauugcacuuggcagucauuguuuuuagaccaacagauacauauauaugcacacauacauauauauaccuauagucauauguauaugaacauaucuauauuaguaucuaguuuucugucuauuuagcuauaaaucaugaauuuacagugauaccucuaaguccaauuuaacacuauugguuuuaucuuggucuucuuauuccacauuuguaucacucuucuuuaacacugagcagcaugucuccaaacauuacacaaguauauuuauucauauucaauccugcaauacauagaaaauaguuuuggaauugcugcgcccauacuacugcaaaaauaaaccugcuaaguagaguucaagauuguuugcagauuucuaaaagguuauuguauucauuugaaauauaauuagguucauuugcuucuauuuguauucaauuuuagguuuuuaccucucuuuuugacaaaauuauacaaaaagcuguuuucaggguagugucagucaccauccccuaucccuucuaacuaguucccgucuacacuuacccuuguaggugaucaguuuccuuaguuuuuaaauuuauucuuucuguguuucuuuuuauaaauguaagcagauauauauauauauauauauaucuccuuauuuucucuuauauaaaagauaacauacuccuuauuuucucuucuuauauaaaagguaacguacuauauuugcuuuucuuuuacuuuaauugacaauaaaugugcauguucaugagguacauagauguuuugauacauauaauguauaguaaucagauugggguaauuaacauauccauuuauauuugcuuuuaccacuuaaugauauauccuggaaaucuccccauagcuguucauaaguuuacacagguauuuuuuucuucauuuuuauaauaaaaugaaacaguuggauaguacuaaauugugugaauguacuguaguuuauuugaccauucucauauauauauauuaucauuuuuuauugugucuauuugauucuucucucuuuuuuucuuuauuagucuggcuaccagucuauuuuguugaucuuuucaaaaaaccagcuccuggauucauugauuuuuugaaggguuuuucaugucucuauccccuucaguucugcuuugaucuuaguuauuucuugucuucugcuaacuuuugaauuuguuugcucuugcuucucuaguucuuuuaauugugauguuaggugucaauuuuagaucuuuccugcuuucucuugugggcauauauauauauauauauauaugagaauggucaaauaaacuacaguauauuugauauacuauauauauauauauauggucauuuagguuauuuucaguauuuuauuuuauuuuucauuuuuugagauggagucucauucuguugcccaggcuggagugcagugucgccaucuuggcucacugcaaccuccacaucccagguucaagugauucuccugcuucagccucccaggaaacuggauuacaggcaugcgccaccaggccuggcuaauuuuguauuuuuauuagagacuacauuguucaguucccacuuaaaagcgggacaugugguguuuuguuuucuguguugguuugcugaggauaauggcauccagcuccauccaugucccugcaaaggacaugauuuaauuccuuuuuauggcugcauaguauuccauguuuuauuauuaaauuaacuagagagaacuggcaucuuuaugacguugaauuuugcuauucaagaacauaguauauuuuuccauuuguuaaaagguccgcugcuuucuucagagccgucaggcauagauguuuaagucugaugaagcugugcccacagccgccccuucucccaggugcucugucccagggagauggggguuuuauuuauaagucccugacuggggcugcugcuuuuuuuuccagacauguucugcccauugaggagaaaucuggcagucuggccgcagcagcuuugcugagcuucgguaggcuccacccaguuugaacuuccugguggcuuuguuuacacugugaguguaaaaccaccuacucaagccucagcaauggcagcugccccuucccccaccaagcucgagcgucccagguugaucucagauugcugcuguguuggcagcaagaauuucaagucaguggaucuuaguuugcugggcuccguggugugggacccgcugagccagaccacuuggcugccuagcuucagcccccuuuccaggggagugaacaguucugucucucuggcguucuaggcgccacugugguauggaaaaaaaaaaaaaaacaaacaaaacuccugcagcuaguuuggugucugcccaaacggcccccuaguuuugugcuugaaacccaggacccugcugggguaggcacuggagggagucucuuggccugcggguugcgaagacugugggaaaagcacaguaucugggucagagugcaagguuccucaggcucagucccuccuggauucccuuggguaggggagacuuuaacacuuuauggucaguauuagacagaucgaugagacagaaaauuaaaaaggauauucaggacuugaacucagcucuggaccaagcagacuuaauagacaucuacagaacucuccaccccaaaucaacagaauauacauucuucucaguaccucaucguacuuuuucugaaauugaguaaaacacuccucagcaaaugcaaaagaauggaaaucauaacaaacagucucuccgaccacagugcaaucaaauuagaaaucaggauuaagaaacucacucaaaaccgcacaacuacguggaaacugaacaaccugcuccugaaugacuacuggguacauaacuaaaugaaggcagaaauaaagauguuccuugaaaccagagagaacaaagacacaacauaccagaaucucugggacacauuuaaagcaguguguagagggaaauuuauagcacuaaaugcccacaagagaaagcaggaaagaucuaaaauugacaccuaacaucacaauuaaaagaacuagagaagcaagagcaaacaaauucaaaaguuagcagaagacaagaaauaacuaagaucaaagcagaacugaaggggauagagacaugaaaaacccuucaaaaaaucaaugaauccaggagcugguuuuuugaaaagaucaacaaaauagacugguagccagacuaauaaagaaaaaaagagagaagaaucaaauagacacaauaaaaaaugauaaaggggauaucaccacugaucccacagaaauacaaacuaccaucagaauacuauaaacaccucuaugcaaauaaacuagaaauggauaaaaucuagaagaaauggauaaauuccuggacacauacacccucccaagucuaaaccagaagaagucgaaucccugaauagaccaauaacaaguucugaaauugaggcaguaauuaauagccuaccaaccaaaaaaaguccaggaccaggcagauucacagccgaguucuaccagagguacaaagagaagcugguaccacuccuucugaaacuauuccaaacaauagaaaaagagggaauccucccuaaaucauuuuaugaggccagcaucauccugauaccaaauccuggcagagacacaacaaaaaaagaaaauuucaggccaauaucccugaugaacaucgaugcaaaaauccucaauaaaauacuggcaaauggaauccagcagcacaucaaaaagcuuauccaccacaaucaaguuggcuucaucccugggaugcaaggcugguucagcauaugcaaaaaaauaaauguaauccaucacauaaacagaaccaaagacaaaaaucacaugauuaaccuaauagaugcagaaaaggccuuugacaaaauucaacaccccuucaugcuaaaaauucaauaaacuagguaucgguggaacauaucucaaaauaauaagagcuauuugugaccaacccacagccaauagaauacuggaugggcaaggcaaaaggcaaggaugcccucucucacaacuccuauucaacauaguauuggaaguucuggccaugacaaucaggcaagagacagaaauaaagggcauucaaguaggaaaagaggaagucaaacugucucuguuugcagaugacaugauuguauauuuagaaaacaccaucgucucagcccaaaaucuccuuaagcugauaagcaacuucagcaaagucucaggauacaaaaucagugugcaaaaaucacaagcauucuuauacaccaauaacagacaaacagagagccaaaucaugagugaacucccauucacaauugcuacuaagagaauaaaauaccuaggaauccaacuuacaagggaugugaaggaccucuucaaggagaacuacaagccacugcucaaggaaauaagagacgacacaaacaaauggaaaaacauuccaugcucauggauaggaagacucaauaucaugaaaauggccauacugcccaaaguaauuuauagauucaaugcuauccccaucaagcuaccauuggcuuucuucacagaauuagaaaaaacuacuuuaaacuucuuauggagccaaaaaagagccugcauagccaagacaauccuaagcaaaaagaacaaagcuggagucaucacacuaccugaauucaaacuauacuacaaggcugcaguaaccaaaacagcaugguacugguaccaaaacagauauguagaccaauggaacagaacagagcccucagaaauacaccacacaucuacaaccaucugaccuuugacaaacccaagacaaacaauagggaaaggauuccuuauuuaauaaaugauguugggaaaacuggcuagccauaugcagaaaacugaaacuaggcuucuuccuuacaccuuauacaaaaauuaacucaagauggauuaaagaguuaaacguaagaccugaaaccauaaaaaauccuagaagaaaaccuaggcaguaccauucaggacauaggcauacacaaaggcuucaggucuaaaacuccaaaagcaacggcaacaaaagccaaaauugacaaagaggaucuaauuaaacuaaagagcuccugcacagcaaaagaaacugugaucauggugaacagguaaucuacagaaugggagaaaauuuuugcaaucuaucuauuugacaaagggcuaguauccagaaucuacaaagaacuuaaacaaauuuacaagaaaaaaacaaccccaucaaaaaguagguggaggauaugaacagacacuucucaaauaagacauuuaugcagccaaaaaacauacgaaaaaaagcucaucaucacuggucaucagagaaugcaaaucaaaaccacaaugagauaccaucucacgccaguuagaauggcgaucauuaaaaagucaggaaauaacagaugcuagaaaggauguggagcaauaagaaugcuuuuacacuguuggugggaguguaaauuaguucaaccauuguggaagacaguguggcgauuccucaaggaucuagaacuagaaauaccauuugacccagcaaucccauuacuggguauauacccaaaggauuauaaaucauucuauacagacacauggacacauauguuuauugcaucacuauucacaauaacagagacuuggaaccaacccaugugcccaucaaugauagacuggauaaagaaaauguggcacauauauagcauggaauacuaugcagccauaaaaaagaugaguucauguccuuugcagggacauggaugaagcuggaaaccauaauucucagcaaacuaacauaagaacagaaaaccaaacacuguguguucuuacucauaagugggaguugaacaaugagaacacacggacacagggaggggaacaucacacaccggggccuguuggaggguugggggggcuaggggagggauagcguuaggagaaauaccuaauguaggugacagguugaugggugcagcaaaccacuaugggacguguauaccuauguaacaaaacugcacguucugcacauauaccccagaacuuaaaguauaauaauaaaaaaaaaacuagaaaaaaaaaagucuacuuuucuguuuuucaacagcgucuuaacauuucucucauauagaguuugcuuauuucuuacugaguuuauuccuaaguguuuuggggcuuuuguuauucuuuuaaauggaauuuugucuuccauuauaccuccuaacuaguuauucuuuguuuuuaugaaaguuacugauuuccauguguugccuugauauucugcuacuuuauugaaucuugguugaauuaguuuuagcacugauuuucuagggguuccuagguugacugucaucucaucugcaaauagacauuguuuuccuuguuaucuaagucuuucaccucuaauugguuucuuuuguauauuuuauuaguuauaggacaguguucaauaauaauggagauaguggggauccuugccuuguuucugauuguaugaaaaugcuucuauuguuuccucuuaaguaagguauuggcuuuaguacugaggucuuuuuucuuucuuucuuucuuuaaauuuuuaaaaucauuguuauuuuuagucuuuuuugagacaggaucucacucugucacccuggccagagugcaguggugugaucacagcucagguaauccucucaccucagccucucaccucagccucccucagccucuaguagccgggacuacaggcaugcaaacaccauacccagauacauuuuuuuuuaaacaaugcuaaggaaaugccaaucaauucuuguuuucuugauuguuuuauuuuaaucaguaauaaguguuaauuuuaucagacuuuuucaauaucuauagagauaaucauaugaguuuucugcuuaugucucuuaauaugguacauuauguuaugaguuuccuaauauugcgcuauccuugcauuucugcaguaaauucuauuuggccaugauguguuauuuucauuaauggaguauuggagguuguuuguuaauauuuuauuuaguauucuuguguuaaaauucauaaaugauauucucuguaguuuuuuugugucugcagccuuuaucagauugaaguaacaaugcgguacuugauuucauaagaaccaucuggaagauuuuucuaauuuuuuaaguccuggaacaauuuauauagcacugagacuaucuguuuuuugaggcugauagcuuuccuccuuugaaacuauuugcgcauggugcuuuuuuuuuuucuguggggaagugccauaguaacuuugcuuguuuauuuaagcuucuauuucuucucaagccaauuuuuauaaguuauauuuucuuaggaaauuuuccauuucaucuagguuaaucaauguauuucuauagagaugugccaauaaucucuauacuucuuaaaaaauuuuguuucagugcuuacuuguucuccucaaucauuuauuuugguucucuuucuuuaaaauuagguuauuuagugguuugccuauuuuaugaauuuuugaagaacuaacauuuuuaauuuauuaguuagaggucuaguuuucugauuucuuccucaucaauuuuugcuuuugucuuuauuuccuucguugugcauuuuuuuguuuacuuuuucuaguaacccuaguugagaauuuaauacauucauuuucauucuuuuauuuuuaauugauaaacauguuuagggcucugaauucuacucugaucacuacuauaaauguguaccauacauucugguauguaguguuuuguuacuuuaggaaugagguaauuucaguuuauauuuucauguuuacuuaagaauugucuaaaaagucaggaaacaacaggugcuggagaggauguggagaaauaggaacauuuuuacacuguuggugggacuguaaacuaguucaaccauuguggaagucaguguggcgauuccucagggaucuagaacuagaaauaccauuugacccagccaucccauuacuggguauauacccagaggacuauaaaucaugcugcuauaaagacacaugcacacguauguuuauugcggcacuauucacaauagcaaagacuuggaaccaacccaaauguccaacaaugauagccuggauuaagaaaauguggcacauauacaccauggaauacuaugcagccauaaaaaaugaugaguucauguccuuuguagggacauggaugaaauuggaaaucaucauucucaguaaacuaucgcaaggacaaaaaaccaaacaccacauguucucacucauagaugggaauugaacaaugagaacacauggccacaggaaggggaacaucacacacuggcgacuguuguggggugggggguggggggagggauagcauuaggagauacaccuaaugcuaaaugacgaguuaaugggugcagcacaccagcauggcacauguauacauauguaacuaacuugcacauugugcacauguacgcuaaaacuuaaaguauaauaauaauuuuuuaaaaaauugucuaauagaagauuuaaaaaaaaauuuccagagccucuuuguuuuucuaguuuuauuacguuacauucagagugugauuuguaauauuucuaccuguggaacuugauguuuucuuugugaccuaauauaugaucaaauuuuuacaaauguuccaugugugugccugagaagaagguauauacucuaacaagguauaaaguucuaaagauauauccauagaucuaccucacugauuauauuguugaauacuuuuguauccuuacuuauuuuugccacucuuuucuucugagaaugguguauuaaagucuccuacuacuaguauguuucuauuucucuuugcauuuuguuuaaguauauuuaauuguucagaguuaaauacuuccuuucuuauaaaagugauucuuguguuuuuugguccauguuuuuuggaacauaaguguuauaucuucauugugauuuauaacuuuuagcauuauaaaguaugcuuugucacauuuaauaccuuuugacuucauuucuacuucaucuaauaucaggaaugaaaccucuacuuuuuucuuguuuccaauuuccuggcuuaucuuggcuuuuuacauuuagcuuucuguauuuuagauguuuaauauauuuagccuucuggaauuauuuuguauuaaguaugucucuuguauacaaugcagaguucagucuugccuuguuagacaauuuggaaauauucuucuuuuaauugaaguaagcuuauaacacuuacugauauguuugauguuaacuucaucacauuauuuuauaguacuguuuauuguacuauaauuucauuuucuaugugauguuucuucucuguucuuuuaaaaaauuucuuuugguauuuaggaaguuuguaauuuuguucuggugguuaccuuugcauauauaccuuuuauagagcccuuaaucuuguuuucuuuuuuuuacaugucauugucagguaugucaguuaaauuuuuuuuuaaugcuuuuuuuucggcagauucuuuuuauuuuauuuuauuauuauuauacuuuaaguuuuaggguacaugugcacaaugugcagguuaguuacauauguauacaugugccaugcuggugugcugcacccauuaacuugucauuuagcauuagguauaucuccuaaugccaucccuccccccuccccccaucccacaacaguucccagagugugauguuccccuuccuguguccauguguucucauuguucaguucccaccuaugagugagaacaugcgguguuugguuuuuuguccuugcaauaguuuacugagaaugaugauuuccaguuucauccaugucccuacaaaggacaugaacuuaucauuuuuuaaggcugcauaguauuccaugguguauaugugccacauuuucuuaauccagucuaucguuguuggacauuuggguugguuccaagucuuugcuauugugaauagugccacaauaaacauaugugugcaugugucuuuauagcagcaugauuuauaguccucuggguauauacccagcaaugggauggcugggucaaaugguauuucuaguucuagaucccugaggaaucgccacacugacuuccacaaugguugaacuaguuuacagucccaccaacaguguaaaaguguuccuacuucuccacauccucuccagcaccuguuguuuccugacuuuuuaaugauugccauucuaacuggugugagaugauaucucauugugguuuugauuugcauuucucugauggccagugauggugagcauuuuuucauguguuuuuuuggcugcauaaaugucuucuuuugagaagugucuguucauguccuuugcccacuuuuugaugggguuguuuguuuuuuucuuguaaauuuguuugaguucuuuguagauucuggauauuagcccuuugucagaugaguagguugcgaaaauuuucucccauuuuguagguugccuguucacucugaugguaguuccuuuugcugugcagaagcucuuuaguuuaguuagaucccauuugucaauuuuggcuuuguugccauugcuuuugguguuuuagacaugaaguccuugcccaugccuauguccugaaugguaaugccuagguuuucuucuaggguuuuuaugguuuuaggucuaacguuuaagucuuuaauccaucuugaauugauuuuuguauaagguguaaggaagggauccaguuucagcuuucuccauauggcuagccaguuuucccagcaccauuuauuaaauagggaauccuuuccccauugcuuguuuuucucaaguuugucaaagaucagauaguuguagauaugcggcguuauuucugagggcucuguucuguuccauugaucuauaucucuguuuugguaccaguaacaugcuguuuugguuacuguagccuuguaguauaguuugaagucagguagcaugaugccuccagcuuuguucuuuuggcuuaggauugacuuggugaugcaggcucuuuuucgguuccauaugaacuuuaaaguaguuuuuuccaauucugugaagaaagucauugguagcuugauggggauggcauugaaucucuaaauuaccuugggcaguauggccauuuucacgauagugauucuuccuacccaugagcauggaauguucuuccauuuguuuguauccucuuuuauuucauucagcagugguuuguaguucuccuugaagagguccuucacaucccuuguaaguuggauuccuagguauuuuauucucuuugaagcaauugugaaugggaguucacucaugauuuggcucucuuuugucuguuauugguguauaagaaugcuugugauuuuuguacauugauuuuguauccugagacuuugcugaaguugcuuaucagcuuaaggagauuuugagcugagacaacgggguuuucuagauguacaaucaugucaucugcaaacagggacaauuugacuuccucuuuuccuaauugaauacccuuuauuuccuucuccugccuaauugcccuggccagaacuuccaacacuauguugaauaggaguagugagagagggcaucccugucuugugccaguuuucaaagggaaugcuuccaguuuuugcccauucaauaugauauuggcuguggguuugucauagacagcucuuauuauuuugagauacaucccaucgauaccuaauuuaucgagaguuuuuagcaugaagcauuguugaauuuugucaaaggccuuuucugcaucuauugagauaauuaugugguuuuugucuuugguucuguuuauaugcuggauuacauuuauugauuugcguauauugaaccagccuugcaucccagggaugaagcccacuugaucaugguggauaaacuuuuugaugugcugcuggauucgguuugccaguauuuuauugaggauuuuugcaucaauguucaucaaggauauuggucuaaaauucucuuuuuugguugugucucugcccggcuuugguaucaggaugaugcuggccucauaaaaugaguuagggaggauucccucuuuuucuauugauuggaauaguuucagaaggaaugguaccaguuccuccuuguaccucugguagaauuuggcugugaauccaucugguccuugacucuuuuugauugguaagcuauugauuauugccacuauuucagagccuguuauuggucuauucagagauucaacuucuuccugguuuagucuugggaggauguaugugucgaggaauuuauccauuucuucuagauuuucuaguuuauuugcguagagguguuuguaguauucucugaggguaguuuguauuucugugggaucaguggugauauccccuuuaucauuuuuuauugcaucuauuugauucuucuuucuuuucuuuuuuauuaaucuugcuagcagucuaucaauuuuguugauccuuucaaaaagccagcuccuggauucauuacuuuuuugaaggguuuuuuugugucucuguuuccuucgguucugcucugauuuuaguuauuucuugccuucugcuagcuuuugaauguguuugcuuuucuaguucuuuuaauugugauguuagggugucaauuuuggaucuuuccugcuuucucuugugggcauuuagugcuauaaauuucccucuacacacugcuuugagugugucccagagauucugguauguugugucuuuguucucguugguuucaaagaacaucuuuauuucugccuucauuuauuuauguacccaguagucauucaggagcagguuguucaguuuccacguaguugagcgguuuugagugaguuucuuaauccugaguucuaguuugauugcacuguggucugagagacaguuuguuauaauuucuguucuuuuacauuugcugagaagagcuuuacuuccaaguuuguggucaauuuuggaauaggugucauguggugcugaaaaaaauguauauucuguugauuugggguggagaguucuguagaugucuauuaagucugcuuggugcagagcugaguucaauuccuggguauccuuguugacuuucuaucucauugaucugucuaauguugacagugggguuguuaaagucucccauuauuaaggugugggagucuaagucucuuuguaggucacucagaacuugcuuuaugaaucugggugcuccuguauugggugcauauauauuuaggauaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccuaugugugucucugcacgugagauggguuuccugauuacagcacacugaugggucuugacucuuuauccaauuuuccagucugugccuuuuaauuggagcauuuaguccguuuacauuuaaaguuaauauuguuaagugugaauuugauccugucauuaugauguuagcugauuauuuugcucguuaguugaugcaguuucuuccuagucucgauggucuuuacaauuuggcaugauuuugcagcggcugguaccgguuguuccuuuccauguuuagugcuuccuucaggagcucuuuuagggcaggccugguggugacaaaaucucucagcauuugcuugucuguaaaguauuuuauuucuccuucacuuaugaagcuuaguuuggcuggauaugaaauucuggguugaaaauucuuuucuuuaagaauguugaauauuggcccccacucucuucuggcuuguagaguuucugccgagagauccgcuguuagucugauggucuucccuuugucaguaacccgaccuuucucucuggcugcccuuaacauuuuuucuuucauuuccacuuuggugaaucugacaauuaugcgucuugguguugcucuucucgaggaguaucuuugugguguucucuguauuuccugaaucugaauguuggccugccuugcuagauuggggaaguucuccuggauaauauccugcagaguguuuuccaacuugguuccauucucccugucacuuucagguacaccaaucagacguagauuuggucuuuucacauagucccauauuucuuggaggcuuuguucguuucuuuuuauucuuuuuucuguaaacuucccuucucgcuucauuucauucauuucaucuuccaucgcugauacccuuucuuccaguugaucgcauuagcuccugaggcuucugcguucuucauguaguucucgagccuugguuuucagcuccaucagcuccuuuaagcacuucucuguauugguuauccuaguuauacauucaucuaaauuuuuuucaaaguuuuuaacuucuuugccuuugguuugaauuuccuccuguagcucggaguaguuugaucgucugaagccuucuucucucaacucgucaaagucauuuucuuuccagcuuuguuccguugguagugaggaacugcguuccuuuggaggaggagaggugcucugcuuuuuagaguuuccaguuuuucugcucuguuucuuccccaucuuugugguuuuagcuacuuuuggucuuugcuuuuggugauguagagauggguuuuugauguggauguccuuucuguuugcuaguuuuccuucuaacagacaggacccucagcuguaggucuguuggaguuugcuagagguccacuccagacccuguuugccuggguaucagcagcgguggcugcagaacaguggauuuucgugaaccgcgaaugcugcugucugaucguuccucuggaauuuuugucucagaggaauacccggccgugugaggugucagucugccccuacuggggguugccuccuaguuaggcugcucgggggucaggggucagggacccacuugaggaggcaaucugcccguucucagaucuccagcugcgugcugggagaaccacugcucucuucaaagcugucagacagggacauuuaagucuguagagguuacugcugucuuuuuguuugucugugcccugcccccagagguggagccuacagaggcaggcaggccuccuugagcuguggugggcuccacccaguuggaacuucccggcugcuuuguuuaccuaagcaagccugggcaauggcgggugccccucccccagccucacugccgccuugcaguuugaucucagacugcugugcuagcaaucagugagacucugugggcguaagacccuccgagccaggugccggauauaaucuccugguuuuuuaagcccgucggaaaagugcaguauuagggugggcaugacccaauuuuccaggugccgucugucaccccuuucuuugacuaggaaagggaacucccugaccccucgcgcuucccaagugaggcaaugccuugcccugcuucggcucgcgcacggugcacugcacccacuguccugcgcucaccgucuggcacucccuagugagaugaacccaguaccucagauggaaaugcagaaaucacccaucuucugugucacucacgcugggagcuguagaccggagcuguuccuauucggccaccuuggcugcccuucccgaaaaaacaaaauuuuuuuuuuguuuuaauaagugagcuuuucuauguuccuauucuuuccauuauuuucucuccauccuucccauuuuuaguuauauauuuugcuuugacagaacaugaaguauuuacauacuaugcuuccaugcguaucccguuuuuguuuuugucuuauagcuacaauuaaguauauuaaauaucccacaaguuugguggcuuaaaacaacagaacuugauuucuucccaguucugggguccagaaauccaaaaucaguuucacuaggccaacgucaagguaucaguagggccacacucccuccagaggagaagcugcucuggaagagaauuugcuccuugcuucuucuagcuucugaaauuguggcugcagcacaccaaucucugccucuugucuucacaucaucuccucugugugggugucaaagaucuuccucugucuguuucuuauaagaauguacaugaaauaugaaaaauuuuuuuuaaaaaauaugugauugcauuuagggccuacccaagauaaucuccccaucucaagauucuaaauuguaucugaagaggcuuccccuaccccuuuuuugccauauaagguaauagugacaggcuccaggguuuaggacauggaauaucuucaggcauuauuauuuagccuaccaugguccuuccagugggccccaaagauccaucccaauauccuucaauuuucagcuucauuucaaguucaaaaucucaucuaaaucucauuagcucaaaagucccaaaucucaucaucuaaaucaguuaugggaggacuggauagaauccauccuggugcaaaauucuccauuugugguccuaugaaacuagaagacaaguugucugcuuucaaaauaccaugaugggacagacauaggaugaaaguuauagacauuuccauuuuacgagggaaaaucaaagaagaaagggaucagcaguuccaagcaacuuugaaauucauuagagcaaauacuauuaggacuuaaugcucugugacuugagucuuuacccuucuggauccauggcucuucccucugugccuguggcucuggcuuuggccucugugccuauggaucugcagcucuggccacauguucucacuuacuucugggagcuaaaaauuaaaacaguugaacuuaggaagauagagaguagaaugaugguuaccagaggcugagaaagguagucuguagaauuuuuugagucuagcacccuuccuucauuucauccugucuuugugucuuucaauuuaagcuagcaguauuucuguugguauaacauucucaaaagaucuugugucuugcauaugucauggucaucuacuccauagacaggucuuuccuggaaaaucccaucuuuauuguuagcuucuucugacaucauuuggaggauccaugaaucacaugcuuuaucucuucagaacuagcaaaagguuauucagccacacucuugcccuucucuccagaauaugcuuuccuaacagcgacuuuacuaaucuuuugcaauuuggacaggcugaaaacuucucaaaacaucaaguccugguuccuuuugcuuaaaguuuuucccaccauuuaucucuuuguucuugcuuuuauacuaagccuccagaagaagguaggcuguaacuuuagcacuuugagaaauagacaaaugagacaguugaaaauuaaaauaucaaccuuaucagugauaaaaguguuuauagcauaacgcuuagcucuguaaccaaugugcuuguaauuacuaaccccuaaacugcagcaucucuucucacucuaucuagccccucccugacacacagggacagaguaugcuguggucaauuuacuucauugaugagcagagacuggcugcucuguggacaggcuccuuuguaggacagagaaaccaaaaggggcugagccauauaugcuuaauuacuuuacucuagagaaagagagaggaggauggagccauaccacaaaacugcagaaagggcaaacauaccuauguuagggaccaagguagguaggaaacugggaggcagauggaaugauucuuucuaacacuaaggugauaggcauuuuugcuaucuaccugucuuaucaguuauagugaauaguguuuuuucuuugacuaugaauuacuaaaagcuccuucaaaucaaacauguaacuauuugaacaguuuaaaugauagcaccuauuuuuuauauaaauuaauauaauauacauauaaauuagauauaaauauaauuuaauuuauauaauuaaauuauaaauuaaauuacauguaauauagaauauauuuuauaauuauguguaauuauuauauaauuauauauaauuaauuauauaauuuaauuauaaauuauaauuaaauuuauaugcauauuuauauauaaaauuaaauuuauaauuauauaaauauaaauuauaauaauauagauaauguaaauauaaauuaaaugccugcuaucauuuaauuuauauuuauauuauauuaauuuauauuauaauucucauguagcuuauuguccuguaauuuauagguuucuccaacaacuaacagaagagaauuuugaguuaauuaguaaguuguggacugacauucagcagaaaauagcaacccagucacaaauaacuccuccaggaacgccaucaucugcucuuucaucaggggagcaaagagguuuguuucccuuuugcauuauuucuaggugccugcuuuauuagguucauucuugaaugcaguaauuuuugaaggaauguuauuugaguuuugacugccuuugccuaauugacuaaaauacugauggaucugucaauugaaauacuuucuuaagaaguuuguucacuugagauacuuuuggaaauguucuuccuuuuagcugcucugaaugcuaccaaugcugucaagagacuccaaaccaggcuucagccugaagaaucuacugagacucuagacucaagcuacguugugggacacgugcugaacucaaggaagcaaaaacagcuguuaaauaaagguucagucccuuaauuuacaaagaugaauauuaaacauguaacuugauacagcugucuuaaucucuuagucaauguuuuucucccuuaaucucauccacaugguuccaacugaaaguuuauugaaugguagcuaagaaaugucuccuaccacauguaacucuggaacagugguucuagugcauucauuauagcuaguguaaaucugguuuaaacuguuuaauuuuuaugagagaaauggugauaucgucuauacaagccuuuuauaaauugugaacaauagucaaaagauuuuucuaguaguuuucuagucauaauuuuuccuggucuuaaaauagaaugacuucucucauuaucagugaaaaggaaaccgaauuugcaugcucuuuccaagccgaagaaaaacauaucaucagguagcacaaccucugcagacuuaccaaauaggacuaauuccaaccuggauguccucaaacacaugauacaugaaguggaacaugaaauggaagaauaugagcgguggacaggucgcgaggucaagggucugcagagcagucagggucuuacaggcuucacuuugucgcuggugagcucccucugucgccugguucgguaccuuaaagagguaaggacauuagguuaguagagucuucuuuucaggcagaaaugcaugaguuuuuuuuccuuuccauuuauugcaaccuccaaauaaaguacagucaaauuugaauagcuucguuuaaaauaccucaguuuuagauuaucugcaguaaaggcuuauccuuuaagucuuuucugccguuaguugauacaugcucagauaagugauuuuaauuuuaauaagagcuuuagcaaauuauaauuaguaggguaaaucugccauuaauauaauuauaucuugugcuaauauuaaauauuacuguuugacaguuguagauuaaauagaacuguuaacugugucugcauucuauugcuauucucugcuuccuacucccacauucaguuuggagaguggcauugccuauaaucgguagacuugauaugugggagaauucuucauguucccuguaugucugguaacucacauauggcuucaaugucuaagugggagauguuuuauuguuguaaaaauaauuuauaaaauaagcaagaauucuuuguuuggcugggugugguggcucacgccuauaaccuauaaucccagcccuuuggaaggccgaggcgggcagauugccugaggucaggaguuuaagaccagccuggccucaacgugguaaaaccuugucucuacuaaaaauacaaaaauuagucgggcaugguggcgggcgccuguaaucccagcuucuggggaggcugaggcaggagaauuacuuucaccagggaguuggagguugcagugagccgagaucgcgccacugcacuccagccugggcggcagagcaagacacugucucaaaaaauaaaaauaaaaaaagaauuguuuguuuaauuugauuucaaauaaucauccacagaaugccacagaauuagaguuagcuauguguuucaucuuugaaaaucuauuuaaacuguuauguacuuaagccuguuauacaaauaugacaaaaauguuuaaggaaacuuuauuauuuaauaagauagauuuaccaccuuaauacagauguuuuaguuucucuagagccgucuuccuaaaauugaauugcuuuuuuuuugagacagggucucauucuguugcccaggcuagggugcaguaguggcaugaucucggcucacugcaaccuccaccucccggguuuaagugguuuuccagccucagccucccaaguagcugggaccacaggugcaugccaccacacccagcuaauuuuuguauuuuuuuuguagagacagagucucacuauguugcccaggcuggucucgaaauccugaguucaaagcgaucugcccaccuuggcuucccaagguguugguauuauaggcgugagccucugcaccugacccuaaaauuaacuuuuuaaugacagauucauuguauugucagaccuauuaaaaccuuaacauucuuucacccuuaacucaggaaucuucaggaguauacuuuuggcucuuggagaguauugcaggcuuagaagcauguacuuuuuuuuuuuuuuuugagacagagucucgcucuguugcuaggcuggagugcaguggcaugaucuuggcucacugcaaccucugccuccuggguucaagagauucuucugccucagccucuugaguaucugggacuacaggcgugcaccaccacgcccaguuaauuuucguauuuuuaguagagacgggguuucauucaccauguuggccaggauggucucgaucucuugaccuuguaaucugccugccuuggccucccaaugugcugggauuacaggugugagccaccacgcccgaccagaagcguguacuuuuaagcuaaucacuuguuuuacaaaguuaaaccauuuaaaguuguagucauuuacuuuaaauuauauuuuaacaagcuuaauuuuugaauuggcaauauagucacauauuaugaaauucaaagauaacagcagauuguacuaacucucaugacuaacuuccagcuagccuguuugcuuauuuauagccaacuaucauuccagauaccaguguaucuuucuagagauggucaguguauauucaaauaauauguauauguauaucccucuacuuucuuuuuacaaaaaauguaguuacuuaauuuuauauagcauuuaguucauuuuauucuauuuaaagaagggaagaggauaaagaagcacauuuucuuuaauuaaauauaauaaaccuuuuaauaaaacucuucaucauuacugucacauaauauaugcuucuuuguaaauaucuucuuugccagcuuugagugcaaacuuuuaguuuucaacaugugaugcuauugguggaaguuuauuugauauuuuuuuguagagugagauccagcuacguaaagaaguagagacaaggcaacaacuggaacaaguauuaggugaucaucgagagcucauugaugcucugacagcugaaauucuucgucuuagagaagaaaacgcugcuacacagguacucagaugagaucccaauuuuuauguguucagugguauaaaacaucuuuaaacauguacuggauucucuuagaguugcuuuugguuuaacuguaucgaugugauuacuuaucagucauuuuuaucaucaguggcagguauuauugaacauuuauuacauggaaguacuauaguagaagcuuggaaguaguauauggacugucuuccugucuucaagagacuuacuauuuagugggaagacagagucuacauuuaaauuauaacuacaaguguuacaguaguuaauccaaaaugugaaaugaguguuaugacagccacuuuuaauuucaaaacagcagaagguagccuuugaggaguccuuuugcaauuauaucagagccauuuacaguuguucacaguaucuucauauuuguuacauaaaguccucuuugcugcuugacuaauugcuccuuuucuuuuuuaaaagacuuacaccauucucuucuggaaaaccuauugcuuccaugcugcauugagcauucuuccuuugugaacuuuuuuuuuuuuuuuugagauggugucucacucugucacccaggauggagugcaguggcaugaguucauugcagccuggaccuccugggcucaagugauccucccaccuuagccucccaagucgcugggacuacaggugcacaccaccauacccagcuaacuuuuuauguuuuguagagaugggguuucaccauguugcccaggcuggucucgaacuccagggcucaagcuauucgcccgccuuggcccucgaaagugcugggauuacaggcaugagccacugcaccuugcuucuuugugcacuucugauacugucuggauauugguauuauugcauuuaucaaauuguuuuauacuuauauguguacuuguuacugagacuguaugcuucuugaguguacacagucuauuuuauucaucuuuuuuguucucauaugaugguuauuauuacuuuuauuuaucagccagaagagacuagacaaguaauaguuagaagauaaauuauguuuguguuaauggacauuagauguagauguauaauuuuuuaaaauugauaauauagggcgaggcgcaguggcucacaccuuuaauccccacauuuugggugccaaggugggaagaucacuugaggccaggaguuugagaucagccuggguaacagagugagaccugucucuacaaaaaauaaaaauauuagcugggcaugguagcauaugccuguaguccuagcugcuugggaggcugaggcaggaggaucacuugagccuaggaguuugaggcugcagugagcuaugauuuugccauuacacuccacccuaggugacagagugagacccugucucuaaaaaaaaaaaaaaaaacaacaaaaaacugaaaccacacacaaauuugauaauauaguucacauaccauuaaguccuccacccuuuuaaaauguacaaaucaguguuuuuaguauguuugaaguuguaugccagcacuguuaucuaaauccagaacauuuuccucacuccagagagaaauccuguacccuuuuucuuuuuuuuuuugagacggagucccacucugucccccaggcuggagugcaguggcaugaucucagcucacugcaagcucugccucucguguucacgccauucuccuguccuagccuccugaguagcugggacuacaggcgccugccacuacgccuggcuaauuguuuguauuuuuagcagagaugagguuucaccguguuagccaggauggucucgaucuccugaccucgugaucugccugacuuggccucccaaaguguugggauuacaggcaugagccaccgcgccaggccauccuguacccuuuagaagucacucuucauucucucuucuugccagcuccuggcagucacuaaucuacuuuuuguguuuguguauuugccuaauauagauauuacauagaaauggaauaauguaauaugugcuuuucuuucacuuaguauaauguuuaagguuaauuuauguuuagcauguaucaguacuucauuccuuuguauugcccaauaauauuccauuguauggauauaccauauuuuauuuauccuuucauuaguuaaugaacauuuggguuauuuuuacauuuugucuguuaugaauaaugcugcuaugaacauucauauacauauuuuugcagaacauauguuuaauucuccugggaagaugugcaguuuuaaaauguacuaauuuacuuaacaaaucuuuguugaacaccugcugugggccugguacuguucuagguacaggaaauagaauagugaacaaaauauagaaaacuuugcccucauggagcuuacauucuaaauaaauccuaaaaacaaaaaguugaaguauaguaaguuagauggugauauguacuuugaagaaaaauaaagcacauaaaggcacaggaaaugcauaggaugggguaggaugcaguuacaaaugagaugggccaugccugucugaggaagugacauuugagccaagaccuggaagaggcgaggagugagcauguggguagcugagagaagagcagucugggcagaggaaaagcaagugcgaaggucuugcggugggagugugacuggugagcuuagagucaucaaggagaucaguguggcaagaguagaguaugaggaagaggaagagagagaggcaggagacaagaucagguaagcccaauuacauagcgccuugcaugaugguuaaagauaugggcuuuuaugcugagugagaugggaaaccacuaaagagaagagacgugauuugucuuggguuuaagaggaucacucugggcuguguugaaacuagaucagagauuggugcccuuucuugggucgcgugcccuuagugucuuauaacaaaacaguucuacuaggccaaaaacaguucuacuuacuaaguuguugaguccaaacaacuauguccuaacaacugaggggcuguuugagaaaaaguaauacuuucucuuaaauaacuacaauuauuuacuaauggguuauauguaccuuuugagcacuguaccacuucucaaagcuuggaaucaugugggacacaaucauucuuauuuccuguuccacacugauuuuccuccagaacuuguuuuuuuaaccuagcaacugcugaaaacccagccaugagaagauuugacauccucaaaaggaauguaauggaaucugacauugaaauugugaacuguccugagcuaauaguucaccagugucugauagauggcaggcaucacuauuucccuugaagauuuaaauuuuccccggugccccuguaaguucacuuuagugcccugaggugccucagcaaacaguuugggaacaguaugggacuagaguagguggccaaaaagcagaauauuacaugaggaguuauuggaauaguucaggugagacauggcagcuuggucuaggguggaagugggagagggugugaaaagugaucaaguuaugaauauauuuugaaggcugaccaaugcagucugcuaauuuauuggauguggagugaaguagaggauauuggaaaagagucaaggguaauuccaaaguuuuggacugaauaauuaaaaugaugaaguugccauuuaugagguaaacaaggcuugaggaggaauuuggcuuuauguaucuuaaguuugagaagucuauuucaguucuagauggagguguugaguaggccacuggauauaugagugugaaauuugggaaaaaauuugggcuggugguauaaaaauguuuacuauacuucauucagcaguacuguuaauaauauuucugagucuggcugcaccugacuuuuaucaaaugucuguaucucucuaagcauacaugagagauauauauaugcuuagauagaaguuuguuacuagcugccaucuuuggguuuucuuacuuuguuauuauuacagagugucagcaauuuacagaacucuccuuuuguuccuucuaccugcaaucuucucuacuucuaggaacauuuguguaacaccaauacauaacuuagaugagcauuaugugguagugaucaaaccugauguuuuuagaugacauacuuguaucauccuuguagagaagauuaagaacaaaacaaauucaucuaaccuucugggcaaucuguuugacuuuuacauguaagaauggaauucuaaacacugaacacauucagcucugugccagaaaguaaaucuauggguaugguauuuugugggugaucuuuuaaauauagaaaaaaaaaaaccuuauguaauauuaaaaauauauauauauacacacacacauauagacaaagaugagaauaucuauauacauauauaaaauauaguguuaucucucucaugcacguauguaaaaaucaaguuguaauuaauauuuauauuaauuacauacagaauuuugugcuguucauguuuaccaguuuaaaugccuggguaauauucauuguuuccuccaccucauguaucugugucucuuggggguaguuuaagaguuaguugaaacaucuauaugaagagguuuuguaaauggaaagcccuguagaaagguuaauucuuauuguuauagcaggguauuuauuaauuacuguuucaugauuuacuuaaccauuucccuaucauggaacuauuagaauauuuauaauuauaaauagcauugcuuuaauuugaagucucaaauuccugaaguauuuaaaaugaugauauuauacauacauauccuuugauauguauugauaugauauuaaacacacguauccuuugugugguuugcuuucuagguggugguuugauguuugauaugcuaauaauauuauuucauauguuuuccuccccaggcaagacuucagcaguacauggucacaacagaugagcaacugauaucacucacacaugcuauuaagaacuguccugugauaaauaacagacaagaaauucaggcaucagaaagcggagccacagguagaagaguuauggacaguccaggugaguguggucuuacucucucagacugucauuagacuacuuaauggccuuagauaacaaaccaaaccuuaaaucucuaaacuuauauagacuuauugacuguuuaugcauguacaguauugucacuacuacaguugccacuacuuuuccagcuaauauuggaugcaugcucuaugccagauacuuguuaagucuuacaugcauaauuucaauucgugucauaauagucugaugagguagguguuauuguuauccccauugguguuauccuuagaggaaacaggcugagagaggguugguaacuuagcaaagucauacagguagaaaguagcagaacuggacaccuagaccaaagagagugcuagcacuuuuaaucccagugcucuagauuuagaagagaugguuuuggaaagagaaaaauacugaguuuuagaaauucauaacuuuuguucaugugugauaguguuguuauuuugaaauucuuccuucaucucaugugccaucauaugcuauaggcugaauuggacauuuugguuuuuucauguguuuuacuuuuaaguaagacuuugaugaguaucuguaagaaaaguguuuuauguauuuaaaaccguuuucuuaggauggauucuaagaaguggcugaccaaaauuuaacuugcaugagguaaacucauuggcuagggcacaucucugucuucugguggagucuugcuauuuuuuuuuuuuuuuucuuuuugagauggaguuucgcucugucacccaggcuggaguguaguggcgcccucucggcuuacugcaaccuccgccuuccaguuucaagcgauucuccugccucagccuacugaguagcugggauuauaggcgccugccaccacaccuggcugauuuuuguguuuuuaguagagacgggguuucaccauguuggccagccuggucucgaacuccugacuucaugauccgccugccuuggccucccaaaguguugggauuacaggcgugagccaccgcaccuggcaagucuugcuauuaauaucucagucaaggaauauguuaguguuuuacuauuaucugaauuaagcuucacuacugagaaagcuuuuaauuauccuauagguaagaagggcugggaguaaauauauuguagaauuauuguuuuuuuuuguuuuguuuuguuuuguuuuguuuuuaauuuuuuuuaguauuuauugaucauucuuggguguuucucggagagggggauuuggcagggucguaggacaauaguggagggaaggucagcagauaaacaugugaacaaaggucucugguuuuccuaggcagagggccuugccuccuuccgcaguguuugugucccuggguacuugagauuagggaguggugaugacucuuaacgaguaugcugcuuucaagcaucuguuuaacaaagcacaucuugcacugcccuuaauccguuuaacccuuaguggacacagcacguauuucagagagcaggggguuggggguaagguuauagauuaacagcaucccaaggcagaagaauuuuucuuaguacagaacaaaauggagucuccuaugucuacuucuuucuacacagacacaguaacaaucugaucucucuuucuuuuccccacauuucccccuuuucuauucgacaaaaccgccaucgucaucauggcccguucucaaugagcuguuggguacaccucccagacgggguggcggccgggcagaggggcuccucacuucccagacggggcggccgggcagaggcgcucuucaccucucagacggggcagcggggcagagacgcuccccacaucccagacgaugggcggccaggcagagaugcuccucacuuccuagacgggaugauggccgggaagaggugcuccucacuucccagacugggcggccgggcagaggggcuccuuacaucccagacgacgggcggccaggcagagacgcuccucacuuccuagacgggguggcggccgggcagaggcugcaaucucggcacuuugggaggccaaggcagguggcugggagguggagguuguagcgagccgaaaucacgccacugcacuccagccugggcaacauugagcacugagugagcgagacuccgucugcaaucccggcaccucgggaggccaaggcuggcagaucacucgcggucaggagcuggagaccagcccggccaacacggcgaaaccccgucuccaccaaaaaauacgaaaaccagucaggugugguggcgcgugccugcaaucccaggcacuuggcaggcugaggcaggagaaucaggcagggagguugcagugagucgagauggcggcaguacaguccagccucggcugggcaucagagggagacgugcaaagaggagagggagacgggagagggagacgggagagggagacgggagagggagacgggagagggagacgggagagggagccagaauuauuguuaauucuuguuauugccuguggaaaaagucagaaagauuuauguuggugagaccaaagauuuauguaauaucuuccugagucucagcucuuguaacucuuuuaaaauacuauggaaugugacuauguugugauaaugcaugaccugugaaguuccuuguuuuguaaugagccuuauauauggaggucagugcauuaauaugacccauuuuagccauuuuguuacuugugaugaccauuaaaaagcuauccauaacaaauaaugaaaaauucuaccagccuaggcagcauggugaaccccgucuuuacaacgaauacaaaaaauuagcugggugugauggugcaugccuauagucccagcuacucgggaggcugaggugggaagaucacuggagccugggaggucgaggcuucagugagccaagaucgcuccacugcacuucagccugggugacagagugagacucugugugaaaaaaaggaaaaauggaaaagacaaacucuggaaugccacauaggauuuuuuaggagucccuaacuggcucgcuuuucauggcuuugaggccuuagugauuuucucaaaaauaguaacuucucaguacuagccccccaggagccugcccaugaaugauuggcagaggaggauacagccuagaaagugaaggcuccaggagcuauguugauucauguggauuuugcacucuacugagaugcauuuaagaauaaauaccugaaaugugcucauaguuucuuuuuguuccuauuguacuaauauccucucaucuucuucagagcguccaguuguaaaugccaaugucucagugccauugauguucagagaggaaguggcugaauucccacaggaagaguugcccguuaaacugucucaggugccagacccuccagauaacaugaaucuggccaagaauuuuccagcacauauuuuugagccagcuguguuguuaacaccacccaggcagaagagcaacuuaaaauucucuccucuucaggacgguaagucuucuucuaaaguuacaugaaaguuguuuuuuaauguuucauuugugcaauguauuacuuucaccauuacaugaaaaacagaauugaaaaagacacugauuaccacacauagccuuuaagcugaaggaagaauuuucaugcuauguguaucauaccuguggucaugugugacauuuaauuaauuuuauuguauaucuauuuuauuaaacauuguaaguauuaaacucagaucaaaagaucagaguccuuagcauuaagaugcagaguaaggggaaucccuuuugucccuaugguccaggagcauuucaaagaguuagaagcaggagauuauacuccaaagaguaaugaaaguuagacuaaggaaaggugaaaacugugacuuuaagggucuuguaagugacaucuggucauuauauucaccucuuucucaucaaaaguuuucagcucaguuaguugaggcaauuuuauaauaaaaguuaauggacaauuaaaaauagcuuuagaguuacucuugcagcucacagguagaguuuugaauaaacauguuaagaauauauuauucuuagcucaaagauucuuaacuuaggguucaugaauggucuucagaaguuccauggacuaccucauuguugggaagauuaaauuuauuuguccccauguacauuuuuucuggagcuauuguuuuuauuucauuuuuaaagaggucuuuagucaaaaaaagaaccaccaucuuaaacucucuuccaaaguuuuuugaaaaauauuauucaggucugauuagccugaauuuuuauuucuuugacaaguuuuuuuuuuuuauuuuuacacaggggaacagaaaaauaacuguuuauuauuauugggacauacaaauuuugugcaauuuucugcacuuugauguauguuuccaauaaaggacacgaagaagcccagggguuaaagaaaauggcaaauccuugcuauuaaaaauucuguuuugguauuuauaaugcagauguagcauuugucagaucaguauggugcaauggugacagugccaggcugagagucagacgugcugguaucuuggcccguuuauuguugacuagcugugaggcaugaggcucagauaguuuaccuuuucuagaccuaaguuuuuccaucuaugaaaugagaagauauuucuuuaucuuuaauguucccuccagcucuaucauuguaugauucaguauuuccucuucagagggcuucaguuacaauaaauauguuuacucugaucacaaccguacuaaaugcuuguuaaagcaaauuugucagggauugcuauagacaacauuuuguuaauaucuucagcaaguuuguauuuaaaauaacugcccauuuauuuuauaaugugcagacagcugcuugugaauauguauuugaauuggugauguuuuauuauauuuuucaagcauuguuuggaauacucacauauaaagaauuauucaguuaaacagaauaugcagaugaaaaugggugauacauagggcccuucaucagcauucaguucucuuuuaggauagcuuugucuaauagaauuuucuggguugaugaaaauguucugugucugcuccauccagaaugguggccacuggcugcauggggcuagugagcaccugauauguggcuuaugugacugagaaacugaauuuuaaauuuuauuuaauuuuaauuaacuuaaauuugaauagccacauauagcuagaggcugccauauuggacacuauugcuguagaauuucccaucauaaauauuuuccucuagcuauugauuuauuucugcuuuucuuuacagccaugcuucuugaacgaguagugggugugugugucuguguguauuggugugcaguuucauuucauuuucugaucucccauucauccuuuauuuuaaagcguucauucgaauucauauuuguauaugguuuuuuaaaaaguacugucaauuuaacccagagaaaggcucucuaaaagaaacugauauuuauuugagauugagaauugcaaugggaauauggugggcauauucagggaaguaaaggaagacaagaguuuuuaaaggggaaaugaggaggauuauuuaaguuguuuugagauaacuauccuuggcuacaaggaucaauaacaaggguggcaucagucuaagguuggauaggcagauguugggcaaauguccucgcagaauuauuuuuuguguaagauugugguguccuuugugcaagguucugguuuuugaagucucuugaacaguucuuguuaucagucauacaugccugagaacccuuccuuccuggcuuuuuaaggcuccacuuaucagucacuugugucugauaaagugacucugauaaagucacuugcgcucugacacaaaugucugauuuuuuuuuuuuuccuuugagauggaguuucgcucuugucacccaggcuggagugcaauggugcaaucucagcucacugcaaccucugccuccuggguucaagcuauucuccugccucagccuccugaguagcugggauuacagccgugcaccaucauggcuggcuaguuuuuaaaauauguauuauuaguauagacugaguuucacuauguuggccaggcugaucucgaacuccugaccugaggugaucugccgaccuuggccuugcaaagugcggguauuauaggagugagccaccgcgcccggccaaaugacuccauuuugauucugacagcuuucacaguacauaccccuaaaggcagucauuuucugccuguaauguccuuugcucaguuccuauuacauauguaaucauuuaaaaauuuuacuuccucagagaggccuuuccugguuaucugcuguuuaaauuggguacuuauacccacuuccucauuccccaagauucccagaugugaguuaauauaugcguuaaaaugugaacuugacagaugguuuuucacaaggguacuaacaaaugcuuuaaggaauguaaaaagucucuguacuugauuacgaggggcggcauugcugguguguucucugcugaaaauaguuuaagcauucagaagccaaacccuucuacugaaauacuuuucuaacuaccauggugggcuaaugaaaugaguauagugccaaucuaugggaaaauaauacauauuuguuauuuuuaaauucuuaucuauaguauugagaaggacuguucaaacucguccugcuccacgacuuccuccaacuguggaaauaauugagaaggaacaaaauugggaagagaagaccuuaccuauugauacagacauucagaauucaagugaagagaaucgucucuucacucagagauggagagucucucacaugggagaagauuuggagaacaaaacucaggcuccuuuuguuaaccucucacagccccucugcaauucccauuccaacacucaacagucaagaagccccacauucucagaagagcucccaguacugggagaugggcagcagcugagaacaaaugagucauuaauacaaagaaaggacauaaugacacgaauugcugauuugacauugcagaauucagcuaucaaggcacauaugaauaauauuauugagcccagaggagagcaaggggauggacuccgggaguugaacaaacaagaaagugcaagugacaugacuucugugaguaccauuuaaggauugauuagggacauauaggaauuuaaauaggaacuuuagcuugggcaacuuaagaaacuucuuuucagaagugauccuagaaagcuuugaggcuagauggcuuauguuuggcauguccucaauacaauagguccaaguuauuuaucagucuguuguacauacaauacaagacagcauaaaagggaaauuauauaaaugaaaauaggacaaagauaaaaugcguaggaaagcuaagauuaaguuaggaaugaaguuuuagguauaaaauauagaauuaauguuacuugaauguuugccacacagccacauguuaauugaaaauauuuuuauuuuuaaaauggcucauaaaagaguauuggcccucaacucaugaguaguuaauuuuugaggacauagaauggauuuuccuauagaaaugaggugguuuuuuuguuuuguuuuguguguuguuuguuuguuuuguuuuuuuugagacggagucuugcucuguugcccaagcuggagugcaguggcaugaucucggcucacugcaaccucugccucccggguucaagugauucuccugccucagccuccuaaguagcugggauuacaggcaugcaccaccacaccuggcuaauuuuuguauuuuuaguagagacgggguuucaccauguuggucaggcuagucuugaauuccugaccucgugaucugcccgccucagccucccaaagugcuggaauuacaggcaugagccacugcgcccagccuguuuuguuuuuuugagauggagucucacucuguugcucaggcuggagcgcagugacgcaaucuuggcucccugcaaccgccaccuccuggguucaagcgauucugcugccucagccucccaaguagcugggauuacaggugcguacuaccacaccuggugaauuuuuguauuuuuuguagaggcgggguuucgccauguuggccaggcuggucucgaacuccugaccacaagugaucuguuugccucggccucccaaagugcuggaauuacaggcaugagccacugcaucuggccagaaauaauguuuuaaaggauuauuaaagccagacuuuaauauacauauuaaucaucuggggaucuugcugaaaugugguuucugauugaguaggucuaggguaggaccugugcauuucuaauaaguucccaagugaugccagugcugcuagucugaggaccacgcuuugaguagcaaaggucugcauuuuauagugcaggaguuuuguaaguuaaauaaacuuugugggcuaaccugguaacuuaaaccuucauuucguuguuucugggggagauagggagucuaaauuccagcuagggaggguuuauaaaagagcuccaaaugcugguuccagugaugguagacacuuucuuuuaccccuucuagagccaaggccgcuccugucaaguuucugauaggaggagcugggcacugucacuggggauuagaagcucgugagguggcuguguucauaagggcuuuaacaacaguggguuggagggcuuuggugaggaagguuagggugaggugagucauaggguaagggccaucucugucagcacugggucauggggaauaaggacaauauggguauugaaucauagaaguagacagaaggaacuggcagaagaggagccagaaaggaauauugcuaguagggagcagccagccauugguagugguguauauaaguaaauaucaacugccucaauuuugagucacugggaggcauuuauauauuuguaguuuugaagauuauucauaacaggcaacucuugguuuaaaaaagacagcagagucuaauguuuugcuugccuccuuuucuaauuaguauguagaucaagcuggaagggacuaucuaauauuucugucuucacuacccucuuuuguuuuaauuggaaauacaaaaugaucuuuaauucauacugauuuuccuauuuauuuauuuauuuauuacuaauagacauaagcuaaaaaucagugauuuuuauuagggauuauuuuuuuccaaagagaaaugaaauaacuaggacugaaauaaugacauaauuaggaauaaugaaauaauuaggaaugacauaagcacauuuggggggggaauuuucaaauuaaauuuaugcuauauuuuuugggcggcuauuuuuuacccuaccucucauauuucuuuccaaucaccaacuauucuugaaucagauaccuuaggccaaaaguggcuuggggaggcugacauaugguuagaaggagugacaagauucccagaaucuuugccaaauggugcauauuugaagccuguaauuauagaaacuucuguuuccaagauagcagauccucuuuuguaaucugucaaacugcagaucugucuucaaagauguguggcauuuacuuagagaccagcucacuuggagcagucucuuugcucaugugaucuuuugugcagcucugcagauacuaagagauacagaaaagcuuuucccagaauauaugcuuaaagggacuguaaauucuauugugugcucacuauucacauuuauauauaauaagggcuaugaauacuaacuugcuggccauuaguaagucaaaauugugugagaucgagguggguggaucacgaggucaggagauggagaccauccuggcuaacacggugaaaccccgucucugcuaaaaauacaaaaaauuagcugggcgugguggcaggugccuguagucccagcuacucgggagacugaggcaggagaauggcgugaacccgggaggcagauguugcagugagccgagauagcgccacugcacuccagccugggcaacagagugagacucugccuaaaaaaaaaaaaaaaaucgugggagagauuuuucaguauucaguauucaauuuguacuuuuuuuuuuuuucucccaaagacuuuuccaguagcacagucucuaacaccagguaguauggaggaacggauugcagaauugaaucgacaaaguauggaggcucguggaaaacuacugcaguugauagagcagcagaaacuuguugguuugaaucuuucuccaccaaugucaccuguucaguuaccucucagagcauggacugguuggucacaaauucaugauuuaaaaacuagaaauaugaagguuuucaguuuucuugauuuugcaaguuuauauuaagccaaaagaaguaucagagcauauauuuuggugccuucaauuuugcacagaaagaaauagcccuaacucacaggauaagugacagaaaugggauuagaaggcagaucuccugauuauuucuauccuaugaugccuauaguuaaucuuuggugucugaguuccuaaauuaucguacaucuaaaugggauucauuauaguguacgguucacuuaggucauaugcugcaacuaagcaugaaauaucugaauguucauuuagaauuucaucagcaaugaauuacaaguuauuauucuguaaaacacuuaaaacauuuucacucaauuaaauuuuuuguuacauuuaggaaugugaaaagcuagaggggauucugaauaauaaaauaguaacugaaaaaauugucauaguauucacauucaaaaagauacugaugaaacgaaguauguaucaaguugcuuuuuaucagaaauugcauuauuaaggcccucaagggacagcuacaugaagaguacugagagauugauuuuggcccaguaaaagagaaggcucuaauugucaggaauagaaaaagcuccauguaccaguaauugauguguucucugagauguucaaacauugguguuugaaggggacucauaugucuuauuucugguugaaguagguuaccuuuaagauaccuuccaauaagacuuuuccccucagaaauuauuuccuuuuugaaauacagacccagaaagcagacucuuuuggaaauugcuggaaaaagaugguaaugcauuuccccagggcucucuguuuauucuaggcuuccucaaaugacaguuuugucuacuguucuucauaguuaugaagccuagagacaacuucugauuagaauaaauaaaucaauuaacuauauaugaacauguacuaugugcgaacauguacuaugugcgaacauguacuaugugcgaacauguacuaugugccugccaugugugggcuugaauacucuagcauuugaguaggggagcaggcaacaaacaaaucaauauuugggauaauaucaguuagugcuaagugcaaggaagaaaaauaaagcagaucagccuuaagaauaauuuuguguuuaaauauacaucuuccauuucaguauuuguguaugguuaaaauaugcuuuuauuuauguuauguaauuuaguccucaacauacuuuaagaggagacagggcuaauauuauaccuauuugaugaauaaguaaacugagguacaaagagguuaugugauuuaucaaguuacaaagcaaguuguggauuugcaacugcguucuuuccuguccagugauuuaucucuaaaguauucuuuuuauaaguaaaauucuuauauuuguuuaaaaaaaagcugcuguggacuauaaugauaaaaauaaaaauaaaccauauaucaugaaaaaccucuuuuguuuucuaggguaacugaggaauauuuuguaaaauuaaauaggguuuuauuaccuuguaaagccaggaagucacacaaagucaggagccucugugaaacugccugugaugaacauuaagucuuucauuaguaaauacuuaguaaauaugcugauugauuaccuacuucugaaauauggaaaauauucauaauuauacuugcuauuggccauauggagcucuucagccaacuuuccucuccuacuuuaaugucuucaguaauagucauaauguaaucgauuuaaaagauuuaaaguuuuacugaaugacuucagaaauuuucuuuuuccuuuuuuuuugggaaaacuuuagguaagcucuuuuggacaaagaucucaagcucuuuagggcuagcucuuaauuccuguuuuucaccuccagagcugacaugaugccacuugucugaagauuuuggcucucuaugaacuggcaugcuacugaauuaacacuaguaacuaaaguuucuuaucccacaguucaguaaaaaaaaaaaaaagucuuucaaguguaucuugggcuaagauuaaaacagauggaaagaaccaccaaauuuuuaaugugcaguuugcaguaagauagaaauugagugaaauuuuuauuucauugaaagguaauggaacuaauauuuauuuuuauauuuuagaaggagcaaagaggacaauugagguaucuauuccaggagcagaagccccagaaagcucaaaauguaguacugucucucccgucagcgggauaaauacaagaagguaaguugcagugugaauauuuauuuaaaaaaaaaaaucaaaaagaauuugguauguauuuuauucucuuugugaaaaaaggaaguguacaguaucugacuuagguugagacagacucaugcaaagagaguaaaauaauuggaaaagagaauuuugaggggaaauggagugaggaauaaacuuuaaguagaaaggcauggguuugcuacugaaaacaaaagugagauaacacguauguagaguacuuacggguuacaaaauuaggagaugauguaugacaggacagcugaauugaccaauaguauuuuccuccuucacaguaaaugaaacugaagcucuccgaguuaauugggugauuugucuagaugggucauaugauugguaaauagugacacuaaggacauaccuggccuuucugucucuacucugcauccuuacuauuguacugugcuguuccaggucguguuacucuucuacuaccuggaccuuuuuccccaucccugcacguucuuuuucucuuuauuauugaaaauuuauccauauaauauuguaaugccagauacaugucauuauacauuugugaaaacccacagaauguguaacacagagagugaacccugauguaagcuaugaacuucagucaauuauaucaacauuagaucaucuguuguaauagauuugucacacuaaugcaagaucuuaauaauaggggaaacuguguguguguuggaggugggggguaaggggcauaugggaacucuguacuuuccacucaucuuuccauaaaccuaaaacagcucuaaaaauuaaauuauauuuguauuaguccauuuucauguugcugauaaaaacauaacugagauugggaagaaaaagagguugaauuggacuuacaguuucacauggcuggagaggcuuuaaaaucauggugggaggcgaaggaaacuucuaacaugguggcagcaagagaaaaugaggaagaagcaaaagcagaaaccccugauaaacccaucaggucucaugagacuuauuuacuaucacgagaauagcaugggaaagaccggcccccaugauucaguuaccuccccaugagucccucccacaacaugggcgaauucugggagauacaauucaaguugagauuuugguggggacacagccaaaccauaucacuauuaaugaacaaauaaagacuuacagguuggugaaaauaaguuacaaauaauuuaccucguuggaccuaaguuagccauauguuuucaagcucuugccaguauugagaauugucaguuguuugcauaaucuuuuaagguuaauaaugauagcucacucucuuacucuguuuuauuuuucaugaauagaucuuccggggcuacugguaauucuuguucuccacuaaaugccaccucaggaagugggagauucacaccucuuaauccaagagcaaagguacacguuaaaauguaauugugaaaugcauauaggggugaggguagaagguggcugauuuagugauuuccauucuuaauuaucauuccuguuauccuaaagcugguaugauauucuuaaaagaaaagaaauacuaauuuaccuuuuuaggaaaaacaagccauauacuucuucuguuuucuaggguaacuaaggaauaagguaaaauucaauaggauauucaacaguccuuaaagacuggaaauuacugguuucagguagagcuucccauauauuuacggcaggacacacaggugugccuugaauggguuguagaucuacugagcuauugguucccccaguccuugugcuuggguggggucugggacagccagagcacuggguccagucacuuuuccucucauuuuaucccugugugccauaucugacugugccauugguuagauagguuaugguaccagggaaaaauaaaugucuuaauguguucuucauguauuuugaugugccauagguauguauagaagcuaagcauuucacaguauauucaaaauuuuugcagaaggcauuuuuucuguggugcuaguacaguaaaauauaguuccuuugagugguuaugguaaauugugaggauaucuuuaaaauuguaaaaguuaauuuuguagacuugagccaauaagugucugacauugggaaaaucuuugcauuucuuauuacugaguucaguaauuagaucaaagagugggugcuuauagcccaaauuaaaugauaggggaaagauauuaaaugauaggggaaugauagauacccgaauuguccaguucuaggagauuuguucuuugcuacuucuuauauucuacaaaagcuuuaaaguaagcuaauuuauauaaauuauucuuaguuccuggaauuuaguagcauuuaauuuacuaagaccaaauaacugccuuuuuaucauuuuaaaaauuuaugccuaugauagcuauaaaacacuggacuuaaaaaaauuaugacuccuaaaucaguaagaggaucuguugaccaaguaaucaguuauuugguaguaucucuguuagagaauuaacauugccaauaacaauuuaauuuccaguaccauucaauggcacaggaugacuuuguuuuaugcacuuggucuaaaugaucuguaaaucuugaguagucucauguuucuaauuaccaucuaaauuuuuuccgugucuuuguucaacagauugagaaacagaaugaagaaggcugguuugcucuuucuacccauguaucauaagugaagucaagucucacugaguuuguucuuaauaauuuauuacuucccuuucccugcucugacuuuuaaguuuuuauauccuucuuucagauaaaaccuacaaagauccugugaauuaguacuaaugaaacagagaaauaaagcaauuauuuuuugacuuucucaaauaaguuuucaacaaccaacugaccuacagcucccugugaaugaaacuuugacuguagagaaguuaaaguuuuguauuuuaauacuuucuuaaguauuuuaaggguuuuuuuuauuaauacauuuuuaccuuuaucuuuauucaggguuuuuugagguuuaguauaucuuaguugauccauuuauuuauuuauuuuccugaagaacuaauuugcuuugcauguaacuuacaauaaaauuccucugugugauuagagucuggcuuucaggaauauguaacacccacuuuucuuucuuuuuucuugggaagucauugcuguucaucacuuuuuccaucaagugaaauauacagccuuaaaaacaauaggccugggaguguuuguuuauauuugcuuaagcagguaagagugguugcauuuauuauaaaaucuuauguaguuuuuaaaugugaaaaugucaucaauaaugguaaugcaaaucaaauaaauaugauucuagagcucaaaugccuaaaugugguaacauugauuuaaugguauauuuaaugcuucaaacaauuaaauagaaaaaguugcuauuaauuuucccagcccugaauuuaagcagaucuuucaggguagauuucucuuuuuuuuuuuuuuuugagacagagucuugcuuuauugcccaggcuggagugcaguuguauaaucugguucacugccaccucagucuccuggguucaagcaauccucuuaccucagccuccugaguagcuaggauuauagguucaugccaccacgcccagcuaauuuguguauuuucaguagagacgggguuucaccauguuggccaggcugaucucgaacuccugaccucaaaugauccaccugccuugguuucccaaagugccgggauuacaggugugagccacugcacccggcucaggauagauuuuucaggguacccuuuugguucugagauguuuauuucuauuuuaaacuuguuuuuugaaugaucucugcucccuggcucuaugauaggaauucucaaccugaguga

SEQ ID NO: 18120 - RNA, 918 nt, Homo sapiens
cucaccucuggccgcggaagguccggggcguggucgauacggacggcggagcugacguagucgaugcgguuccguucaguggccgugaagauguuguccgcccuggcuauguccuccgggcuugggucaaagauacgcaggugaaggucuugccucccguagggggcgaggaaccgcucuacuuccugcagcggguacagcagcuuccucagcugcugcuucggcagccgcagcaccucagcaaaagcuugggacgugcuauuauagcggcucagucgcucuagcaccgcaggcauuucaaagagucuucccgcucccagccgcagcccgggcgccgccauucucccuucccagaagacgggcagagagauuuuacuccuguggccuggguugcgcgugcgugacuucccgcugccgcgacgccugcugggaguuguugucuccucuggccucgcucguuccggucuaaguguuuugccuucagugcgcgggaggaggguggaggcaggcggugaccugcggggaacagcucacuggguuucuuuaacaccgugggcuuaacgauuaugucuuacuggaaggauguuuaacgguuugcagaggugaaagaccuaucuggccauguggccuuugagucucaagcgaaggacuaaagugugaagcuccgaugcauuccaggaacguuugauuuucacaguuuuugguuaucuuauuaacuguugacguuugucguaaguccgcagcacuaggauaaacacuuuugcaaaaaagaaaagggcugaugagaaaugugauuguaauagcaccucguuuucguggaagggacuguuuguauuuccgccuucacuauaggugcaggaaaugucauuaaauuuuagagauuucuuauaaaaacaguuuugcacagauguuacagaa

SEQ ID NO: 18121 - RNA, 3070 nt, Homo sapiens
aacauuucugggacugaauccaggcaagagaaagaagaaaaagaagaagaaaaagaggaggaaaaagguagggagaaauaaagggaggagagaagcacagugaaagaaaaaaaaagucccuuuucgacaucacauuccuguguuuucccucagccuggaaaacauauuaaucccagugcuuuuacgcccggaaacaaagagacuaagccagacuaugggggaaagggagauaagaaggauccuggaacuuuaaagagggaaagagugagauucagaaaucgccaggacuggacuuuaagggacguccugugucagcacaagggacuggcacacacagacacacgagaccgaggagaaacugcagacaaauggagauacaaagacuuagaaggacagcuccuuucaccucauccuacuuguccagaagguaaaaagacacagccagaaagaaaaggcaucggcucagcucucagaucaggacaggcuguggaucuguggcgguacucugaaagcuggagcugcagcacaccccuuuuguauugcucacccucgguaaagagagagagggcugggaggaaaaguaguucaucuaggaaacuguccugggaaccaaacuucugauuucuuuugcaacccucugcauuccaucucuaugagccaccauguaaguguguaaucuuuucugucuuugaucuguuuauuuguuucuuuauugcuuauuuugaaggaaugaaaugugaauguugucauaauuaauaugcuaguuugcauuuucuuuggagcauccagagcauuaguugaaacaguacaagcaugcugacugggaaacugaauuggauuuccugcuuaauguaacugucucuguuaaacacuaacaaauuauaggggauugaaaguaacaggaucucaucccauuuuccaucuccugaccucccuccuucucucuaaccaaccuuuuccccuccccuuggcugagauacagaaaaagaaaaugaccagcucuguuuccagauaaauaauuuucuuucuuuuuucccccuccccuuuguuuuaugaccuccgugcaucgcaaaguggauuacacaaugacauggagaaugggaccccguuucacuaugcuguuggccauguggcuaguguguggaucagaaccccacccccaugccacuauuagaggcagccacggaggacggaaagugccuuugguuucuccggacagcaguaggccagcucgguuucugaggcacacugggaggucucgcggaauugagagauccacucuggaggaaccaaaccuucagccucuccagagaaggaggagugugcccguguugagacuagcucgcccaacagagccgccagcccgcucggacaucaauggggccgccgugagaccugagcaaagaccagcagccaggggcucuccgcgugagaugaucagagaugagggguccucagcucggucaagaauguugcguuucccuucgggguccagcucucccaacauccuugccagcuuugcagggaagaacagaguaugggucaucucagccccucaugccucggaaggcuacuaccgccucaugaugagccugcugaaggacgauguguacugugagcuggcggagaggcacauccaacagauugugcucuuccaccaggcaggugaggaaggaggcaaggugagaaggaucaccagcgagggccagauccuggagcagccccuggacccuagccucaucccuaagcugaugagcuuccugaagcuggagaagggcaaguuuggcauggugcugcugaagaagacgcugcagguggaggagcgcuauccauaucccguuaggcuggaagccauguacgaggucaucgaccaaggccccauccguaggaucgagaagaucaggcagaagggcuuuguccagaaauguaaggccucugguguagagggccaggugguggcggaggggaaugacgguggagggggagcaggaaggccaagccugggcagcgagaagaagaaagaggacccaaggagagcacaagucccaccaaccagagagagucgggugaagguccugagaaaacuggccgccacugcaccagcuuugccccaaccucccucaacccccagagccaccacccuuccuccugccccagccacaacagugacucgguccacgucccgggcgguaacaguugcugcaagaccuaugaccaccacugccuuucccaccacgcagaggcccuggacccccucacccucccacaggcccccuacaaccacugaggugaucacugccaggagacccucaguuucagagaaucuuuacccuccaucccggaaggaucagcacagggagaggccacagacaaccaggaggcccagcaaggccaccagcuuggagagcuucacaaaugccccucccaccaccaucucagaacccagcacaagggcugcuggcccaggccguuuccgggacaaccgcauggacaggcgggaacauggccaccgagacccaaauguggugccagguccucccaagccagcaaaggagaaaccucccaaaaagaaggcccaggacaaaauucuuaguaaugaguaugaggagaaguaugaccucagccggccuacugccucucagcuggaggacgagcugcagguggggaauguuccccuuaaaaaagcaaaggagucuaaaaagcaugaaaagcuugagaaaccagagaaggagaagaaaaaaaagaugaagaaugagaacgcagacaaguuacuuaagagugaaaagcaaaugaagaagucugagaaaaagagcaagcaagagaaagagaagagcaagaagaaaaaaggagguaaaacagaacaggauggcuaucagaaacccaccaacaaacacuucacgcagagucccaagaagucaguggccgaccugcugggguccuuugaaggcaaacgaagacuccuuguaaguagccuucuccuuggcauucuucuaugggcugaggcagggcauguuaacgucugucuuguuaguuuuguaaaaaucauauugcuagaugccagacugugacu

SEQ ID NO: 18122 - RNA, 3070 nt, Homo sapiens
agucacagucuggcaucuagcaauaugauuuuuacaaaacuaacaagacagacguuaacaugcccugccucagcccauagaagaaugccaaggagaaggcuacuuacaaggagucuucguuugccuucaaaggaccccagcaggucggccacugacuucuugggacucugcgugaaguguuuguugguggguuucugauagccauccuguucuguuuuaccuccuuuuuucuucuugcucuucucuuucucuugcuugcucuuuuucucagacuucuucauuugcuuuucacucuuaaguaacuugucugcguucucauucuucaucuuuuuuuucuucuccuucucugguuucucaagcuuuucaugcuuuuuagacuccuuugcuuuuuuaaggggaacauuccccaccugcagcucguccuccagcugagaggcaguaggccggcugaggucauacuucuccucauacucauuacuaagaauuuuguccugggccuucuuuuugggagguuucuccuuugcuggcuugggaggaccuggcaccacauuugggucucgguggccauguucccgccuguccaugcgguugucccggaaacggccugggccagcagcccuugugcuggguucugagaugguggugggaggggcauuugugaagcucuccaagcugguggccuugcugggccuccugguugucuguggccucucccugugcugauccuuccgggauggaggguaaagauucucugaaacugagggucuccuggcagugaucaccucagugguuguagggggccugugggagggugaggggguccagggccucugcguggugggaaaggcagugguggucauaggucuugcagcaacuguuaccgcccgggacguggaccgagucacuguuguggcuggggcaggaggaagggugguggcucuggggguugagggagguuggggcaaagcuggugcaguggcggccaguuuucucaggaccuucacccgacucucucugguuggugggacuugugcucuccuuggguccucuuucuucuucucgcugcccaggcuuggccuuccugcucccccuccaccgucauuccccuccgccaccaccuggcccucuacaccagaggccuuacauuucuggacaaagcccuucugccugaucuucucgauccuacggauggggccuuggucgaugaccucguacauggcuuccagccuaacgggauauggauagcgcuccuccaccugcagcgucuucuucagcagcaccaugccaaacuugcccuucuccagcuucaggaagcucaucagcuuagggaugaggcuaggguccaggggcugcuccaggaucuggcccucgcuggugauccuucucaccuugccuccuuccucaccugccugguggaagagcacaaucuguuggaugugccucuccgccagcucacaguacacaucguccuucagcaggcucaucaugaggcgguaguagccuuccgaggcaugaggggcugagaugacccauacucuguucuucccugcaaagcuggcaaggauguugggagagcuggaccccgaagggaaacgcaacauucuugaccgagcugaggaccccucaucucugaucaucucacgcggagagccccuggcugcuggucuuugcucaggucucacggcggccccauugauguccgagcgggcuggcggcucuguugggcgagcuagucucaacacgggcacacuccuccuucucuggagaggcugaagguuugguuccuccagaguggaucucucaauuccgcgagaccucccagugugccucagaaaccgagcuggccuacugcuguccggagaaaccaaaggcacuuuccguccuccguggcugccucuaauaguggcaugggggugggguucugauccacacacuagccacauggccaacagcauagugaaacggggucccauucuccaugucauuguguaauccacuuugcgaugcacggaggucauaaaacaaaggggagggggaaaaaagaaagaaaauuauuuaucuggaaacagagcuggucauuuucuuuuucuguaucucagccaaggggaggggaaaagguugguuagagagaaggagggaggucaggagauggaaaaugggaugagauccuguuacuuucaauccccuauaauuuguuaguguuuaacagagacaguuacauuaagcaggaaauccaauucaguuucccagucagcaugcuuguacuguuucaacuaaugcucuggaugcuccaaagaaaaugcaaacuagcauauuaauuaugacaacauucacauuucauuccuucaaaauaagcaauaaagaaacaaauaaacagaucaaagacagaaaagauuacacacuuacaugguggcucauagagauggaaugcagaggguugcaaaagaaaucagaaguuugguucccaggacaguuuccuagaugaacuacuuuuccucccagcccucucucucuuuaccgagggugagcaauacaaaaggggugugcugcagcuccagcuuucagaguaccgccacagauccacagccuguccugaucugagagcugagccgaugccuuuucuuucuggcugugucuuuuuaccuucuggacaaguaggaugaggugaaaggagcuguccuucuaagucuuuguaucuccauuugucugcaguuucuccucggucucgugugucugugugugccagucccuugugcugacacaggacgucccuuaaaguccaguccuggcgauuucugaaucucacucuuucccucuuuaaaguuccaggauccuucuuaucucccuuucccccauagucuggcuuagucucuuuguuuccgggcguaaaagcacugggauuaauauguuuuccaggcugagggaaaacacaggaaugugaugucgaaaagggacuuuuuuuuucuuucacugugcuucucuccucccuuuauuucucccuaccuuuuuccuccucuuuuucuucuucuuuuucuucuuucucuugccuggauucagucccagaaauguu

SEQ ID NO: 18123 - RNA, 30145 nt, Homo sapiens
caguguuacgcuuccggaaggaggggagaagcggcuuaucccgccccagcccggccccuuucucacgucacgugccgggagagucuagugucacgugaggccccgguggcggcgcagcuacggcaagagagugagaaggaagggaagccggaaggggcgcgagugaagcaaagcgaggacagacagcucgcagagggcgaggggugcgugugcguccgcuucucaccucaggucucccuucggccccgcugcccucccucgcggcugggugacagcuggguccgguccgucgcgggcugccuggggugcgaggaucgcgcaccccgucuucgcgcgcugugccugccgccccgcccccucgucccgcccgucccgucgcgucgcgucccguccccucgggugcugccagccgggugcugaugcgagucgguggcagcgaggacauuuucugacucccuggccccugacacggcugcacuuuccaucccgucgcggggccggccgcuacuccggccccaggaugcagaaugugauuaauacugugaagggaaaggcacuggaaguggcugaguaccugaccccgguccucaagguaagccaggccaggguugccgggagcugucaggcacaugcucgacuuuucagggaccaggcgccgcaggaguccccgcuuucuccggcggggcaagguguaggaaggcaguagggcucgagacacagggaagugugcagcccccacccguagucuuaaccggcuguucguuagggcuuucugacuccucagggguaaacuuggagcgacgcucugcguguuccugccuucucccgucauaacucugcgcggucggguacgucggguuggaaggguguucggaggcugaguagauugaagaacguuaaauccaaacacuggaagucuuuuagccuuuuuaagcaaggauuuugcuucucuuuaaaaaaugaauuuaguguuugacacacagaggucaaaagagaccugaggugaggucacuuuuccuuuaaguuucaugaaaguccgcuguaguggggaaguugugacugcgaucccaacucguuuagauuucagaggaaggaggugaaauuggcaacauuaucucauucaguaaccuugaacccaucuaacgagcaaaaccuuuuucccaagcuuuucagauagccguagcugguuauuagugauaacaaggcacgguuugaccuuccuggcuguauaauuuuuaaaaauauauuggcaacaguacagcauuuuuaaaguaaaaaauugugacacauuagcuguuacaguagugacugauuuuuuuuuuaaagguaaauuucuacaacugccuucaagcuuuucuuuuauaacucuuuuggaguguuuuguuguaacuucauuuuugcuuucugaaaagugagcaagaauaguaaauuaaugggaaguucuugcuuaguuuuuguuuuuuuuuucuaguuguuuuuaagcuuucaguuagaauguaccaaucucagugugggggugaaauaccuuaauaugcuaagaauaguggagaguuuugcuuugcucccuuuccaugacaaagggaaguacuaggucuauacuuuuuaaaauacguuuuuguaaagcuccuuuuaaaagaauaacuuauuggccaaguaagaaauaaaccagcgauuauaaaugagaauuucaacuguugcuuugcuuacauuuguuuacugugaaagucauuuuaagauuauucagucaaacuaagauuggaaaauaauuuucacauuugaaucaaaugcuuuuacauaauuauguuaacuuuucagaauaucauaucuaccuagguauacaguauuuuaauaauacaccauuguacaacuuuuuaguuuccgggagagaggagcaagagacugcccaaaugaaauauaaaauguaugauguagaauuauguuuucaggaguccaucauacuugcucaccaaacugaaaaggaacuguuggcaugucaguauguaugguauaugucuuuaguaaaaaggaaagaaugaaugaccgucuccuugauacuccugugcaaacuguuguuuacagagagaauccuuacaguuuccugcuuagggagggcaaggagaaagaacaaaauccucaggaaauaaguaauagccuucuccuagcaaguaaaaauuaagaaaaaucauguuuuguuuggaguauguacaugcaguaaacacugaaguucuuacaaucaucucuaagguucugcuuaauugguagaggccccaaucucaucugcuccauccccugacugcuguugcuuaagcuaaccugaucucuuuauuauucuguuaagcacacucuugguuugggguuuugcaugugcucuucccucuaucugaaacgcgcuucgcacuuaacagccuuauggcauguuccuuuccuuaagguuuuuaagucauuauucagugaagucuuuguucucuuaccauucuauuuuaaauggccaucucuccccagccaccccacagauuccucucagcuucauuuuucuuuaugguauguuauucauuaccauuuggcuuuucuuccucaacuggaguugaaacuccuuaugagggcaagaauaaauuuguauuuauguuauucacccccaaauauccccacugccucaaauagugucuggcacauaguaaacauuuguugaaugaauaauguuuauaaaugaguguuuucauuuuuguagacucuaccagaaaaucuuacauauaacuuaaaguuuagaaaaauuuagagaauagugugucaguaucuugguggagaugagaauuagaggaaaaugcuaaauaauuucuagauuugguuucuaacauuauucaguuuaaauaagacuggcugaauuguaagaugucuaaacaucuuuaagacauuuuugcugugcuguaaaauaaagguauuuguucauuucacagaaucacuguaaggcuuuauuuuuauuuaaaucuuagaauguuuguacauagagcuuggccgggcgcaguggcucacgccuguaaucccagcacauugggaggccgaggcggguggaucaccugaggucaggaguucgagaccagccugacaaacauggagaaacccugucucuacuaaaaaugcaaaaauuagccgggcaugguggcacaugccuguaaucccagcuacaggcaggaggcugaggcaggagaaucgcuugaacccgggagguggagguugccgugagccaagauggcgccacugcacuccagccugggcaacaggagugaaacuccaucuuaaaaaaaaaaaaaaagaauguuucuacauagagcuuuacucuauuauagcacugaucugauaguauuauaauuauuuucaugucuguuuccuacauuagacuuguauauuccuguggucauuaccagugagugaaacagauagauagauauagauagauaccaaugagguagguagauagguagauuagauagauuauagauuagauagauagacuaauuuuuuuuuguaugugcucuauugccuagaagggcaccaggcaaauaauugcccccaaaauauauuuaauugauagugaaacaugauauaauauuguuuuucuuucugcuuuuuuuaggaaucaaaguuuaaggaaacagguguaauuaccccagaagaggugagugcugaagauauacugaagucuuuuuauuuuacaauaauacuaaacuagguggcuuuucugcuucauaagaaaacaucuugaacuuuaauuuugauuugaguaaaauuagguuuuaugacugugauuuaugggaauuucuacuucccauagaagaaaagauguaacuuccccgucaguuugccacuucucauauuucucuguaguuccucuuuauuuagaaaugagggugaaagaagggaucaaaaugaguccuaugucacuuauccuugacuuguauugguguuauauugagcugugcaguaagcucuguaaugucuguggugucuugguucuguuuacaucaaaugugaguuuucaugcuuuucauuggaaaacuuugcuuacuacuuagauauuguuuucucuuaagaguucuauuucguugucgguggagaaguaaauacugggcuaaaaaccuuuucaggcuccaauuuuaugaauaauuaugguuuuaucagacuuagguuguucuuaauaagagacaauuuauuuaagcuugaauuuuuuuuuuucugccaaugaaaacaccacuuuuuggcaauagaacuuuauucacuguuuugaaacaaacguuuuaagccuuauuuuaugauaaggcugcugcuguuaagguccaagguguggagcuagagaauuaacugaucuuucaauuuucaguugugauggaauuugucuaguuccaaaucuuugugguuuuuuuaauuuuuuuuucuugagacggagucucccucugucaccaggcuggagcacaguggcgcgaucuuggcucacugcagccucugccuccuggguucaagcaauucuccugccucagccucccaaguagcugggaauacaggugagcgccaccacgcccagcuaaguuuuguacuuuuaguagagaugggguuucaccauguuggccagaauggucucgaccucuugaccucgugauccgccugccucgggauuacaggcuugagccacugcgcccggcuccuugugaguuuuaagaaugguuucugugcugggcgugguggcucacgccuguaaucccaacacuuuaggaggcagaggcaggcggaauacaggcuaacagggcgaaaccccgucucuacuaaaaauauaaaaaauuagcggggcgugauggugggcgccuguaguccagccugggcgacagaacgagacuccgucugaaaaaaaaaaaugguuugcauaacuaaucuuuucucuaaaauugucuuuuguuuuuggugaagacacaugguaguauggaaauaaccuaggagaccugccuucuagaccuauuucuguaauuucuuuuuuuuuuuuaauugaucauucuuggguguuucucgcagagggggauuuggcagggucacaggacaauaguggagggaaggucagcagauaagugaacaaaggucucugguuuuccuaggcagaggacccuguggccuuccgcaguguuugugucccuggguacuugagguuagggaguggugaugacucuuaacgagcaugcugccuucaagcaucuguuuaacaaagcacaucuugcaccacccuuaauccauucaacccugaguggacacagcacauguuucagagagcacaggguuggggguaaggucacagaucaacaggaucccaaggcagaagaauuuuucuuaguacagaacaaaaugaaaagucuacaaugucuaccucuuucuacacagacauggcaaccauccgauuucucaaucuuuuccccaccuuuccccccuuucuauuccacaaaaccgccauugucaucauggcccguucucaaugagcuguugaguacaccucccagacggggugguggccgggcagaggggcuccucacuucccaguaggggcggccgggcagaggugccccucaccucccggacggggcggcuggccgggcggggggcugacccccccaccucccucccggauggggcggcuggccgggcagaggggcuccucucuucccaguaggggcggccgggcagaggggcuccucacuucccaguaggggcggccaggcagaggcgccccucaccucccggacgggacgguaauuucuccuaaugaggaaaucaguuaaacuaucccugccgaggcuucauguuuccucaucuauaaaauaacgguugugggcuagacauucuguaaagauccuauucugccuuagguuuuauuaccucaaaugccaaauaaaacuaaguuuugauuuuaaggauaucauuaacauucuugccaaacagagguguaauuugaacauggcucuuuaucugaaaucaagagcggagaugaaaguaugcuguucuuauugcacucuuugguuuuauuuccucugugaagaugacuaauuguugaauauauaguugcaguuagagaugcaaagucuguggucauuggauagaauuaagcaguuucaaaacaggaauucauccuagaauaaauaacuguuacacuuaauuacaacaucaaucaauuuaugaauuuuccucucuaaaaaaauccaaggccaaauuagcccagcuggcugucuauuacauaaugcaggguugggauagagcacaauuacaggauugaguuagaguagaaugagccuggaggaggaaaugggaaggcaucauuugcuuuguguaaauauuauauacugaguugauuuguucauuuguuucaucuugcuguuucugaguuucugccagacaucagcuaucuuuuuguuuucauucagagguguggcaguauugugcuuaaaaagaggggcagcuaguaucugauacuguauugucaaaaaacaaagaaaaaacuaauguuggauguauguaugacuuguuuaaguagaauacuauuaauugagguuagcuugaggaauggaauugcucaccaagguguaaauauugauucuuguuggaguuggucaguauuauauacugauaauaaagauaauaagagaacauuuuuagucucuaagagaaagcuauugcaagcaauauugaucauuuagaaauuugaaucuugcaucauuugaacacgugaagcaaguuaugauggccauugcuaaugagggcagauguacacauguauuaucagugugagucuguguuuuuuuuguuuuguuuuuuguuuuucguuuuucuugccuccuaguguucuuguuuuuaaauagaagauacuauagggacuaugagauaaaauguuagucuuguuaccucaaggcaauacaaugaaagaauuuuuuauuuuuaauuauuuugcuuucauuuaguuaaauuauuacuuuuaaugguaauaaauuaguuccugauaaccacagagcuaaauguagcaucugguugcaaugagcucgaagugcucaaaauuuggggaagagacuauuguuuuuauuuugguuuuugucuuuacuuaggcuguuuaaauaauaagguuauucgaaguaaaagaacagaaacauaaaguuucuaucaggaauccaguugcuauaucuuguuaauguuucaucuuaaaagagguuauucuuagaauucuuauuugauagaauuauaugcucaaauuaaacuagaguauuuuauauaggcauacuuucucaaagguauuagagauuaaauauuuuguaauuuuuugcuguguaguaaacccaugaacaauacaagauuuuaagcuagagcuguugcaaaauagaaguaauuuggcaaguaugugggugucacaugcguccauguguagagaccaccaaacaggcuuugugugagcaacaaggcuguuuauuucaccugggugcaggcgggcugaguccgaaaagagcaaaggauggugagauuaucauuaguucuuauagauuuugggauaggcaguggaguuaggagcaauguuuugugggcaggggguggauggcacaaaauacauucucaaggauggggagaauuacaaagaaccuucuuaaggaugggggagauuacaaaguaccuugaucaguuaggguggggcagaaacaaaucacaaugguggagugucaucaauuaaggcuauuuucacuucuuuuguggaucuucaguugcuucagcacaucuagauguauacgugcaggucacaggguauaugauggcuuagcuugggcucagaggccugacaaugcacauccugcuugaguugggacacugcaguuaugcuuaacagacuuaaauuuucugcccucagaaauaagcaggauuucuguucgccaguaagaucagcucauguucguguaaacugauaauucucaaaugguuaaaguuuaucucccugaaucugguuuuuauuucugaagaaaaacaaaaacuuguacaauauucagcccgcuuaggaagucuaagguuuuuuagagagaauucaauuuguuaauuuuguagguguuuucagagugagaccaaaaagcuucuaacuuuuucccauuguuuuggcacugcauuucucuuuuagaagugcaaaaaagcuuucaaaaucacuuaaauuuuuaaaaauaauaaaagaggaagaggaagaagugugcccagugauauaauaaaguagacuuacauuauagacuuguaucuauuuaguaauuuuuuucagauuuuuauuguauuuucagucauuggcaagaaugugucuacauuuuuguauccuuaaaauggauuuugacaauuuaaaucugauagccuuacauuuaucaauuucauuauacugcuuuuggcauuacuuaauccaauuauaaaaacugaauuuuuaaaaaacagcacuuguuuuuucuuccaagauuaauuugaauuuuuuuauggacauuagaaaacauugcaguuuagucauaaucaaaaauaaaucuugaggcugguagagcagcuuuguugcuguuuauauuuuuauugcuuacuggauuucaguguuaccuagugccaucaguuugguauuuugccaccuugcacauucagugauguuugauuuuucuuuuuccuuuuuuucauauuacuuuuaaauccugaauaguuuguggcagcuggagaucaccuaguccaccacuguccaacauggcaaugguaaguaauauugaguaaagaauagaaaauuaguaaaaugcauggcuucagaauuauagcaauuugcaaaauagguuaauggaugaaaauuagaaugaccaguuuaacuuuccccccagcagauucuucuguuaaacaaugccccuucaaaauaaaggaagaacaaguggguguuauaccuauguuauuuggcuauguuagcacaauaugauggacuaauuugagaaaaaugcauuuacuuccuuuacuauuacuucuuuucuuuauagugucuaagucugaccuucugguucuuugaauaauaaauaguuuaauaaaauuugaucagguuuuuggcagggcgcgguggcucacaccuguaaucccagcacuuugggaggcugaggcgggcagaucacgaggucaggagauggagaccauccuggcuaacauggugaaacccaucucuaaaaaugcaaaauauuagcugggcaugguggcaggcgucuguggucccagcuacuugggaggcugaggcaggagaauggugugaaccugggagguggagcuugcagugagccggagaugaugccacugcacuccagccugggcaacagagugagaggcucccgucucaaaaaaaaaaaaaaauuuuugaacagguuuuuuuuuuuuaaauuaacaaaauuuacugaacauguuuguggcauuaauaaaugcagagauuuugcaguuuuauguucuuuaaaauauaaaacauaaacguuuucuguuagguucaaaaguaugcuccaucuuuaggaaacuggcuaaagcuaaaagaaagguuuaugauaccaauuaaggccuucauuauaaaucugcuuuuaagaggcuuuaaguuuuuauuuuuuuucaauaccuuuuauuuuaauuacuaagguaccuuaagcaauuuagcaguuuucacaaucuauauuuuaaaauauucugaauaauaacaguguuuuauuacuuccaaguacucacgauaaagacucccuguugguagcugaaaaaaugaucccaauauuggcagaacuuuuauuuaaacuaggauuguuuggaauuaucaccuuguuuguauauaggugcuucaacuuaauauaucuuuuuucuuaaaaauuguuuuucaauuguaguugaaagguacaguuuugacuggggauaggaauucuauaauuaauaaguuuccaauugauaauguuuuucuagcuucaaacucuuucaucuguggccugguauucuccugcauuuuaauacuuaccgugucgcugaaacaguugucacugcuuuuuucaauuacucuuuauuuuguagggcauuauuuauguaccaaaagacuaaaguuucaaguuuguuuuuauguauuuuucucuccuacauguguuuuuuguuccauauuuaaaauuaaauucaugucauagaagaucucugauuuaauaaaggugguuuuuuuuucuuucuguauuccagauuuucuguuaaaacuauauuuagcuagguucuggucuauaauuuauauguauuucaagucaaauagggaaaugagguuuacaguaguauucauuuugugaaaauaacugauucagguuuuuuucuauaugauaagcauuuucuucauugagauuucuuuguucuaccagcuuaauuaaguaguuuagguauuugauuuauagcauuguuguaggggcuuguauauauggacgggaucuuuuuuuagcagguacuaguaguuuuauuccauuuuaugaauuagagugauuuaaauacuuuuauuguaacuuagaacugaauuauaccccacuucaguguccacacuuuuggcuaaauuccugggccaaaggaaaaauucauuuuaaaucagcacuagagccagguuauuuccaugcuuaugccuucacgugcacaagugcuaucaugaccuuauuuuaacucuuuccucagaacuucggguguugccaugacauuguugaauuugacacuugggacuagucaaaagaagucuagaaggccgucaaauaauauuagggcauuuccugacuuuaccuugugcccagaucuaugguuugaacuuuagacugaagcuugaaaagacagcugaacuccaaauuuauggccauauguuugugaaaggcaccacauaccacuccaccucucaccguuuucagaugacccacaaauucuuaagaagaggugccagagcagcucagaaauguuguagauaguuggcucugacccacagagggagcaguguuuaagaguaggagcccugaagucacuuggcuuugacccuugcucucccaccaaguuuugugaucauaagcaacuugaucuguuuaaucuuuaguuuacuuaacuauaaaaugggauauuuauauguucuacuguuuagaguuaugaagacuaauugaaaauaacauguuggagacuuaaauucuauacucaauaagcacucaauaaaagguuuuuuguuuucaagaauuauuaauauugucauuuuaugauucagagcaucuuuuaucucuuaauucugauuuuaauccagugauaggaacagggauuuugccagccaccuacaguguuacauaaugucaugcagcuuuuuuuucugccuuuucuuguucucaagaugagcagcaguacuuuaggauuaaaaaugugagagauuauacagugggcuacaacucacugaggagcagcauauuuuauuguuguuuagaggcaaacauaauaguugcuuaauaguucuauauuauucuaccuuuuuugucuaauauuuaauccaaauucucuugggucuaucugcaucucuuaguauguuucacuuagauuauuguugugcuuuucuccaugcccugacauguauuacuuaauggaguccuucccaaaucaauuuuaaaccaauuuucugagaauuauggauuauaucauuuugagauuuauaugcaauacuuucugcuguauauuugccuauuaaaauauguuuuguauuuuggugcuuuucacuguuuuuaaagggcuacaggggaagaauugaaagugaaggcauaccuaccaacaggcaaacaauuuuugguaaccaaaaaugguaagaauuauguugcauauaugaauaaauuuugcguagagguauauuaaaaugaagcucucgguuuuucuauugcuugaaaauuuuuuccuuaguuuuaucaccucuuucuguuauuucuuuuugccaaaaacauauaguugucaagauacgaaggaagagggcccuaaggaaaguuagacuucuaaguggauuuuuuugaaguuggcuucauaauaaucuuucuagguauuugauuuuaaucuucuuuagacugaaauuuugcauggcaaaugaaauucauacuaccuaugacaucuaaaagcucagagcugacgauguuauuauccguugugucauugaaggacacaaaaauauuuugaaacagguagugguuuuuuuuuuuuuuuuuuugguuguuuugagacagagucucacuuuguugcccaggcuagagugcaguggccugauuuuggcucacagguucaagcgauucuccugccucagccucccaaguaguugggauuacaggccugccaccacgcccggcuaauuuuuguauuuuuaguagagacaggguuuugccauguuggucaggcuggucucgaccuccugaccucaggugaccugcccaccuuggccucccaaagugcugggauuacaggugugagccaccgcgccuggcugaaacagguaguguuuuauuuaugaaguuaaauuuaaaaacaacaucaaaagguuguuauaguuccuaacuaaucacaaaacaauacauugauuucuguuccaauuuacucauuauaggaaagggaaaauaaagugaacagaacagcaguuuuuucuuuucuacagcauauuucuuuuuacaaaggcugauaauuuauauccugauuguuuuaaaaaaaucaggagauuaaaaagcaauuuguugaccuuauaccauaaugcuuuuaccauauaauuacccaaucuuaggcuuaugaauaauaauaccuguuaauugacacauuugcuguaugaacaacuuacuagugugguauaaagaaguaaaaaucagaagguuggugaauuuuaaacuguuuuauccauugugaauaacuggaacuuaaauaugaauuauaaaauuuauauugaaaguuacuuuagccuugaaaacaagaguucaccuuuaccaccacugacuaugauagcugguagcuccauguucugaaaguaaagccauuaaaauaagguauuauuauucauuagacugaaauugaacuaugauauguaucucugacaucagccugcuguucuucacagaccaucaugguaaaggaaugcauagaacauucccaauagagcuuuucuacuugucuucugacaaagcaauuuaggaaaagguaaauguagccaaauaauuaugugucuaugagcugaauguaacucuuaaucaccuuuaaaagugaaauauucacuuaguacuuuggugguauaaacacccuauuuuauggacuaagcucucuucuuucuaauggauuuaugguuagcagauuacgugcuaguuaacuguauuuaccauuuuuuuuauagugccgugcuauaagcggugcaaacagauggaauauucagaugaauuggaagcuaucauugaagaagaugauggugauggcggauggguagauacauaucacaacacagguaagaggagaauaaaaugacauauauuuaguuuaaauuaaacucuuucacaaucuuuuauaauagccuugauuuaaaaaagaggauacauaaggcauaguuuugucccaauagacuuacaugaaaaaagcaggaggacaaauuuuaaaaaagaagccuuuagaguaugccaaauuuauuucuuuuuuugagacaagagucuugcucugucaccaggcuggagugcgaucuuugcucacugcaaccuccaccucccggguucaagcgauucuccugccucagccucccgaguagcugggacuacaggugugcacccccacgcccagcuaauuuuuguauuuuuaguagagaugggguuucaccauguuggucaugauggucuccaucucuugaccucgucaucuggcugccucggccucccaaagugcuaggauuacaggcaugagccacugcgcccggccagaguaugccaaauuucuauaauaccugcuacuuccauugcaauuugaaaauauuauuuucuuaguuucuaaauacagagagggaaaaaaaagaccgucagagaugcugaauaugcauacuacuuugcuuuacagucucuugcuuacaugucauugucauuccauugcuggauuaugugcuccucuaugacaggaacuauacuguauucacauuuacccagagaacugacaucuauuaaguauuuaauaauuauuuguuaaauaacgacuaaaagaaauuuucaguacuguaagcuccaugaagguaaagauucauuguugaauucucaguaucuaucacaguguaugauguagaaguuguucaguaaauauuuguuaaaugaguugaaugcaagguuuuuauaaguguuucuaugaguuauuugaaacccugaauauacuuuuuuauucuaaguccuaaaacacuguuuugccacuauauuuauauaacuauguacaugcauauuaucauaugcugcugaagcuaacuaccauuuauuacuuaguuuugaugaagaaaaugugcucuaaguuuaaauccaugauacuaaaaacaaauuuuucucccuuugaguccuagagguuaggaguuauauccuuaguaguaguaauaaaacaggguuucucaaccuuggcacuguuuuuuggaauggaaaaugugcucuaaguuuaaguccaugauacuaaauauguuuuucucccuucgaguccuagagauuaggagguauauccuuaguaguaauagaacaggguuucucaaccuuggcacuguuuuuuggaauggauaauuauuuucugugcauuguagaaugcuuaccaguaucucuggccuguaaccacuggauaccaguagcaucccucaguuuuaacaaccaaaaaugccuccagaaauugcugaauguucuguugggggaaaaauugcugccuucaguugagacucacugcaguagacagagggcuaaguaucugcccagguaaaaguuccuucuuaggucaguuucuccccuacucugaauaaaggauacugccaucucuuuccuuauggaguuauaggcaaagauucaggacuugggcuccuugaucugaaauuuauuggcuuauuaaugagucgagugcuauaucaaagccuaaaggaaauaacagauugaaaaacuuuuaaaaguaauuucaaaaaucauccuucuuuccccccgccccacugaguagugaaagucuuuuaacucuucugcuuugacuuuuccaugccuggaagauguuggcaacacaucaguaggaaauucucuguugacugacuggauccauugauugugcauuguuuuugaugucaaguuagugacuuaugaggccagauacugguuccuuuuucaacucaguuucccuugcuuuauccuugcuuuuccugggcguuuucuucuauuagcuuguguauuagucaugguucucuagagaaacaacccauaggauguauacagaguagguuuugcuuucugugguuucaguuauguagucaaccaugguccaaaaauauuaagugccaaauuccagaaauaauucaucaguuuuaauuuuuguccccacuguugggaguagcaugauaaaaucugcuauccugauccguucugcccaagaggugaaucaucccauugucuaguguaugcaugcuguauaugcuacccagccauuagucacuuaauagccaacucgauuaucaggucgacugucauguacagcguagguaggguuugguacuaucugugcuuucagacacccucugggggucuuggaauguauuccccacagauaagugaggacuauugcauagguauagguauagauauagguagauagguuuuuuuuuguuuguuguuguuguuuuuuguuuuuuuguguuuuuuuuagaggaauugacucaucugauuauaugggcuggcaagucugaauucugcagggcacacuggcagacuagagauucagggaguguugauauugcagcuuuaguccuaaagcguucuggaggcugaauuccuucuucuggaggaccucagucuuuuucuuacaaggccuucaacuaauuggaugauaucccccuaucuuguagaggguaaucugcuuuauccagucuacuuacuuaaauguucaucacaucucaaaaauaccuucagcaauaucuagaaugguguuugaccaaacaucugggugccacaaccuagccaaguugacauaaaauuaauuaccauaacccuuuagaguauuacucucauuagagucauuugagcuuucuuuuucuuugucaacuguauccuacuucuagaaguguuuuaauggcguacuacuuauuauauuuugacaaauuaaagagguugauuugcuuuguuuuuauguuccgcagucaauucguauguuaaaauuuggguuuuacuguuaugaaauagucauaccuauuauauaguaauuucuagaaaaacugaaguaaaagcuuugugcuagaccuguggauuuugaccuauuuuauuugugaaagugagcuauuuauuuuguuuaggcauguugaacagacaucucaaaauuuuagaagauuaacaaaggagcuaagcauauucuguacuuagguuuuuucuuuaguaacuuuagaugcuauuguuuuacuauauuucuuauucuuguuaaacuauuuuguuaacauugacagguacuuugaaguagaaauguuaucuagcugacugguggugcugccaccuucuuaaggcuuucuuugagacaaguagguuuugagguauuugccccguagagugcaagagaauugaaccaaaaguuagcuuguauggauuuuaaucccaauuucaucauuugacuggguauaacacucaagcaagucaucucuccagugacuucauuucuucauaggaagacauuauuacuguaacguccucauaagauagucauugugaggauuaaauaagauguggaaauaguagaaagccacauauaaaugugauaugauauuacuaccuuuggguauccuacauuucugaagcaaauaacaaacagauugaguaucccuaauccaaaaauccaaaugaaauguuccaaaagccaaaacuuuuugagcacugauaugaugcucaaauaaaaugcucauuagagcauuuugaauuuuuguauuagggauacuugaccaguaaguauuuaugcaaauauuccaaaaucuaaaaaaaucagaaauacuucuggucccaagcacuucagauaagggauaaucagccuauauuaagauaacuaauagcuuuuugagaaaauuuugaugcaaguuuaauuaaaauguacauacgaguccuguaguuuuuuuaaacucuugucuuuccuuuuuuuuuuuucccugagacggaguuucgcucuugucgcccaggcuggagugcaauggugcgauuucggcucauugcaaccuccaccuuccggguccaagcgauucuccugucucagccucccaaguagcggggacuacaggcacacgccaccacgcugagcuaacuuuuguauuuuuaguagaaacgguuucaccauguuggcuaggcuggucuugaacuuccgaccucagaugauccacccgccccagcuucccaaagcauugggauuacaggcgugauccaccgcaccuggccaaacuguucuguuucucagaaaguguugugauagagauucaaacaaggaaaguaauucaugguaaaauauuaaugaguuuuucaaaauuugaggaggugccauugugacuauucucauuagaguucauuuguaaagauacuacuauuauuugccuccuuauuucagagaaauugugagaauuuucagcauuuuuauauugcuuuaauaaguaaauaggguguuuacaguuuaauuuuaguuauucuuuucugccgaauuuuacauagguauuacaggaauaacggaagccguuaaagagaucacacuggaaaauaagguacugguuaauuaguuauauuuuuaaauuuaaugaguaguuauuugccuaucuaucuaucuauacacacacauauauaaucaccauaucuuucuuauaaaaacccugguuuuuuauuaucaagcucuuuuaaauuccagcuguuuucuuccccauucauuuuucugucucaacacaccaaaacacuacugcugccuaaugcaucucuuauuuuccuuaauuuguaguaugguuaaguaaaacagcuuuuagauuguaacuuguacaaacuacuaauuuucacugacuggagcaacuucuaggcuaguuuaaaagagaugacuuuuuuguuuuaaaauguauuuaguaccaaaugucauauaaguggagaauguugggguggaauuaacuacuugcuuacuaguagaugcuaaugauauauuaacauuuaaauuuuauagcuuaaauagugccauaagcaauuuaaucauucucucuguauuuucuucaauuacugguaauuugggguuuauuuguuuuugaaaauuugaaagcaaacuuuagcuugcaucauucaaauucaugacauuuugaaugaauagaagcuuaaucuguuaaguuuuauugcaugauuuauggggguaaaacauaauuggguagaguuuuuuugcuuggaaauuuugaguuauuuuaggcuguuguagguauuagauuagcuuuucauuucucagagagaucaaccgcaguugucuucauguuuuuauauaccuguaguuguuugaaaugauaugaaaaaauaauauaaaaugcuuucacccuugucuuaauuauuuuuuuaaccaucaaaucacuuagaggauagacuauuugaauggaauaauuguguuccuagucuuaugacacuuuugcuacaacaguuacuaaagauauucuuuguguguuuuugucauuuggaucuuucuagauuuguuacuggggcuuaacagaaagugauagaaacgaagacaaguuuuuuuuuuguuuguuuuguuuuuuuauuuacaguuuuaugcuuuaagauuuaguucuuuggccugagaauucaucauuuugaaauuagacuuuuuggaguguuugaaugacuuacggagaaauaacacaaauugcuuugcuguuuuagaagaucuuguuuacucugaccauuacuauauaugcuucagacuuugggaaugauaaauggcacaguaguguagauaguaguguuuuucuuggacgggcuuaugguaauuccuuuaguauuuuuuguaacuuagaauacuugccauccaagcagaaguauuaaucuugguugucaauuucuauucuacuuuaucaaguauaaauaucaccaauaugaugaaacuuuuucuuaaugauuaauuuguuaaauauuagcucauauaauaauuacuccgacacugaugguuuugugguuuugugguuucaauuuuggguguaagaaugauuuaaguuuuaaacauaugacuuaaguuucuaguguuaaauuaaaccaccccuaaguaaaauguaaccuagguaaaacuaaauauucaguuuauccacuuauuauguugacuucagauuuucagaauauuaauuuugugaaaacgauacccagauguuaaaccuguccaucaauauucuuucacuuuagagcuaauauaguuaagaaauugaacugauaucuugugcauuuuaauaacuguaaagucugauaacuugccuaauucagcuaagauauuguuaacaaauuagaauguaauaguguuugauuuauauuuuagcuuauauuugauuuacagauaugugcacuuuuuccccuuauaagugcacaaguuaauauaauuuugaacugauuuucuaauacuaaugaauugauuaaccaaaaauacuguuuuauuggaagugcaacuggcaauuauuuuuaaauagcuuagaugacucuuacugcucccauaauaaccuuuguuauuuuucagucacagcacuuagcacguuacuuuuaaugacugauauaugaauucauuaucuucauuggaguuuaagguuuuuguggacaagaacugccuugucauucuuauuuucacagugguuaccacugugcuagcacauggguguucaguguucaaauuaauguauauacuuaagugauuuuaaauauaauuaauuucaaaggacaauauaaggcuucaagauugcucagcacuaugugaagaggaagaagaugaagaugaaggagaagcugcagauauggaagguauuccuguucuagauuugcuucaguuccacuagaauauugauuuagaauauuuguaauuuauguggauuaagaauucuucauugaguuguaaguuuagcauuuagcagccuagugaguguuuuauauauguuuaguucauaaauuucauuaguguaaaacuuaucuugaucuuggacucuucuauuuuacuccaaacauagucuuggacaauaucauuuuuauuggaauaacuauuagucauaaauauuuaauacuggauacggcugcaagauauuaauuccuaacugaauuauuucagagcagaacaaaguuugcuuauuaugcauuuuguauuuucuuuucccucuuugauagcaucuuucuauuaaaaccugaagauagugaguuucaauggggccuuuuuuuuuucuuuuuuugagacggagucucacucucgccaggcuggagugcaguggugcgaucucugcucacugcaaccgccgucucccagguucaggugauucucuugccucugccuccugaguaacugggacuacaggugcaugccaccacacccagcuaauuuugguauuuuuaguagagacgggauuucaccauguuggccaggauggucucgaucucuuaaccucaugaucgcccaccucggccuccccaaagugcugggauuacaggugugagccacugugcuuggcuaauggggccuuuugaacuacacagaaucccaucaguuucccaagauucugaaaaguccuccuccuagaguugccaguugagaaucacugcauuagugaaucauucuuaaaagagagagaaacccacuagaacagagcaguaugggucugugagcacaugguuauucaaagcuuuguauuucaugagcaugauaaucuuuuucaauacauuugaaaccucagauauuuaaaaguagaugaaaaaauugcugucaccagggugaccucuuuguuaaauccaguuuaucuuuauuacacuuaccuuuucugcauugauucuguuaaccauaucuuccucuuuuuuuuuucucucuugguuucuauaacacuggguuuucuuacucuuuccuggacucuuucuucuagucaucuucuaugauucuuuuucuuucccucagcuauuaaauguuacuguuccguggguuucuuuuuuuuuuccccuugcuuacucucuguacucccagauuuuuucuucuauaauggcauucuguaguuuggcaugaaaauuugugcaacaagaaagauagaguauaaauuacauccaguacuuugugagaguugaaauaugaauauauuuauauauguaaauagggugcauguguaagaaguuggaaaaaggaaaggaauaugaaaaaaaggcaggcauugaaggcuguaaggcagcugaaugccaaaaauacauagacuuuagagugagauagauuguguuuuguagcaugcagaaguagaagauggugccaaguagaguugaaacaccauaauggcaagugaugcuugcuagaucaaaaguaccuuucuguuuguuuucaaaauuacuuucaauuccccaugaaaccuagcuaugucuguuccuaaauuuuagugagauucuuguccuuauuuucaugguaaacugcuguuccuuaaggaaaucugaaugaauuacuuguaaccaaaauugaucacagcagccucacauaccaucuguaugcuagggacuuccauaucuagagguagccuagauauucucaacuucagauguauuucaguuucauuucccccuggaugucucauaguugucagaaacugacaucacuuucuuggacaaauauuguuucugaauuucaucugucucugaaugacauaguugaccaaguugggguggugggguagcauagaacccuucgaguaaagcacuguuuucaaaguacaagcugugggauugccuuaaauaucugauagucauuuaguauguuuauuauauucccccuagauagaguuaaagaauugcuauauauguaauuuugcucaacaguuguguuaaugguaucuaauauaaagguaauuuucauuuauugaacaaauauuuauugggcaguacaguauuuaucagguauuguccuugguguuggagauaaagcaguagacaugauuucauggaguuuauauucuaaucaguggagacaaaaaauagauaagcaaaauauauacaguauuaguuauaaguguuaaggaaaaaauaaaggaagaaagggguuagagaaucuuggggugggaaugaguauugcaauuuuuaaauaaauuggucaagaaaaaccuaauugaaaguacacgccauuuaaauaaagccuggaaggaagugaaugaaacuagguauuugagggaagagugcaaagguacugaggugggaacacguuuggcuuauguaaaauauuguaagguaugcuuauguccagauaggagagaagggagaguaguaaaggguggagucagagagguaaccagggaccagauucuauaaggucuugacauuacucagagugagacaagccauuggaggguuuuguuuguuuguuuguuuuucaaguagaggagugacauuucaacagaaucacugugcaguggugagaauagacugaagggagaaagggacaacaggaggcuguuugauaaucuaggcaagaaaugaugguggcuugggcuagggucguaacauugguagggaugagaaacaguagaaugcuggaauacuuugaggguugagccaaagagauuugcugcuggauuggaugucauaugugacaaguggaauagucaagggugacuccaagguuuuugaccugagcuucuagaaagauaccauuaacugagauguggaaaaaucaaaagugauuagcuuuggagagggagucaggaacucaguuucagacaugugauauuugcaguguucauuaguuauuuaguagagacguaaaauaaauaauccaaguccgcaggcagggaauaaauuugaaagucaucaguauuugaagucauugagucuggaugaaaucguuacagaaauaagugugguuagaggagagacaagguccagaaacugagcccuugguuacugcagcguuugauuuuaugguucuuuuuaaaguagaggugaugaagaggaaccagcauagaagauacugaaacagcacucagugaugagggaggaaagccaggaaaauauuuuaaaagccaaggaaagaaaguauguuccaaggagaagggacuaaaucaugccacauguuccugauaggucaauuaagaugaaaacugggaauuuaccacuggauucagcaaagaagaggucaccgaugacuacgcaguuacagaaguaggcuuguguacacuguggagccacugaggacucuacaguauuauuaugucaagccuuaaacaugcuggcuuucucugggcuuucgccuuuggaaguauagaauuagcucacuuauaucuaucuauucaauaucuucacuuaaaaacaaaggcaaaaccccaguuuuugaaugauacuaugaaguaauacuuaaauugguuuagggaauuuucuugaacuugaacuugauuaaucuuuuguuguuuuuuuauaacagaauaugaagagaguggauuguuggaaacagaugagguuuguaaauugaguuuucuuuaguuaauuuuuaauggaugaacuuggggaugcauguucuuacuaauaauauauugaucuuucaaagacauucuaauuuguucauauugauuauagcauauaaaacguagcuuugaguuccaaguucauuuacucuuaagaaaacaaaauauagaauggaaaaaauaaguuuucuagaaugucacauucauaccgauuuaaugguuguaaauuuuucucuuuuauuauuuucaggcuacccuagauacaaggaaaauaguagaagcuuguaaagccaaaacugaugcuggcggugaagaugcuauuuugcaaaccagaacuuaugaccuuuacaucacuuaugauaaauauuaccagacuccacgauuaugguuguuuggcuaugaugagguaaaaaugaaaagcauuauauuuuaauaucaauauuuuaaauuguuggguuuuaauuucuucuucauuagguccaugaguauuuauugcaguguuucacauuuuggaaaucaucuguuuuacaguuuuaugauuaauguugaacuugauucuuucuuauuuugaaugaacuaugaauuauucaguguaacaauaaugcuaagacauaaacagaaauaaucuauuacauauuccuuuuuugaaggcuuaugccuucaaaaugugagggaaauuuaacuugguuuauuuuauuaaauuuuguuugggauuacaucaguuggauauauaggcauuuacagaaugaccaugucacaugugaagagaguggauuguuguauguauguauuuuuccccuuaagacagaaaacucaucuacuuaauugaauuaaaggauaauugacaggaaaucaacuuguuuaaccugucauucuuauggcuauacaugggaaacaagaaaauaaagucagucuaaaagaugagccacaaaguuauaaaauguuuugauagccacaaacuugucuuuuugugagauuuuuuuucugcauuggggguagcugucacagagcuuggcugugacuccuuccugucccucccuugauauuaauaaauuguaaaauuucccagaaaucauucuaaacagucuagaauucuaaauugcaagugaugugagauggagaacuaaauauauuauaaaccuugagauuuaggcugaaaguuucuaaauaguaauuucuuuuuuuuuuuuuuuuuuuuuuuuuuuuuuuuuuuuuuuuuugagauggagucucgcucugucgcccaggcuggagugcaguggcgcaaucucagcucauugcaagcucugccucccggguuuacgccauucuccugccucagccuccugaguagcugggaccacaggcgcccaccacccugcccggcuaauuuuuuauauucuuaguagagacgguguuucaccauguuagccaggauggucucgaucuccugaccaugugauccgcccaccucagucucccacagugcugggauuacaggcgugagccacugcacccggccuuaaauaguaauuucaaagcauuuuuuaugcuuucagcaacggcagccuuuaacaguugagcacauguaugaagacaucagucaggaucaugugaagaaaacagugaccauugaaaaucacccucaucugccaccaccucccauguguucaguucacccaugcaggucuguauauguagagauaaauauauuuuuugaugugauuguauauuucauggauuuauuacuugagaaucuuuaaacauagaacccuaacagaaaaaaauuuucuuacuaaaaaguaaaauucucucuuguccuccuuagaaauuuucuugugcuuaaauauauaagaaaaaggaaaaaaaacuuaccaauuuguuuuaaguuuaauauguuaagaauuuuuuuguucucuguggguguuuauagaauagauggaucuuugugauuuuacuacacuuuuuagcuuccagaacaguuuggaagauucuguuuuugacucagaaauagucauuuagauaugguuugcuguguugugacugccuuucugugaauguagacuguggaguuaaccuugugauuuuucuaggugaccuauuugcuuucuuuuauugauuagugaagggagauauauggauguauguucuucaguugagagcuugucagccuuagcaagucaagugcauuuuauaaguugggauuuucuuuguaucaguguuuuuucacagagccaaaucugugaagcugaaccuauauacaugauuaguucagaauuuuucuuaaaaaacaguuacuacaugccaauuucuuuagguugguuauuucuaauagauaacuuucccaguugacuggaaaauacugguaacauacuaguaacaauauuuuucagugaaacucauauucuguugacuaguuagaugaaacauuuuguuuucucuucccucuaguuaaaaacaaccuuuaauauuuucuucucauauucugcaaccucuuuacucucaaacuuuaacuccguggaagaccuugcucauuuuuucaguuuuauuaugucugaaacuuugcuaacuaugaaaaauaauuuaggagccauuaguuuuaguuuugaauuauguaaucuaaaaaguuuucaguuuuuagaguuauucucuugauuccucuuaugguuuaaggucuuaggauggugcuuaucaaacugaagcguaucucucugagguauaaacuuuacucaguugggggaaaaauaacugguaauuauguuaaacauuuuaauaaaauagaugacuguauuguggaaugggauauaaguauuucaaaaaaucugagugccuauaaaauaaaacuucaaggacauuuuagaccauuccaugggcugccucagauugugccuucaaauccucuggaaucauacauuuacucucauauucuaaguugacugucucugucaugaagauuauagucguaaaaacugaagcagcauuauuuaagccaagguauguuaaaaagacuguuucuuuaaaaauuaucuuuuucuugguuucugugccuagauacuaacuuugauaucacucuuuucuauaguacaggagagagaacaguuagccaugaaaagauguauagauaggacaaaaacuucauauaaauaaauaccuuucuucuuauaagccaaaaaauuuauuuuuacauagaauuggauaaauuuuagaauaccuauuaggacaaagaaacaaauacaaaccucucaacucuaaccaauuagcuuuucuuaaacccucucaguuuuggcuuauucucagcuaaauaaacagcccagaucacaagauuauagauaccucuuugcuuuuuuguccaacugauaccaugugucuuuuuuuuuuuuuuuuuaauuugccugauaugacucuuguuucuuagagcaaacagcuaucauuccacauuuucuccuggaaugauuuccucaucucugguuuucugccuuccuugucucucccaauuaucagaacacuaacuaaugccauggugucugcugugacuaccauagcuuuuuaagauuaugcccuccccugguaaaacuguuggcauggcauaacaaucuguuaucuuuuguguuucggaaguggaggggagauauuuuauaauuuaacuauuuuaauaaauauuuuauaguuauuggggaguggugggggagauaguuuauaauauaacuauuaaaaauuaauucacugagaguaauagggucgauuucuuuacaaaugaaaauauguuuuucuucuuucggucuaaucgaucuacauuaacaauuuuuuuuuuuuuuggcuucuaggcaugcugaggugaugaagaaaaucauugagacuguugcagaaggagggggagaacuuggaguucauauguauccuucccuguauguaagauuaguggcaaaauggcuguuaacgauuuuuuuuuugagaaauuuaguguaaccuuaaugauacaguagcuauaacuuguuuuaacuucucaucugaaaauccuaguagaagucuuucauuuauuuagaaaauguuauauugugauaguuaugccuugcuuaguugauuagaacauguccccauguguagcaguagcucacccuuguuacagagguaacuacuaauuuagaauaauaauaugaguaucuuuuucuuauguacauuuccaguuuaacauguuaccaaaaauguacuuucccaucagguaaaaguaaaauuagguugugucaaucugaggugucucugaagcaaauaauucagcuuaaacaaauacguuaauuaaaaguaauguacuacgugaagugcuuuagauauucuuaaaauauaguacguucauuuuucucaagacaguagcaccuuucuuguaucuuacuauaguuuuccuacucaguuuucuuggauugacaaaaguaauacauucaaguuaaugcccaagcaaacuguuggauccuaaaguacauguacucauagcauagauuuaucaaaaacagucaaaaucaaugauuuacaugccagauagcuugaauuaguuugaugcuagguuaauacuugacuugguggugguuucggcuacuauguguuagauuagauguggagacuaagaugccacgucuaaucagacuguggggcauugcuaauaaagugugucccuaagaagaacuuugaacugauuugauauugaaacaaaccaaaaacuuccaguccaaaccauauuuacuccugaaguccuauuaugccuaacuggcacaucucugcuggaugcuagguagcaacuuggaagacugucuauauauaauucauaauaguaauugguuucccccaaugaaaaguaagcuccuaauguuuuuaagugcaaugaacauaaaaaaauuucagaauuuaauuaaagacaguccaguagagcucagucuuuggcaaauacauacacuaaccuagaaucagucuacuauacaggauuuuuauuuaauuuuuuucucuuuugcuauaguacuucauuauagucuauucugccucauuuucugacauaacucuagcaaacuuaaaggagucuaguaaaugaguacauuuuguacucauuuaaacauguauagcuuuguccuuuuuaugucaaaguaauugugcuuauaugaacaccuacucauuaagaaguuucaaauucaauaaucgaaugaguggucagguagucuuaaagagccucauguuaaauagacacaaauuugcauaguugaauucuuuaauagacuuaauuuaagauuuugugggguuuuuuugagaaauuaauggcuuaauaaaauggauaauuacaacaugggcuuaaaacauagaacuauuuacaaaucuuauuuuccuuagcuaaaaaccuuuagguaucuucuuauuuucuugaaauuuguacaagcugucauuccaacaauagaauaugacuacacaagacacuucacaauguaaugaagagagcauaaaaucuauccuaauuauugguucugauuuuuaaagaauuaacccauagaugugaccauugaccauauucaucaauauauacaguuucucuaauaagggacuuauauguuuaugcauuaaauaaaaauauguuccacuaccagccuuacuuguuuaauaaaaaucagugcaaagagaguuuuucuugugucuuauuaaaagguuaugauuugauuuccccuaaguaacaauaagugaagacaucugucuuauauagaaugaugacagauuauuuuugguuuacauuuaugaggaagguauuaaguguguaauagucucaaaacuaggauuagaaaauacugugugcuaguuuucucucaccuuuuccuguucugcuaauaguuaauauuuaugaagcgcuuacugugugccaugaacucuuuaaguacuauuguuuccuaauuguaguguuaaguugauauugauaucaccaaaauuauuuuuuauuaaggauucgggaauauuuauugugguugccugguagaauacuagaauuuaaagggauaauaaguuuauucugucaugucaguuuauagaucuugguauaggaguuuagaaaggcaaguuuucugcucuaggaugcauacugcaagccaaggaggaaaaccuaagcccuuuauucccuuuauaccacuacaugcuucaucuuuguucuuucaguagucugcacaaaguggaauggcuaaucuuguccauaguuuuguuuuauuuucuccucaucauuuaagaauacccuccuugcuu

SEQ ID NO: 18124 - RNA, 917 nt, Homo sapiens
cuggaggccuggaagcccuacgcguucuacugguuuuaaaacaaagagcucaauugacaccagguaugacuugucagucucuacauucucuccugauggaagaguuuuuugaguugaauaugcugugaaggcuguggaaaauaguacagccacuggacucagauguaaagauggugguggcuuugggguagaaaagggagucuuccuaaacuuuaugaagaaggcuccaacaaaagacuuuuuaauauugauuggcauguuggaauggugguagcagguuuguugacagaugccccuucuuuggcagauauaacaagagaagacgcuuccaacuuuagaucuagcuuuggcuauaccauuccacaaaaacaucuugcagacacaguugccaugcauauacacucugcagugcuguuagaccuuuuggcugcaguuuuacaguagggucuuacagcgugaacaacagggcacaauucugcaagauguuucguaugguuauuggggcuguacccuuggcaaagccaggcacgcugcaaagauagaaaauagaaaagcuucaggugaaagaaaugaccugccauguuauuguuaagaaguugcaaaaauauuuacauaguauaugaugaaguuaagaauaaaccuuuuaaauuagaacucagcaggguuggugaauuaacuaaaggaagaagacaugaaauuauuccaaaagauauaagggaagaagaagagaaacaugccaaggaaucuuugaaggaagaagaugaaucagaugaugacaauauauaacauuuacuccagcaucuauucuauuuuaaauuucugcuacagucccagguuaacauuuagcccccuguggauuauacacacucacuaaccaauuuucauuaaauguuuguauugugaaaaaggagaaagaa

SEQ ID NO: 18125 - RNA, 917 nt, Homo sapiens
uucuuucuccuuuuucacaauacaaacauuuaaugaaaauugguuagugaguguguauaauccacagggggcuaaauguuaaccugggacuguagcagaaauuuaaaauagaauagaugcuggaguaaauguuauauauugucaucaucugauucaucuucuuccuucaaagauuccuuggcauguuucucuucuucuucccuuauaucuuuuggaauaauuucaugucuucuuccuuuaguuaauucaccaacccugcugaguucuaauuuaaaagguuuauucuuaacuucaucauauacuauguaaauauuuuugcaacuucuuaacaauaacauggcaggucauuucuuucaccugaagcuuuucuauuuucuaucuuugcagcgugccuggcuuugccaaggguacagccccaauaaccauacgaaacaucuugcagaauugugcccuguuguucacgcuguaagacccuacuguaaaacugcagccaaaaggucuaacagcacugcagaguguauaugcauggcaacugugucugcaagauguuuuuguggaaugguauagccaaagcuagaucuaaaguuggaagcgucuucucuuguuauaucugccaaagaaggggcaucugucaacaaaccugcuaccaccauuccaacaugccaaucaauauuaaaaagucuuuuguuggagccuucuucauaaaguuuaggaagacucccuuuucuaccccaaagccaccaccaucuuuacaucugaguccaguggcuguacuauuuuccacagccuucacagcauauucaacucaaaaaacucuuccaucaggagagaauguagagacugacaagucauaccuggugucaauugagcucuuuguuuuaaaaccaguagaacgcguagggcuuccaggccuccag

SEQ ID NO: 18126 - RNA, 8511 nt, Homo sapiens
aggcguuuugugugugaucauccaggggugucucaaagccaguuuuugccccuuauaugcucucuugagaagaauugagagaaccgucaccgcauucaagcuagcuuucagaggaguggaaucaauuuaccuccaccggguucaguucagaaacugaagccgccucauugcuauauuguaaauguuaaagggaccuagcacucagcuuugcaccccaaacucaaggauucucaauguaacuuucauaggagucaggccucucagaguacagccagccucaaggcaagguuuucuuauaagaaacacaauccuacaauccaguaacauuuaaaaaucauuauaauuuuuuucuugcaucuccuaaagaauaugaagaggucuaauuuacaacccucagcaccacaucugagaaguccucacaccucauuucucuugcguggcaucucuugccugcuccaggagacucacucuucaguccugcucucaacucuccagccauacucucugagaacucauaauccaaagggacuuuuuuccauuuagcucccccuacuucuugcagucaguccucaguaaaccuggggcccuuucugcuguaaagccccuguuuccaucucucccauacuucccaaugucaaucugaauuagauccauggugggaagaauaauccaauccugaggggcagugucagaauuucucuuagcagacggggagaaaaaggcagggauugcuggaaccucaucacccugugggcacugggugucaacagaaagcugaucugucacgcuuuaaaggagaaacacuguucugcugauccagacacaaacuucagcaucauucacgggcugugcauauggcaagugagaaacugccugcugaaaguggggaaagauuaguugaguugcuucauaccugaaauuugaucuaacuuggggaagaugagacagaauaacaaaaaaaaaaaaaaaaaaaaaaaaagaauuaagucauguacaaauucgccucuuggguuuuguuauuuauuauucacauugaugaaauuauuaauaaugguuuagacuuuauaauauuacuuuuaauggcucaucuuuccaguauuauuucucuaccuauuucuagaacuaacucauauuucaccaauauaaguaaaauuuguauacuuaucgguggccauugacaaagacucucuucuugaccaaaguguugucagguuacucugagcucucuuuucaacuagaccuuguccuugggccuugucuuuggcccaucuggucaguuuagcaggaauccccccgccuugauaucugaucacccuugauuuugcuuucuuuuucuuuucuuucuuucuuucuuucuuuuuuuuuuuuuuuuuuuuuuugauucaagaguggccuugaaauacccuugauaucugaucaaguucuuuauccccuacccuugauauguaaguccuuggcugccuguaacaagaauccugauuggucaguuuagcaaggaugccccuugguguuuccccuuaguaauuuuccaaccauggacccccucacucucuucauugacuacuaauccccagcuuucuuugcuguauuuggaacugaguucagcucuauaucgaauucacuuucucccguugcaacagugcugaagaaaaucugucuuuacagccuuuaacuaguguccccccauccuuuuuucccuuucacaccaccaagugugaaaaguggcagcaaaauaucaggaggcuguguuaaauguaccaaauuuaaaagcaaucauaaaaccaaccaaaggcugcuuuuucacuaucaucaugccagcaauucuaaauaaugucagugacaaaauacuccucucuaaaaaaaaaaaaaaaaaaaaaauugccaugaguucuaaacaaucacugccacuacaacuguuugaauaauacuuauuuaaguguauaaugagcaauuccuauuauucauuuuuuaguaagugaugaaugucaugcagaaauuaauuuggaaaucucccaacuguaaaguuggucucaaacauguuguggguaacaacuaucuggggccaguggugcaggugguaaaggaauuucccaagacaguuguagguaaagaaagguagauuuauuagagaaaguaagaaaauacauugcaagagagcaacaggcagaucagcaagagaggagcuggcugcgaggagacaaaggcuggcucgggauuuuacaggauggugcuugugcucaagagggccacguggagugcugauaaugccaaggucacaaugagcuaacuugcauuuuucuaucagucaagggucuggugauuagucgggugcaggaagauugugaguuauuugaguuacuugugcaggagggcuacaugucuuggaccaugaagaaaggcagacuuacagcucauuugcuuucuucuuuuugcuuuccccugcuuccaccagcccgacuccuuuucccuaauuaggacuccacagaauacaagaugacugugacacauguucauuucaagaguaagcuucuaauggucuggaaucauuugcacauacuuagggcagaguccuugccuccagcaaucccugugggauuacauauugcugcauuuaaagggaagguucaaaacaagcaauaauagcacaaugauuguaaagaccaagaaacagaauuucaguuauuucauuuguccuucuaugugaccaaugaguuaauuuauauuuaaaauuuaauacaguuacaggguaugaauugcaagguguaauauuuuuauauguaauauucuguaugcaguauguauuuuguuaauuuuauuuuugcuagcauaauuauauauacaaaguugacuaaaauuuuucacuuuuuuucucaucaauauuauuauuaguuuuauuucaugauuccuccugaaaacaauuuuacuguauaggagaagagauuguugagaaaugauccacuccaaggagaagcagccccugaguagcugggcagcuucuguagggucaacagugugaaggaccuaccacagggugucguuggcaccgccugguaacuggugauuccaucggccagcagagcucauacccacauucccagauuaguccacgggguccagguacuaccucgacuguggcucuuccagaugcauggaggcugcaccaccgcccaugcccugagugcaugguaucagaggcacaggccauacuucugcuggagccaaguggugcagagccugggccacugcuccaaguagcugggccuccccacagcuaacuauccagaauaagugguagauaaccuuccaacugguguauccacaucauuuaucaugguugggccaguuuggaaguggaaauguccauaagaugguggugaacauaggguggaauccauacugcaaaaauacccaaaaaauccacaaaaacuccuaccaugcaugccuuuaaagaggacuucuggcugggcacaguggcucauaccugucaucccagcacuuugaaaggccaagggaggaggaucacuugaagccaggaguuugagaccagcaugggcaaccuagcaagauccuguucguacaaaaaaaaaaaaaagccagguguggugguucgccauuaguccuagcuacucuuugggaggcugagguaguaggaucucaugggcacaggaguuugaggcugcagugaacuaggacuucugugggaaaauccucaaugugacuaucguugacuaccucauaaaggaaauuacuaaucagaaaaaaacuucucggauucuuuagagucacuuguuucagcaauucacggugauauugaggaagcuaagaaaugaugugauuuaccagaacauuugaaacucaaagaagacaauuucuuccagguuccuaaaagcaaaaugaugaauggccacugaugaaaaaaaucaucuuauuuauucauucacucuuuucuagugaaaacauaacugcucauaacucugcagucucaucuugguuguauuuuaaaaaccaaacauuucccuacagcuauuaauuaguuuaaacagugcacugcaguuaccauuuuauguuucaacuguuaaacccaucaggacguaguacaaaagagauucauuuaaaaaucaauauuauuuuuauguaauauguugauucaaaugcaucacuagaaagguauuggucuuauggaaauaaaauguauguaaguauggguaaaaaggcaaaucacuaguuugaugugagaaguauaauucucaugguaaaauaccagcauauauauacucauauagauuuacugcuaaacagaggggccuuauaaaaguaaaugcacuaaacagaagguugauaguuuauuauaauccuaaaaggaaaaaaucuagauuuuguacuuuuuugauauuuuguacauuaauauauuaucauaaacaugaggacauuugggaaauauuauuuuagucauuuccuuuaugaggucacagcauuguaucaucuucauuuuuguauggcacugccucaauuuguggacuagacacccucugccuaucaugguuuuuguguuuauauuuuaagacagcagaauaaguguuuuuugaaucuguaggucucauuuuuguguuggauaacccuuucuaucuuuuaacauuuuguguuggauaacccuuuuuaucuuuuaucuuuuuaacaguagauaucucuguccugccacaauuuuuuuuuacuuugguucuuucuuccuuuaaaugauugucaaugucaguuuauuccauuuagaauauccuacaacuguauacuuaaaagagauugcaucuguccauaccauuccauucuuucacuauagaacaguaaguaagcauauguauguauugcauuuuauagaaaaaacaaaacagcaaacuucaucuuuaguuuuccuuaagauuuaaaugaacauuuagccguucauuuauauguaccaguuuuuuaaagggcacaaaacuauugagccaguuaaacuauaaaauaauuaggaaguuauuuauuuuuaaugcaaguauauguucuggagcaaaucuaaauugcuguaguugcauaugcacaauguaauuugaugcuugucuaaagagugcuuguagcuucagggaaaugcccaaaauuuuacuuaaauaauuuucauaauauggauuuuuccuccuacuaacuguaugauuuuuggccauuugagucuuuuucuuuauaccagaagaaaguugaaaucuuuggauacuuaggaaauuaagauuacagguuguguugggcuccucaaacagcaucuugcaucauuguucacucuagcaacagaucuggugguaaaugggggucgggguuggaguagaacuaugcaaaagcuauuuuuaaagauaacucauuaugcaucaguuuccccuaaucugcauaggugaauuagaacugauuuuaauuaaaauauuuuaaauuauuuagaaaagcauauaaaguuguuggagaagagaaaaucauauauaaacucaguuggauuguguuuuacuuuuugcuguacguauuuauggcaaacaauauaguuuguggcuucuuuauagaaauauuuagaaaacauaauuguaaauguuagaaauccuauacuugaaagaagccucauuuaucauggauuuuugaagcaaaguuaaaaacaaacauggaaauuguaaaaauauuugugcuuguuuugucugaauagauugcugcuaauuauguucuccuuaggugugugaaaguuauuugauguuuuauugucaucuugcauuuuguuaaauagcccucacuuuugaaaaucaaaggguauccuuguuuaagaauugugucagcauuuuucaaaauuuuauauuauuuauguauuauaauaaauuacuguaguaccauuuugauuagucugaaugucuucaggccuugaaauaaaucuugaccaagugauacaacacaaaauauagaaagaaaugaucuacuguaagugagcaguuauaugauaaagcaacuacagcaaaauguuaaugguagaaucuagguguggguauaugcauuuacacuauaaaauuauuucaacugcuuguuugaaauuuuucuuaauaaaauguugaggggaaaaugaucaucucugagagucaaauacacuagauaagucacugguuuugagugaugauggcaaagaaagcugggauguaagauaagcaagcuugcaacaagcuuggugagcaaguaugcauugaucuccuuguuguuuuuuacugguauggaaguucugguacagaguccuuucaaucccagagcauaugaccaaagacaaucgcaauggccggguacaugcugauguuuuccaucauaagcaguuuagaagacgguggagagauuucuauuucuucccuggagcaaaggccccugugcuaagagaagcaggguaggugucugaaagcuggcuuucuaagcagauaguguacagugaucuagaucaaaggagagauauuucuccauugcauuuagcagugauuauugggagcaaacacauaaucaauacaugaauucaacacacgaaaacacuuuagauguuucaaccuuccaucccugugcugagacuagcacauugugaagacaggauguaaguccaaaucaucuaucuaaugugaacaagguucugcacugcuggcauagaaggcacuuagcagcgggaggugacacuuucaucuuugccuaaccagaggagaggucagcucuucagaaacugauaagugucuuucugcuacuuaggacccacuucucccuauuaugauaaguggcuacgugcaaaguugccaucugaucaccacuguccacugaguuaucugcagagggggaguaaauccugaggaaucucaagguugcacaggaugcugggaagucagccagccacuuaacauuaucauucucgguguccuguaauagacucguguaacaaugauccuggcuucccuuucccugaugacuugcagggagcaugaaucuaaucuuuugggucacaucacauggauuuuuuuuuuuuuuuugagauggagucucgcucugucgcccaggcuggagugcaguggcacgaucucagcucacugcaagcucccccucccggguucacaccauucuccugccucagccucccaaguagcugggacuaccggcgcccgccacuacgcccgguaaauuuuuuuuuuuuuuuuuuuguauuuuugguagagaugggguuucaccguguuagccaggauggucucgaucucuugaccucaugauccgcccuccugggccucccaaagugcugggauuacaggcauaagccacugcgcccggccauggaucuuuuuuaaaagugaaauuguaguauggcaucugaaaucugggccauugcaauauccucuuaacugcuuuuccuucuguaggcucaucugccacacucugacccaugaguacaucacuguuaguaaaucuuccuaaaaugacucuaacgucacuuccaucuuuaacaaauggcagcccuuuuguucagucccucuagccuggcauucgagauuuccucaguguggcuccaggcugccuuucuaacuguguacuccugucacauauacugacccuguucugucaaaucaugcauuuuccauuuuuauuccuccauuuauucauccaucuaucuguuaacucaauauuuauuucaugccuacuauaugacauaucaaauauuuuuaaaaacugaauaaaaccuauuacugcccuuaaaaagcucucauuggagggggcagaaaugcaaaugacugauuauaauauuauguaauaaauauuauaacagagaugugaacaaaugcccuagaaccuuagaggaagcugauauuaacagcccucuccccugaauuucgugcccccagagcauauugcuauucaaauccuaaccacuuuccauacccuacuuauagcucuccuccaugcuuuuucaccccacccuaugacacucucuucuuccuaacucaaaaccuuuaugguacauacuaguacuugaaacucuaaauaauguaauaauuaaucaagcacuacuuuguagcaucuaucaucugucuuguuggcuauuuaauuugucauauggauauccuaucuccaacuaaacucuaggcuccuugaagacaaggucccuguauuguauccuucaauguaauaaccuuggggaggggcaauuggugauagccucuucaggaauuaguuaggucugggauuuguuugcaccuuauuuacaagcuaauaaguuagccuguuaacuguuuuauggaugguagcaaaagacacaagauucauggcucagcaaacagcaugagugucagugggugucccacaggggugauacaacaugguccagauggaugcugcaucuguaguggguuuccauugcagcugaggaaugcagaguuuggaaaaucuaccauuuuuacagcaaacaauaagcaaaccuucucauuguccaagauggagauauuaucuccuccc

SEQ ID NO: 18127 - RNA, 14991 nt, Homo sapiens
cccccucagccaugagaaaaucaaaucaaugugccauucuuccaggcgcgaggcagcagcggcugcaguucaacaugaaaggaggcuuccucccugccugcuaauuaccugcucuucccgaucucaucguuucugccuuugcaaagugcuacugagaagggggaagaaacguccgccacccaucccccuugcugccuggggguucagacuugauugugaguccguguuauaucaucuggucucauugauaggcgggauagggagggggauuccagccccccuggaccggccggagguuuauucuagaguuacuggcggguagcugugcuuuucuuucccguuuguaggugaaaccccauuggcuucauuggcuccuugauuuaaaccacgcccggcuuucugcccucuuugcugcugcugggccagguugcccagccauaucccagccccgucugcagggagccggaggcugcugcugcugcuauuguguggaugccgcgcgugucuucucuucuuuccagagauggcuaacaggggcccgagcuauggcuuaagccgagaggugcaggagaagaucgagcagaaguaugaugcggaccuggagaacaagcugguggacuggaucauccugcagugcgccgaggacauagagcacccgccccccggcagggcccauuuucagaaaugguuaauggacgggacgguaaggccggcagcgaucucgguugcuggggcggugggcagggaaacccuccagggcccuuucuuuuaacguaaggcugcgggaagagcugcuguugccaagcucuaugucucaccgggaggggaugagaaugccuuuauuucuucaggguuggaagauuugggcuccaugcacuauucccuagcuagcuuggggguucuccacucacccuagcauuacaucucccuucugaguuggcaaauucgaagcccuuuugauuuuucuaaugagaauagagauaaguauguccuuguaauuuccccagccuuccuggugcaucagcucuucuggggccauuucuuucccuaggggaucguguugguuacacaguaaaacaaagaagggaggagggggacuagccaccuucacauucuugugggagccaugcacccuggaaguguucagugucuguuuauugaguggaugcguucucaugaaacugaaaggaguccuuauuuguuaacugcauuucugaccaaaugcucguguguguuugaggguuugagggccgcaggcucugugauucaaacaagcccauccuuuccugcagucugugauuuacuguuacauaacugcuauccaaugcuucugcuggguugcccagagcuuggguuauauauauauaucugggaaaaagguaccacauccacuucuuuuacacauuguuaaaauauaugggaugaguaaauugaagccugcuuaauuugccuuuugauagaagaaauaauauuagacucuaucauuugagcucugccaaccucaggagccacuaagucauuccuccuuugaaagucuagaaucacguccucaucacgucacaucauucccuaucuguaaacauccuuucccucauccagaaaaaggaagggaggaacagggagggaauggcgcucccaggcuacaggaaucucuguaguaaggagcagcauuaggaaugggguccucugggucuuuggggcuuaguauaggagccuggcuacacagcccagagcccgugccuuccuagggcccaugacuugcuccugcccaaacuggaugagcagugucccacgugagcaggauucacuucucauucuugaccuguaaauacaaagggaaacauugauucugucucuccccucccucuucagguccugugcaagcugauaaauaguuuauacccaccaggacaagagcccauacccaagaucucagagucaaagauggcuuuuaagcagauggagcaaaucucccaguuccuaaaagcugcggagaccuauggugucagaaccaccgacaucuuucagacgguggaucuaugggaagguaaacagcccccuggccuuugggauuguucuuuucuucucuccuuugccccaucuccuuguaaaaacugcucacaguguucuucccugugccgauugauguguguaagaugcucucagcuguuauccugggggcaguguuugccuuccccauuguuauguucuauuaaaaggagguacccucuucuaauggaacacacacccugaggacacagaggggaucucagcaacuaauguaaacagaagccucaagcuagaggaagcuaacggugacauacugccuuuuauuccucuuaccacucccauaacaaaucacagcuaccagaggagaagggaggcagggggccagugugcuucuugcucaacugcagcuuauagacaaagccaucuggggcuauuuugucaaucugagaaauagauagcacuccaaccuuuuguuaaaccuuuaucugggagcuuggugacuaugccuuccagauaugcauucugcucagugugacaagugcuuguuuccuucacauuugugaauugacuugcugaggaaaucuuacaaaagcauaaaaaucaaaucacacuccuggauguauuuaaugaucugccauuacugggggaaaugaugugaauggagacacugccagagaauuugggaccuauggucauggugucguuaauguccccuuuagcgaaaauguguauacccaaccauaugacuguguuccuucuccacuaggccugccugaggcaccaagagauaccaacuagucagagcaggacugucagauugacucugcucucacaugcucuuugucacuggcugucauuaguggcccaaccaacaggauccccagggcagugacccaaauggcucugcugagagugagaaugggguagcuuuccccugauggagagacaugguauuuuaaaggguauucagaugaugguugaaauagauuucuagcagaggaccauucuacuacucaccacacuaugauuuauaaagaaacaauugccuccuuaauccucggcgucaugcaaagagcuggcauugcauguuucccucauaggugagugguuaaaauccuacgaugcuaauaaguuuaccuugugguuugccauuauuuagaaacucagauauucaaaacugcaggccaggccaggcuauggaucuugcuguugagccuccaaauucucauguaauuucacaguugagauuugauccuugcuuccucgaucaaaacuaugaugauuuuuucuagcuaauacagauagcuacauagcuacugcuuauugauguuuuccuaugcacaaggcauuguacaagugcuuuauugcauaaugucagucaguucugcuaacaauccuaugagguaaauguuuuuuaauuuccccauuucaaagaugaugauacugaagcuugcccaugauuucuuguguccaugagauagcagagccagaauucaaaccugggcucucugacagcaaagaauagagccuuaacuagucugccaacccauucuugagccaggaggcuuaguuuccuucaccuacaccgugagugugcuguugaaucauaauggugacuaggugaugaggaugaagaggaggugggggaggaggugaggaggaggaagaugacucaggacuguguaggacagaaggauaggagagucagugugaauggaagggacccgggugagucccccccccaccccacaaagugcaggaagugugugggaggaggaagaagccaggaggucugugggaggugaggauucugagagcuuuccugucuucaugcuacugaggaugcuuuacuugucucuccccuuuuuacaaagaacacaaagguaaacuuuacucgucagaggugcucacagcaaguguggaggaguguagggagaaauagucccugauguacagagucggaggagguauacaccaccugccccagacccguguguuagacuccucuaaagaaagagggaggccuggagggaugaguguggucgccugagccagggccguggaccagucagcuccagggcaacaagacagacacuaagacucccagcccuaggguagaaaaauggggcuuuaaaggaaauaaggaaggagguccacuccaagggcaccugggcugacagguagcaggaagaacuguagguaggucaugcaguagguaggguugaacaggagagcugucaauaggaaagcaggugcuucagaguuuccaaauggccccaagaggccccagggucugguggcugacucuauggaauggccaaaguccagggagauucauuauaaguuggaggggauaucugauauuccccaggaucacugucugaagcuuaggccaaugcuggucaccauacaacagggcaggagguacaaaagugggucgcuuugagcagagaagcaggaagagggaggggaaggcugacaguacugcagagcagacugagcaagugaggcugggguccuuucugcaagaacugguuguugcucauguguuuuggcauaagaaagcugaaaucaaaggaaugcugcggggcaggguuggcacguguuaugugucuaugugcaugugaggggguacauguuugugcacacagcuauuagacuagcuguuugcuuagcuuagucccacauucucccuacuauucucuaccuugacugugguuuuaaugcuguccucacauaucaacuuacauuaauucuggauucccugcaccuugguuguggugucuguggccacuguggcuccagcccuccuugccuaggagcuucuuuuccuccucugcaaguauuucaugcccaaccucucacucucccaucuccccuacucagugucuucucccaaguagggcucugcuugcccacagcugcccucugacucuucaggcugccuggauguugcaaacccguaagucuggaggagcccaggcuugccaaaugcauucuuguuuaggcuucaaucacuucuauaggcugaggccccagauguaccacuauccuuaauccccccaggugaaauacuucagauagacugcaggguaauuggaauacaagauugaaggcuuuaaaaugaaacccaaagcuaaaugguccagaaaaacaacacaaucacagggacauuauagauaaagcuacugaagucccccuagcagggagcuggggugaccacuugcuuucagugauggagaagaaguaggguggcuuagaggaauggaaggggccugggaagucuucucuuggaaaacagaaggugaauggccuggcagauuacuuuuggauuugccaugggugcccuggaaagggcagggguggggccaucucagcugucuaugauucagaagaaaguacucugcagguaagacuucagcaucuuuucuguggacagaaagugggaaaggaagaaaaggcagagcaagaaagguggggggcgggggguguguguaagagagagagagaacauauuagagcaagugagugugcugguguaguaucaggacagaaagacugcaauacaagcuuauccuggaaaguauuacaggagaguacaggcuccugagucagaaauuagacugccuggccaaaccugugcucuaccacuuaucaauuaacuucucuaagccucgauuuucucaguuguaaaguggggauaaucauauguauuucacaggguugauauggaaaguaaacaagauaguucauuagaaguguuuagcaugguucaugaugauaguagaagauaauaaaaguugguaauguagaaauuauuauugucauuggcuugucuuuucuaagauuaacagaaaauaagggagggaaaaguaagucuggaaagacacucacucugucuuagaacaaauggacuuaguggccacauacaggagcugguguugcgggggcgggggagguugccugaaugaccuuugcccucucugacagcuguggagcuuguaccucaucagauauucucuaauacaaaugaccaggcuuuaggcaucacuuuauugacauuuuuuuccacuuugugaucauuacccucuugaugucuuuccccauaauuuacugcuuuacuaauuccagacacagaagaccccacuacacuggaaagagcaugaguuuuggagucagguggauggguucaaaucucuuuugcuacauacuaacugugugaccuuguuuaaauugccuaguuucucagagccucaguucccuucucgguaaacaguucuaaugccucucuuuuguagaauuuuuguaaggauuaacuauguaaagaagcuagcacagugccuggcuaccagacaccuaauaaauguuggcuuucccccccacacuauuagucauucagcaacugaucuuuuugguucauuuguauaaccacuugaugugcauuaaacguauaaaauucuagaaugucagagcaggcaagacucacagaucgaucagucucauggcucuucuuaguaauucuacugguauggauccugaacacauggugaugucaugccuguucccccuuugaugacugggaguuagggaggugugguuuacauuggaagggccuggagguucaaauauauucucugggaaggcgucacuuuaugugucauuccucaacagcaagagugaagagguauuucacacagcaugagagaucuuuugggauauuguaaguaaaguaccuguaaugacuugagacaucacaagugucugcugcucgaagccuaauuuucuuuuuuuucuuuuuuuuuuuuuuugagauggagucucacucugucgcccaggcuggaguucaguggccugaucucggcucacugcaagcuccgccucccagguucacggcauucuccugccugagccuccugaguagcugggacuuacagguaccugccaccacgcccggcuaauuuuuuuuuuauuuuuaguagagaagagguuucacugaguuagccaggaugguccaauuuuuuuuuuauuuuuaguagagaagagguuucacugaguuagccaggauggucuugaucuccugaccucgugauccgcccaccucggccucccaaagugcugagauuacaggcgugagccaccgcgccuggccuggaagccucauuuucuaucagagcagccgucacugcauuuauuucaaguggcugcugacgauuguauuuggugggucuuuccuuuagcaauggcucucuaaugccagcaugcaucggaaucacuagguaggccuguuaaagcacagacugcuaagccccaacagcagaguuucugagguaauaugucugaggugaggccaagaauuuguauuucuuaccaauucacagaccauauugauucugcuggucugggaaccccacuguaagagccaccacccagagcagugggagucagggaggcaagcaacaaacauuuacaaaauccacagagcaaacccaaccucaccccugauauuucucccuugacuguugcaauauuuuggucuaccuucaguggagaauuggaagcuaggccaaaguuauuauucagggaaauaagacaugguuucauacacuacugcuuacuuucucuguaaguccaagaaagauggaaaaauccaguauucuaagaguuacaaggcugagucaagacugauauauaauagaaguauaauagcucugagacaaagaacuuugacugcaagacugauuuuuuguauuaaaaguagaaauagaaaguagagacuguccaauccaaguugacacacccaaaugacuucucuuuuaccuuuuuucuuugccuuuauccuuuucauuuacuuuuuauuuucauagacauacauaagauaccuuggaaguaauaaagaauuuaauggaacaaaauccuuguuaaaguaucuuuauagcauuaagaauuccuggguuggggccuuacaaugcagaaccuccaguccuacuccccaggaguuauaacuuaguaauauggggugcaggaucacacuuuggauaacauuacuuugugacaauguaggaaauagggagcucuguauugucaaguaaagcugucaguugcuaggugagacucuugcugaaaacacuugccaggugagacagagaaagcuaccauaccaucagcuccuuuuuuguuuaagacuaauauuuucaaggaguuuuagggucacagcaaaauugagaggaagguacagauauuuuccauaugcccucucucccccacaaaugcacagccuuccccauuaucaacauccccuacgaaaggagcacauauugcaaguaaucagccuacauuggcacaucauuaucauccaaaauacauaguuuacauuagguucacucuugcuguuauacauucuaugcauuugggcaaauguauaaugacgcauauucaucauugcggugucauaucaaguacugcccuaaaaagcuucugugcuuugccuuuucaucccucccacccucaacccuggcaaccacugaucuuuuuacugucucaagaguuuugccuuuucuaguaugucauaaaguaggaaucauacaguauguaugcuuuucagauuccaccagcucuuagauaaccagacucuaucucauuuuugcuaucccuccauccagaaaauucccgacacuuaguugauccuucuuugaggaauguuuuucuguucuuggaagaauggccuggagcaguggcuuucaagcucacuugaggagccccagccaucuaccaaagcauccaggguggcugucagggagcaaagccauuccaagcugcagggcucugggcugacuuccaacuuggaacagagcuuuucuaauuaucgcuuuuacuuuugacuuuguggaggauaucucugaagaaaggaguuauugcuuaacaaauauuacuuaguacuuaccacauggcagacauggggauguuuuuaaacauugaaaaccaaagcuuuagaguaguaucugcuuguccaucuggcugccucacaaucaucccaggagacugccccagaaucugaauauuuaagauucuuggguaauccugaagaucaguuuagcuugcaaaucaccaggcaacaccuauaacucucaaacuugccugaagauaugaaucacccaggaagcuuauuaaaaauauggacucccagaauuuaccaaaucauucucucaggagaaugaccucaaaaugcauauuuuaaaagagaugccccccugcaaacucccauaaauaauccaagaagcuugggaaagcaggcuguguauggccauuuuuuauacuugcacaauuuugaaggcuuugucauuaggcagauaugacacuugguugugauacgacuaguuuucuuuucuuguuuauaaauuuauuucauuuaucuuauuguuauuuagagacagggguucccucuguugcccaggcuggagugcaguggugcaaucauaggucacugcagccugaaacuccugggcucaagcagucuuccugccucagccucccaaaguguugaaauuaccguugugagccacugugcccagccuuuuguuguuuuauacuucgugcacaucacagagcuuccuuaaccucagcgcuuuuuuaugcacuuaaauuuuugacccccaguugcagaaaucagcuucuacaaguggcccugacuccugugugccacucucauccaauggugcuugaugugggcuucugaacuggcaaaacaagacagggaaggcuggaaagaggcccucuucccaucuugucaguccaagagugcuggaauuaggaaacauaacaagaauaacauaacaagaaagugagcuagaugugaacugguuccagaaggcagauuucuggucauaguguuauuuagaauuuuggcaaucauuaacuuaguguacuaguccauuuuuguugcuuuaaaggaauauuugagacuggguaauucauaaagagguuuuauuuuagcucacgguucugcagaguguacaggaaguguggugcuggcaccugcuucuggcaagggccucaagaagcuuacaaucaugguggaaggcgaaggggagccaguaugucacauggugaaagagggagcaagagacagaaaguaaaggugccaggcucuuaaacagccagaucuugugugaacucauacauaagaacucacucauuaccaugaggucagcaccaagccauucaugagggaucugcccucacgacccaaacaccuccuacuaagcccaccucccacauuggaggucacguuucgacaugagauuuggagaggacaaaacauccaaaugauaucacuuggccagaacaucaguagugaggcccuaacugcuuuucuuuguuucagucuuguuuggaugaagacauggagaaaccuagacaaaaacacucaaagacuuaugggcauugagguuggugcccuugauucuacagggccugaaaucugugcuccaguuuuauuccccucaguguccccucuggccuggcacaaaacagucaucaugacccuuucagaucaucccugaucgcugguuccuacugaggaaugugcuccucauccagccugcaauggggugccaugggagauggcagaguggcaugguggauuguucaagggcuuuacauucagacaggucugaucuagagcugggcucuguuaacugauugggugacucugggcauguuaauuaaccucuuugaaauaguuuucucguccacacaugaggaggaauaaucccaauuccaugagguugagaugacauauacagugucuacccuauaauuuacaucaaauaucuugcuuuggaaaguuucuuaaggaaaaaauuccaauuucuuccugucaaauaaugcccgcuucccuaguggcuucuuucucaaguguaaucacuuccuuuuccacucuccugggaugaggguggaguuguguugauaguucuaggcuccuggauaucuuaucuuagccggcaacuuaguucccuuuguccucucuggguucauguaguagucuauauaagaaguguuauauauaacacuuacauauaaguguuaguucuuauaaguucuuauauauagucuuauauauaagaaguguuauauagacuacuacaugaacccagaaaggacaaagggaacuaaguagggaacuaaguguugggaauuuucuagaugcagggauaccagggaugaacuagcuacuuugaaggagucuaguucuauaguuuaauaaaacuuugcuucuucauccguugcuccaggguagugucugugggugaucugcuggaugucaggccccacauuuucccagauccuggacauaucagaauagcucuuuccaaccaccagaaacaaguauccagggugcucuuuguaaacaguagagaugagugauauacccuaaccuaagccuuccuuugcucauuuauuucucuagguucccuuuaauaguucacugccuaagagcaaguccucucccuaucucuucacagaaugaaccuucagaauaucauuacuacauuuauauuuuuuaaaaagugucccauuauauggugacaauuacagaaaugcuuucaccuguggaagagucauucuaacaacaacuucuguguuucuucuuaguucugaauauuccuuaugccuucucccuucugucugcuucugaaauacuucauucuccaccaccccaguuauuccuugagucugggggacuauccauugacagcauuuuauccuuguauucaccaaccagucccacagggccucaggauucaggcaaucacccugugguuaacaugggagguggggguagaggggagagaggaucagcuuucugucucuccucuucgaauaaaugaagauccugagcuggacuuccucugaaggccuuaauuguuuauuuuauuacaguucauacuccauucucacuuuccaucugccuuuccccuguaauucuguauuccccagagacugagcugcagcagcugggccaaaaaacugcagacgguucaccaggucuaaagagagccuuaauauuugcccuuaacuuucacaguuccccgccagguuagaugcugccuucccuuuuaacccuaugcuuuuuagcuuuuguauuccacacuggugccuugcauggacuuuuggucugauucuaaauugcaggccacccccucaguagcaucuucucaguuuaggacaggucagucaacuggaagagaagaaaggagaaagaaugggaggaaaggcugaguuguaaggcccaguugcuuucuccauggguuaauggucacugggcugcuuagguaacagggcuccccaucccacugugcaggggccacacugcacaucccucucccuugcucuccucucugucacacacaagccaguuguuuauugucuccauuuagcuguuuucaagcggcacaaaauaaaggcccuaucacuugugucacauugagugcuuucuguguugauuugcuguucuucauuugccaggccucuggcccaaagagcaaagugaauacucaauuugaugcacauggaugauuuuauuuauacagcaacuaugaacggauuagaaacuugguaucucugguauguaccauauagagaauaauuaaccagguuacuuuuuguuccuuucugagaaguuuggguaugguugucuuagggccacuuugggagguguuugauagcacugcucccuugaaucuggucaccugcagccuucuaucagaacuucccuccuggguguccagccguauccuuccagcauuccuuggcucugacacgugcuuggcuuuaagcucuuuguuggcuuccagggaaggacauggcagcugugcagaggacccugauggcuuuaggcagcguugcagucaccaaggaugauggcugcuaucggggagagccauccugguuucacagguaaaagccucuuccuugcccccuggaccacaaggcgauuuuaaccagagggagggucugaagccuuggaacucuacagaggcuuuaugugcaaagccccaggaccaagcacugcugucuccacaacugaguuccccaaagcaaugaaagacugaugcuucuguacaggccaguaaccuaaccagagcagaaaugguugggccuuuucuaccagauaccucccagcuccacccagguucuguuucuccugaggcucagcaggacuggauggccuuucuugaagguggcuucaugucugaacuuggcuuuauuaugacuuaagccagcucugagcuuucuugccugccuggcugcuucccucccucccucccucccucccucccucccucccuuccuuccuuccuuccuuccuccuucccucccucccucccuccuuccuuccuucuuuuuuguuuguguacuuaauaaaggguaaauaugucauguuuguuuggaacagucaugguuaauaucuauguugucccaguauaucuauuaauagaacucucuuucacucucaacagcguccuaguccggaugacaaauuauaugguuaucucucaguaaagggucuuuuuuuaaaaugauuuuuuuuucaggggguaggguaggcaggaagcuuaaacuggguaauuuaguuguagaagagugcccuguggcaaauaauugauuauucauuuccagcauccccuuuucuucuccuugacaguuauuaaaaaaaaaaaaguuaccagcuuaugucauuuuaaagaacacucgcccugaaaacuucugagagguuggccauuugaaacccugguuuuagugucuguauuauuagugaacuaccguguucccauguggcuacacaaccacaauuauguacuaucuggcucuuuaccaaaguuugcagaccucuaaucuagagugcgacauuuccccucauuaacucuuaggucccuuggcucuaaaaggguauauucaucuuggcccuauacagggaaagggggaaugggauuaaugaugugcuuuguaagaagaaccaauuuuaauuuucacaaaggcuugacguagcugugagagaaaggguaagaagaagcaggcuucuucuuagaagucugagauggccuaaaguggugggggaagaagggagaguggggagaaagagaaacaagaaaagcugagagugaauuccccagagagguagccacugauucugcccuacucuuugcuggaauucuggaaaacaccugggcuucuaaaagauagggagcucaugcaucaugguagggccacagcucaggcuagggccagagauagcucagaguagcgccacggcucaggguagguccacagugcaggguagggccauagcucagaguagggccauagcucauaaccacagcucaggguaggaccugcugaucuauuuggggacccccagcagagccugucuaauugcauaucuugaaaaggauuggaaaacugucauaaugacauuauucccucucacuuuccuuguccaggaaagcccagcagaaucggagaggcuuuuccgaggagcagcuucgccagggacagaacguaauaggccugcagaugggcagcaacaagggagccucccaggcgggcaugacaggguacgggaugcccaggcagaucauguaggacgcggcauccugccccugguagagaggacgaauguuccacaccauggucucuacgaaaaagaaauaguuagucaccuucugaccuucuccucuuucucaaagccuucugucccugguuuuugcaagugcugcauuuccgccgagaauccgcguugccuacugcugccaccuccuguucauuuagaacuaugcaaagacuccgcuuccguuuuccugagcuccucgggccccagagucucuguuugauuauuuauuuauuuauuuauuuauuugccaaaaauucuccucuucaacuuauagaaugcaccuaauaaaguaauuagucuugugucuuaca

SEQ ID NO: 18128 - RNA, 52216 nt, Homo sapiens
ugggaguccuggugccgccggcugcacuucugugugucuuucaggaagccacagggcagggggcgucugugcagagaagcgggggagugaguagcaggcaggcccagcuuguguaccagcccagugacauauauagaaacauaaaucaggcuagagccggcgcgcccgggcgcgcaccuguguauggacccgcaggcaugucuguacacugggugggcaccugucuugugaguggcuccggguguggcugcuccucggacuuucaguuuauguaagauuuaucucuaggggccuaccuucccccaucuccagaggggaacauaagaaguuuaacggagcugggacugagcagauuaagggaguggagcggaggcugggccggagagaguggggacugugagugcuaguggguaaggauccaucuguuugccccgucccccagccagaaaggcauuuuggaaagacuggcguggcaagcgucgcccugaaacguccacagagcccaagaagugaugaucacugagugaguggcacugggcugagacuggccaguuuguuaacaacagggaugcuagcaguuaggaaggccaggaggaaacucaggauggggaccaucugcucccccaaccccagcgggacaaagacaucaucggaggucugcaaugccgacuggauggccucgcuccccccucaccuccacaaccucccccuuuccaaucuggcaaucccagguauucgucuauuccuacuuguucccacuguguuuaauucugccauuuuaguguuguuaagggguuggguugcuuuucuauugugcugagaaauuaauugucagugaccccuuuuuauuuccaaaccaaaaacuuaacacugaagcagcugcuuuaaagagauugcaguacacugcaucauugguaaaaggacucaugaaaacagaagcaucauuguuuuuguuugugguuuuuuuguuuguuugcuuauauuugcuagccccauucuaagaauauuauccuucuuacuguuguuauguguaugugaggggugcauugucuuaaaucacuugaaggggaaaucaaaggcaaugaauuaaaagucacaaacaauuuagaucuggaucaaaauuaaaacugaaaaauauuuuauuucucauuuaucugaccuuguguauuggaaaaacaaaaaauggauaagcauuagagaauagguucagaaucagaacugaguauaaagacacauuuuuguuguuagaaagccagaauagagaaugcagacucucaucacaggcagucauuaggugugaugagguggugguguuugaagcuuugucucuguauguauguauguauacaggugucugccugacugauuuagaacugcagccuugaaaagcacuucugcuccagccacugucucucugccggagguuuuaugccuugacaucauuuguuaaauguguccucuuccuuccacucagaaggugguuauuguauguuuucuagggaaggauauuuggacagugaguuuggccuggugugcugagcaaguccuacaaaugcugauacuggaaagcacuccuagaagcaggggauggacuacugccaauccuuuauuucacucggagacauaacaauugaaguucacccacagacuaccagacaaacucccaaguauucccuagacccgucuggguuuuuuuugagguuugguugguuuuuuuguuuguuuguuuuugguggcugaaaaucugaccucaugcaacucccgaucuuugcuuucugugcaugaggaagagcagugguggcuucaaaugcaggcuuuucuuuacucaccuccucuuuugggugucuuccagguucauuguccucauaggccccgguugcuuuugagcaaggagagggcugcgaaauuucuuuauaguuaugaucauguauguuuuaucagccauugacuacaguuccuugggaaaugccagaugggcaugcuucagaacaggucuuuuccauguuuaauuggcgccuguggaguugucacugaaaugaugcaugggccacuuuuaacauuagucauuugccuucaggccuucugauggaauuauuuuguugagugauauggcagguaauauguguuugcaaacagaauggcaucuuuggcaggcccuaaauggcugugucauucagggcauguccgggguagguuggggcuuccuccuuccuuguuguacuuuggcucaaaccauaacuccagcucugcuaguggguuggcuguguacucugaccccgugacuguagaaaggaguugggcauuuguucugugauucauaggauaucucacaguuacuagaauugcuuggguagcgggggagcaaauagcuggugccagcugcugaaacuggaaauuauaugauuagccaccauggagaucaugcaaauucuuucacccugcuuugugaaguccgguccugcuaaggaaaaagaaaaaaaaauggcuuugacuccucaaaagaugcugaauucacugcugugaaaugccguuuccucagcaguggaagggacauuaaguguauguauguguaggcucaagacaggaaaauuacauauuaaaugcuagccauucauggacuucccccuacuaguucucuuuccucuaccucgagcuucauacucaccagauaaaagcuggcagucaagucaaguucuaccaguccuugcugagaaauccugaaauauaguaggcauuugggaaaugggggccaucaucgucccccuacuuccucuuuaacucuucccucuuaucaucaucugcaucauaauagcuauuauguacugagcacuaccacgcaggacccauuggcauacauuaccuccaguccucauaacuccaugaaguagguauuaacauccucacuuuagaguuaagaaaauuauuguucaaagagguuaaguaauuuucucaagaucacacaaauaguaagugguagauguuguauuuaagccccuguguagcugcaaaacccaggcacugucucugugccccugaggggucuugggaauggcagagcaguggguguaaucuuuaacugaaagccaguuucuucaaaccauccucugcagugaaugaaagaauuuuuaaaagcgagugguauuugucuaagugauuaucacuuugaauauauagguagauacauacauauuauaugcacaucuacuuguguacauauauacauauuauauauacauaugccuguuuagaauugaaacccaguaaguuuuaaauucaauuuuagugcuucaaccuguugugugcgugugcgcccacaugcccaaucuggggcaucuauaggacugggucagaucuaucaggauggugaugaggcgggggacaugggaaagggcagggaaaaggcaagccuucuggcaacaauagcagaaaugagauggaguaaacuaugccacguuugagugcaccugcugccuuugccuaagucaugaugggagagaacaugugugaaugugcaccucucaacagagccuugauguauuauuuuacuuccgcaacuguuaagaacaccuguuaauggccaauaccaccaaacauauuaaaauaucuuggagaagaaccucaaaauaauucucauugcuaacuguauagaaucauuugaugucugaaggauaaaggauccagacaucauaaaagacagauuuuuaaauuaaagcuuuaaacucuacaaacauuuucacugauuuuuguaaaagcgugauauucucuauggacaaauggacuaaugggaagacauuucucuauaauguauacugcuuuucaaugaauuuuuucucuguacauuuuaaugcuauuucauuuuuuaaaaaacacuuucuuucuuauuaaagguaaacuacuugguuuacauuuugggaagguucuauugggaagagccuugaacuuaaggguugcaaaauuuauuguugauucuugcuguguaauauugaagaaguaucuaaauuucucaggacauaguuucuuuauuuguaauuaagauauuggguuaaaugaaauauagaguccuuuccagauuaaaaauuaugugauuaauuugaggguuuuuuuguuuuauuuuguugccuguucuuuguccaauguagaaagagcuggaaggaaugauugggucauuuuaggucuaaaaccuauuucuuuuaugccucuucaaaacaagaaaauguauaaacaagguuucacaauugccagaaugaagcagggucuauucacuuuagccucuuaaaaggggcuguagauuacuugaugcaaaugaacuuuuaccucaucagacccuaagugcacuuuaagaaaccuccauagagauauuuauauauauauguauauauguaccuucaucauacauaguuuuuuuaaaaagaacuaauuagaagaaauuuuaaaccagagauauaaauaacauguuacagaagcacacagaauggaaagauuaauuccaccuucugagaauuaggaacuaccuuguugagaaaauagcauuugaucuagaauuugaggaauggucaagacuucaagggauauggguugagggucaggguugggaaggaggcuuuccagguggaauggggguauaugggaguaaauggggguauaugagggaaauggcuagaggacacccucucugguccuuccauaucccuguuauaguuucuuugucauaguacuucucaacacauuguuauuuuuaaguguauguuuuucccaugugaacaacuugcugacagaaaauaucuuauuuuccuuuauaauccugaaucgcaguagaagguagcagcgcagucauuggugacaguugagugaauaauugaaaguauggaaaguauggaguaagaaugcuggaaacaugguuugcagccaccgcuguuuuucauugugaucagagcugaauagauugguuaaguucagcuuucacaaauagccacaugaaaccauaugaagauuuuccaauccauuucuuguuauugcgcauaauauuccugaagauuaggcuugauaaggcucaucacuaagccccauuagaaaugaaaauuuugaggcugaaaauggucgcaagagucagaagcagagcccugguguaacuucuuuucuaggagcgauucuuucacccaacaucccuccugccuuccuucuucccuugucaaauuagagcuuuucaucuuugcugccuggcugcugccucucccagaucucauuucuuguuccccucuuugcuuucuuuccacugaccugaccuggucuccagccuucccuuggcagggucaacccuuccacaggugcuccucacugcucuccgauucccagaugauucucugaucucauguugcuagugaucauucccuucuuuucuuuucuaccuuucuggaauccuauccuuuuccuagcaguuuugcccuugaguacuuagugauuucuauaggucuuccuccuguggccgcacacccucuucccacaugugugacauggagacaaaaucccuuaguggagcaggauggagucauuacucagaucuugcuucugaaaguugaaccagauuuggcauaucuaaaagagauuuggagaccaccccaaaagagcacaaaauaaauuguguaacaagaaguuuugguuggcucuacuuugaggauaguaugaaccgugaguuggcccuaaaacaaauccauuuuccuacaggauuugagguugugggaaaccaaggaccaagcugaaucuaccaaggcugacucaaucaugaaaaaaaaaaaaucauacaagaccaaaacugucucuuaaaugagaaucguuuauuuuuguuuuguuuugcuuuuuccccccucugaguggccauggugaaaaauaaaaagacacuaugacuguggugguuccauuaguagguuucacucuuaaaaaggcucaucauuucucuagccaucucuccuccugcaaaucacaaaagccacaaggaauuccagaaucacacaugucuauaaacagaaagaucauggauugguuaagaguaugaauacaacagccagacuaucuggauuuaaauacugauucugcccuuuacaagcagugugacuuuggacaaauuacuuaaccucucugugccucaguguccuucucuguaacacagguaaucuaugcaccaccucauuucuuagugugagaaauaaauuaauucauauaguaugcuuucucucacaaaauaagcacuagauaauaauaacaauuguuauuauguaucguuuaaaaaaaucaaucagaacauucauuuauugaaagccugugacuggaauggacaacaaaaaagagguguaaaaugcaguuuauacccucagguaauuuacaaucuaguuaaggagcuggcuguccaauuaaacugucugacucaguguucucugucugaucagauuaggguaacuugaaugguuacccugcaaaggaggcuuuaaaguuaagggaaggauacacggaggguuccccaggaugugagugccaagggugucuuagaugcaauagcagguggcugaucaagacagccagaaaacuuucuuuaguuauuuacucuguccugucccaucccaaauucagcugucagacugucauccccagacauccagagccuuugggaaaaacucagcccucugugacagaaacauguuguuaacuuuuuucugcucuccucauuuccucaucacuugcccuccuaacccagucauuuuguuccuagcuugagagugggaauguuacaaaaugcuuuccuuugaacaaauccuuauacauguuuuauaauuccuucccccagcuauuggaauaauagcuucaucaucccuccaaacacauacaucacccacacaugcaacacacauguaccacccauuacccaacacacacacaugcacagauacuuagcuaugacguuagccucagccucaaccuccacugggcccaaaucucaauacaugcuaucguucaccagucauaaauaucuugcaaaacaugcccacugacacuucagacccuuggagcgugcugcuugcaccugcaagcuccucucucagacauguuucugaagcugaggaguugguuucuaacacgugaucugaccugaccuccacuagauugacagguagcuucuacaucucucuccugccucuaggaacuuaggagcacaggcacacuaaagguaaugcuagugaaaugcuuuagcguccugcaacuuugccucugggaaaaucgcaaaccacuuugccaaugcugacuaaccccaauuagaguuucaaaccaggccugcagaggagggauuauuuguagacauuguaauagguggguguguuugugugugugaaaagaauuugaacacgcaucaagaaccaaauuuagguggaggagaucugugacuaaauuuauuuuaguauuuacauuugugguuaagcaggaguccuuccaccuucucucuuguguuguuaaacaucgauaggaauuuggauuauauuacugaacacugugaggaucaaaguacaugggaggauuauauuaguaggucucuagguaacuucaagauaaaagagguugagcuacagaggucugcauugcucuaaggggcaugccuagguuauaucaucuaugaaacacaggcagucuuuuguggauucauugucuacuaagcagcuaaaauuuucuaagaaaauaacagguugggguuuuuuuguuaauguccaauuacucuagaacugucagcuguaaaguaucauuucuucuuagagaauguucuaucaguauuuuuauuucuguucagaccugacaagaugaaaauaaaggaaaaaauaguacacauuugugcgcuauaaugcaaaugucuuggaguguggcagcagucugcaguagugguggaacugaaaaaugccuaggcccugucagacugagaugaauauuuuaugaacauguaugauuuggaggcuuauauauuaaaagcauuauuuuuaaagugcgauugaaaccagauacaccccuccccaaauaaaugccaaacagagaaaggugaaaacagcauucucguccacccuccccagguucgaguuuaggugaucaucuuggcaguagguguccauauggauccucacaagaauuauaugaguguguuguguuaauuuggcuaaaaauauaugucagugccugcauacuccuuuugcuucuuuugguucucauugccuauauuuaaaaaauuguauucauuuaaaggaaaaucauuaacucaaaagguaguuacugaaugcccuuuugugccagguacuguguuaaaucgggugaucacacagauuuguaagauucuucucccugcucuuccugaaaauaugaccuuagaagaaagccaaaauucaaacaugauagagaaaauguauggggucuguaacacucagaaaaccaauacccaauucuguuacugguaguaggaggaaagcuugguagguuggacuuccaagagcacccuuggguugaaauauaaauagcgaggaguagaaagccaggugucccagugcagagggacugaggagucagacagcauggugaccuugggcaaagccaagcagucuggugugguuagagcauggauuuuauuuaaagaaaggaauagauaugaggcugggaaaguaggcaagaacuagauccuaaugagccuuauaugcccaugccaagauugaaugucauccugauggcaaaaagcagccauucaaagaguuggucagaaauggguggaaaguccccccuaaaauaacugcauaagagugaagugaaacaaaaugacccagcaguuauuagggauacuguggguuaagaugagaaacucauuguuucuuucacucuauucaacacuuguauaauuuucuuccauauacugggcucucuccuaggcacuggugauucagugaugaucaauacagacaugguccuugccuucaaagagcugacaguauaguuggagaaauggucauuuaaucaagcaguuauaacacaauaugcuauguaggaugacuggagagguauacauuacugcuggaagaagcauauagcaagggcaucuuaacaagacuagggaggccuccuggaggaaguuaugaauaaacuaaacccugaaaaauacacagaaauuagcccucaggauaagauaaacacaguaaggaugcucuagagggggaaauaaaaugagugaggaucuugaagagagggaauggcccauuuaacaaaccaaaauaguuuauuaugguuguacuguggguugcaaggaggagacugucagggaguaaaguggcaacauacuuagaggucuuaaaagccauguuaggccaggcgugguggcucacaccuguaaucucagcaauuugggaggccaaggcaggcagaucacaaggucaagagaucgagaccagccuggccaacauggugaaacuccaucucuacuaaaaauacaaaaauuagcugggcaugguggcaugcaccuguagucccagcuacucgggaggcugagacaggagaaucgcuugaacccgggaggcagagguugcgaucagcugagauugcgccauugcacuccagacugcugacagagugagacuccaucuaaaaaaaaaaaaaaaaaaaggcauguuaaaguuaucuuacuucaggcugggcacaguggcucaugccuguaauaccagcacuuuggaaagccgaggcugguggaucacuugaggucaggaguuugagacuagccuggccaacauggugaaaccccaucucuacuaaaaauacaaaaauuagccaggcaugauggcgggcgucuguaauuccagcuaccugggagacugaggcaggagaaucacuugaacccaggaggcggagguugcagagagccaagaucaugccauugcacuccagccugggcgacggaacaaaacuccgucuuaaaaaaaaaaaaaauaaaguuaacuaacuuuaccugaacaggagugggaaggguuuuaagcaugcaaaucacaaggucaacuuuguguuuuggaaagaucacucucgcugcagcacaaaguauaugggaacuaggaaguacuguaaccaaggggaccaauuagguugcugaugaggucauccaagugggaggcgacccugaccugaggaggagggugacagcauggacaaagaaaaagagaaagugucagcaggacuuggcgauuaauuggagggcaaaagagaaggugcaaggggcuugggugagagagaggaaguuaguggcauucucaggaauauggauaaaggagaaggagcagguuuagaggugguggaaggaagcaggugcuuagucuggggcaugcugaauuugaggcaccugugggacauuucagaauugggagaagggcacaggugggacacaguggagaugguuucagagcuaaaucuucacauuucacaauuugcccaaccuucuacccucacuaacagcuacuauuauacccaauaucagaagguuugaauuuaaagcugauauccucauuuuuagauuauauauuuuagauuugaacuaagauuguacuucuuuuagaaaauuuguugaguuucuauucccagagaggugcccccucguguuugucuaguguccaguguucugccuguucuguaugaauucucucuuggcagcuugggcaugaguguaggaguuagcuuguguauacuauaccauaaaccagcugugaaauggaaacuuuuaguugcuuuaccacaaucaucaaacacaauuuauuucauacauggacaucucagguugcaccaauaagcucaaaaaaagcaggagaauuuugcaguagaauaguucauuuaauguaacuuuuucuccuacccuaaacauuuuucugguuucuccuaaagcuuauuauuguucuuucuuguguguuuacaaaaagguuguuaaagcaaauaugguuaucucagagcugagaaggcuuauuagggaaugaccaagugccccuugcaagggguuacuucacaaaaagaugacgccaucuauuuggagacagagcaggaugcaugguagcagaauagaagaauuucuugugaaugaauuaucuacaaugucuuauuuggaguagggauuggggucuauuggacaauugaagaagagaaaaucuuucaaaagagaauagguaccccuccccauguagagggcuuuaaaaugcucccccccacaacaugggauugaaaacccuuuggcucacauaaaucauaggacguuggagcuaacuuggggaauaccuugggcaauggaaugcucauugugccuugcagagcagggaagguuuaguacccuuuggugccccucuggcaaucucagguuaagggguggagacuguuggggagaaacuucaacuagagaaggucugguugcauuuguuucacacauagauacuucauuugaaaguauugcaggucuaaaaaguacccuguaaaccucugauuuacuucaauuaucucugagcucauccagccaguugcagggguagaccaagacagacuuuuuuaauucccaggcugucucuccucagacagugagaugcaccuuggcuucucagcacauaaaaaagaauaaguugaucaacauccucugcuuccaaguauucugccuuaaacaguugcuuuauugcauuguggauaauuaugaauuuaauaggcgacugauuaaaaauuaaauuggccacauggcucucucagauuuugcaggcaguuugaugguuauuaugaauacucucccacaugccucauggaaaauaaacaaguaugauauguugagaagaagguuuaaagauguuaucuuugguucaagggacuacuaaguggccccccucauuuggaaucuuggacucauaaugacuaauuuuguauacccuaaagaugccucagccuuucucuacuuguuaauauggagucaagcucucuacaaaugucacauuuuucucaaggaccuaauucagaagugugagauugguggcuccaaagagauauuauuagaauauaauuuaugcaggcauaaguuucaggaaaucucucugguaccuuucuuuuaaaauuguucaauguaauauuuuauuauaguuguuccuuuagucauccuuucugguuaauuuuguccucuauguuuucugacacauuccucuucauugacccagauaacucaagcuagaaggaaaaagggagauaaauggagcuaggaaacaggugcaaggggugaaaaggagcagagagugaacccuaccuguuuaauguuggauggaccuaauagaaguuugggaaaggaucaggagagcuaggcccaccagccuuaggcaacucucugagcaucuguucauucaaguauccaugcuuguauuuauucuguauagaugcauuuaguaccuacuaaauuccagaaacuaaguuuggagauauaagcgugaaguugacauguuccugcccugaaagacuuucacuuagguggcagagacagauguggagauaaauagcacucaauguccuaaguucaucaaauaucaacucacugccauggaaucacagaggaaagaacaggucagucuccuugguagagucaggugagcucacagacuaaugaugguaauuaaaauggaaaggcaagggacaauaagauuguccccaaggacucuaaggguuuuuuguuuucuuagacaagucuuuugcuauauucaaugaccauaaggcguacuuauauguauuaauaacuuuguaaauuaauauauucuuaacucaggccucaaauauuuuaacaugcacaauuauuaucuguucauauuaaauuuauuguaauauuuguauggauuaaauaccugaauuggaauacaagauguuuuucuaugaaagccacccuaaauaucuucagcauuuaagaacacauguucaucccucuguucuuuauggguuuuuucuuucuuucuuucuuuuuuuuuuuuuuguuuuugagacagggucuugcucugucacccaagcuggaguacagugacgugaccauggcucacugaagccucaaccuccuggcucaagcaguucuccaucucagccuccugaguagaugagacuacaggcacaugccaucacaccuggcuaauuuuuuuuuauuucuaguagagaccaggucaggcuggucucaaacuccugagcucaagcgauccucucgcaaugaccucccaaagugcugggauuacaggcaugagccacugugcccagccuuuucuuauaucuuuuauccucucucucucuuuguuauucacacaggaggcacuaugaaaaaguaguucagaguguagguuguaggcucaaauccucgcuacuauuaauaguugcaugaccuugaguaaaaagcuuuaccccucugucuguuaguuuuuucaucuguaaaauugagauaauuauaauauccacuucaaaagugcaaaguuagaggaagcacaagcuggaagacuacccucacucugauaccaguuacagguuugggagccuuaagaucacccuuguuugauaauuugcuaggaagauugacagaacucauugaaaguuguuauacucauaguuacuguuuauugcucugaaaggcugcagaucaaaaucagcuaaaggaagaggugcauggagcaaaguucaggaaauuuccaaauguggagcuuccaguuguccucuucucauggacaguguuucuuuccucguauugaugugugacaguaccacacaaaguacugcuaaccagggaagcucaccugagcuuugguguccagaaucuuuucuggucuuccacauggcugaccuaaguauccagccccuucagagguuaagcccaugcccaugugacucaaauccugcaccauaaaucacauccuuauacuuucccuuauggcccaaagcugucagguaaauaaagauacuuugaucaggcaggacauuccaagggcuuaagcaauugccucccaaggacugagggcgaagaccauaccuccuuuuggguaagguuuaaauuuuuuacuacacaacaaaguuacuuaagaauuaaauuucaaaaaagaauuaaacaagauaaauguaaauuaacuuuaaaaaaagaauuaaauaagauauacaaugugauuagaauauugccaauuaugaaauaaauauguuauauauauauauagcuauuauuauuaaacauccuuuugauuacuuaauauauaccuaauaucauaauagcuacugugggacauuuuuaaaaaaugaacaagauguaguuuguagaucuuauaagagauauacaagaguucaaauaaaguaaauaaaagcagaaugaggugaguaccaugauaaagaaacaagcaaacugugcugggaccuggaaagggaaagguuacuucuaguugguggguaaggaacugcuucaggagaagagcaccugugagcuggacugugagagacagggaggauuucaacaugaagagggaaggacauuccagagacagggaagcaaaugcccaaaauuagagaugagaaaacaagggcaccuucaggaaacagagaagggcugccauggucaccuguagaagugacaggagaaggaaaugggaaaguuacggaaagacagacaagccaguuggagagagauuuucagcacugugcuaagcacuuuaugcuuuguguuguagaccauagggagccagugacaauuuugggcuugaagaaaacugugaaagaaaguguucuaucccuguuauaauuccagucuuugaacacccucccuuccaauaacccaccuucgcuuugccucgccaauuacaguucaguucagguaugaccucugugcacauuuccauuauaggacaugauauaccccauugggacuguuucucucugcuguauacaacuguuuugucauuucuguauacuugcugucuuguucagaauaagcaccuuaugauaaaaguggagggaaagaagaaggaggggaaagauggaaucuugaaauauaucuacaaagaauuuaagcauaaaaaacagauauuuaaaaaucuauauuucuaguuaaggagaaacuaggacaggcaggaagcaaguaguaacgccuaagguaagacaaaaucuuauaacugcauugcagucuucucaagaugccucaaggcuuuaagaguaagaacaaguauaauaauaauaaaagaagcagaagaaagauagcuugcucauuuaauauuuauauagcacuuccuaggggaccgauauugcuguuugauuuauauaaagccaauuaauuauuauaauaaauuaaugauguagauacuccuacuauccccauuuuacagaugaagaaauucagucacagagagguuaagcagauggccccccaaaauccugauaacaauacuagaauuguaaaaauuaggucaugccaaauucauuuaauugcauuugaauaaaagucauugauagaguuggagauugacccaguguuggguuguaacuuuaguuucuuuuguugguuguaauaaaggguaauuuucuuuucaucugaggccauuugcucccaugucgggacucuaaugcaugagcacccaugaggauggugauguuugaaggacuacaugcugaccuguucuggcugaacaaguuacauuuuuuuuuucaagaccagacaucuaggaggcuuuuuauugacucagaacaaaagcagcccagugguuuaaguggucuauguaguaaucacccagcaaggcuccggcacagaaaaaaaucuaucuggccucuauucugccucuacacagaaagaccagcaugaggcuuuagcagguguguaagcucucagaacacuggucuucaagggugggguguguuuucauucacuuuccccguuggguguaauguacaaauucccuuuaagcccaccauuucauguaauuuaaacugcuacuuacuggauuuucucuccucccuuuucccuuuccucugucagaacaccuagcuuaggccuuuauuuacaggaaagagaaaaaaaccucuucuuauccuggaggggaacuagcuaagaagcuucucuguaucucauucuccaauuuaucaaaugaaucuuaaaauaacucugcccugugaaaaauuccagccaaacuagguaacuuuaaauauguuuuuucaaagucccaaugauaaauuccauuaaaaugacccacaaaauaaugaaacaacagccuuuaaagugaagggcacugucacauaaaugcuaaacaauaagugaacuauuagccaaugcauuuaaucacuguaggacacaccuaagacccaacaggaauauggguccuaggaaucugugugagcagaaagaaggucuccagcaauuugacgaaauucucagccaaaaagcaauaaauaccacuuuaggcuuggaaugauuugcuuuuugcaaauaugaugaguuaaauuuacaggcauauuuucuguuuaaguaugguaagugugaaagaaaaauguuauuucuuugcaaugaugaauaguccuucauaaauauggucacaaaugccuuuaguaagcuguuaauaaguggaauuauccaauucuuaagauagaagagacccuaagucgcauuucacucacuuuccuaaguuugcaaaugaagaaacagaauuccaaguacaaguuuggaagcccagguucacagaaguaaucacagcagaaccagcacugggauucaggcucagcuguggaauuacagacuguuucuucaacugagagaagguuagagugcccuccugugucccuauguagaaauucuuuaggucuuuacaaaauuuaaaauagcuuuaaucucuucaucaauuuuccugcacuggcagggaccaggcauuuagguccaaagacaaacucugcaaucaccauguuauugaaaguaaaugaacaaugcacuugacuuguuuaaucaauaaggacauagaaccaauacuaucauccccagaguaucuuugugugcacugaggucugacagaccugggucuaugucccgggcagccacaugcaaucuuugcaacccugaacuaguugcaaaaccagucugagccucaguuuccucaucuguaaaaugcagguaaucacugcccugcaggauuguagcacaggucaaaugagaucauguaaguaaaaugcccagccuggcauuagguacauaauaagcacucaauagauugaaguuguuucaguuauuuucaggcaagagcccccaccaggguuauaaaaaaguuaauguuaaaagagcugagguaaaaacacuggggagauaaacugaaugucuucagguuccuuuuuuauuuuuuugagacggagucuggcucugucgcccaugcuggagugcaguggcgcgaucucggcucacugcaagcuccgccucccggguucaugccguucuccagcuucagccgcccgaguagcugggacugcaggcacccaccaccacgcccggcuaauuucuuuuuguauuuuuguagagacgggguuucaccguguuagccaggauggucucgaucuccugaccuugugauccgcccgccucggccucccaaagugcugggauuacaggcgugagccaccgcccggccaggaugcuuuuaguuauuaggugaaaagguuuccaugaguuccaggggcagaggaaagggggagagaauuuuuaaagagauauguacugaauaugugauuccugaaaaaugaauuucuucuucagauggggaaauuuaaaugaaccuaagccacauggcuugaccacagauagaagcucucucucaaagguaacaccuggcaguaaggguccagcaauauuuuuuuaaaagccucuauaugaaagaaaauauuugaaaaccagauucuauuuaugucauugacccaguuuuagaagucuuuauuuauugagaggguaaccaaauuaaaaucaauuaacaacagaggugaaaaacaauagcuggaugaauucauccuuugauguuaacuuccuucaacucuucaugaaacgagcuaucucagcuaaaguguucagcaaaauugcaguaaaucaaguccuuuugccaggugaacuuucaaagguucccucccccucugaccuuagguaauuuucaguuauccuuucccuacguguggaagggagauaucauuauuuaugauacaaggagacuugaccuuuaaaugucaguggaaguguagagucuggccauucugucuguaucuuccaccagcuuauaggagaauuaagggaaauaguucaauaacgugcaaaugggaaagagggagggguagaaggaacacaucaucuaugccaccauuuuuuguuauauaaccagggaaaagcaaagggagaauugggcuggccucuguuaucuaaauacuuauucuagauaagacaaucaccaggagguuuauauagauuauuguacugcaaaagcucauaaaaggcugcucagaguuugugaggcuuaccccugagccccaggggcuugcuuacccuuuccaguaaucuguuaccuuuaaauaaggcaaaugcagcacaaggcugaggcauuuauuauuuauagaaaguuccucaucagacucaucuguggcuacggaggagcagagucggaaccucugagccuccgcagugacgaccugcugcauucuacacuagugcagugcuauucugagcaacgugaagcuuaagcuagacucuuugugguuguacauuuuuagucaacuaaugaaaagauuucccugccucauccuugcaagucaccuauuuguguggauuaucugaacacuacauuuucuggcuauuguaguuacuucaauaguaucugugaaaugcuguauuccugguguucaucucauuuucuacuucaugcuuuugugacuuuauacaucauucuccuucgaaugcccccagaucgauauaucuugcuucucgauguuuauguugcuagcgcuuuggguaggguuuuaauuccaguauaccaagaaaaacauuuguucauaaaggggucuuuuuuaagauguucaucucaaucagagagaaagcuuucucuuguacuuucccaccuccuucaccccuuugugugguauuaucccacuccccagcuaggucuacaccugcuuggggacugugauccaggcaccaggugagaugaagccaggaggcaagguccacagagcagagccccuugagggauggggcaucaaaauggcuagacugagacacgugugcuucagacagcuuaauaauaggcuaccccuucaagcugucgcuuuaaaaauauuuacaccucauuugguaaaaguuguagaagugaaaguauacugcagcuuugaaaauuuucuauuagguuugccuccuuuccugagucuuucuucugagcccugcagcccccucugaucccucuccuuuuccccuuugauucucacccuccucagccuucacucccagcuucucaaccucucucuguuuccucagcagauccacugaggucuuuccaagagucuaucucuaaauuggcauaccccuacccacugcuuaauacugcuucaaguaugucaaaagcuauuaaugccagagaugaauauugcaguuggugcucagcaaacagaagauacuccagcuaccaguauucacugugcuuagaggagaguggugauuaaaaaugacuuuuucucuuaucgcauguucauuuucaagauaaagaguuuacuaugugcauugaagagagcuuuuuuuuuuuuuaacaucuugcccauuucauaaggagucacuggugaaaaccugcagcaacuggcaccaaauuugcaguuuuuccaagcaauaucuuaacauccuuuguagacuagucccuuuagucacugcucuguggccaugccccucaacauggcuguaccuggaagcucauaguccuggcagagcuggcugcuguugugagucaggaagauguuccacagggaagugagcuggugacagccuccaugggaagucagagcuggacccuaagggauccggaguccagcuaggccggugcucucugaagggccagagagguguucuggcauauccucaucacugucaaagucugagaguggacauucaugcugaaggaggagcagcuccuaaauggcucuucuuccagaaacuuggccugcugauuuugccuguauugccuguaugcauauugagacauauguugucagccauuuguaaaaugaaguagugguuucucuaaaccucaggaauauauucagaguuuuuaaucagggugaacuugagugggaauguuuugacugccuucguuuuaguacauuugaaaaaaauguugaauuucuuaaaaaucauaagucauuaaaauccaagcacuuuuagugagauaauguguuugagggccuaaaucucauuuuuuuacccauuuucuaaaaaaaaaaaaaaaaaaaaaucuuguugaaacauuuuuaauagaaauucuaugaagauagggucuucuggcucuccauaaaucaaaucauaaaaucuucuuacaguagucucuuuuuaucugcaagugguauguuccaaggcucccaauggcugcugaaaccauggauagagccaaacccuauacauccuguaauuuuuccuguacauacaugccuaugauaaaguuuaauuuaucaauugggcacaguaagagauuaacaacaauaacuaguaauacaauagaacaauuauaacaauaugccagcaucacugcugucgcacuuuggggucauucucaaguagaguuaggguuccuggaaaaccaacacugugaaacugcaacaggcaugcuuggccaugcuuaugucucuaagaacucaucauuaguauuuucaguuuguagaaaacauacagaaaaacuucugaaaacauuacugguucugcuguuuacauuagggaaagauuaucuguugaugguuauauugguguuugaguguuuuaaugauaacugagauggcuaagugacuaaugguuggggaaccucuaccaaguagauaugcuaggcaaagggaugauucacauccugggcuggaaggccugugggauggcaaaacacuucaucacgcuccucagaauggggcacaauuuaaaacuuaugaauuguuuauuuuuuaaauuuuccauuuaauaguuuuggaccacaguugacuguggcuaacugaaacuguggaaauugaaacugcaaauaagaagggacuacuauuuuuucucagaaaaauucaacucuuuaaaauugguuaacaacucaugagguugacaucucugaaacccucaaagauggcagugaugagggaggaggagcuauuguuuagcuggacaucucugauucaauuccauuggaggggggcaucuguucucauuuucguccuucagagaugggaaaaaauuacucuuuuucuuggcuugaacacuuauaucuucuaucuuuuuauaagcaugauacugcuuucucuucugcuguuugcacagauugucuucugaccuaguugagccuuuacugcugcccagacaccuucugguagcuagcaucauaugaauuacuuagcuuuauuaagauaaagugugagcaaaggguuuuuuuuggucuuuuguguuugggcaccuuuaauaucuuuuugcuguugcugggcagggaagagucuuugcagcugagaucuuauuaauuugccuagaauuuuuuuuaguuuauauauuuuuuauuaauuaggaaaacuaaauuugacauucaaugcaauuuuaugcagcaucagcuauaguggguaacuggaaagauagccgcaccugguuuuuuugcaagcugccugcauuacucugaccucacuugacaaaguauaggcuaauagagaaagaauaugcaaauuacagacaugugaccuaaaauucagacugagauaaaauagacaagcuuuaauugaacacucugacuauucguuauagaaaauacaugcauauccaauauauguuuuuagcccaagcuuacgauggaccgaccagaugaucuuaguuuugauagaaauaauaugauuuaggucuugauaaaaauuuggagcuuacauggcauuuagaugacucucaaaaaugagcucaaaauaauauuugucuuuaaaagaauuuuuagagaauaauuauuaucuauuagaaguuuucuauugauauuaguaaacauauuuccaaauaaaugaaaggugggcuuuuuuuccacugaauaagagaauuuucuggauuucauuuaagaugggccaguuuuagugccaacauguacacauagacaugcacauaaauacuuugguaaccgagaagaccuuagcuccaaacacgucuguagauauuccauccaaacucuugcuauccaaacauuugcuauaacuuauaagauuuauuuuauccagaauucacuacuuaaauaaaaaaaucccaucgugugagcuagcaaaaacauuuaaguugcagguacaccuugucaaaaagauggagaauguguuacauccauaguucagcuacccucccagcaggcucgagcugugcauuagcgcucucaacuuaccacauuauugagugagaaugucuucuaagaaagcaaaaagccucugaauaaaacaagcacacucgagaggccuaaaaagaaaaauugggugauaaagcauauugagagagaugaacuaacauaaacuuggccauacuuacaucucuaagaacuaugcauuaauauuuuuaauuuguagaaaaaaauacagaaaaacuucugaaaauauuacugguucugcuguuuauauuagggaaagauuaucuguggaugauuacauugguguuugaguguuuuaaugauauuugguauuugagaaaacugauaggguuuuuuugauggguugggaagacauuacuguuuuuuccauuucaaauaauggauuauauaggcuucuacucucaaaaaaucugucauucaacaucuuuuuggcaacagguuggauuuguuuuuccauaaaaaucacuugaugacaucuaauuuuauguuguuaaaaauaaaaaguuuaagaacauccucagaauuuucugucuuauacuugcaaauuguguagucacuguauuuauuuccaaguacugacauaggagcagacuagagauauuaauaauuuauaauuuuaguuuuagugccaauuugaauuucaacuguagaauacuaugauccaaacuuacuccuuuugauguugauuuuggguguaaccuaaaauaaaugacuuaaacuacagacuucauuuuuccuagcccuaaauguuaauugccaugacagauccucaaauauaaauauuuacugagguuucauggcuuuauuuaaaaaccagaauuauuuguuucucagauaguaucauccaaauaaaagaugacacaaauuucuuaauaauuaauaauaauaacauguuugagcucauucuauuagccaaggacucuucuggguguuugccugaguuaacucauuuagucuucacaacagaccaaugaaguuaguacugcuguuguccacauugugcagaugaggaaacugaggcccagcauuuuauucacauaacuaguaggcaguagagccaggauuaugaacucaggcagccugacaacagacucugugccccuauccacugcggggacacuccauuuagcuuauucagagcuaugguaauucacuaaguuagguguuaggacucaccauuugugaaguucuuucuuaacuaguaucuuacaaagugcaagucugaguccuuugggacuguguagacagaaaaaugauuuguugguaguccuggaaauugcaagugagaauacuuaaaaagauuacuggaaaagaagaaauucagugguucccaacccauuaguguucuagagacaggggaugggaauagaaccuuccaguacugggucaccuuauggaugggagggaaacauugcuggaggcauugagaggcaggccaauuaaggauaaaaagagacagugucagagguucagcccagacaagccaggaaccucagucuagggugguggucugucucagccuuuuguucauaaucacucccugaaggagucuuauuaggcauuucuauuccuuauuucccccccuccuccccugugaaauuauaacacucagauguaucuguacuuuguacauagaagaauaagauuuuucacucccuaagaacaaauuuuugcaaugucagugccuaaaggcacagauacacugaauggugucaauacacaugggguggggagagugggaucagugaagcaccugcaggaacuaaugggcuucaaaguuagaaggacuuagagacaggaggaccuaagggaggugaagacaggagguuuucuuaaauaugugaagucaggaguucuuugacuuagggucaccauccucaccuacccagauggggaguuucucucuaucuucuuauaagcuucacuuaacucuugucucaaucuucccuccauggcuacaaguguggucaucauguaaucugaaaugccauuguacuguaaugaaauguaucauuucauaguguguguuuugaauucuuuuuguuuuauuuauaaaccagguucccaagaagccugcuuuaaauucuuuuuauuugagcucagaaaauggcagcuacuccaauuugcaagaaauggguaaugaaagugcuuuaaaaacuagaaugcacucauuugagaucucuaauccccaaauggcaacccucaggaagaaucaagcaguaauuuguguuccagauaaagagcaaacugauugugccuggucuucacaaggccagcuagcucauuuucucauaccuuaccucucaaauaaucuaacacuaccuaggaggcaauaacuauaacacugaguaaaaaucuugcuaaccuuuucgcauucaaaucucucucuucccgugugacuuugcugccacagggacuugauucugagcucuguaaccuagcgcacaucccaaggauccuaguaaaccuuaaguaaccuaaucuaaucacauacuaggaggcaugauaaggaaaccaaggccucccaauauuuuucuucuucacaaacaagcugugguuauuuaauugguuaaagggcaggguguaucuuagaacaaaaggagugaugaagaaagcaucuaccaauacaugggaaaggcacuucaccagauuauuauuugaagguuugaaaguacuagaaguccagccagagaagaccaugcccagaaaucagagaacuuuugggaaacuauaaucuuacauuuguggcuguaaguaucaagccuggguauacauuagaaucagcaagaagcuugucagcuuccgucccagagagauuuugacuuagaagguuuggggugagcucaugggcacugguguuuuuuaaaagcgcccccugcucugccaccucccagugauucugauaugcaucuaagguugaggaucaccacuuuacauuauaaagugcuuucacauacaugauucaggauuuuuguaugcacacagaaaggaaaaagaaacaccguuaaugacuguugacuguaaaagaaaauaggaagaaacagggguaguaauugugaaaaugaaaggauuagagaaaagucaauuucuagaaacuggaggaaaaaaacuucaccuuucuaagggcuaaaauuaguccuaugcauauagaacauuaaggagggacuuguauguccauauuuacugcuauauauggaauaguuuuuagaugaccauaaaauucucagcacagagaagucugaaaacagucauuuaguauuugaugccaauuacuuccuaagaucauauugcuucuccucuauaaaugaaauauauuggagaagaggaaaaaaaaaauuuguuguuaguaaaaagguguguuagaaaaugucauauuaauauucguauguguauuucaggacuguauagacagacaauauaccucagcaggcucuuaacagcuuucagauaguuauaauuaauaauucugcaggugaaaacuggcaaguggaugaucuuggauauaacugaaggaugaaguaaagccaaugcugugggcucucagacuguguagggcggggcggggggucaggggcagaauauaaaagucagguugcagcguggcagaaguaaagaaacuugugaucaaaaagucagaaauuaaauuuuaagauuuucaaugugggugaugacaaacuuagacugugaccaaaacaguggugguggcuauagucaacagaguggaggcuaaguuuucaucuccaugucagcuaauaagauagagaggaacaaugaaucagguacagaaaauaaaaucuucuagaccaucaguauuuaaggcaagaagcuucaguuaaucagcccuucacacucugauuucugacuaauuaaaaauggcuaauaauagcaauaauuacaguucagcacuuacuaagugucaguauuguucaaagcacuuugcuuacauuucaauauucacaauaauuuugugacaauagguacuauuggcccauuugacagaugaggaaacugagacauggaaaaagcaacuuacucaauauggguuacaaaugcuggggagaaaauauagacauauuuggggugagaaaauauuuuacagaguaucagcaaaagugaacagaguccagaaaggggccugccuaucuguguauguugcauaccaacaguuuccaggcuauaaguaggggccugguaagagaugagucugaaauaaugcauugguaccauauugaagacaauucuaaacccccaguguugaguuugagcuuuauuuggaaggcgggaagugggaggaaugugucauaaucaaagcuguaucuuaagaaaacuaccuuuuaaguaugaacaaauuagagugaaaggacccaaauuaggguuucuguuuguuugggugguuuuugguacuauuugacaggcaaugagucuaucaaugagaacaguggcaguugaagguuaaugaaagagacagguuugauguauguuacaaaggucaaauguaagguuuugguaacugguuaaaugaagacggugagagagagggaagaguuuaaauagaauccaagauuucaagucugagugacugggugacuacuggcagaaauucaggagaggcacuuuguggggaugagagggccagcaggagaagcuagacuuugaaaauacgcacuuuguugugugagcaggccauuggaggcaggccauagcaggaaggugggaauguaaguuugcaacuuacaagagucugggcuagaaaggaagcuuuuggugucaucugcauaaugauacugugguaaacuggggagugggacugaagucucugaagguggacagaggaagugaauacagaacagaucccuggaaaacauuuaaauuuagggacaauaaagacgagucaaaaaagcagacagaagguaaaggaaggaugggaacacccagaaaugugcagaaauauacacugagcacaagggaauggaagguuccacaaacaaacugacuuggcaaacccacauagaaaccaagaagaauauggccauuugaauuagaguagcaacagaaggagagaaaguggacucagauggaaagaaguaugucauagcagacaaaggcggcaggacuggccuacacuuucaagaauuugauagcaaggaggaaagagaagacaaucguguguggaguaaggcauguaaggaaaaguacuuuguuuuguuuuaagacaaagggguaccacuuaaauauauuuuagacagagauaaagaagccauagagagaggugagugaagaugcauagguaauaccagguaguagcagcaaagaugauuuuagcagcagaaauuacagugggaugagguccuaagcuguuugcugaccuuaucauaaaauaaacugcuaucccuaccaauucccaagcagcaauucucuuagagaauaaggcaaggaucaguggugcaggguauuuuccuccucuucugaagaaaugcucgaauuuuauucauacauuccaggacagaagggaagaaucacugucuuuaaagaauaaaauaauuuccaugaguuguaggggaguaauaagggaacaaacuuugauagugaauuugaauuauaaaauauuaggauuuucuauuuguaaguacuauuugcagauuacaugguuuauaaauauuguaugugcaggaauggggggacauuguuagccuguuuuucgaaaaagaaauaauuuaaugcacuuaggcaguuaaauguuguuucacccacuccauaugacaugaaagcuuucuggaaaagaaauaaguaggacaggaaaaauauugauagugguuaauaagugagaguuggcuuugacugcuauaggccuauauagggcaagugcuauaaaacauucagcaaucugcuucauuguucuguccuguccuguccuguaaaggggguuggagggaugcagggauggugcugggcacaggaugucagaaagccuaagguggggcuggggaaaugaaaagagaacaaagagguaaaaagagacucuguuccuaggaaauauacaugcucucccucuucugugggaugggcuggguaccuuguaugucccucuauauucaaaaugaucccuggggucccauugcugucacauuucugcacaguccucagacacagagaaaaguguuggagguuguuagcacaucucccucuggagaugaaacugggcucaacaccaacaagagaacaccagaggggauucaucucuccuccacgcuuggauaauggcuauucccuaaugcccagggaagaauuaaguucaguaugugccuugcacuauauuacacacucaauccugaacagcugggcuguuaaugaaauuuaaaaagaagagagaacucacuauucaccaucuauaucuaauguauucauaauaaaucucucaaugaggagguauaaaaauuuccuguugcuauacagccaaaggaagcagagcaguaggcagguauccagggagccucguuaacagagauaaccaauguggaaaauccagggggacuuguuccacauuucuauuaguaauggcaauuuuucuuaccugaaauaugcugguaauuuucucacuugcaaaauucaauuugccuaaggaugaauaaauaggucuuuucuuaauacuuacuggauagccucuauguuccagaugcuacauaaaaguaaagcauuauuugauggguuuuuuuuuccuuuuucacuuuauuucuuaggaaacaaaacacugagucaucacagaaugauuuguuuucaagaaaauugaaauaauauaaaaugguagugugguaaaauuuuguauuauaugugaaauaccuacgcuaaaauuuauaaaaauggaaaauggaugacagugaacuaguaugaauacaggaauucugaugguaauauugcgggggguagugguuaagaacaagguuaguagugccaaagcaaaggcauuuuccuucuagauuuuacuugcaaagugaagccagcuguguggagucccucaccucagagccagucacagcaguaaccaaauuagcuuccguaugaguuaguggauaauagacauaagaaugguugacccuggauagaaccaauaaccaaaaugaaagauauuugcuaaagaugauuuucaucuagaaauagcuacuauugaaauauuuucucacuguaauuaggaauaugccuaugguggucacucauacuucauaaaaagauaaucucugucuagggggauucaugcuuucuuccucacacccccugcccuuuuauuuuuaguugacaguaauaauugcacauauuuaugggauacagagugauauuucaauacguguauacaauguauaaugaucaaaucaguguaauugguauaaccaucaccucaaacauuuaucauuuccuuguguugugaacagucaaaauccucucuucuagcucuuugaaaguauacaauaaauuauagucaaucauauucauccuacagugcugcaaaacaccagacuucauuccuccuaucuagcauaauuuuuuuuuuuuuuugagacagagucuagccaucucccaggcuggagugcaguggcaccaucucagcucacugcaaccucugccuccuggguucaaguaaugcucacgccucagccucccaaguagcugggaccacaggcaugcaccaccacaccuggcuaauuuuucuauuuuuuuaagguagagacaggguuucaucauauuggccaggcuggucucaaacuccugaccugaagugaucugcccgccucggccucccaaaguacugggauuacaggcaugagccaccacgccugguccuagcauaauuuuguaucugcuaaccagccucucuauccuaccugcucugccacccuuccagucucuaauacccacaguucuacucucuauuucugugaacuccaaaaguuuuuugaguucccacauaugagugacaauauguaauauuuaucuuucugugccugacuuauuuugcugaacauaacguccccaggcuuauucguguugcugugaauggcaggauaucauucuuuuuuauggaugaauaguauuccaguauguguuuauaccacauuuuuuauccauucguugguugaugaauauuuagguugauuucauaucuucacuauugugaauagugcugcaguaaacaugggggugcagguauccuuuugauauauagauuuucuuuccuuugguuaaauaccuauuaaugggguugcuggauuguguaguaguucuacauuuaguuuuuucagcaccccccauacugucuuccauaaugacuguacuacuugacauuuccaacaacaguuacauacaucucuacagcuucaccagcauuuguuauuuuuugucuuuuuuguuuuuauaauugcuguuguaacugggcagggaugauaccucauugugguuuugauuugcauuuccuugaugauuagcgacauggagcauugcuuccuauguuuguuuacuauuuauaugguuuuguuguuguucguuuguuugcuugagaccaggagguugaggcugaagugaaugacaaacaucuuaaaaagacagggucuuacucugacccaggcuggagugccgugguacgauguuugucauucacuucagccucaacuuccugaucucaagcaauccucccaccucagccuccugaguagcugggacugcaggugugcaccaccacuccuggcuacuuuuuuuguauuuuuuguagagauaggguuucacacauguugccuaggcuggucucaaacuucuggacucaagcgauccaccagucucagccuccugaaguauugggaucacacucaugagcuaccaugcccaucugugugucuucuuucugagaaaugucuauuuaauucuuuuguccucuuuuuaauuugauuauuuaguuuuuuugcuauugaguuguuugaauuccuuguauauucuggauauuaguccuuuguaagaugaauaguuuguaaauauuuucucccauucuacagguugucuuuucgcucuugauuguuuccuuugcuaggguggagacgucaguuuaauauagucccauuugucuauuuuaguuuuuguugccuauguguuugaagucuuagcugugaaaccuuugccuagaccaaugucuugaagcauuucuucuauguuugcuuauaguaaaguuaaacaauaaaagaagaagaaagguacaaagaauauacaaaguaauuagaaaauaauuaacaaaaugacaaggacuaaguccucaucuaucaauaauagccuuaaauguaaauguuaaauuccccaauuaaaagauauggacuggcugaauggauuaaaaaaaaaaaagacacaacuauauacugcccacagaaaacucacuucaccuguaaaggcacacguagacugaaaguaagggauggaaaaaaauauuccacacaaacggaaaccaaaagugugcaaauuagcuauacuuauaucagacaaaauagacuuuaaggcaaaaaaaaaaaaaaacacaaagagaaagaaggucauuauauaaagauaaagugaucaguucagcaagaggauauaacaauuguaaauauauuuauacaccuaacaccagagcaccuagauuuaugaggcaaauauuauuagaguuaaauagguagacuccaauagaauaauaguugcagacuucuucagcauuggacagauggauuaucuagaaagaaaaucaacaaagaaacaucagacuuaaucugcacuauagaccaaacaggcauaacagacauuuacaaaacauuucauacuaucccuuuguuaagacagaggaacagaaugugcguuuggaccauuuaauagcaguuuuggcucauugagguacgaauucaaaaagagggacauauuaacuaaacuguguugagcccaucgaaaugguuagcugaucugucaauaaaucauuccuacugacucagacuuuuacaauaguaaaauaauauauacaauuuuuuauauauuuuaaaaacauaaaaagaaagcaaguuuaguuucuugaaauccugccuuuccuagaauuuaaaucccuuucucggcauuguugagauagacacaguguuuucauacccucuguuucaaugauggcaugaauaaaguggauauaccacaacaaagcauucuucuauaagagacacuuaagcauuaucuccaguuugucucuauuaugaauauucuuuggcagacaucuuuguuuuccugaauguuagaguuuauuuccucagaauagcuuuccugaaaugaaauuacuggagcaaauuguaugaauauuuuaaagccccuauuuucagcauauuucuaaauagcuuugcaaaaggauauuuauuaauuugccuuaugccagcaaaauauaugaaaacuauaguauuaccccaggcuuaacaagcugcuacauuacuuuucuuuguguuuauuuuauuccuagcaagcuuggcaaauuuugcuacuauucauuugcaguuuuaguauguuauuuggugcuuaauuuuuguuuuguuuuguuuucucaucaauuggcuuauuuuucccagcucccgucucaucugcuuuccucaccuguauuccuuuguacaggcucacaugauucauucagcuacuggguggaugaaaaguccccaguggggccugaccaaacccaagcuaucaaacgccucgccaggaucuccuuggugaagaagcuaaugaagaaguggucugugacucagaaccugacauuucgagaacagcuggaagcugggauccgcuacuuugaccugcgugugucuuccaaaccaggggaugccgaccaggagaucuacuucauccaugggcuuuuuggcaucaaggucugggaugggcugauggaaauugacucguuucuuacacagcacccccaggagauuaucuuccuggauuucaaccacuucuaugccauggaugagacccaucacaaaugccugguucugcggauccaggaggccuuuggaaacaagcugugcccagccugcaguguggaaaguuugacgcugcgaacucugugggagaagaacugccagguaggagggaaggagagauaagcuuccaagagcaagaauuuaacucuuccugcuuuuccuguauugccgucuguaaaaucacucaauccagggcucuuaggcuaaagaguggauuguuuggaauauuaaacauaugcaaacuaguuccugggcucuagaauagguucaagggccagggcuaacaccugccaaauacuuaaagcuuguccagcaaacuguuugacaucuaauugacuuuuaguggccuggccagaaccaaccaaggcaaaguuguaaaauugggccaauaggucauuacuauucucuguuucccgagguccauuuuuacccuucugguuccccucagggauagucuguuccaucuugccuucaacucaaugucagauaauccuggccaagguaucgacugauuaggaaaaguauuagcugacugaaacauagugauucaucucaggaguguuaauauuauaaaaguauuugggucuuagagggagagagaguuaaggaaggaagagccuguugaaggggcugcagccuguaagagcauuccauagucugcuuaaguugagaagagccugccagccuaggaccaugagggacacgcucaggaagaggaaugugggccucagauauauuccacucugauccuaaaggaugacaguaggagaaaagagcuucaggaaaguguuuaauuuacacucucuggaaaaaaaaaaaaaaaagacauaccuuucauucaaaguuacucacuugcucagcagaugcauuaaccaaaacaacuuuacgaggcagauauuuuuuaacucaaggaggagcuuuugauuaaaaauaguuuaaagguuauucacuugaaaauauuuauuaaacaccagguacaugccaaguaaccucuaaggacuagggauaaauuaguaaauaaaauagacaaagauaccuugcccuaauggagcugucauucugguggagggagauagaucauagauaauagagauaauaaacauacauauauguguguguaugugucugugugucacauauauacauauauguauauucucucuccauauauguguguguauauacacacacacacacacgcacacacacacauaaaguguuagaaagugauaagagcuauggaaaacgaaaaggucaagcauggugagagggaaccaggauucuguggguuggaggauugguugaaauguuuaaaaguugaucaggagaggcuucauugaaaagaugacauuugaagggguuaaucacaugcuuauuugggggcagaagaagcaggcagugcagagacccaaaagcaggagugucccugccaucuuugaggaaaaggaacaugcaguauggcuguagagcaggugaagacagaguagugagaggaggucagagaggcgacuggugaucaugugagccuagaaggcccuguaaagacgcuagccuucacucacucuaagcgaggagaguucuggcacaggauguuguggccugacuuaggucuuaauaagaucucuccgguugcaauacuaggaagagaccagggcagggggauugggcagaaguaaggaacccagugagacuguuaguggcaaguggucagauuuugcaucugucagaagguagagccgacaggguuuccuaauggauaugauuugggguaugaaagaacaugaggauucaaggaugagucccaggcuuggccggaauaacuggaaauaccaaguuguuuuugcgcacccugagaaguucuaaaugucuucgacaccacggaggcuucaugaguuaacucuuaguaucugcuaaagucuaucuaaacaaguuucuucacuaagacuuuuguaagugauauuuugcuaaauauuuaucacaccucuauaccauaaaaguaaguuuauaucuguucaugucuaacuuggagagacuuuuucccaguggcauuucucuuuuacaauaugagauaaugguaacaacaacuaauguuuauugaaccuuuacaaugagcuacguacauggauuaacucauuugauccucucagugacaccaugagauggguacuuuguuauugucaccauuuuacagaugaggaaacugagguauggagacacuaagcaacucacccgagagaaaccugggcaaauuuuaaaauccuaguuagugagaaccaggauucagucgcaggcuuucuggcuuuccagaguucuuacagcuucucaugcucucugagggguauuuaggcacauugguguuuuucacaacugguguuguauauuaggcuaaugaaauacuuugcuuuuauuaaugagccccuauuaucagaagaucucagagaauuagcagaaugggagaaagggauggagagcuuuggaauuuggggauucgguuaaauuugaguacagauauaauuuuauacacagccaggauugagauggguugacauauugcauacuaaacugcuuacaaaucugcaggaguaagggguaucuucaggaauaaagaauaguguaggcagugaauuucuaacaguagagugaugaucuaucauaguuuuuuaagcaugggcuaauuuaacuguauuauccaacuacaaauacuucuaaaguuaugaaggaaagagacugugaugauaucucagaaaaagggagagcaucaucaguuuaaauccuaagaucccccugugcucccuucuuucccauguuuuuccugccacauuucuucuugaaagcuaaacaggcugggugcggugguucaugccuguaaucccagcacuuugggaggccgaggcugaucaucugagaucaggaguucaaaagcagccuggccaacguggugaaaccccaucucuacuaaaaauacaaaaauuagcugggcaugguggcacacgccuguaaucccagcuacucggcaggcagagacaagagaaucgcuugaacccaggaggcagagguuucagggagcugagaucgugccauugcccuccagccuggcugaccagagugaaacuccgucucaaaaaaauaaauaaauaaaauaaaauaaagcuaaacaaagagauuucaaacagaggcaccagucaucccugcuacugccagggcagaguuaaacuuuaaauauuuuucauguaaugagcugccucacauguaagccccugcguauuuuauuacuacaauuuaguugaaagaaguaugcuaccauucagucaaauuucauuuacuuaacaugcaauuacaucauagccauagguauauauuuauuuguacauuaguggcuauggguuuugaggguacaaugaguuagagauuuaaucuacaucuuggaaguauuuaggaucuuaauaaaaugguaagaguacauaacacuagggaauacgaaacaacugauagacaauugcaugauaaaagugccucaaauguucuguacuauaugaagaaggggauuuuguaauaaaucaguugaaaaguagaacguagcauuaagucuauaucccagaggcuccaaguaaaagaaugaccagaauaagaggagguccaucaaggaaucguucuugaaggaaaugagacuuuuaaucugagucucaagagaaaaacugaacaugaaccacugagauagagaggagaguauuucagagaaaaacacagcagacagagguuggggggagagggaggcagaugcaaaacacaggcccugagugacaguugcugcaccuagaucccuguacagugggaguugguuugcaaggccggccucccccuguaaacagaaauucucccuguaaccuuuagggucagauugcucaagaaggcucuugaagaaaggcauaaagacccuuuuggauaauuuguacuuaaugcacuuuuuccaaggcagaguaaagaauggcacaguccucucguucccugaaauguggcccacgggcaggcccaagaugugucugacagguccugucacagggcugcaccgccucccaccucucccacgguccacugcacaggacggcuuuccucacagcccccaggcuuaccaccuggccaauuacaccucuacaaggaaauccuccccuucccccaggcaaucugcuuaucaugagccugugauuaaccucauuaacacaccgguuuaccacagacgucauuagcagucagucagacauuacucaaaaccauuagaaacaacaagaacagccguuacccaguucagugcaaccagccuggugcuccccagcucugggccuuggggagcaguuagucaggcaccuuagucacgagcuaaaugcacaccggaaaugaggcugacauccagagcucuuguucuugggugcccgggaggauuacccucuguggccaacuauccggggauggcaguccaggccucgugagcaugugcagggcauuccuccaggaaaagauuacuagugccugggacagggaaaaauauauuccuuuagaaaccuucacagcagagcucugaauugggacgaucaaaauagcaguuuccuaucccacagcugccucccagaaacuaauuaaugcuguggauguagcuugcuaauuauuuucaacaucaccaccauccugagcggucccuguggaggccaguugccucugcaaagucuccccugacucaaguggcacacuccccacucuccugggaagggcaguuccaggcagagccagcacacacgauugaaagucuauuuacccacaaauuaguucaguguuuuuauuucaacuccaaaagcugucaguuuuguaauuacaggagacauaacuucuagacagcgcuugcugcucagccuaagaguucucagccugagguccaaagcuuccccagagggauaugaggguagaauuuaagaagucuuuaaauuuggaugggaaaaaaaauacauauucauuuuuacuaaaauugaacugaaaauuaguauacccauagauuaugagggcaggcggugacccacaacaaucuuagcccugccugauuuuuaucucccuagaugcguccaucucacauuuugguuaucgcagauaucugagauaccacuuaugcuuaucccuaacucacaguuaugggacuuauuagacuuacaacaaaauauuuuuauugaaugcauuuaucaugcagcacauacauuaauuuauuacaaacuuauuuaauauauugauugcuauauuuccauaucauagauuuucuuuguaauccuguauauuguaugcauucauuuaacauguaauucugagaaggggguccaugauuuuaauauacuuccaaagguauuuaugccaacaaaauuaagaauuuuugagucagacauauggcaagugcucuguaaaucuuugcugauuuccuaaaaauauauauuaauauaaacaguucuugacuuuccacauaugauuauauuuucuugccuuuuuccuagcaguccguauaaaacggaggaguuaacauucagcauuuuuauggauugcucuccuuuuuguguuuugaauauuucagguucuuauuuucuaccacugucccuucuacaagcaguaccccuuccuguggccaggaaagaagauuccagcgcccugggcaaacaccacaagugugcgcaaacuaauccucuucuuggagaccacucugagugagcgggccucacggggcuccuuccaugucucccaagcgauccucacccccagagugaagaccauugcccggggcuugguugggggccucaagaacacgcugguucauagguaagaauuugcuuccaccccacaaggaaagcuuuuuaaaaaauauuuaucuugauucuauucugaguaaaucgcaguaaagccauguagucugaggaguuagaaaaacaacaaaacaagcaaaaaacuuuguauucgagaaaaccaugcaguugagguggauuguauuaacaaaggcucucuaaacacuuuguucauaaguacacaucauaccauaaauacuguacucucuaaauuuugcuauaaggcaaagcacauugagccaacaccaugucuguucacuccugguaccuggccacaugggguccugccugugccucgcagcugacccaggcacucauuuaagaagcauucaauauaggcugcuguccuaggugcuaaggauucagagcuggcccuucaagaauuuguucuccuuuccauggugaccaugagucacugaagaagcagcuuaggaugccacccaccaugcccaugcuguagcuucaaauacuuccucagggcagaauugagccugguuguacaauuagauagcagaagcuucaguaauuuuguaucagaugguguuccuuaucccggacaccaaugaaugauagauguucucaagaaaaaggaugguuuauuuguaugcguguuugugugugugcgcgcacauauaugugaguguguguauguaugugucuauguaccuguacauguguauguguauauguauauguauaaaaggaauguuauaaauacauuuggauaacagggaaucccuugcaauccaagcuaaggaagcuaauacguuuggguagcaaaagauauuuacaagaaucaguuuggucccugaguuucagguugacgagcagaguucagauaaugaaagauucauccaaaaacauguuucuauuuauuugguccugaguuuagguaacaugaguucagauaacaggaguucaccuagcaggaguuuagacagcaggacuagauuuuucuuucuuggugagagcuccugauuaugucaaccauggacaaaaccagaaaguguuuucuguguggcucuacuaagucuugacugaauucauuaugcugaacuuggaaaagugaauuuuauaaaccagcacuauaucucuuugaaagaucccgaauuagaagcuuuauuguuuuaauaauauguuuguguauccacacuguuuuccucaugccucugguauauuuguagaucaacauuauuuauauauucauucaacaaacauugagcaccuaggaagagcuagguacaaagauucaaggugaauauuauacugucugcugucaaggaacucacagucuagcagcagaaacuggcaugaaaauuucuauaaagcaaugugaaauaccacugugaagaagucugugcagacagccauacuaauaauggagagggaguauuuaaaaaacuaaggauaaguuauaucuguauaccauauucugaauaucaaauggcuuuuugcagaugauuucauuugauucuuaaaucaagucagccucuaggauggcacauugucuacagcauauuaucauccccucuuuagaugggauucagggagcuuaagugaccccaauccauacagcuaguaaaagucaagaauaccucucagacucuggccuucugaucguuagaccacugcccuuuucagcguuggacacugacuuggauacugcauauuuuugugcuuauucuuuucuguuccacaggccugcaguugucuuauuaguaccugaaucugguaauaucucacagguuauaacuaguaacccacaaugucacaaagcuuuucauaucuguacauuccuaaaacuuuaaucuggcugcaagugaaacauuggcucuuuccuuuaugaugagagauaaugauguuggcaugcgcccaaagccaagggauccuacuaugccagagcccuugcacuacugcuagcagcaagccaauguccccaagcuuggaaagauacuuucuuuggcaucucgccccccugccggccauaagaauauugcaaguaugcaugcauuccuaguccugcacaucaacugaaggaggaaaauauagcucugguugaguuuguuccaaaaggccagugcagaguguggcugucauuuccucugggcuguugaacaaacauaggaccuuccccugugugccaacacccagagggucuguccuaacaacuggucgcuggcacugguggucagcucaaaccaagaaaaaaaagacaggguauauuuucuuacaaauguagaggugguuucucggcagggauuuaacccccuaacucuucgauaaacuuuggagcuaagaucuuguucauuuugguucaacaccguagaaggaagccacaagaaauauagccauuugacucaauuuccauggugguuucucccagacuuauagaaaccugaaauucagguucauggcacucucacugaaaucauaugaaaaugcuuugccuaagcuugaggacagagcauccaugaacucuauaagggaacauggacugaaaucagaaggccugagagugcagccugacaugcucccuguuccagggugcauuguguugugccccgucccauccccgccauccccaagcucacauauugaagucccaacucucaguuaccucagaauguggguacauuugcagauacggccuuuaaagagguaauuaagucaaaacgaggauauuagggugggcccuaauccagucuagcugguauccuuaaaagaaaaggaaauuuagacacacaaagagacaccacagauauguguucacagaggaaaggccaugugagaaugcaauaagaaggcggcugucugcaagccaaggacagaggccucaggagacaugaaaucugaugacacuuugaucuuggauguccaacuucuaaaacaagagaaaauacauuucugucauuuaagccaaccaguaugugguguuuugcuaugguagcccuagcaaaucaaugcagucccugagcaacaggguggccguggacaaguuuucugaggucucugagcugugguuuucucaccaguuaaacaggauuaauaaaccucaucagauuguagccuuaacaugaaaaugccagccacaguggcuggcagaaaauagacaugccaucccuauuuguaaagacacccagaaacacuauggaccacccuuguucccagcugggccccaaggucaaagggaaguuuuuaaccuccugcucugccauccaugggaacuguugccucacgggccugucagcacugucagguucagccuuuugcacagaucccuuguccugguaaauaccaagagcugagaaaauaaaguagcuccucuucacuguggguucugcauuuccccuucuucguacuuaauccuaauuauuugauccuugccuuggagaagguugacacaugcuacccgaagcugacacagaacucuuugucacuggaaaccacagguacauaccuuucacugcauuucucugcucaggcuccagggauccuccaaggugaggaggcucuggcugcagugacuggaguuacaagccuuuaaggcucauuucccuguaaugaccagcagagggcgccugcaccucauacuucaacacugacucaggcuuuuaaaaugaagucuugaaucuaucagguucaguacuacuguguccuuggugugguuccuuguguauccuuggucuaucuuuaaggaagucuguauuugcagcuucucacuuccaaaccacaacauguugucacguaagcaggaggaugugaccucuuuaagguguaguuucuuacucccagccaccaaauauuucuaccucacacucuuccaguuaugauuccuuaccuuuuuuuuuuuaccacacuuaucauaucacagaaacucuucuaaacacuuuacauguauuauuuuguuuaauuccccaaaaaucuguaugaagcauuauuauuaucacucuucaggaguccccguucaaaauggaaguaccccugggagggugaucuuuuaagucauaaucagcuauuaauauaaaaauauaggccaggcgcaguggcucacgccuguaaucccaguacuuugggaggccgaggugggcggaucaccaggucaggagaucgagaccauccuggcuaacacggugaaaccccgucucuacugaaaauacaaagaaauuagcugggcgugguggcgggcgccuguagucccagcuacucgggaggcugaggcaggagaauggcgugaacccgggagacggagcuugcagugagccaagaucgcgccucugcacuccagccugggggacagaggaagacuccgucucaaaaaaaaaauaagaugauggauagaugauagauagauagauagauagauagauagauagauagauagauugauugauuuaugauauguguuuuagcccguggcugauuguagaguccacugagagagggaggagacccaggacugauuauaguuaugguaagagaaaaagaaagaggagaaggacaaaaugcuaccaaggccugaacaggguugucuggaaaacugagaagucaagauaugugcugaaagaagggcaggcagcaucaagggagaguuucuucugucuucuuuaaagcauucucagccuacugaguauguauugagcuguuuuuacuaugauguaaacugugaguacacuuuauugcuuucuucucuaugcugccugugguaguuuacacuuacuauuaaugcagaaauuaucacauugaauuuucauuauuccuuuaugucacuaaauaacuggcugucaccuaggaagccuuugauuaauaaaaugagacugaaagaccguuagugagacaacugauuaaguauuggucuauuaagaagccacacuuagugaucgaauaacuguauauccauaugaaaaaaguaagccuugaccuccuacuuuauaccauaaacaaaaaucaauuugagaugguucuuagagcuaaaccuaaaagcuaaaaaccauaaagcuuuuagaauaaaacauaggauauguuuguaaauuuggaguggacugaagugguucuuagaucacagaagccauaaaagaaaaaaaauggacaaauuagaaucuguaaaaauuaaggaauucggcucaugaaaauaugucacugagaaaacugacagacaagcuauaggcuaggagaaaauauucacaaaauauaucugacagaagaccaguaucuaggcuauauaaauaacuucuacaacucaacaauuuuuuuaaaagaaaaugaaaaaaugaguaaaagaauugaacagauaacaguuuuacucauaauauccaaaaaacuggcaauagcccaaguguccauccugccaguguaggaaacuggauacacaaacugcaguauauacauacaauggaauucucuucauugauuuugaaaggcaacgaacuacugauacaugcagcaacguggaugaauuucagaacaauuaugccaagugaaagaaaacucacgugaaauaauacauuuuucauggcuuauaugaaguuuuaaaacaggcaaaucuaaucuacaguggaaaaaaaaaucaguauagcuguugccucugggagaauggggcagguguugaugaggaaggggcuugcaggaacuuucuggaguaccaguuauguucuagaccuugauaugaguuugaauuauguguacguauuugucaaaacucggcaaguguaccauuaagauuugugaauuuuauugagcguaaacuuuauguuaaaagaagaacaaauuaaaaacagauauugaacuccaguuaaucauaugcaugcugaaguacuuagggaauguguauagaugcuugcaguuggaauaugucaaaaauacaagauggauugauggaaggauagugacagauugauggauagauaugugguaagcaaguauaguuaauggugggaucuaggugguggauauauuugcugcaaaauucuuucaacauugccauauguuugaauauuuucaugauuuaaaaaaauuaaagaacccauuaaagcugaggcucuuggucuuaguuuuucuuuuucuuuuuucuuuuuuuucagacagagucucacucugucacccaaacuggagugcagcucuuggcucaccgcagccucaaccuuccaggcucaggugauuaccccuccucacagacaggguuucaccauguuucccaggcugaucucaaacuccuggauucaagugauccacccaccucagccccccaaagugccgggauuacaggcaugagccaccgcacugggccugaucuuaguuuuucaaguuccuguugacaugguaucucuuugaugcuggaagcaaauaaucuccucuuccagcagagaaacccuggaaaguguaauuuucuaauggaauagagacuacuucaucccugaaggagauauaaagcuuaaauggaaauaccucugaaagcuugugcucuuauuaacauauuuuuguaauauuaagggaaauguuuuauguccaugucuggagaagacccucuaagcuguacuguauccacucucuuccuccaacacuuuccucuguauaggaaucuuccugccauccuggacugggugaaaacucagaagccuggagccaugggugucaacaucaucacaucugacuucguggaccugguggacuuugcugcgacugucaucaaguugaaugaccuccuacaggaggacacagcucuggcuaaaugcugauuuaauuuuuaauuuaaccuuaauguugaauuuguugauccaggguagaguucuaaaggauguccuguuaggauggccccuggggcagugaugaugaaguaagaggaagauggcuuuuuuuucucccuuccucacagggccauuuagauaaaauuacagggcuauuaauugcauuuuucccaaaugagacuuuuuuuaaaacuuaaguccaagggaagaaagcacgcuucaugugaccaaggucaggaccuccccaguggcuuaugguggugaauggaauuuggaaauaggaucucuaggacccauugggguauugagugucccccuaauuggcccagcucccuauugucgucugggguguuguguuugagccggugaaaaaguugaaccagaaacacauuccuggugaaaaagacuggcucauugcagcuguggaccaccaucugggguggaucuaacaucaaccaggggcucugagggggaaaagagccaagcaccaggucucucuaggauuguuggaugucaccacuuuucugagagaguaggacucauuuaucacuaagauguuucaaacacaagcuguucuuucauagcguauacugguaacuggucaccucauucuucagauaaacagugcauacuacccuuaguaucagaaacaugcuucccaguuuuaaaacuuggauuccuuucuauuucuuuuggccccuucuuaaaagugaaaagaacaaugaugggagaucuuuuuagcguggggcccaacaagagauagauaugcauguuugcugcaugccagauaucuuuuauuuaauucuacagcuuuuuccagaauggcugccagguagagcaccugcaucauuuuggcaaaguccucuuuggaguggggucuucaagccugaucuuggaauugcguuuuauuauugucugccuaggacucaggucugcacugugggacacaacgcuaaguggaaggccccuuauccauggcaccauggaagcaggcgcaggaugcaugggaaacugcaauggcauuaaaggaggaagcuccaaguggauuuggagccauucuauaacuccuugaaaacaagacuaccucggggauauuuaggaugacucgugugucaccaagugagaaauaccuaguguuggaacauuuccaguccuucucuugaugguucuacuuucugcagguuguuuugagccuaccaaucacuacugcaugaggacuuugaaacucgagagggaauuuuuuuuuuaucgauaagaggugcuuaucuauaaggagcccucuuguguuuugauuuauuuauuuauuuauuuauuuauuuauuuauagauuaaauaucugccgugcuucuuacaucaagagcacucacacaggagcuuacugaacuuuucuuacccaggauagaugcugcuauggucuuucuguccugaacaggaccacgcaucucagggcugugagugauuccugacucugcuguucauguccuggcucccccaguccuccuggggacaguauacauguguggauguggucuagaucugagaagucacuaccaagccaugcccaugaacgaagauaaaaugggucgugaagaacuauuaguucauaaguagacccuccagaagaguguugaaaagaaaggcucuagaaagaaaacuaggcauggaaaugugugcacuuuguugcuccucagcaccaucugagaaucccuaaggaaguggcagcuucuggauucuuaagaaggaaauauaaacauggagucccgaauggauguaugcauuuauaaagauugucagacucuucuuccagcaguuuccuguuucugucuuuugaugcccauagauggauuuugcauguugcuugcagagagggguguccuaggugagguacuaaaagcacauccacacccccaacucuuggucuuccacccuauacguucuguaaaacaauuuaagaccuggcuuuuagcuugcacccuugaggaggucauaauagaaaugccucugggaaaaucugguugaacuuuccuuuuuuugcauuugaaccccuccccaaaggguuuucugggauaaugucaaauucuguagggccuucucuggauaagaguaaguaaguguguucccucguuuucuaaacuuuccuucaauucugaugcuaaaugcuaaugacaagcucugaaaucccuggucuacccucaggguuuuauuuuuguugucauuucauuuugcuuuuguuuuuaauuuuuggucaauugcuaggggcuagaucauuuccccacuuuuuacccuuuguuacuuggcaaagagauaaggaggcaagaggagaauuacuguucucuguuuuauuugagccucggcuuuguccagguguuuggugcuaugaggccagguguguugacaaguaucuacacaggaugccaguaacacccaagggcugcugacuguuccaugaaauguuuacaugauuuuguccuuuaguucuuaaauauaugguugcacuucacuuggguuguaacauuuaagugcaccucaguguuugcaugauaaaugucaucaagcaugacacaaaagcccagaaaacuguaccaagguugcaugcacggaguccugcucugcguggugcgugcaggugcucacuccuccaugcugcuuggagcugccagccuugcuugcaauuugaaagucugcacaagaguucugggagauaggaggauuauuuacaauuuucccuugauaaacaccuuugcaucagcagaaucucugccucaagaaaaaguugcuuaacauauuguaaaggaugugugccuucugcuccuugaccgugagaccagacaggagaacucaggcaugugggacagagggaaaacagauuuuagguucaugacucauucugcaacugccaacaauaaaauagugacccaaccacaucacuuauucucacaaguucuggagaccuuucagaucaaaacaaggcucucauacuugcucagaacuaacuucaagaucagcuaagaagcuacuugauugagccaaagaggacuuuaguuucacagaauuuuaggucauauuuauucugaaauacaacugagcuauucaugagcucccuggaccauuucccacacagccauauuuccauggcuuuguggcaaaggggaccaucaaagguuuuaguucgguuagaguaguguuuacaggcuugaacuuugagccuuuuagagagaccaccaggauuucauggauacagaaggauuggagagagaggucgagauggacuuaauggaagggaauaaguuauugaacauuaaauuuuaaauuaguggcagaccuccaagagagucaugccaaaaaaguuuuuauauuugcuguauuaaacucaaugguaauuacuuuuagucauuuuccuuagcacugaaucuaaacccugaauuaccgagagcaguuaagccacagucccaggauuuuauuauaaacucaaagaaaagcacaaaaucugagcccagguaaugauccaucuuaggaauccuaguucuuuuuacaugaucucauauucauccaaaaaaauuguuucuucucaauaagacaacguaguagaguauucuggaauuaaaugcaguuuuauggcguggcgggacuuuccaucucucguuuugagaaucuugccaugagaaagugcuucccaaugagacauuacuaccucccagcuaggaggcuuagcacaaugcuaaagguggagcaacagaagaaauucagauggaaaugaaacuacuucuuccugggaaguaaaagagcuacaugaaaccaguccauccugcagauuuaguucaugccacaguugaaguuugugugauguuucuuaguagcuaauuucaaauuuuuacuguuagauucuaagaaacagagugggcuaaugauuggagcacagccaugagacuccgcuccguuagcugagcaugugauccugugcuaaaucuuucuugguuccuucaucuuugaagaugcugucugcuacuuuagugcugacugauuugcaaaucuugguugauuagcuccccaaucauaaggucccuaaugauuagauuaaaugccuuauacucagggggugugcagauaugcuauucuuccuucuguggcuuggguggaaaagcugcuugggcuuauuucccaacagugugauguaggauggcagaacuuaucuaggaauggcaccuuugaugauccauauaaugaaauguguagagcucaaagaaaucugccaacauguauguggacucuugagaggugggcuuucccaguacaugcuaaacagacuuguuaugccaagaggaagugaauagaaaugauagcaucaaauauccaaacugacaggaaguuucuuuugcauagcauagaacaugguugucuucugaguuccacuaauguuccaggauaucuuggcccucugccucuggcugcucccugguguuuggcaccauagcguugucacuuacaaccauugccuugggacacacagagugaacuguuugagugauaaguaauuuagguagaaacuuuacccuuaauuucaaaugauaccaaacagcucauuacuaccccaagggacgcucuccguagcuucuggauuccccaguuuccuucuagaaacaaggacuccaauagcacuauaacccuaaacaggcccuaacccagaagaauacaccacaaaaugcgauugauuuucucaaaauaucacagucuuagacacuauacaaauaauucaagaaaauucuuucuacccugcaguggauauaguauucuauuauauucuccagcaaaacuuuuaggacuuuucaaacucauuucuaagccaaauaguuuagauaaauauuuacccuuauauuuggggggaauucaggcucaccauuugccgaggcaagcccaucaacagucuagaggcauauucugugucauuccuucccgucuccuucauagaauacuacuuuuuccuuuugucuccuggccauucuccaucaucugcugauuauugcuaaccacaggaugcuggcaaagcuuacagugauaggcacguguguucagugauguccaauacacucuuaucacagugguuauugcuucuuacucuuuucaaaugcauuauucuaccccucaaccuacauccaaucauuagaacuauacuggagcccagaacuugggaccaauacuuaauucaaauagcaggggcuugcucacaaacauuaagcccaacaagaagcacagcacuuugaaaagucaaauaggccuuugguagcucuguacauuugcaguuuuacauuuguuauuaguuuauagcacuaauaacacuucagucgugaaucuacagucucaauaugauaagucuuagaacauguucuagaaauagugguaccuugcugcuauuauacuuaguaacuuauaccccaauauaauaauaaguauuaaauacagauuguguaugcauucuuuguguguauaugccaacuguacuacuuaaccucacugaugagcaauuagaaaaauacagaaauugucauagugaaaauaagucuuggucaauucagaugauacgugaaccugauaaaugcucuaauagauaugcuauuuuguccuguauugcuuguuuuacaguauggugcauguuguuugcuaaguaaaaugauaauaauaauaaaguauaccaauuuuaagguuagaauuaaaauuuugcacauaugcuucuugauauucugaaauguauucuguggcuuaauuaucuuauucauacacauuucacuuggcuuuuuaccccuaggaaauaauuguccaaguauauaucucgucuucuuucuuguaacuuugauuaaacugcuuacuucaacuuacaacauuguaaagccagaauaccucauuuuaacagugaaaaaaaauaugaugaccugauguguucucuuguauuugauuugaacuaccuaaauaggcuuaacuguaauaauaaauauacaauuuuggcaggc

SEQ ID NO: 18129 - RNA, 1924 nt, Homo sapiens
cuuuuggauuuacauaugcacaacauuugaauauccuuauaaauuuguucauuucacacauguacaauuaugucugucaaaugucucagcaaacaaauugcuggaucaaaggguauauacauuuauuaugaauagauauugccuaauagcacuuugaaaaaauuuuuuuagucuacacuccuacagcaguguaugaguuuuuuuccucacaccuucaccuaccugguggauuaccagacuuucuuaucuugcugaucaaacaggugaaaagugguauauccuuguaguuugaacauacauuucuuauacuuugagugugauugagcaucuuuucauauguuuagaagucauucagauuuuuaaauuggacuuugucaauuuuucuacuuggugguggguauuuuucuuauugauuuguaagaacuaucuucgcauuagggauauuaucuuuuuuauaugauauauauuacagauauuuucuaacaaacuuuuuauuuuuguuuuuaugguguuuugagucaucugggauuuuuuuaaagauuacgauuuaauuuccuuuuguuuauggcuucuauggucauauuuagagaggacucuccuauucuaaaauuauaaaacaauuuugcuuuguuuucuuauagugauuuauauuguuaaaccuaugauucaucuaaaauuuauuuugguguaagaaguaaguuagaaauccuuuguguuuauguauguguguaugugcauuuccacauagccauagcuuugucccagaauuauuaauugauaaucaguucuuuccuacucucuuaccauaccaccuuuauugcauauuaaauucuuauuuguaauugagucuaguuaaaaaagaaucuauuuauuuuucauugagugcuucaucuuuucucaugccagauucaugguguuuuugguagggcuauuuaauaauuuuauuuuucaaaauuuuuuguguauuuuuugugcuugauucucagaauuacauuuuguagccaccaauaucccucaaauucuauuuuuuuuuuagauggggguuuguggugauaauacagauuaauauagagagaacugauaugguuuuuaauaguaagucuuucuacccaagaccaagauacgccuuugcauauccucaagucuucauuggaacccuacaguaccauuuuaaaauuuucuucaaauacaucuugcacauuccuaguuauauuuauugcaguuagauuuauuuuuuagccuaucaugaaugaaggcuuuuucccaugaucuuaugacuggcuaauguucuauacagcaagacuccugauuuuuuaauacaauauuguauucaauauaagaauucucauuuuacaaauaauuuuaaaguuuuuuucugcaucagcaaaugaucauuaugcagguuuucuuuuuguuucuuuucucuuuuuuuuuuuuuuuuuuuugagacggaguuucacuccuguugcccaggcuggaguacaauggcacgaucuccgcucacagcaaccuccgucucccggguucaagcgauucuccugucucagccucccgaguagcugggauuacaggugccgugccaccaugccuggcuaauugugcauuuuuaguagagacuggguuucaccauguuggucaggcugcucucaaacuccugaccucaggugauccgcccaccucggccucccaaagugcugggauuacaggugugagccacugcgcuuggccaauuuucuuuaaaguagaauuuauaugaagaaacaguuucuggaucucagguccuuauauucuugauccauccaaaguuuuccuuccucaaaggauuuuccugccuccuugaaaacuuuuacuaccuuccucugccaucaucuguauccauuuuuucuuuaauuuaaaaauuagugauuaauaaauguuaauggug

SEQ ID NO: 18130 - RNA, 1854 nt, Homo sapiens
gcacagagagguacaaaguuugucuuuauuacccaagaaucaggaauggaacaaaugaagugggacguuugaguuagauuucuugguugggacccugguuucauuacugucauggucacaaaacugaguucucagccuccucccugucaggucagguggcagcagcgggcagugguccaguccaccacacugcacuggcaguggcaggugguuuccagcugaacaucccacgaaccacagccauagccacaagcacagccagugacagccaucccugcaugagcacaugaagcacagacaucagagcucuuggaauuuaagaggaggaagggcuacccacaaccaucuuucaacccugugcagucagggguagagcuagguuucguggggccucaagcucauucaauuuugcgagcucauuucaagaaaagaaauacagaaaucacagaaacaaauauuugcugccaugaaagagacucaugcaagugagagacuuggaacuugggaguuucaguuuucuucgauuugugauaaauucaccucucuguuggccccuacccaucaaaacagaggaauagauuggaaagagaaaugaaguaugugaucauuaugggacaauggaggagaggaagggcugagaaacaggggcaugaagugaaggggugaaaggaagaggcagaagcccaagaucccccaguagcauccuucagggaaacaagaaugggcaaggggucucugggaaccaagagucaugacucagccccagggugccagggugauacagaccugacaugggggaagacguaggugcagggagauggacaggggaggauacagggcaucguagucgccauucccucucagggaguuacucaccagcagggcaggaggacggucugccuuggcuuuugacacuagcacacgagagcuucuugcuuauaggagagggacuguacucugaguaggaaagaagaaaggguacaucccaugagcuauccuccccauaauccccuuauccccuuccaaauugucuucuaccuuggaggugacacuguguccagaaucagccuacucaucagcuuuuaagguuaguuuccucauuuuuaaagcagaaguaauaguuguccuuaccucauaaaaugguugugggaauuaaaugaaauaaucuacguaaaacuuggauuauaccugguucauaaugaguguucauaaauuacagcuaccauucuccuccaccucuuccuccucaucaggaaaaccucagcuuuuagccaagacuucaaacacggguaggguaguguagaaagcccucaucagggguugggcuugguugggaucuugggaugggauagagacaaagcuagaguuuaagaacaggagaaaugagcaagggucaaccccccgcuuccccuaccccagucaguuaccuagacuguugagaacauccuugaucuucuuauccauaacggagucuaaggaacacugaguacuccccggguugaucagcuggagaagggggauuaggaugagaaggaggcaagaggacggccccauccuguacagagucaguguccuggggcugggagaaaagauggaaagcagcuuagaucucugagcuccugggugguggugaaggaaagaagacaacgugguuaguuuccagggaguaaagauggaagaacagcgucaucaguacuggaucucuuuaggcaguuuggagaagcagguaggguugcugaagaacagauuuauucaccaaaacauucagagaaggucuacaaggacuagccaggcaagggcguuuuaauacaccugguauuaaccugggcaccuuuaacauacaagcacacacaa

SEQ ID NO: 18131 - RNA, 213932 nt, Homo sapiens
agauggcuuuggcucccggucccgacgcucacgcccaccugccaccccuuauugguuagcuccuucgugccuugcaucccuucguccauuuccuuucccguuuccacuuucguucccgggagaguccaggccccucauuucucuccgaguccaauuccuuucugacgugcugcgagcgggccuuccucuggggccauuguguacuguggaggacguggacggggcggcagcgcgaggaggacgggcgccucccguccauuggcugcacccgcugucgggcagugcgcgguugcgcggcauuggcucagcggcgcccggccccgcccccgccccgccccgccccgagccuggguccugugugugccacaggggugggguguccagcgagcggucuccuccuccugcuagugcugcugcggcgucccgcggccuccccgagucgggcgggaggggagagcggguguggauuugucuugacgguaauuguugcguuuccacgucucggaggccugcgcgcuggguugcuccuucuucgggagcgagcuguucucagcgaucccacucccagccggggcuccccacacacacugggcugcgugcguguggagugggacccgcgcacacgcgugucucuggacagcuacggcgccgaaaggcaagaagggaaggggucgccggggaggcuccacacuucuugccggcccgggggcccgggguagccaggcgcgggccaaggaggaagaggggacagcccuggcucucagcugccuuugccgccgccguccaguuugaaguggggcauuuaaagaccagaacccgcaggccggggaggagggagagggcguccaggcagacggcggugaggacugcagcaggcggccgggaggcgcguccacccaggcgccgagcccacagugucccucccgcgcccuagacggacggugcugcgggcacgggagggacacuuuguccccucccaguccaccuuccuccugcagcucagacccgaggggccgggaaggggccugagcagggaagggacacaggcguccugaaacaaagcuuuggguugagggcagaggcgaggagccagagaagugaacuccuccuuuccguggccgcucuugucauuuuucucuuuucucuuuucaaaugggcuauuuguguguuaauuucauuugguucuugggaauaacgacucaccgcguugauuuaaagaaagguguucguguguccguacuuggugguuuuagugugggacaugcccugcgcuuuuguugacaacagagcugucccuuacguuuguguaggauaaucuuuauguuuauguaacuuggagaaaucuaacagagugaaagugaaguuucugcguaaggcucccaaaauguaugauaggaccuucaguuguucugguauuuugaauuggaauuaaggcaggaggggaagaacauucuguuuuuaucuaggugggggaaaccuguuuaaguuuuguuuguucuuuuuuuuuuuuuuaugaguugaguauuaguucagccuuagcuacuugaaacgugagcaggaugcaucuuuaacucuuaguauuguaaaagcaaaucuaggaucacugcucuuaaaacuacuguguguaaagauugagaguguaaauucacaagcuuauugauaaagaugaauccggaacuuuugguuuugcucuaaucgauggaggaagaugcagugguacaaguuagucucuaguuuucugguggguaaauauuuucaaaaccaacuaacuuuucuuuuuuuaaaucugccuuuuaaagaacuaaaauuccagauggcaaacucaaugaauggcagaaacccugguggucgaggaggaaauccccgaaaaggucgaauuuuggguauuauugaugcuauucaggaugcaguuggacccccuaagcaagcugccgcagaucgcaggaccguggagaagacuuggaagcucauggacaaagugguaaguucugucugacguugccugugcgaaacacuauucacuuugucugugguuucuccagauuuauuuauacuguuaauuaauaccaaccauuguuauggcaacaaucuuuugauuucaauucaucauuuuucuucaacucuguguuuuuugaaaaguuggauucaaagacuuuuuuguuuuuuaaccuuucauccuuucuacucuuuaagguucagaguuccucuacaugacucaguauguaaaguuuuaccauuggcugcuuuuuguugguguauggccauagaaugcuuggaaguguuuguucugucuucugugagguuguguugcucuuagauaacaaaagaguaccagcagguuauuuaagucuuugaccacucaugacaaucaucugguaugauacugaaaauauuuacuggggaaagaaacagauuaguucuuaagugaagaagcaguaguugagggaguuuccauuuucaucuuugagaauucaucuucauuaagaaacuuuuuuuguuguuaaugggagaguuaacaguuucuuucaucuacuauuccauuuugaaacaggaaaccuuucgauggcacauuguuuauugugaaaggaaaauuuauguuggggguggugaggcugagaguaucagaaaccucugugguuucugcauguugcuuucagacaaacuauaauuucacaagaagaaaucaugaugggugucaguauccagagaagucaaucugaauaccuuacagagauuuacucagaaacuguagcugucaguauccuaccuuacuaaguaugauuauaaaauaaauuuaagauguagcuugcugcuuugcaaaaauuaauaauucuuuuuuuugaagcaguagcacuguccuggauuuauuaguaaauguuuggaacacauuaugacuuuauuucauagauaucuggggccaauuauaaguuuaguugaggcaagacucaguaucuuuauaacugaagaaauggagguuuuaaaaacaaauuucuguguaaggaugugccaaagcauccaugaaaucaugugauaacauucaucuuugcuuugauuugcuccugucuguaaauauuggcuauaaaagccacuaucaguaguaguagcaacauaugaaugugacaagauuuccauuauuuucauuuauucugauggaagggacacacagaugaaugacuggccugucauucuacaggcaauggugcuaaaugcagagccagaauauuuuugccagauaaauagccuuaguuuugggcuucagugugaccuauuuacgcuucugccaauuuauucaaauuguuauauuaaagugcuccagacagaaugaugucauagugucagaauauugcaacuugcugcuugggguucaguuuugauuuuagcauuggauacuuuagaauaaggacuauucaauuggaaaaauagcauauauuugucaagcacaaugcugccuaucuugucuuugcuaaagagugugcauuugaaggucacucucacugccuaaaucauuaguugggguaagagaaggaauucaagguuuuucucuaacuuaucugcuacguaaguggacagcaaaugguucagauucuauaaaggggcuguucuuuuucccccacccuccaacuuugaguggucaguguuuguacauuuguguuaggacaucaaaucaaaaagauuuauauaaggauguggugagcuauaguuacuauaaaaucauuauuuuugaaacauuaaaaaugauguacacaauuuuggucuguaacugguuguuaacauaaguuuuauucacuuuuaauuauuucaccaugaguuaugguaaaauagaugguuauuugauaguuaaacaucugcuauuguuuauuuuauuaacccuucuguggguuuagguuuagucucuccaauugagaaacuugacccaacaaggaaaucuauuaucaaaagucucuacuuagugggaugugggugcggguguuggcaaauguacauugccuguuugucuucauuauuugucaaagaugaaaaugguuguguucauuugugaauguacccaggggcuuuguggagagaaauugcauaaauuauuaugaaagaauucaguauguuuauuuuuacuguaagauacaguaaauagaaaggcauugauaauuacuaauuggcaguauauaaguguguaguacagaaacaucccccucuuuuguuuaucuuuucuuauuuguuaguggugaaggaaguggcucauaauaucaacauuguccugaugauuacaucaggaacuuuauuauuaguucugaaguuaaucccuugacacauuaccuuuuuaaaaaaauaacugcaauagcaugaauuuaguuugugaauaacagaaaauagcaauuuucaagucuaauugguagguauguaaaaggcagaguuaaguguauaguuaauauuuuuuucuuaugaagccucuuugcaaggguagaucuuggaaguauaaauaugaacacaagcuucaauuucaguguguuucagcuaccaauaaaguaaaauaacuauuuuuacagggaauaaugaagcagucuuggguuguaggggaaauaucuagugaguauguaguuuuaccauuucuuggccucuggaauuuaaaauggucaauugaaauucuuuccaauuaauguucuguuuucagagggcaggcuuuugcucuaaggucacugagaauaggagagcguaauugcucaguuguguuccuuauaagauguagaguguuuuguaacagaaaaucaguagcacagaguuagcauagucuauguuuugaggaaaagaauaguagauaguagcauaucccaaaacaucccauuacagauuuucuggccuuagcucuguguauguguaauuugauagccgacccagaagcccucacaucaguggaugcuuauuugauacagugauagaaguauuaaucaugaauacauaucuagguucaagugcgccagaaugaaauguggagucuguucugaagcuacucaagagacaagguuucuuaaacacuuaauaaacauuuuuugagggccuacuguguuuccacugagugcucguuacuggggauaugaagcuagacaagacauaaucccgccuuugaccugucaaggaacucagagaacaguaucagagccaaacacauaaauggauaauugccauguaguauggaaagggcuauauuacaaaccccaaguacagugggaacagaguagagaacauccuccuuguuuuucuggccaguguugagacaguuuucugucuggauucugcuggccauugccuuuuaggaacagcauuauuguguucuuguuggaaaugcugaggugagaguaaggaaaugauuacuaaucaguaugguuggaaugauaauuuauuaaugugagguuccugagcaugguuuucauaagaaucuuagccaggugauggaaaauagaagaaacaauuuuccaucuaauagauacuaaauguacugagcauacauggaugcuuaggaaauuagaaaauaauuaauugaugcugaagagcaaagcacucugaguaccugccucaaauuuuuguuuugcuguccucgucauuuauuuuaaauuacauuaccaaaagaauuuaaaaagcauuuaggaagugaugaugcccaguaggcuuuuccugccuuuugcccucagucuauuuaguacauuuuucaagcuugaaauauaauuuacacuccuuuuaauuuaauugugaucauaauauauuuuaaaguuugucaaucaaggaugcuuggauuauauauaaauauuuuaaagaauacaagucaacuuucuuuucuaagcugaguuccucauaucucugaaagauauuccauguggacuaagacagguuuuagaugccuguuguuuguguuuacuaaguuggagacucuuacauuccuagagccuuaaaaccagggauaucauucauuugaauuauacuucuugacguauuuccuuuuccucacugaaguuguuccaccuuagcagaaucauggguugugguagacuugguuaggggauaauaacaaauugucuggacaguuuuguuuaguacucaguucaguuuugaauuuguguugugauaaaugaagugaucccaaaguuugguacaugacuucuuagaaaagcuauugauaaagugaaagauuuaaaggaaucauaugaagacuuaccuugguuuaucccugugauauaaggcauucauauaaugcaggccuuaaucaguuaguagucuuuuaaauauuacagaauuuuuagcauugagauuuugaaucuauuucuuucuucuuuuuagaaggugcuuuaugugcuaucuguugauuucaucauucauuuaucaaaucucaacuauggaaagacagacauuuccaaauagcuaugccauagaguaaaauguaguaagugcuuuaagguaguauaaauaaagugcugagauguaguacgugguagaggugaaccguugcuugcuaagggugaaaaguugguguagaaugaagcauggaggaggugcuggccagcucauggguuggaguccagugagauggaggacauguuagguugaaggaaugauagauuguugaguaagagaggggaaguuaggguaagaugauagagguuuugauugcuuuugucaaauaauuuugucuuaauuuauuugguagaaaaccauugaaggcuguuaaucagggagggaaaacuucagggcugugcuuugauagaauacuuacuugacucuguaaagcuugaauuaagagaaaaaaacugaaagcaagaguaaugaucaagaggaauuaaaacagucugggcaagaaauaaugaaaugcuggccuagauacuuggaaguagguguagcaaguguugguucagaugugggaggcauuuuggagguaaaaucuacaggucuuggugaccccuuagaauuagaggaugaaagagaaggugcagugaaagugacucuugagguuuucagccuaguugacuccgaaggcagugaugcacuuaaugagguaaggaacguaagaaggaaaagaggaagugugcggguuaguuuuuggccaugcuaaguucaguguaccagagugaauuucauuuaaaaucagaaaauuaaguguacaguucaagagagaaguagaaacaagagacacauauuugguagauauucucauagagauagcauuucaagcuauauaacugucagagauuucggaggaagaauagagggagcaaugcagagaaaaagucagauaauugaauucuggggagauugagggguguaauuaaauaccagagaaggaaagagaauccuacauagauuagugaugagaaagguagaauuaaaccauaaugacauccuagguacaaacagcuuuaagaagaagauaaaaucugaaguucugauaaaacuaaguucagauucaaguagagaaaaccaaacagggugaaaaauuaagaagucauugaauuguaugauuagaggccauuauugaccuuuguggagcaguuuaacuuaugugauggggugagauuaaaaugaguauguggauuauuuaaaaauuguucuagaacuguaacaacaaugaaaaggaagggaguucuguuagcuugaggauuugaacaucauugaaauaacucuguguguguguguguguauguauguguguguguguguguguguguaugugugcacacaccauaggagagguucaaagauuggugggaaaaaaaaaagauugaugggaaaggauguaguuagggaauggccuaagaugcaagggaaaaagaaauaguugaagcaguagcauucuagauuaaacugugggagggaaagaguaggaacaaguagaaggguuaaucuuggcgaauaaauguaacuuccacuuacacaggaggaaagcaagggaauauacagagaaguuuugagggaauuuguaaauuuuauauuggguugucaggaagugauuuaaggcauaauauuuauaauguuuaaaccauguuuuuaauuuuuauaucaugaaauaugcaauauauguauuuuaacuagucuucuagcauuuaaguggguaaauaaguaaaaaauuaaaauggaaaucaauucucaucuuuaauauuaaguuuaucuuauuauacacuugcugugacuuagaggaugccacagugcuauuuuuaucuacucugcuugggcauauauuaauaauauuauuacaauuuuacuaaagguuuuuuuuguuuuuaaguauuuguagguugcuaauuuuuuucaaguaaugaaagacacauuuugaaaauauccaacacauuuuauagguuuuuaacauaguuacauuuagaugauuguugagcuuauauuaucuuacaguaucaaugaaaaaaguauuaauaguuauaauauucuaccuguuaaaagauuuaaaaaaauauuaaagcccuacgucuuuuccugagagccucuuggguuugaagaaaccagaggauuccaugucagcugacaggaacacugaccugggcuuagccuuauuuccugcuuuucugcacagaacauuccaggcuuuuuaaggguuuuaggcagcaugaguaacuuuaugagcuaaaagagcuucuaaaaaucaugauccucaacaaacuguucagugcccuuggucuaauuuucauaccuuugcaaaaucugcagggauuuugccuugugauggaauguaaaauauggaagggagaagaaauauuaagaaggagauagggcuaacuauguucuggacacagugcauagcacuuuacauuuccucuuguaagaauuauaauauccuaagagguuucccgaagaagaacccugcccaagguuguaaagcuaguaaauguuagggccagauccuagguuugcuugauucuaaugucuguguucacaguaugaagagugaagcacacugcuccauggaauaauaugaugcuuccuuuuuccaaaggaaguaaaucaaaagggcauuuccccuccuccacuuccauauuugauauuaucaaauucuucuccaaacuuuguacucauuuuuaggcagcuuuauucaauguaguuguggauaugcuauuuguaauauaauuuuccugagagguucguccuuaccuuguuugcuuccuccuccucuuccuccuuucugccaucaaauauuuguugcacaucuacuauaugcaaaguuccauauuaggugauagagagagaccaaugagaaagacuguucuucacuuucaaggaaguuccauucucauuuggaagaaagagagugaacagaauacacaauugauauuuuaauuacaacuagucaguucuuuaauggugcuucuuaaugucaaucuucugaagacaucuucguggaaaaccauaaaggucuugguaauuuucuguaaauucagcugugcuggacucaugaucaauuuuauaugccaacuuuguuuugcccaauuaauaaucuauuaaaaaaguguauuuuuauacuuuuuuacacuguacauuuuuauacuuaguaaaauacauuuuuauaauuuuuauauuuaguaauuauuugcugcauuaaaauggaaagaacccaaagaacucuucgguaccuguuauuauaaagagagagauauauauauacuuuaggucacuguaauaagaaaccucuucuaacauuuauaggaggaggacagggcuuucuuuuuuuuuuuuuuuuuuuugacacggagucucacucuguggcccagguuggagugcuggagugcaguggcacgaucucggcucacugcaagcuccgucuccuggguucacgccauucuccugccucagccucccaaguuccugggacuacaggcgccugccaccacacccugcuaauuuuguuuuuguauuuuuaguagaaacaggguuucaccguguuagccaagauguucucgaucuccugaccucgugauccgcucgccucggccucccaaagugcugggauuacaggcgugagccaccgcgccuagcccagggcuuucuauauuguuuuuaagaaugaggcaguucacuugagaguauaugacuugauucaguguaacugaaugcuccaugaagugaggcguguuuuauaaugaaagucuuauaguauaggcacaauuccuuacuguugaaauuuucauuuuauuugguaagaguucuuuccuauguuucacaggcugguuugaaccuuguuugcaaggaauguacuaucugaucuaauacauuuuuauuaccuuuuggcuggaaguuuuaauuaaggcgcagucagaaaacucuuuaaaugcaagauuauuccaagaauaaguaaugacuuugaaaauucuuauagcauuaguaaauccuguuuuuguauuugugcuuuugcuuugauaugguugaauauauguaucuaaauacauauuuauguauuggaaugcauagccaauauauuaauaauauauuuuuauucaugugaaacaaugcauguacagagagagucuccuuaaauauuucuaauacauuuaagcaaauacaaaacucaguuguauauugguauggagacaguuccugauucucaaguccagcuaucaggguucugagcaguaaccuuaguuagguucuaguucuguauuucaauauugacacgucaaaaggaauugguccugguaauuuccaaauuuuuugagucaauggcuauaguggaauuuucagccuaauuccaauaauaaauguuuugccuuuuaguucaacagaaaagagcaauauugcuauugaaccaauucuuuuaugcaccaaucggugcccuacaaaguucaucauuuuauaaugugacuacagauuuguucuuugucaaagcucuucuguguuaguaccaagcuucauucuaggaagcaauuuagguauuucuagaagagguguaaccauuugaaucugaacuugacccugguggugagcuugauuuucucucuaauauacugccuuuagaaaagcaauuuuucuuuccuggcuuuugcagcuccuugcacauagcagguauucaauaaauauuuauugaauggaauugaauuugaccugcuuagaagucauaguccugauguaggguuauucauuuuuggcagaagcugucauaaaucacaggguuuaauaguaauccaacugaugaacugcgcacccaguggcauaccguaguucagcauuguauguugcacuuucccaagugcaaauuuagaaaacaguuuagccuacagggccuugaugaacugacucuggccuauuucagaucucucguacuacucacucacagccuuccuuccuaugcucugaucuuuuagaauaacugcauuuacuucucucuuaacaugcuugcucucuggugucucuuaagccuuagcacacuccuuugccuagaauacuccuuuuggcaaauuuaaguauguauuuccugacacucuuauguggagaugagugagcugcugcuuuucuccuguagcaguuuguacuugccuccaucauagcacuaaauucuccuguaauucuuuuccuaagccaccagucuuucccacuaggcagcugcuugagggcaggugugugauuuauuccuuucuguguucccuagagccugaaacaaugccugccacauaaauguuuguugaauuaacaaauggguccugaaguuuacguaaauuugcaaauggaauaaaauaaaaauguaaaugaguuuagcagggaucauuaauuauaugccuaauuuuaauuaaauugugauacaguuagaaagaucagcccgagauucagaagauacaagcucuuguauuggauuaaugauauuuuaauggucccuuaaucuuucuaguucuuaguuuuuuuaaaucuggaaaugaauggauuggguggaaucuuuacuaagaucccuuagagcaagaauuacauugcucuuaaguuaauuauagagaacuacgucucuucugccagacucuuugcaucucuuugaaucaggaaguauguucuagucaucuauaauuuccuagcucuaagcucaguaccuggcauauaguaguucaagcaauuuccaccugauaaagcaauaaauucccacauggaauuacaguuuuaaauaaagcaaaugagaaaaaaguucagauaaagaauagugaauuaaauauuuguaaaacauaaacguuucugucaaagaauauuuauguggaaugucuggaaaaaaaauaccugacagaaauuuuguauguaucaguuaaaaaguucucuaguagaggaaaugaauuugaagcuaccugguccccaaacuagaagaaaauaauguaucagucugugacauguuacaccaaguuuuauguugcugacauuaaacuaugccugcuguagaauguugguggcaauauucuugguauuuauguauacuugugauaguauuuuugguuuaaauaauuuaaaaaccauauucuuuuucaagcaggauuuguuaaauaauuggcauauuugggacuuaaucuuuagggcagaaugaacucugauuauacuaacguaucacguauuaaaaaggggguaaaaaaagcucugucagccauuuucacuauacuuuguaaagauuugcuguuauuuaguaaaugagaugacaucuuaccuuuccaaggacuuucuuggagauaaaaauacuauuauuacuuuuuaacuaagccuauaccuuuggauuauuaauuugaauacuugauacuuuagaguucaauuguaaaaauaaaggaaauaauacaaucaaacuauuugugaaaaaaaaauagcagucaaccaauccauuaauuuguugguuauguacucagcaauucugcuuuaaggcauuguuuacaaagaggaagaauauaagaucaugcccuggguuaaugugaaaaacaucuuaaauuagaggcugaugguuggaaauuugaaccagauuuuucucuccaucuacucccucugaaaaaaacccugauccccagugauuucuuuuuuuuuuccuuuucuuuuuuuuuuuuuuuuuuuugagauggagucuugcuuucuuguccaggcugagugcagugaugugaucucagcucacugcaaccucugccucccggguucaagugauucuccugccucagccuccuuaguagcugggauuacaggcaccugccaccacacccagcuacuuuuuguauuuuuaguagagacaggguuucaccauguuggccaggcuggucucgaacuccugaccucaugaucugccugucucggccucccaaagugcugggguuacaggugugagccacugcgccuggccaauuucuuuaagaaaguaagugugauaguguguauaagaguacccuuuaaauuuguuaguuccuugauuuauuguguucguuaugcuugaaguuauuauaguucgauuguuuauuugucccaggcacuuuuaugggugcccagaggcagauccauguuuuauguccccugaaacuuauaugauuugaaagaaucuuucuaaauauaaagaauacgaaaguacaaacaucaaauuguuuaugaaagugaauuuuuuuuagaaugagaaaaauccacaaagcacuauaguuuuuaaaaagccgguauaucuacaagugauuagagaaauaaucuagacuaguuuuuggcucuguacauuuuauacuuugauuaucuuccguuaccgcauauacuuccaguuuugggugucaugaaacacauucaaauugccagauuugaauuggauuucacuguucccaugguaggcuagucagcauugugggcaccucagguauuucuaaaaccaucuuuuaaaaaaaguucuauuacagauuuaaaaaauauuguauuuauuuaagguguauaacaugaugcuuugauauauauacacauagugaaaugguuacuacaucaaauaaauuaacauauccuucaccuuccauaauuaccuuucugugguaagaccauuuaaacucuguucucuuagcaaauuuucagaauacaguauuauuagcuauaggccucaugcuguacauuagaucuccaguauuaauuauccuacauaacuucaaauuuguacucuuugaccuucuucucuccauuucuuccccuccccaucccuggggcccacccacuguucuacucucuguuucuuuguugcuuaacuccuucuuuuaagauuuugcaugugaaaaugagaucauauauuaauaguauauucuuucuuugccugccuuauuucaguuucauugggauugcugacaguaauuaaaccauuuuacaggagugacuguaugccucacauauaccuuccauuaaacccaaaguaaaugugucuucaauucaaauuuccauuagccagauuccaaaaauacccacagccacuccagugccacccaacaggaggcuuuagccaauuauguuuaagauauuauacucuuaggccggguacgguggcgcacaccuguaaucccagcacuuugggaggccgaggcggguggaucacaaggucaggaguucgagaccagccugacaaagauggugaaaucccgucucuacuaaaaauauaaaaauuagccaggugcgguggcaggcaccuguaaucccagcuacuugggaggcugaggcaggagaaucacuugaacccgggaggcagagguugcagugagcugagaucgugucacuacacuccagccugggugacagaaugagacuccgucuuaaaaaaacaauaaaauaaaauaagauauacucuugacaauuugacaaaaaaaaaaaauacaacgagggccuuagaagagagccauguaucuuuaugaucuuuaugugaacauuuaaccuuuuguaagagugcugucccauuacacuauauaaugcuacugugcaauucucaauuauuucauuugaaaguuauuuauguaaagaguugauuaugcccuuucuggagggauaagaaugugguggacuaacuuacucuuggcuaaaucacaugaacauguagaagugaauacauuaguuggauuacuaccuucucuggccggcagaagguacuuucaguucugcaggcagccccugaacgccccagugguugggcagcaccugugaugggaugacugaaccguuauaugccacauguuuauaggcgugguagacaguauggggagguggaaaagacugguucugaccugacacacauuuacuacuuaauaacucaguuauucaaauugcaccucuuuguuuuauuguccucgggguucagaacaguacaccaaaacgcuaauuaacaaacuaugagacagcaacagcugggaauucaguguaguaaaauaacauauaaaugugagacauugguugucaacagagaaggcccauuuccucauuuuuauuuaaaaaaaaagacuaucagugauauacagugauuagcauacuggaguucuuuuaagcuaugcacaaugagguaucuuagaauuaaacuuuagagguucaaaauaaggauaugauauagaaaagauugaaugguaggagaacagaauaggauuuauuuauauuaugacaaacgugacuaucaguuaauaaauuggagauaguaaguuaagaucauuauuuauauuauggaaaaaugaagaaauaggacaugguucucuaacuuuuuaauuuuucugugaaauaaaauauuaugacuuauuuuauuuuuaucuuuguuuuuagguaagacugugccaaaaucccaaacuucaguugaaaaauagcccaccauauauacuugauauuuugccugauacauaucagcauuuacgacuuauauugaguaaauaugaugacaaccagaaacuugcccaacucagugagaaugaguacuuuaaaaucuacauugauagccuuaugaaaaagucaaaacgggcaauaagacucuuuaaagaaggcaaggagagaauguaugaagaacagucacaggacagguaagaagaauauuucagauguuuugguguaaaggucauuuauguugcuuuuuacuuaauaguuaaccuaaacgucaccauguaauuguuuugggguaaaugugagucgcuuuguauauagucaugugguacuuaacgauggggauacuuuacaagaaaugcauuuuuagacaauuucauuguuguguggacaugauagaguguacuuacacagagcuagaugguauuaccuaccgcacaccuaggcuguaugauguagccuauugcuccuaggcugcaaaucuauacaguauguuacuguacugaauacugugggcaguuguaacacaaugguaaguauguguguaucuaaauauaccuaaacauagaaaagguaugguaaaaauacuguauaaaaggccgggcguggugggucaugccuguaaucccagcacuuugagaggcugaggugggcggaucacuugaggucgggaguucgagaccagccugaccaacauggagaaacccugucucuacuaaaaauacaaaauuagcccggcgugguggcacacgccuguaaucccagcuacucgggaggcugaggcaggagaaucgcuugaacccaggagguggagguuguggugagcugagauugugccauugcacuccagccuggacaaaaaaaaaaauacuguauaaaagauaaaaauggauaaccuguaauaaccuguauaacaugcauggagcuugccagacuggaagugagugagugaacggugagugaaugugaaggccuaggacuguuacuguacacuacugcagacuucagaaacauuguacacuuaggcuacacuaaauuuauaaaaaaaauuucuuuuccaauaugaacagccuacugucacauuuaaacuugauaaacuuuuaauuuuuuuuaacuuuuugacucugguauuaacaauuagcuuaacaaaaauauuuucuuucuauauuacccuauaagcuuuaaaaaauguuaaaaaauuaaguuuuaaaaaaaauuuuauaaacuuuuuaaaaacuaagacacaaacacacacauuagccuaggccugcacagugucaggaucaucaauauuauugucuuccaccuccacaucuuauuccacuggaaggucacacaauauguaacuuuuucagauuggcuucuuucaccuaacaauuugcauuuuagcauggagcaauaacaugcauggagcuaucaucugugauaauagugccuucaggaauaccuccugaagggccugccugaggcccuuuuacuguuagcuguuuuuuaauaaguagaaggaauacccuauaaaauaauguuaaaaaguuuauaguauaguaaauacaucaacuaguaauauagucacuuauuauaauaucauuaucaaguauguguuaugcauaauuguaugugcuaugcuuuuaugugacugguggcacaguagauuuguuuacaccagcaucaccacaaacauguaauauguugcacuaugaccuugugaugacuaugacaucacuaggugauaggaauuuuucaguuccauuauaaucuuaugaaagcacuaacauaaaugcagucugucauuaacugaaauguccuugacugaaaugucauuacgggguucaugacuguauuugcuuuuaacauuaauagcuuuaugugaauuuacuuaugauaguagcuaguucaugagacaguauucucaauguuuuaauagacuucauuuucagagucauuuuagguuuacaggaaaauuauucagaaauuacaguucccauaaaucuccucugcccaagcaguuucuccuguucacaucuugcauugguguaguguguuauaguugauaaacuauuguugauacauuauuauuaacuaaagccuagaguuuacauuaggguccacuuuuuguguugugcuguucuaugcuccauaaaugcauaauguaauauauccaccauuacaguguuauauagaauuguuucacugcccuaaaaaugccccgugaucuacuuacugucucacuucccccccugaacccauggcaaccgcugaucuuuuuacugucugugcaguuuugccuucuccacaguguuacauaguuggacucacacaauauguaacuuuuucagauuggcuucugucaccuaacaauuugcauuuuagguuccuccaugucuuuucauaacuugguagcucauuucuuuaugccacugaauaauacuccauugugugguugcaucacaguuugguuuuucacucacaccuugaaguacaucucgguugcuuccauuuuuuggguaaucauguauaaaguugcaauaaauauuuguguguagguauucauguggauuuaggcuuuuaacucauuuggguaaaauaccuagcaagauugcuagauuuucaggguaugcauaaguuuagaaagcacauaagaaacuuucaagaaaguuuguaagaaaccccuugacugguuccaaaguggcucuacccuuuuucauucccaccagcaacgaaugacaguucuuggugcuccacauccacaccagaauuugguauuggagacaaguguuuuaaagacauaguuugauugaaucugcggaugugguagaugugggugggagauguaacuuccaucuguguauuuugacuuaagugagaaacugaacugggcuggcaaagacugaauugacaucaaccaaauccuaauuuuauagccaggauucuucauuuagauauccucauucaaguuuauuguuuggccauucuaauguuaaauuucaggaucuaucuuaaacaaaauaaggaaaaugauagaguuuuccauuucugggcuauuuuaaauauauauggaauauucaugauagugauaguuuauuuagauuuccaaauuggaaaaccaauauuaaugaaaauauauagugucuuaacauguuaguuaaauuuuagugugagacucuuaaccucucuguauuuaguuuucugacauaggaaaaccuuuaagaaaccucuaauauuucuuucaggucagaaaaacuggccucauaggguuguaaaauagaaaauucaguuauggagguaugugaacucuaaauuuucuaugaauacuggccaaauacccauaacaaguaaaaccaucaaauucaaacauaaaaaacccucuuccagguguaaaauggcauaauuauauauuuauaauuuauaauuuucucucucaauuagagaugaacccaaacauacucguagacgucuaaccaauuauguaacuuugggcucgucacuuaauauucuugggccacaguuuauucaucuugaggguggugaaucuuccuguugccuuuuagcauuaauuaaugcuuuaaaauucuccaggaauaacaagaggaauuugaguugccacagugugacagaaguaagguagagaaauauuauagugauuguuuauucuuguacacuuuucaagaagugcuaacaucuugggaagucagauauuuauguuaaauuuuuauuuuucacauuguauuucugccauugaccuaauaaaacuaaguucuuuacaaaugucuuuauaauucuuuuuucaaauuuaguaguuuugaaauucuuccugauccagccaagucauccauuaaauuuuacucuuuaggguaucaguacauugacaaggcauauaacuccuuugacuaggaauuugaguggauacaguguuuuaauuggauguaaucauauaugaugugguaaacuuguaucccacuuuuacaucuucuguggaaacuugaaacauuuucuaacucaguagauguuuuauaauuuccauuugauaauuuugauaguuuugcuuauguggaaacauuucaugggagacauuuaaguuuuguuugauaauguauagauucccauagauuuugauagcucucauaaugcugacuauucacaaugaggucacucauucuguguauucuugccugcauuuuaaguguccaagugaauuuuguucacuguccuaaaugcaacccuaagacaaaauuuauugguuucuaugcugauauagcauauccuuaauuggauauuacuguuauccuuguucuguuuacugacaauguucuguggccagcuguguuuaugcagaauuuacauuugauaaauguuucauaacaauucauaauaauguaccauucuugguacaccauaacaggcacauaaacuuucgaacuguguuucuuuuucuaguaauauauuuggacacauucacuucuagguucccuuaggauuccaaaugcaaacugagucuaaaaugugccauugcacauggagcucugaggcauuuugcucuacagaacacagaagagucuucuuagcauguuuucauuuacagaguggccucauucugaauagucagcauuaugagaucuauugaucuaugaaaaucuguacauuaccaaucagaaccuaaaagucucccaugaaauguuucuacauaagcaaaacaaucaaagguaguuaggcaacaaaguauaugguuuaguagaaugacuccaccuaaucgguaugacaacgcugguuacugggaauauuauaaauucacuacagaauuguuucuuugauucuguaaguagcucacuagggacauuacuauaauugagcuaaaaaugaaggacaguaauaguagaaacaguaauuuggaguuaauugacuuaaucaguauuacuucaugugauucugcccgcuuuauugaagaaauugugcuggaugaguacaugaaucaaaaugcauauuuuaauguuccugcaccucuguugugucaacaauaaaugcggauuguuauacauuuaaggggagaugagaaaaaauuuaggugucaauucugaacugauugcuuuuuaaaauuuuaguugauuguuaaugaugaaugaguagcccgaauuuuaaagcaauuuuacauaaauguaauaaauagaaagauaaagaaguaaauggcauucaauacauuuccuaguuacuuagguccuguguagaaggagagagguagaaauuauagucacauaauuguauaugcuacugaaguagauauuuagggcacagugaaagucuuuugccuugagaguagauaaugauuucuaguagagaaaaggcaugagcaggcugcaugccucccccgacugauacaguaaaccuucaucuuuuauaucauuuuucccaaauuguuguuguugcuggugcucuguuguuuuguucuuuuucuuucuuucucuuuuccugcaaacaguucaaugucacacugaguuggugcuacuccagcugggugucuaaaccauucugagcugacauuucugggaagaguaauucagugauuucugacaagcauaaagcuugcauguguauguguguguauguguggagagaagguaaagaacauguggagaagucuguaguuugaagcauagagaaaaggagaaacucuaaguauuauauuacuuaaaguuuuaguggcgcaaguaaaaauggaugugaagguugucauugcuaacaaauguauaauugauaggaggcauuucuaugauuuuacuggcaguuucaucaguuaaccauuuuaauaguaaaauuuauuucuucugaaaaguguguauuaaucagcugcucugcaaggucugguguuggccacuguguuuuuuaaaacacucagaugauggccgaaggauacugagauuuucccuauuuuugaacugcuugagugagccagggugcuacaacccauuuuccccuccuacacacugcuagacaaccacuggaaaaaaagucaacugagguggaaaaaauagcucugccuuugauagacugugaagaaaauaaagauuaacaaaagcucuggccagagaggaaaacauagauguugccuuaacauuaacauuaaugucauuucagagccuuugaaucaugccuuaauaaccaguguuguagaaaaaauaaaugacaaaauggggugugugugugugugugugugugugugugugugugugguggaggguuacauguucuguaguuaaaaaaaguauuugacauagaaaaauuagcucuagaagaagcuagccuguauuuaaaaggcuucaggagcauccggcagaaauauuuuucuccauugacuguuuggcuaaacaaagaauaauuuguaaucugcuccauuaauaaagugccuuuccccuuaaaggacuacagaucacuaugcuugcuguuucuacuuguguugguuauuuacaagauaguguaccaaaaaacauuuugcaauugguacguugaagauacaugguuaaaaguugaaucaaaagcaacagcagccacaauaauaacaagagcaacaacaaaacaaaagcugcaaacaaaccuacuuucuuuccuuauguuacuguaugacaucauugcuuugaguaaagaauacaguaguauuaauuuaaaugcuuaaauuuauauuuauacaaauguugauagcauggucauugaaauaguuuugcaaguccucacagguuuucaguuuaccauauaaagagauugaucuguauguguaauuugugcuuuaagugguaguuuuaauaguuacuggaccucacaguuuaaugggcauguuuauaaugcuacaucaauuaccacauuuucucauaguucuguauauugugagaagaaaaugaaaaaagugcuguuuaacuaaguacaggaauguggagccaggaaaucucaugcucugaugccauuucuucucccaguguucuuuguaacuuugguuggcuuccugacuccaauuuacauuuuuucaguuauuaaauuauuuucugguuauucauaacauuuucaccucagacauuucaaugucacaaaugaaaauuaaguuguuucagacuaaaugcuacuguugcuaccucagucuguuaauauuucaacuuuaguaguaguuucuauaguaaaaauauuguuuuuguuauuauaacaauuauuugcaagagaaucuuaagaagguuugucuuuuauaaauaaauuauacuauauuggauaucuaugaaauauguaaugauacaugaaagggaauggcuuauauucaucauuaaaauaauuuuacauuuaaaaaauuaaccuaguuuuucuguuucuccuuuuuuuguuuacuaauggugaaaauugcaauuauuuugaauuugaugaggacaaaggaccaauugcaaguagaaaauauuucuaaauaaaucaaaauaggcaacuaauuucuuuugaacacaaguauuuugauauaaacauauacauuuacucauuuuuucuauauuuguuugcauucaaggcauuuuuuccuuuuaaaugggaaacuagaggaaugaaaauaugaauuuuugauacuucaaaauaauaauuuuuaucuuggauucagaagacaaauaguaaucaaucucuuauguagaaguaugucugccagauaggaaguagaauuugcuuuagaaagcuugaaaaaucuucugagauugauuuauuguaaaugaauaaaaaguuuauuuuaucuugaugagaauguuuuuaugcauauuucaagcaucugaguggugugaauagacuuuucuaaaguuuggaaaugaaggggcucauuucuuuaacacaccaugaaaguagaggccacaagaaaguuauuuagacaaauguuuucaaaguuaaacaaagggagucuguuaggggaggcaggugagagcuugcagaaucuuugacuguuaaggacuuuauggcccuguguauuuggcuaacugcaccccugcugcuuagcuagcuagauacaauguaauuuucuuguugauuuuucaaugaaaagugaaaguuuuuuuuuuuuaauagcaguuuccucucuaggguauauuuuacaaaauacaaaagaaaacgaaauuauucagauguaauuaaaaugaauuccaccauuagcuuuuuaaauuuuaauaaaaugcuuacuuguaauacauuuauuugcuauuuauuucauuuauuuaguuuaguuuuuuuuuuuuuuucuaagccccauguuaauacuguucagcccccaacuccugguuucuuaguaacuaaaacuuauugcaaguauuuuaauuucuucuaaaucagauuauauauuaugcacauaugauauuuggauauuaaaauugaggacuuuuuucccccacagaugagcauuuguuaaauguuuauauauuccugagaaugauaccaauuauuauauauauuaagcaaacucacaagacucaagugaacuuggcuuugcaguggaauaccguuuauguuuuucagucuuagguagcuuauuaaaauugauguuuuccuuucaguaaauaucuggugacauuaaaauuugauaauuaaaauccagaagcacucaagaaagaaugccugcuuuuaguuucauaauaacaauacucccacaaagaaaguugaugaaugaugucuuucaaguggcagaguuguuauuuaguuaaagaaagcuccuuuggcaguuucuuacaaaacuaaauuaaaguuuguuuauaaaacagacaagcuacagugauaauccuauagccucaagagugcuuggaaucuagcccaagaagagucuuguuuuucagugauuuaacaaagaaguggaguuuccaagaauccaaacagauuagcauucagugcuaauuggguaggguguaaaauaguauucaugucugauuguuuugaugugaaguacuucauaaccauuccguuuucuaaaucuuuuaaaaauauuaaucuuuugucucuucagauuuauuguuugagcaugaguuuuuguuugaggauauauguauacaucaaugguucauagaugugcuguaaacagcaagacacaugagaucauuacaaaaagugcccuuuauagauuaaaauaauaaagagagauugaggcucuguuguucaguggaaacauugaagaacaaauuaaacugaaagauaauuuagauguucuauugaaauguauuacuuugaacaucugaucaugugauuauaauauaccacuuucacauauaaucacaaaugugugacuguauuuguuucuucgggcugcgguaacgaaguaccacauacuggguggcuuaaacgagagaaauuuauucucucacauuucuggaggcaagaaaucugaaaucagggugucagccagcagggccuugccccucagaacccucuagaauagguaauuucuuugucugucucaguuucugguagcuccaggaauuccuuagcuuauggcagcguaagucuguucucugcucugucaucacacaguguucucuguguauguacguguguguccaaauuucccucuuacaaaaacaccagugauuuuggaucagagccuacccuugugaccccaucuugacuucauuacagcugcaaagaugcuauuuugaaacaaggucauauugacagguaggauugagguuagaauuuaaacauaucuuuuuaggggacaccauucagucccuaacagugaccaaauauggcaguguacauuuauacuaaggaggggaagaaaguugaaacccauuagaacaugucauggagguuugaaaaacuuggauuaauagaauauaauagcaaacaaaauuacuuguaauuauuuuuuguaaaggucuguagcugaaauaaguuuuuuucagguguguaaugcaugguuaauuuaugcauuaguuuuuauaaauauauuggaaaacauggcauauucugcauuucccaauaauacauuuuuguauuuauugauauaauugaauuuguaaguaccuuuuuuuaacauucuuaccgauuuuaauguauaaagugccaucucucuuuagaaauuauuaguaauacaaauauguacauuuaauuuacauuuauaauauuaauagcccugguuauuucuuaacaaucccuguuuucuuuaauuuugugauaaucucuggaggauuaauuagaauaauuauaacuuauuaaaucuguuuauaaacuuuucccuauugcacauagaaaauaaauaauugggaaguguuuuccauguuggugacaaagagaaggcaacaaacaccacauucauuuugucuuuaauauuaaaauauggaguauuaaacaugauuucaauucaaauuuuaggaaaucaauuugaggauuuuaguuuaaacaagaguaaaugauuguuucugaaaguggcauguugaaugguuuaaaccaugggucagcaaacuguacagagccagauaguaaauaguuuagacuuugccagauggucucuggcaauuagucagcguugccucuguacuaggaaagcagacauagacagucuguaaauuaauugacauggcuguauuuugauaaaaauuuauuuacaaaaaugagccagaccaaauuugaccauugggugguccuucgccaacccuuggcuuaaaguaccuaucuaauuuuuggagaguaaaauuuuaaaacuauuuuaucaacaccaauccaucauauaaguugcauuauauguaaguuucaucaacacagacugaguauauaaguuggcuaaaaguaacaauacccaucuaacaguacaaugcugucagagacccaggcucuuucuggcuuauuguaauucauuuccuuagcauguuggguuuuaucuucauucuguucccuucacaguuguggaauuccuguugcagcuucauuuuuuaaggacacaaggcaggaaaggggaagggcaacuccacacgugucugucuucuuaucuugaauugcaaagcugucccaguaccuuaccaccuacuugcuucucuagcagauucucuuccauauuauuuaagccacugggucacuccagguuacaaagguagcgguauauugaaacuuugaaauuucagccuccauaguaaagaagggcaagggagaaacgguguuuguuuagucagucuaaauugucaaaggagauagccagauaucucuuuuugagagauaaacagacacucuucauuuaaacaugguauaacuuggcuuuaaggcauauuucuuuaaaaauauauugucaaggacugcgaagagccugaagcuacuuugccauacuuucagggcuagcagaagacaggagaauauuuggucggggaaaaugaaccauuuauuagucacagagggacagcauuaggcaaggggucaucacuugugccaggucaccaacccucaguuucuauaggacaguauaaagggcaggagacaccugcaugugcaguggcuggcauuacagaugaaucccaagccuaaggacccugaauuuuuauaauggacaguaaaccugccugacucuugcucuggaaggagacauuaucuuuauugaacuggacuguaacccucuuuuuuuuuuuuucuccagaggaaaacacugucccuauuaucuaaggcuguuugauacacaaauguuccugaaaggauaauuugaaaggcuggcaguaucugguugcaagacaugaaaaaaugugggagaccuauagauacuucuccccaaaauauuuauguucuguucuuucuuaaaaaccauaauguaucucauguucucaguuuugaaugcuacuuaagaguaaggauauuuacucuauuuuggauuauugguaagcuuaaaaucuuggguucugggcugggcgugguggcucacaccuguaaucccagcacuuugggaggcugaggugggcagaucaugaggucaggagaucgagaccauccuggcuaacauggugaaacccugucuguaauaaaaauacaaaaaaauuagcugggcgugguggcgggugccuguagucccagcuacucgggaggcugaggcaggagaauggcgugaauccgggaggcggagcuugcagugagccgagaucacaccacugcacuccagccugggcaauacagugagaccccgucucaaaaaauauauauauaucuugguuucugccauuuuaauauauauaacaaauuauguauuugauauaucuaauauguauauuagaaaucucacauauaugugaaauaaugugaucuccagaacaacuguggaaacuuuguggugugaacauuuuuaauuccuuuuuuuuuuuuuuugaaaugaagucuugcucuguugcccaggcuggagugcaguggcacgaucucggcucacugcaaccuccgccucccagguucaagcgauucuucugccucagcuucccaaguagcugggacuacagaugcacgucaccaugcagagcuaauuguuuuuguauuuuuguagagauaggguuucaccauguuggccagacuggucucaaacuccugaccuuaggugaucugcccaccucggccucccaaagugcugggcuuacaggcaugagccacugugcuuggccuacauuuuuuauucuuguuugcauauuagaaaaaaaacuuuaauaauuaaagaaggaacaguuuuacaaagacuuuucauuucaagcucauuauccuuuaaaagagaagacgauuauauuuucuucuuuuuuuuuuuuucuugaguaauacuucauucacuuuucaacuuugacuacuguaacuuuagguuuagacccaaauaauugguuucaguagguaaggaagguugaaauuaugugauauaagaaugauauuguuuaucuuuguuaucagugucuaaaccucagagaugagcaccagguaguccaauuccauuuuccuguguggagaagcuaaauagauuggagguuacaugacuugacacacuggggugugcauguaauauucaugugugauauauuucuaaaugaaguuucguuaccaguuggcaugucugagccuacagcuguuggcauaugaaggguaucagaauuauaaugccuuuuucaacuuuguuucgggaggacucauuugaacaauuagcacauuuuaugguugugaaaaugaacuguuguuuuuucucuucauuaaaccagaauuaauauuguaugucaucuggucagucgaugcaacuuuuuuuuuuuucuaacacgaugcuuguauucauuaaauucagaaagacuauuuaaagcuuuauuuuucaaguauaccuuuuucuguaaauaucucuuccuuucucacucuguuuauguauauacaugugugaaauauuacuuguaacuuuuuaagcauuuaauuugucuugaugggcacagauuuuuaaaaaggaaguaagaaagauuaccuaguuuuuucugaacuauauuaaugauaaagcaucucagcucauuuuacagaugcugaaaacccuucgcguuuuguucugaagguuuuuguagggcauacugauuuucuaugaaguauguggagcugucaauuuuauucuuuuuuccagagauuucagaaaauuuucauuuaacuaaagauuuccauccuggucagcugggucucauuuaccugauuaaaauagguuugcauggauaaagucuuaaagcaaauucuccuuaccacauuuugugugaauuuuuuccucuuuaauacuaauuuuaguuuguucucauuacaauugcauauguaaaaaauacuuuuugauaaagcaacugaaacuuugaaguugauaauuuaucacaauacuuuuuuccccauuauaucaacacuuggcaaacuacagacugugagccuaauccagguuguauuuccuucugugaguaaauuuucaauggcggagccaugcucauuuauuuacuuacugucuguggcuacaauggcagagguaaguaguuccauagagacuaucuggccugcagagcugaaaacuuuuacucucugggccuuuacugcaaauguuugcugauuccugcauuacugauaucauuuucauaacagucuuaaaaacuuggcauuuuuaaacuuaaauacuuuuuucuuuuugucgcuuucuucucuacccuaucucugccagcaguucuuugugaauuaccauugugaucuucuaaaggcaaaaaaaaugguagguagucaaugacugauagcuauagaccuaugaaacuaacauuuccuaucuugucucaauauucugauguauauaaucauuuuaaaacauaauaaauuuaggccuuuuuuguuuuuguuuuuaacacaagauaugccacuaaugucugacaagcauuuaaucuaguggcuuuccugcauuuuccauggaucagaugcauucuaauccucugaaaugauuauuaaauacagauugccagccuuuauauaaugccugcuaaauuuaccaguugggaucugcacauauauugguaaagagugcccuagcaguuucugaccuucugucugcuuucagaauccacaugagucaaauuaucuccuuuuauguauaaucuuaucaaggacuauugagguggcacagguggggauggaauccuggauguguucagaacuccuuucauuuuacuaagcuuccuuuauacuaccagaggaauccacuuccagucucgagucacuuagaagagggggccgggcgugauggcucaugccuguaaucccagcacuuugagaggucaggagaucaagaccauccuggccaacauggugaaacccugucucuacuaaaaaugcaaaaauuagcugggugugguggcaugcgccuguaaucaggaggcugaggcaggagaauggcuugaaccugguagguggagauugcagugagccgaguucacacuacuacacuccagccuggcgacagaaaaaaaaaaaaaaaaagaaggauacauuucuguaagguuuuuaaaguuuuguuggaaaagauggauugcaauucucuucuuauguuuuucugagauuagccuaaucacuauccuuggaauuuaccuuugcuugccagccuuuuauccugccccuuucuccucccuuuccuauuuccaguuuaugcagauauucuuucuuauuacuggcauagcuaacauucccacucuauccccaugcccaucuuggcucugauuuucugaucauucuagcuaaaaugugucuuuuccuucugaccauagcauuuaucaaggccuuucauguggcaguuaaugauauauugucaaauauuguuaucuuuuuaaaaugguguuaggagccuggguaacagagagaccccaucucuacaaaaaaaaaaaaaaaaaaaaaaaaaaaauagccagguguguuggcccaugccuguggucccagcuacucuggaggcugaaaugggugagauugcuugagccaaggagguugaggcuacugugagcugaggucauggcgcugcacuccagccugggugacagagugagaacgugucucagaaaaaaaaaaaaaaagaaaaaaaggaaaaaaaaagguaauaggcuaugucucuucugugucucccaugguauccagaacagugcuuuauacuuggcaaacacucauaauaauauaugguuauuucuuuagaauuacuauaggaugauuugaaaauccugauguauuccuagauuacgagcugcuggggccuggagggaggcagaagagagauguuacaauggaaaguguugaagugucugaaggcuuguuuuuagaauuuguagguacacucugaaugucagcuucuucacauuugggaaugaguacuggcgauuuuagaagaaaagaaaaugcuuauaaggauaguaauaucauuauuauuuauguuuuaauuauaaauauauuucaaagcaacucuuaacuguauguauucucaaaauagcuuuacuguaauaacauucuuggacaaaguucaugaaauuacuacaguuuacaaguacuucuuuaauggaguguccuuguagcuacacuuaguaccuguaagauaaauuccuaaaaaauucacaucauucugccuacucucacaaacuacucaaagcaaugagcauauugcauagcuuucuuauugacuuauuaguucuguaucugagcuccaaugaguguuuucacuuccucuuauucuuauauuaacauuucuucaaagacuguuuuuguuucugugauguguuguacuuaugacccugaauacacaggacuuuucggcaacuggggaauccuccaaaaaucuaugcuuucgacaugaauaguccaguuucauuugguauguauuauugacagaagugcuucauccucuuuauagcuugcugugcagcagaugguuguuauauuauucaggacucuugaggcagugcauuaauacgcgugcacaauguuuuuuaagucuuauugugggaauugucuuguguccuuguugacggaauuccuuaauacggaugaagauuuccaaacuugaaaacuaguuuuuaaauuuuagcuaaggcuauuuuguauuuauguauugcuuaacugcuaucucuuuuucuuuccuuuuaaaguaaaggucggaggguuggaucuaauauucuugcuauaaaugauuuuuuuuuuuuuuuggucuuguuuuguuuugaugugagcauaucagcuuugagggacaucugagauauuuugaauauguaggcagggcuuuuaaagaaaggaauugcuguuuucuuacauccaccaugcagacuuagacuugacaggaaaacagaggcauguguguucucacuguguauuaucguugcgcccccucacauagcuguuaggguuugucagcaguuuguuuugacucacuagaccaagggugggggugguuuuguguguuuuuguaaguuaacuagugugggaugucaguaaucucagcuuuaccauuuuaguuggccaugaucccuucauguaagaaaccgucauauuugcccuauuucucaggccauacugugguuccgaaacuugcccguaaauauuugugaaauaguuuuucuuuucuuauaacucuggaggucaaaacccagcccuaagauaaacuccuguuucauauugccucugcggggugcucaugguauguccccagacuaauuugggaaccuccuugaauuacuuuuuaaaauuuaucuggauaguucuuacacaauuaaauuuaauuuuuauuuauuauagcaagauugaggacacucccaaauccacacuucauuuccugggagaucauguuagacacagauaacuaugcuaaauuauuuugauccagguaagcguguuagaaagagaggauggggcugcuggacuucauugagaggaucuuuugauuucagaaaccauuagugaaggaaagguguacuagacagagcugucauaaccuuuuuacuauuucuuaagagaagugguaccucugagaguuguguaacaugguggucuucccacaucuuuaucaagagauuaauuaagguugugaaguaaagcuuuagaggugaggcacaaaaggcaagcaguguuuaccucuaaucacucgagguaaccuuuauauuggaagaucaguguagauguauuguguaccagauaacauuccauuauguaacuauucuuuauuuacuuccucuacuguauguguggcaucauuccagcaucaaguuuaauccuucuuuguaugcauuuauuguaaacugucauuuaugugggauuaaaauaacuggaaagccuaaauaacuggaauucuuguagcauguuugguacuugacauuuaaaagagagacagauggcaaguaaacaaggugagagcaggacuuuauuugcuguacugcaaucucaaacugcugucaagaauuuuaauuagauguuauuuuaggaagcuuucaauuuacugcaggucauugaagcuuagaaagaagcagaauguacaccaaguauuuuaauauguuagcaauccacugcaauuaguuaaucuggagcuaguagguuguauuuuuaagaguguaaacauuuuacuggguuucagugugacuuagaguaaaauaauuuuucuguuuaauuuuaaaucauacuauuuuaaauuucuaaguugggcuucaguaucaaguugguugaauuaaagauuuaaauauuucuccugaugucuucccuucuccuuccuacuaaacugguguucauuuuucuuuauggugaucauuucuaauuucccacagcuucccuggacauuuccuucacugugagauaguaguuuuacacaucauucaacauccaguuguucaguuuucacaaaaagauuucugagaaaucugacuucaaaguuacucuuuucaaacugaagcucguuuuuagaacuauucaugauauaggaaaauacauucauaacugaaagcuuuuuuuggguuauucuuuguaacauuacaugccgcuuuucaccaaugaaaagaauccucaagaaccuggaaaaagcaauuccuuuuugcaguuaaaaugaagauaaagagccuugaaaaauggcugaugcuaauaguucauggagauuaauaagugauaugugaaaggcagacuguccuguaguugcaaaauguuacauaguuuguacaccuugucagcguugugauaacaugaagucauaguuuaauugguaaacaagaaaagcuuccaauaaagugucccauggaugaucuuuuccuuugagacugcagcauuucugaagaauauaggguaucuugugauacagcaagguaaaagcagggcacaucuucccuaugauaaaucugugcucuuauugucggaguuuaaccuaguccuucauauuuuguuucugaauacuugaguucauuuauguauaguggggaagauuuuguuuuugauuuugacuucugucaugcuugcuugcuuacuugauuuucuuuucuuuuuugagauggaguuuugcucugucgcucaggcuggagugcaguggcgcaaucuugucucacugcaagcuccgccucccugguucaugccauucuccugccucagccuccugaguagcugggacuacaggugccugccaccacgcccggcuaauuuuuuguauuuuuaguagagacgggguuucaccguguuagccaggauggucuccaucuccugaccucgugauccacccgccucggccucccaaagugcugggauuacaggcaugagcuaccguguccagcccuauuucuuuauuuaaaaaugacaaauacauuuaugguuguacuacaugauguuucuguauauguauacauuguggaauggcuaaaucaagcuaauuaacauagccauuacuucccauacuuacuuuuuuucuuuuuuaacuggugagaacauuuaaaauauacccucuuagcaauuuucaauauacaguacauuguuaaccucuugaacuuaugucuccggucuaacugaaauuucguauccuuugaccaauagcucuucauccacugccucaacugcccacccccaccccaggaaauugugauugauauauuuuuuaagguuguugaauuaauugucuuuuuugcaguuaaaaaauauauuaauaguaaaaugggcuagguagagauuuuuucagagggcaaguuaauucuggaccugacaaccuuaaggucuggaaaaauaguuacucucaaauuuuuuuuuuuaaaacgaaagguuuuacuuaauuaucagguucuaauucccuuaggauacuggucuucagugauuguuuaaaugucucagaggaaacuuauauaaaguuuggaauuuucauuuuaaaauuuguguuguuccaagauuucaaaacagaucuaaucuagauuauuauugauguuaaaugauguaaaauaaaaguauauuuaauuuuagaaauuuccauuaauaauaaaauuauucaaauuauaaggaauauacccaagaaugugaguucuuuucaaaccagaauuaaacucauuuauauuuauaauaccccuaaguacugaaaauaaauacuaacagcauuucuuauucagaaaacaaaacugguugcaagcagcaagagaaaauaucuugcugagugucgcuuugaaagccaaaugaguuguaaaaaaaaaguaaaaguuccuaguuuuuguuuuacaauaaaguuucuaauuuugucuuuaguuuuaacugaucauagaaauuaauaagccugucugucucagagagagauauuuguucugccuucacuauucugccugaagcaggauucuggaauguucuucagaaucaugcagaaugaguuguaauuauuugcuacagaaugaguugcaauauuugcuagucuucaaauucauucucauuauucaagauuauaugaucagaaugaauggaaacugcgauggcuauaaccuagagaaguaauaagacaaaaagcauuauuuacucauaugaaggguuuaucauucauauuucuucaucaucuaccuuucuagauucauuucacgacacucucccucaggucuuccuucuuuauccacucacaucauuuuucaguuuuucaggccuuuaggaccuccacaucugaggcuucaugugccugauuuuuuuccaacuaccuaacacaucuuucguaucauaacuuaaaugucauuuccucagagaggccuucccugagugaucauuaaauguuuugacacauuauuuuaucucaugguauucugcuguguucuuuccaguacuugucacaguuucuguuucuucguuuucuucaccacugucaccacagugccuacuucauuuccaacacgguguagguacucaauacagauugaaggaaugaaggauagauaaugcacucaucuugagcuacauccuauuuagugagcaccauaaaacuuggcaggcauuguuagaccuuuauauggacaagagcuuugaugguucguuuuuguuuuguucaguuuuguuuucuuucuggagauggaaaaagaaauuuaauagugauaaagccagagaaacuuaagcuggaccugucaaucugguaugguugagagguauuuauuuuaaucagcuguggauuguauuuucaugugacauuuuaaaaaggaugaaaagggucuuacagccacaugcaucauucuuuugccugcugauccauaauuagaaucagcaucuagaaucuguuuuuguauauaacugaaguaucagaguuacaaguaaaaccacuuuccacguuauuuguuguccauuaacugcugaagauuagcauauuuaaaaguuuuacugagaagcacauaauuggaaccugauguuuguuauuuauccugauucauguuauauuuucuucuuaguggacauuaaaauuucaaaauugcuauaacagaggugcuguugggguaguuucuuaguuguauaugggucguauauuguauaugggaaucuuuuuaugguacacaucuguuuucaucaaauaggugaguaguauucgggcauuaccuuauaccuucuuuaaagaauuuucauccauugcuuuaauaauuauauuaugccagcucuauuuaauauaauuaaauuuuuuuuuaaaauuuccuguuguaucaaccugaaacuacuuugacuagcauuuuggcugcaaccuucuuuucuuaacuguucaguaucccucuguguauuuuuauuugguucccuuaauuggaaauaauuuaaaaaacauaaugugugacuuucuugcuuacucuugaauaacauuuaaacuucagccucacuugucuaauuucaguucugagguauguucuacuuguugccuccucaaauugcuuugccuuccugaaaaguuuuucuuuugauucuacauauuuucaggggagggauaaagaucuaagcauaaauaucaccuccuuagaugggucuuuuuugaccauccuaucaaauagguugucacaguuaguauugugaauauuuucugaugauuuauuuucucccccaacaaauuuuaacugucuuucaaaguauaauugaaguucucauucuugaagcauuuucugaauaaucaagugcuagaacuugagcauuuuuuagcuuuuacuuuuugucagaacauuguaguuggugguguagagacaguucuaucuugaugcuucagguucucauuucuacuugagggaagcucacaauuuucaggaaucacggaggauggcauuugagcccgccuggcggucugagcccaccuggagauccccauccuuucaauggggaaauguauuugagcuauuccccaagcuaaugcucagguaggagauacaggcaggaaaagaugucauggaagauauuuuaaaggaaugggaguauacgccuagcuuagaauacaauaugugaaagcauauuguauugugguucuuuggugcuggauaucucaggaguggaggaauugaaggauuguguuuucauuuuuacacuuuuucucuucugcucuucugauuuuucaaccaugaacaugguuauguguauggucugguuugggggaaguauauaucagaaaaaauaaaacaagaaaggaaguuacucugguuaccaugcaauuucguauuuaaaugacaagguuuugcauuuuggauauuucaugucagccgugucuccucagcuaaguucuagucacuuagaaguuuggugucacugaauuauaauuuuggugcuucccauguuuuauauuuacacuagacuacaugcuauauggacaaugugcaaucaguuaauaucugaaugaaugaauugaccaacuuuugagaacagaguuugacauaaauuuggugguuuuugguucauugugcuuuaauugaaggagaaguagacauuguacuucacauuaggcuacucuuuagauaagcuuuccauuacauggcaugugucuuacuuucuuacuugauaauggcucuguuucugaaauuauauaaacagauuuuuacuguuuuuaaacuuuacaacuuaauauuagacuguaaauuauuuacuuauuuauuggaaacaaacuuuuagauacagaaauuggucuuuuaagacaacaacaaaaaauaccuaguuuuuaaucuggcuccugucuuucaugacuaagucugacugaucuuucuuguuauaugaugcuuuauaagauugauucuguauccggguuaccaacgcuuccuguaacagaagaaaaacauucagauccuuauagugcugagucaggggaaauuauuacauacaacaaaggaaaagucuuugauaggaaauauugcuucugguaggaaauuaaguacagaguacaaggaucuaaaugucugucauauaaacaaugggcaaucuuauuaggcaauuuuggacaccuauuacguggcuuuauuuauuuauuaauaguaggcuuuucucaucaugguucauggggauuuguaagguaacgauacccuggacagccuuccaagauguuuugauguuggcagcaaugcauuacuggggcaggggcaggggaggagguagaaagugugauaacucugcaucacuccuucuucuuuguucucauuuauaacaccuaaggcauuggaauuccccagaguaagaauucuagugaaaagggaagcaaauaaaauacaucugacaguugggauccuuggguuuauacaugugcugacuaauuacauaugaaaugagauauccccuuaaauuaaaacuauuugaagauaccacuucaaauauauguaauagaugauuuacacuucuuaucauggcuuucaauagcaagaauuucucuugcaguaggauaauuaacuagaaauauaaagaaauguuucaaaaguauaauaauguagaagaaaaauagaaaaauuugauuuuggaagaaaucuuccuccauuauuaugaagauagcugcaguuugguuuuuuuuuuuuuuuuuuuuuuuuuuuuuuuuuuugggacggucuugcugugucgcucuggcuauggugugguggcaugaacacagcucacugcagccuguacuuacuagguugagccauccuccugccucagucuccaaguaggcucccaaguaggugggacuacagguacaugccacuaugccuggcugauuuuuaaauuuuuuguagagacagggucucgccauguugccuaggcuggucuugaacuccugggcucaggcauuucuccugccuuggccucccaaagcgucaagaucacaggcaugagucaccacacccagcugauagcugcaguuuugugugugagaguugaucuucuugccuuuacugugacaaaacaucuuuauggaaagacaaacaguauucguuacguuuauuuuaccuguguauucaagaauguuuauuuuuuucauaagcuacaaaaccagauuagaaaaguaacuuguauuuccuaaaaggaggcauauuuuaggagcuauaugaacugggcauuuuuaauuuuuuuucauuacuuuggggaauauuucaggaucucaucagcauucauuacaugggaggacaggggauuaaaaaaacaaaauugauuguuaaugaauuuuuuuuuuuuuguauuuaggaagaagaaagacuguaacuuaaaaagaauuguggcaaauuauauauguuaaauauucuggucuagaaaugugguauagagguucccuagaagcuucuguuccacugugguuaaaauguuuucucaccuucuugaacugucuuuguaggugaugucaugaaaugucccaagagaacguuguauaaaacuuccuuugaccuuucuggacucagggcugagcuccuuagaccuacaguuucuuguuaaaaucgaguagguuguguuugaaaaauaaaguuuauuuguaaaauuauuucaguuuauauuuuauguauaaucaucucucuuacaaauauaugacucaaggaaagauaguauuuugcccuagggucaagagugaaauuauuuaaacuuauuagugcauauuuauuucuuuucuauuuuaugcuaaaaaaauguguggaacuaaaauuugaaaagauacuuauuuuguuaguuuagaaaauguuuaguauuucauauaaucuuaacuuucaaguauuuuggcgucuaucuuaauauuuucuccuuuaagaaaagacaaaaauuaaaaaucuuauucuaacuuaguuuaguccacucagugaaacagcauuuaauauuuaaugaaaauuguuuugucguuuccuuugacaucuguauuaaagauugcuaauugccuccaaaauccauuuugucccuuuccuaucauuauauauuuccccauuguuauccauccauaguaaagauagcauuuccuggguucacauguugcugauguggcccugugagcaaguuuugaugaauuggaugugaguagaagugagcugugcagcuucuagaucaugcccuuaaagggaagccacaugcccgcucauuccccuuuuuccugcucccugcuggcuagaaugugaacaggguuaugagucaucucaaccaugugaaggagggugauggaacagggaugggagaaggagccuaaguccuugacuucuccauagacuagagcugcuuugcuuaggcgagaaggaaauaaacaucagcaucagauaguauuauucugucacacuuagccaaaacuguguauaaaauacauuaccaugcugacagaauucaccauuucugcuguguuuuuuugagguuuaaguuucaaauuugcauaauaugugaaggcauuuucaugugaaauaaaacauuauuaacuauaucuuguuuucagagcaaccacuggauucaugcuaauacugcuuuuauauuacaguuauucaguauuaaaccauuuugugacuaucuguaacuguuagauguaugacccauuugaggcguaaacagagugcugucucuugauaaucuaaauuuccugucuuaaauuuuugugucugcuuugccucccuuucuuugucuuccucccucaugucuuucccuccccuuucugccuuuggcuaaugucugggccagugcugguaaagugcucccuggccaguccaugggaguuuaaggaccuuaacagagaccagguuccuggcguuacuucugaacacacacacacacacauacacacugguaaaauucaguuacuugcuuggggaguuuaugaguuuauauuguaauggauggaaaaaugcccugugcuuugcaaccuuuuagacuaaguaauaacacuuacaagaaauugugaguguuaugggaaccaacuucugugugggagauggguacgagggaaaaaaaaaguuucauaaugaugaaugagaaauuuucagaaagcauuguuugguuugucauuuucaguccagaagguuacuuacgucauuuacucuggggauggaauauagcuucacugaaugacagcauuugguuccaaguuauuuaguuauguuucauuguguugaaauacccuaccuuugccagaaucguuguaaacuaugugugaagcucuagguggggaaaaauugaaaggagcgccauauuauauuacaggaacaauucauguccuacucuugguuuccuuucaaagcccuguauuuguggcugugcuaauaaauuccaucacauucauuaugcauagcuguaaguguauguaaauaccacgcaucuugcauuuugaagaaaaccagggagugaacacacauagucuuucuugccugggauucauuuauuuuuuaaaauucauuuuauauaugaaugagaaaguugagggaacauuuccuuucauaccaacauagaaaauccucuaauaccacauccccugucuccugguccugggagcaguaaugggauuuucugggugcauuugcaucauguguaucauugcuuuucuguuuauguucagaagccuuuucugccaaggcuuccacaaucuucugaccccagcagcagguacauccuuguagaugucaguguaagucuuuauauuaugaagaguauuugagagaaugguacaagaggaugaaagggugaauggaaguugggggcaaaauaauggagggcuaaagaauauagauuugaucuuacaaaagcugucgagaaaccauugugcauucuuaagcagugaaguggcaccauuuaaaaugcacaugaaugauuagucuaauauaguuugucugacggcaaagacuggagaguggaguaagaaauuuguuggauuuuauaccaaaaagcuaaaguguuucuaggauagcaugucuuguuuaauauuuuaucuuuuuucaaaauggagaucauguuuuauacugccuuguuauaugguuuuauuacuucuuuaugaaugacuuaauagagcauuuuguguaugugguaaauauuuguauguucguuucucugaucaagaagcuaauggauuauuuugaaguaucuacuauuuuguagcacuacaugaguuguacaauuaacuugaguccccauaaacaaaauuggggacaugcuggauccaugucaugcugucaugcuggagccgugucaugcuggagccauuucaaacuccagugugcuugacguuaaauuucaaaagucaaggaaauuguuguuaaggagcuuaguugaagcuaucuuuucaagaauuuaaucuacuaauucauuuuguuuaauuuuuaggaauuuguaugucauuaaaauacucucaaaaaugcuguucugauuugaaaugaaauacgaguauaaaaauuggggucgaucuuugguacauuguuuauuguacuggaaaaugaaugcuuaacauuagucugugauagugauaucaugcuauuuuguauucaagccuuuauauguuuucaucaggaagagucaggcaaaagcagacaaaaauuucaacuaauggcaaagcacuuuguaccuuuaaaacaauuuaaugaggaguuguuuuuacucuaaaagcugaggcaagagauacauggcaguaaaaucugcuauuguuaaucuacuguagucucaaauuuuuauucauuaauuuauuuauucaucaguuccuucagugauauuuguugagcgccuacucuguccuggcacugcuguagucacagaggacaauuaugaguuacugagccugacuccucuccuauauggauuagagagugaacauaaaauaucaggaaaacuaaacaguuuuuacauuuugcuuugaauguuuuuuuacuuuccucuccgcuuccuuuccccccuucucuucuuucucuuuccaucccagguccuccuuuuucucacuaucugagagucggaggaaacaaggagaugggaauuuggaguggaagauagguuuaaggagauaguuaucccacucugguucuaaauucuugcacaauaucugauauggcauuagcugaagaaccaugacaugauugauuucuuuuuuucaucccacuaguauauguuacaggcucucagugugccaaccuuguuugagacacaaaggauuuaguagugaauaaccuagaugcaguccucauggagcagacgcugugauggagaagguagaccacaaggaaaucagcauauacaaacaugcuauaauuucaguuagugauaaauccuauaaagaggaauaaucuaggauaggaggagagaaaaggagagaugccuuuauaguaacgcucuagguacucuucugauuacacucuaggauuguguauauggcucucucauguccuaacacuuuugcaaagaauggggauauguuucuuuuaguaggucuaagucuaaacaagagaagguggaaugaugaggucuccuucucaguggcuggagugaaguggaaggguauaggaggcuccccuuucgugaaugcccuugcugucucaucagggacaccagaugaggcugagcuguuagcuucccucuccaaauugucauuucugccaccuugaaucccacaguuggcauaaaaaucguauuuuaagauguuauuacuauaauuuaguugugaauaggaauggguuaugugauaggcaucagggaagggcacaaagaagaaaggggcccagaguggggagauugcaauucgcuaaagucaggcugacucuacuccacagcccuccugaccuaaggcuguguuuaugauauucaguccucuuacgugacagaaauaugugguacuugguuuagguuccaggugcauauuuguuaacuaaaguugccuugcuuggguggcaaaaaacuagccuguaguccauuuuacaagcauaagcggugaagguguuuaagauuugacuuugcauccaugguaacagucuccaccaauaguacauguuacagagcccuuuaggccuacaauuguacuguaaagacagacuguagugacuugucuuucuuaucaggaccccacccuacauggauccuugaagagugagcaggacugcagaaggagcucagguggauuugacagcuuauaaaccuggaguuuggggaaugcugaggcuucaggaagaaaacaccaguaagcuuaaguuugggauucccacuacucaggaggacugaugauggggaccaaaguuaggaaagcagaggaguuuuggagaaccuaugaguucaaaagggugaaguaggaaaggugagaaugugagggagaaaugucagaguuuauuuggauucuuuuaaagaauaaaauagaacacaguggggagauucagagucagcuugguaggguugaguuugagggccuaagaaggaagagagugauggagacauuauaagaauggaagcucaagagaaccauguaggugcuuuguacccugguauggagaauuucugggugcagaguucauggacccuggcgaguaagagcucaacacaagagauuaguugcuacuugaaauaaacaugauaauuguggcccagacagaaaagccuccucuuuuucaaaggucaagauugcugagguacaugacucagaccuugcauagcaguaggaagaguaaccagcagcaaagcaauaaguuguuuaucaaagggugcuggugacucagucaggaggauuuggaauagaaugauugauuuggaaguagguuaagcuaaccaaauaauaugaaucuccuauguguuucuuaaacugauuauuuugaacucaagauucucuucuaguguugugaaaauaguuugugauaugaaaauguauaugcucaauugcugugaccacuaagggagacagguauagcaagagaaauaaugguucagucuggaggggaagccaucccuucucgcccuuccccuacguuguguggauggaaggucuccaagagaagcaucuaugagauuaggccagggagccuucuguuucagggccaccccauucugugugguuuuauuugucagagacgcugauccuaacagaaacagcuguuucagugaaguucaagcuugccaucuauuuucaguagaagcaggaagaaugucagagacaauguuugcauuuuagggccuuuuuauaggagccuaagauaaagcuguuuaaaccuucuguccucugucauuuaacuuaucaaauucaagcagagccuuuuaauuucaacacacuuaacuucuagggaugaauagggcauugaacggauucuauaaacaaguacuuuucugagcgauaaacaggaacaaaagcagcacaaagauagcaugucaacaagguaggguguauugugagaagggcaaggcuugagagccuaaucuaugcuauucuggggaagcaacuauguuuguuuguuugauuuaaggagcagugaaguuacagagagcagaaaaugcugauguaccugaaggccauuauucacuucuguagacagugcuacugggugagaagugaauaauauuaguaauauauguucauuaauuaaauguagcuuuuaaaagaaaacacaagauggaaaagugaaacaaaauggauagaguuguuuggguacuaagaguaguagaguagauugaagaccauuuaaaugggaggcagauuuucccaugcauaucuaaaaagguccuaguguuaucccuucacuccauuuuagauuuguuuguuuaguuuggcccugaguaugcuagaacagauaauaaccucccagcaaauguaacugagugggaacauuauuuuaguucacuuucaaaagaagagggagauccaauucauaauacccaaaauagagaguaccgguuaguuccagaauugaccagccauggaaagacauagaaacuuugccuguuagaaugcucauccugagaauaggaccugagcuuuuagagguguuagaugacuagaaggccuuagaaccauuaaggcauuuuauuucuuucacauucagccagcuuuccuugagcagcuuuucuaugccucuugcauuuauaaauacuuaaacauguuaucccauucaaaaguguaauuuguugauacauugguucaacacugccauuguauaugugugugugugcaccauauauguucauauuauaguugcagaugaauaaaagauaaugauaaauaauaauauaaguuauuuauaauagugucaauugguuaaauaacuuauacauccauaugaugaaacauuuccauuuuuaaauauaaugagccacauuuauaugugcugguauggaacaagcaaaaaaaauguuaagaugcagaaagauguguuuaguaucauaacauugaggcaagcagagauacacacagaugcagacuucacaucucuguucauuuauauuugaacuaugagaagaagugagaagggaugaaaucaugaccuugaaaauaagaagcuguuucuuccucugagguaggagggaaaagaaguuggguaaagauaugaaauggugaaacauuaguugaggaagaaaggacaaaucagugagcaaaaauccuguuuuuguuuuuauaaacauuucaaucccgggcaaucuugagaaagccagggucauagguuggaugauugcaguacuuucuuguguguucaaagaggaaaguccaaaugcgcauuuggcacuggcacuucugaaaagcccugaccuuuguaaucagguucuuuuucuaccugcccugcaaagauuucuuuuuguuuuguuuuggcaguaguguuuaugugaaccuguacccuuacugugaaauuuuaacuuacuguauagacugguuugugugaugggcuccuaccuauuuuaggacuagaaaggacugauuagaucauuugcucuggcaguuggcuuuuaggaaggugaauguguaagccuuugaacuguucggcauugaaagauuuauggaucucuuaggcaguuauaucaccauuugaauaguaggugauagauagauagauagauagauagauagauauagauauagauaucugaucuuuaaaggaccaggauuguagaauaauguuagcuagguauguaaauuauguuguguuuggauguauuuuguuuuuggauguaagggacagaacaaguacauggaucaauuuucuucauccuauaaauuugguaaaacagaaacaauaugauguuuauuucuuauuuuguauuuguauaaaaaauguaaguguuggggaucauugucucuuaugguaccucacaacccaucacuuuauauccuaccuucaaugauauagguaaaagguauauuuuuuaaaccagauuuuacaaauuuccauuaaaauguugaauuuuuaguuuuuauaaaacuaaaauuuugaguaaagaacaaaaaggaacagaaaauagugaagaaacagaaauagagaacgaacuuccuaggacuuuuuaagcaaaaugaauauucaggcuaauaguucuauuuauuuccuagaaguaguacacagucuaguuuuucuuuuauacauuuucuugauuuuaggguauaaaauuaaaaaaaauucugaagaauuucuuucugugcucuuugagguuuugcauuuuuaucugguguuuguguaaaauuaauucaacuuaauuaugggagggguuuaaaacaaaugauacucuuucuaagcugggacaaguuauuuuccuuagucacuauaggaacaaagaaggaaugaguggcagaguagaauugcuuuuguugagcaugagcucugauaucuuggcuguacuguucauuuacacauuacaaauauuuucuuagauucuaaguaaauguuacccccugcccccgaaccuugcuucuacuauuuuaaauucuuucugcuagcugcuucuuucugaacccuaacacagggguccuuaaccccugggccacagaccgauaccgauaucaggaacuggacguacagcaugaagcaaguggugggcgaaugaaggcagcuucaucuguauugacagcugcccccacauugcucacaugaccaccugggcuccgccuccugucagcucagugguggcauuagauucucauaggagugugaacccuauugugaacugugcaugugagggaucuagguugugcuguccuuaagagaaucuagugccugaugaucugucacugugucccaucacccccagaugggaccaucuaguuucaggaaaacaaguucaggguucccacugauucuacauuaugguaaguuguauaauuauuucauuauauauuacaauguaauaauaauagaaaucaagugcacaauaaauguagugcacuuggaucauccugaaaccauccccaugccccugguccauggaaaaauugucuuccaugaaaccggucucuggugccaaaauaguuggggacugcugcccuaacacauguaggguaagugggauuucacauacagguauaaagauaacauuuucauuuuaggaauauauuuuuccauauaauaauaggaaaauuguguaucaaugaaguuuuggaaugguuugagacucucuauguaagacagugaguccaacugaaaggaagcaugguguccguugaaugaauuuugcuucuuaucaauuccugcaaaguucugaugauaucacauuuguagaaaugagagcaaagauacaaacaaacaaaacaaaacaacaaaauacuacuugucacuuuugaggagaaauugaauuguuucuauacaucuuacuuucccuucauuaugguuuuucuuucuuucuuuuuuuuuuuuugagagguggagucuugcucuguugcccaggcuggaguucaguggcacaaucucagcucacugcaacuuccuccuccuggguucaagugauucuccugccucagccuccugaguagcugagacuauaggcaugugccaccacgccuggcuaauuuucgcauuuuuauuggagacagggucuuacaguguuggccaggcuggucucgaacuccuugccucaggggauccaccccccuuggccucccaaagugcugggauuacaggcgugagccacugcacccggccucauuauguguuuugaugaaucuguuaauuuaugcuccaacuuaaauauucauauuuacuuuucucuucaaguguuuucaccauuguugacuauauuuaacugauauaugaagcuagauuuaaguuauaucuaacauuuugcaaaguaugcuugaagcagaauggaguuauuguauaacuauacauaagcagaaguucuauuugcagauucacagaugcaauuaugaaguuaagucagggauaguugaguugaaacaaacuuuuucacuauaguuuugcuuccucauguagccauuuuauuuuuuuuuacaaauuaaucuaaaucucuagacuuucauuuuucuauauccuauauucauaaauuacuaaagguuuuaaaguaauagaauagguuaaaauagcugcauacucuucuuagaauuuugcauaaaacuaaucuucacaaucuauuuuucugaacaucuguaugcuuuucguauuuaauuuauuguuuaaagaauuuuugcgguuucucuuguguuuagaguuacguaaacagcauuugcauuagauucagugguaauauacaguugcauuauaauauacuuacuauaaaaaguaaaaauuauucaugauuuuuuugcugguaaguuugaguuuuuaacguaaauuaaguugccuuaauuucauaaauuucagugcaauuucuuagcauuuuuauugaagugaagaagcuauguagucauugugccuuauuuuuaaauugcucugguacuuucaguagggaauauuauuaacaugaaccccauuucauuacuuuuuaaauguccuucuaguugcccuaaauguauuguaaguaccuggagauuuuaugucucaagccuucuuuuuaucaguguggauguauaaucuccauaaaugucaauugguaaugaugaugagccauuaaaauuaauagcuuauuugcuaaauuugaugcuuuuaagucuaggauucgauuuuacaugauuagaccuauaaauacauuuuauuauuacaaauuuauuuguguccauucuuuggaauaaucauucugagaaguuucuuugggauaaguuuucauuaauuuugaugaaauuugugguguuuuugaaacagccacuuuaauauuauugugacauauuuaaaggaaagcacauggauuucuggaaaccagaauuuuaaacaagauaauauaauuacaucuuuugggaaaaaaauuguuuauuuucacuaguguguuuuauuccaggaagcaaguuucaucaucaugauuuaaaauaauaaauugaaagacauaaaacuuaauaaugcaaauuagcuuuuguugguugugaugauguacuuugcuuuacguguauuuauauaacaccucggauacccaaaauauuuauuaaauaccagcaucuuucucacauuaaccugaaaacuuacaguagucacuuuucugcuugccuuuauugccagacuaguggcauacacaacugucuuuucuuacaacuaaugccuucaguuauuucuuagauaugagcuuugguauguuacaguuuucagaacuugcucaaguaaggccucauucggccucauuguucaacucaguggcuugggcucuguugcaucucccgauaguuuuuuagaauauucacuacucuaguuuucagugacaucgucugucuugguucuucugaacuacuuaaugugcauuccucuuguaggguucucauccuccuaaaugccgguauucuccaaggcugcuucuuuuaguguccucaagcuucaagucacccauggcuacucauccuuuucuucuauuuaccaucuucaguuagucccaaguccuagaaucuccucucccuuaaaaauaaucuuugcugcuccuccuuguccccuguucuugcaacuguguuauuucauccuucccuuacucaugauaagauuacugauaauggcuggccuucuaauaucuugcuccccaaugugcuaaagcuagagaagucuuuaacacuuuaauccucuucugggcauuugcuuuucuugcaaaagauuaauuaucuucuuuuuaaucugguuuauuuuacauaugccgucuuauuucucacuacuacggacuugucuucuucucauuuucaugccuucauaauucuaaaaacaugucaugcuaauucucccacucaucuggaauccuacacacccaguuccugucccagcucuuccauaagccuuuagaccuugcugauuucuccuuuugcugaaccugucuucacuuuuaauagcaugcauacugauguauauauaucaaaaacccuuuuuuuuuuaaacauuacuuagaauugugguggaguugucacuaaagauuaaaaguagguuccauuaauaagagaccauauacuuuuugguauccaccgcagcagugcugggcccauauuuuggugcucaguaaaguugaugauugauuuaauugauuaaauaggugauacuucaacuuucaaauagagacuuuguuuuuaaaaaguacuuagcuuuauauuaguugaacagcuguguacaugaacauguaaaguagaacuuacuuuaugcacuauuuacuccuguaguucuaaaaauacugcauuuugcuucucuuuuuuuguaaacuacuuucuggagugcuuuuauuauuuaaaaauguacuucuuaucauagggauuagugagaaguauuuaugagaguucuguuaauguaccuguaaccuuagguauacccaggagcuuaacauugcaaaaaucaagcuuuugaagaaagaauagcuuaagugcuaaauuugaaauugccugcuuaguaguuuucuaaaugguuuagaaaaaauuaguugacacguuuguuucaagugauuuuggagcagccaauuuguucguuuuuuaaaauuaauaagggcagucaauuuacuaauuuuuacuaauuucaugguuuugcaaagagaaaaacaagaucagaugacaucaugcaauuuuuuuuuucuuuuuuaaaaaauauacuaaguucugggauacauguucagaaugugcagguuuguuacauagguaugcaugugccaugaugguuaacugcacccaucaacccaucaucuacauuagauauuucuccuaaugcuaucccuccccuugcccccuaccucccgacaggccccagugugugauguuccccucccugugcccauauguucucauuguucaacucccacuuaugagcgagaacaugcgguauuugguuuuuugcuuuucucuuccuguguuaguuugcugagaaugaugguuuccagcuucacccaugucccugcaaaggacaugaacucauucuuuuuuauggcugcauaguauuccaugguguauaugugccacauuuucuuuaucuagucuaacauugaugggcauuuggguugguuccaagucuuugccauugugaauagugcugcaauaaacaugugugcaugugucuuuauaguagaaugauuuauaauccuuuggguauauacccaguaaugggauuauggggucaaaugguauuucugguucuauauccuugaggaaucgccacacugucuuccacaauggcugaacuaauucacacucccaccaacaguguguaagcauuccuauuuuuccacaucgucuccagcaucuguuuuuuccugacuuuuuagugaucaccauucuaacuggcgugagaugguaugucauugugguuuugauuugcauuucucuaauggccagugauacaucaugaaauuucuuucaguuucauuggaacugauagaaauugucauugauauuccauuguaauauaaagccauuaacagccuuucuuccuguguuuuuugcuaaucauccuuugaacagaacggaugcuuuugucuuuccuuucacuacuacauucuaaaagaacaaagauauuuuuaucauucauucaauaaagaguagguaccuacagguguacaaagcauuuuuuguagauuuaaaucucaaucugcacugaaggaguucuuaaauuagggcaauaauguagguuuacaaaagacaguaugauuuugcaugaaaaugcacugggaagugcuuucauagauguauaaacacauucugaagagagagaauuucuuaugccugacagggcuaauuacagauaauuuugugaaggagcuagcauuugaauucaucuucggaagcaguugggauauuaguggcuaaggauggaaguggagagacuguacugugugagacacaggggcaggagauacaggguguguggcauuagagggugggggguggguacaaaauuuggcucuggagauaagugggaccauaucugggaggugacugaaucuuagacuauggauuuucuucucauauucauuggacaugagggauaauugaagagaauuuucaugaccagagguguguuuaugaaaauuugucagcacuguugaguauaaauuggagcaucaugaaauugguaaugaggacgguccuaaacaagacguuguaguaguauaaguaagaaauaauugaagccuaaacugaagauaauggcaguaggaauggcaguaggcaaaagaaggaauggacacaagagugauuucaagagacucagcauaacuugcugccauauucauuuauauuuccaugaauccuuuuugucauuccuuaaguacauauuguacauguacgcuauuuuccuucaauauauucagugguggaaguuaauugauuaaacaauuuuaguuuuguagcaucaaagucuguuuacucuugugacaaauaacugaguucagguuuguuacagaauuuaaaagaguuaaauauaccauuugcauaaacaaaacaaaagggaaucaacagucucaguaauacugauuaaugauuuagguauauugauaaauccucuuaucuggguucuauguuguuaguuuuauuuuccgucacauuuuguuuuucuuaucucugaugcacguauaaacauaaagcacacaaaagcuuuaguugggagaauuuaauucuuucugaaauucuauucggauuuugagucucacucuuugauuucucaaguucugagucaugaguguuugggcauaaaaaccugaugaucuuuuuuuaaauuuucauuagaaagaauuaaacaagcaaacaaucagaauugcuuaauugaacuacauuugaaaccaaauuauagagguaguuauaauuuuaucaacuuuuucuguccuacgaucuuucuuauuagacaagucugauaggcuuuguaagcaguauauaugacagguuuucauugaaaugcugccaguguugaagaggagaaaagcugauuuuccagaagugagaaagacaaggaaacagucacaauuuuuuaagauuaguugaggaauaccacacuuggcuucuuguuauugaaguuuuuugguguaggucuaacaauaaaaaucuuguaauauugguuccauauguauagcugcuuacuuguuucauguaauacuuucaucacaaaaaauauauaucuaauauuucugugauaaauuauaaauacaguauugguuuugguccuuggaggaauaaccuuacaaaccuuuaaagacuuuuaauuuuaauuuuuauuuucuuuccagcuuuauugaaguauaauugacaacugaaagacuaguugguaauugaaauuaggacucauuuuuauagucagacaauguuaauauuuaggaggagaaaugaugauuuauuaauaacuuuacucaaaauaccauugcauaaaaauuauacauauaauaaagugauuaaggggcacccacuuuuuauuuacuaauaacuuagaauauucaguaacuauuguuuguaaaaugaauuuucuuuuauccccaugucugucauucuccauucuuaaaauauuuuccucugugaaacaagccagcagggauaagccccauguuuuguuugaucuaguuaauuugacuuccuucuguuugcaauguguuauuauaaggugaaauauuuucuggaguuguuucuuaaucauuuuauuacucuuccuucuuguagggaaauggcgugccauuguuuccuucuuuuguuugcuaaguuaccugaauuuuaucuaagccauaguuuagguggguuagcuuuaauaguauuugaaauacugcuuuugaauuaacauacugcuuguuuacuuuauccuuuaaaauguacuuuaccauuuaauucuuuuaguagcacugagacauaaauagggcugaggaugauuuuauuuacauuuccuagauaagaaaauugauagacuaucaguuuaaguaacggccuaagaugacuaaguugaaaugagaaauuaggacugacauuaagauauugauuuuauuucaaacagcauucaagaagaagguuaguaguuauuuuagauaaaauuaauauagaaauaggaagcacaaagaauaagcaccccacauuucugauagauaccacaucuaaauaucaccuauaagaucuuccugagucuagcccuucuuacuuuuguaucuucaucucacaggguuucccuuguuucuuugcugcauccaugcugacucuuuuuuccagucccuuugcaauugcucugccuccuuuuaaaacaaaacuuuugcccuugcucauuucuacuuggagcugucauuucuuccucuuagcaucaauaacuccauuuugcuguuuagaucguaucuuccucagaaaagauguuccagacuucacuaagucaaauuccuuugcauagcucuuggcacaguugugguguuacuuuugugugcauguuaguuuuauuccuuccuuuaucccacugaucugaguuuacagaucagugggaugugacuggucuguuuuuauucauucuugugcccuaggugacuaauagcauagccauugagacauaguaggugcucaguaaauauuuguuggaugaguguuuagguuuaagaaaguaucuuugcaaacauuugcagcauuaucuuuuaauauuuauagcuagccagucauauaugccaauuucugcaucuaccuauuuguccucuuuaacuguauaugccauuagcagcaaagcaguaauauggauauuacuggcagguuuaagucauugacagguaaguuaaaacaacaaacaaacaagaagggaagggagaccaaguauuuaaaaaaacaaaacaaaaaaaaaggaaauggggccaggugcgguggcucaugccuguaauccuagcacuuugggagggcaagguggcagaucaccugagaucaggaguucaagaccagccuggucaacauggugaaaccucgucucuacuaaaaauacaaaaauuagccaguggcaggcgccuguaaucccagcuacuugggaggcugaggcagaagaaucacuugaaccugggagguggagguugcugugagccggguucgugccguugcacuccagcccggagaacaagagugaaacuccgucucaaaaaaaaaaaaggaaguaauuuucguaggguuguagaauuacagaacuugauggaauacugggguuuaucuagggaaaucugucugucucucuuuuaaagcuuuuuauuuugaaacuuuacccaguuugccucaguguuaacgucuguagcacaauaucaauaguaggaaauugacauuacugucauccacagagcucauucauauuucucuaguuaugcaugcauugauuugagaguguauguguguguguaggccagucauuuuuaagauaauagaaguuuauaaacuuguuuccgugacuuacucaaagccaccaggccaugaggugaaauaauugguuuuuaaacucuauauugcugucugcccaacagccaugaauucugucauaaaauucuacagauaucagggauuguucauuagcauuagugccagauuuagacuaauccuacaauauugaaagauacuaacuauaccuuuuagcuaacuguguuuauaaugacucaaaaaauuuaguucuaucaacuuggaucuaugucaaaaauuagaauuaaaauccuacuuuuguuuuugcccagcaggacuucucuacuauucagggaaaggccuaauuaagguuuccugaaaaauacucuuuaaucacuuggauuagaauaaaaaagaaaugcuuuuaaucacauacauaucugcuaaugcuuuucuucuaguaucuaauggcuuugauaauaaaaaguaguaauaaaacuggagaacuaauggauuuuaaacauguuucuauacuguacauauuauaaaauauguauacuuagugcauuaaguaguaucuuaaacuuauaccuaugaaguacuuacggucuaaaauugaucaggaggcaaccuuacuuaguauuuccuggaaguagcaggcauuuacuccuaacaagaaguacaaagaaauuaauauagaguuugauucagcguuggagucugauuuuuaaaaaucaaacuaauuucugucuugcaaauaauuauauguaauauuuccuacuuuuuauaauuauagaaacaugacagaacuauaaauuauuuucugaaucuauggaauauuauugauuuggucaguaaguuaucuaucauuggacauaaacagaagaguauauagguuuccuuugauuuuuuauuuugagguuuagaauuaaagucuuaugaaguuuagcuauuucuucgcuaaaugcuuuaaguuauacccgugcaaaaaccucugauuuguuuuuguaauuucacuaaaauaggcuaguuggugagcugugguguaugucuuaggaauuuaaaauaaaaauaaauauuaaacugcuuaagugaaucugguucacacacacaaaaaauccagguauuuuaauuuuuuaccaggacauuuuuuuaaaaagauuuugggccaagaaacuuauuuuaguaacagcaugcuauaguaaaugcaauuggaaauguaaguaauuaauuuuauugaauaaaauaagagcaaaacauuucccaauagaaaaucucuuugaauuggcacuauuuccagcccaauugauuuuuaaacagguauaaauucauagcagaaccagcuuaacuuaauuuguagagcuccuaucaagcaggucucaggguguacacguucugucuuugguggaaguguuaguuuauauuucaucuugaagccaguggacauuuuaaaguuucuuuuuuucuucugauguuuacaaauauguuucuuuaguaauuuuaggcuugcuaguuugcuaugcuagcuuauauuuuguuauuagggagugcugauucccuguuucuaaaugucccaucuuuuuuucucacugaauuucuucacuucagaaacaugauaaugggacauuaaaaucacauauguaguuuaccauugcuuuauuguuauuauagguauuauuaaacaguguacaugaccuuucccccaucugaucccucgucuguuugagaaaguagauaaccaaccaggauuuguaaaggaaaacaauaagaacaguguuuggcagcuugcuggggcagcuugggguuuauacauauuucuuucucucagacuuugaguuuaugacuccaccaaucauaaaaaagaguaagcauaaagcagaucuuuuaguagauauucugggauuaaaaacaaauccaagaugguaaugagguuauuguuuugcuugugauucuugguagacuguauguauguuuaaaaaauaagucucaaggugcuguuuguagacucaugaguggcuggcucugugaugggagcaucuacugagcugguaguauagccuccugcuaaucaucugccagcuucuaagcugcucaaggaguuaaaugacuguugauacaauuuuuaaggaguggaauuccguucuugucauucagucuauguuaauaaucuccuaugaugaaacucaaguguuggguauguuuguuuccugagcuccucauagacagaauauguguuuauauacauaauacuuuuuaaacuacuucugauguuauuauaacaagguugaguauaauaaaaccaaaguuauguuuuaagauuugcuuuauguguguauuugucugcuucuaucuguuucuccguugcauugguuuauccagauaucuuucuauacauucacugcugugucacuguugcccagaugggugcgugcagguagcugaacucaauaaauaugagcuaagugaaugaaugaauguuccuaaaugguggguuauuuugucuuuugagcagcugacagugauucugaucuuacaaucuaaaagcuacaauuaaguuaaauaauacauaguuuuaggaauuuuucuuaauuuauuuucagugcuccuauuuuugaauauacucuugcauuuuuccuaaagugauauuuaaaaacuguuacaggaaagcauuuuuaucaguuauuucuauaacugguuucuauaaaucaaccaaauaaacaaugaauacuuauuuuuuugaaauauaugcaaugaauaauaccuauuaaugcuauucucuucuucaguguacuuuaaccugaaugcauauuucuguugguggcucaaauagugagauuuaagucauagauuuuguuaucuacaaggaacaguuauuauauguuuaccauuugcaaaacaaaagaaauaugaaauaugacuccugccuucaagaaacuuaagaauauaguuggauaaauauaguguaaugacauaagacagcuuaguauacagcaugaaacuggcauaaaguuuauauuaugaaaacacagaucuuguccugauggaauuucaggugaaugaguacuuggacaacuuaccuguaaaauaaagacuacaaaacaaauacacagacagguccuuagagaaacacauauuacuaaagaugugggacaggaauaguuuaaagaucuuuuauaaguuuuuguauuaagcuaaagauuuuuaaaaauaaauuuucuucuuuaaaguuuguagguauuuuaagaaaacaucauuuuauaugaaaaauggcuuuguagaagguuggaaaguuaacuuaauauuuucuuuuaaaauuuauauggaagauacuuuucaucuugguuuuauaaggcucaguugaagacaaguguuagcacugaagcuuaaauaguuaagcuggccaaacagccaaaggaugaagaauauuuuuuaggaaaaguucugugaacuuagguuccuuauugguggcuuguuuucuaauuuuauaacauagagugguuacauauuuguuaccuacacaaugauaguguaaugacugagcacucacugacgcaucaagggaucccaauucuagucuugauucuauuuccaacuaguuguaucaugcaaguccucugaguuccuuuacuuaucuaauaauucauggaguuacaccacaguaugucuaagguccuuuccagcucuaugcugauauauacgauucuacuucaaaagaaguuauuccgaauaaccuuugcacaaacucacaguauagucuugagaaggaucucaguuuuguuuugcuuuuuuuucuuuaaagcaaauaaggacuuuuaaaaauaaauucucauuauguuuugugccauauauaauuacauauauaauuauaaaauguauauaaaaauguaugauuauauccaacuaugaugaaauuauguuuuuccauuaaauuauauguguuucucugaacauaggauuuuacuucacaaauaagacuauguauugaacuguuaaaagggcucacuggacacauaccagauucucaggauucuuuucaagauuauauugcuaguuagugcaauaauaucacugguaaugcagaauaucucuaccuacgaggucuggacauguugcccaaccuguucacgaacgccugggcucaggugauccucccaucuuggccuccagaaaugcugggauuacaggugugagucacuguguccggccauaucacaguuuuuugaggaaaaguagaaucuuuaagaaaauaagugacuaaucuuucucaaaaauuuaaucugguaaaauuuauuuaggugacauuugaauguauuagcagaaauuuacuugaaaaguuaaaguuuccuuucauauaaugguauucuauuggauguauguaugauguacuguucaacguacuaauugacuuaaauguuuaguuugguguuacucaaaauuaacuuauugcuauaguuagauagcggugagugggccuaaaagagcuuguucgugucccugugcagcucaauaacaguagucuagcaauucauaugguuccauuuuuaguuuuguaacaaaaaugaauugcuuaaaaaauuuuuuuaaguuuuggaagcaacaaugaauguuuuacacaaaucagccucaauuaaauuucuuuaauucugguaaauuaagauuuaguuuucuaaguauuccauauuauugaccaguauuuuaacaguuuucggauauuuuugccauaucuccuuuuugugcauuucuauccaucaauuugccacugaaaauuaaaaguaaccuguugcaggguaguauuucaaugaaaaaaaauuaaaaguaacuugguaugacaugccuacuucccauggcaugucuguguucuuugaguugguuuucagccagcuauuuggcaaagcuuacugggggguuaugacucaucauaucuuugugaccuuuaaaaagaauauccacuugcuguaacagauagggaucucacacaauuucuguuuuuuuuuuuuuuuugagguuuuaguauuaggucacaaacccauauaaauaguuaccacuucuauuuuuguuuugaaguggaguuuuaugaauauuugagaauauagacagcuucccauugaggauuguauuccucguccagagguuucauuucagugguaaauacgguuaaguuuguuacaagguauuuacaugaguauguacagaaguguauucauuuaugcauuaauucaacacauacuauauguaaugacgucuuaaagugagaauuaaaaaucucucugaauuucugaguuuuuaaacccagaaucaauuucauucacauuguucuuucuugagcaaaaugucauuuuaaagugagaauuaaaaaucccacugaauuucugaguuuuuaaacccagaaucaauuucauucaucuuguucuuucuuuagcaaacuuuucuucuguagaguuccccauauguagaccaugggaggaauaggcacugugggaacauagugguuuaugugacuggcuuccuauccuuaagaguaauuuuuuucuguuuuuuuuuuuuuucuuucccuuuucucccucccucucuuucauucuuucauucuuauuucuuaagaaucaugcaguggagauacgugaauauaauucaagguaauaaaagaauuaauguccuacuacugaugguggcaaagugguaugcggcuucagagaauagagugauuaauuccaauuucggggacuggagauaguuucacuaggagaugaauggauuuugauaaacacccaugugagggaaggcucuugcagccugaagccguaagacauguaaaggguuuuuaaugaaccuggcaguugagggaauaaaauauaguaguauaagaauuugagucaucggcugggugggguggcucaugccuguaaucccagcacuuugcgaggccaaggcaggcagauugcuugaggcuagcaguuugagaccagccugggcaacauggcaaaaccccgucucuacuaaacauacaaaaaauuagcugagugugauggcacaugccuguaaucccaacuauuugggaagcugaggcacaggaaucgcuugaaccuggaaggcagagguugcagugagcugagaucaugccacugggcaucccagccugggugacagggugagacucccucucaaaaaaaaaaaaaaaaaauugggggccauauguuuugaggagagauguaauaagaaauguggcugggauuuucucguuuggccuggagagaaugaaugucaugcucagaaaugcgaacuuuauaaaaauuaggguaccauuggcauuuauuucaggagguaaaugaagugaucugaccugugcuuuagaaagaugaugguggcagaguauggaaaauguguuaaaggugauagauuggaagcaguggaaccaauagguggccaugggcuauuguuuggauaagugaugguaagggccugaccucucaaacagcaacuacuguggugguggguauggaaguuaccaugcagugaagaagaggaacugauaaauauaauguugcuuacuuuuuuuagaugguugguauggaggguauuagagaugggauacucucccacuguggaguaaggauaaaggaaggcuguucuacuauaggggaauauauaaaugaauucaaggauccuuaaagauccuugaaaauaaagaggagguaaaaacuaaagagaaauagaaacaaagaauggauauaacagauguugggagcuggugaacuuuaaggacaacaguauccaacagaaguaucauguaaguacagguaauuuuaaauuaucuaguagcuauguuaauauuaacauaaaaauaagcaaauauaaugaauuuuaacaaucuauuuuauguaaccuaaaauauuuaaaauauuaugucaggauguauucauuauaacaaauucuuaaugagauauuuuacauuuuuuuuuuuuugagacagagucuugcucugucacccaggcuggagugcaguggagcgaucuuggcucacugcaaccuccaccucccagguucaggcgauucucacacccuagccucccuaguagcuaagaucacaggcgccugccaccacgccuggccaguuuuuuuguauuuuugguagagacgguguuucaccaucuugcccagguuggucuugaacuccuggccuugugauccacccgccucagccucccaaagugcugggaccacaggcaugagccaccacgcccggcuuuacauuuuuuuaaacuauuugaaauucaguguguauccgcauuuauagccuauuucaauuuagagcaaccacauuugaagugcagaguagcacacauccugagugaccaccauuugggcauuugagauuuaagaagucaacuuuuuaaaguccucuaugauuuuuauguguauauuaaaaauguugaagcuaggcaguuuaagugugcagucagagugccaugugagaacuaacuucauaaaguuguagccuaagagaaaagcacacagacuccugagugaacagaagaaacuuacucucgacauuacccuaaaaaucacuccuguaauugagugucuuguuauuuucaugaacuguuuccaguugacaguauuauuaagucagcaauguauuuuugaggggaaaauguaacuuaaaaauuauagugaaaagauaagugaccccuucaaguaguauaacaaauuuaaguucauucuauuaucuuuaagaauguguacccggcuuuauuaacuuuguuauauuaaucaacuuccaaauuauuuugauuuucuacuaagaauggacugucuccuuacucccacccccaguuagaauuuuggaacaaauaauuaaaacuauuacuucauagauuucgaggauagagaguggggcucaagugagccacaacucccugugccuuaccugacuuucgacuugagaaugguggaaguuauaaacauugcuuugaguuaggcuucuuuuuacugacuuuugaaucaugaggagguaggugguccacuccaugaaaaugaacucugaacgucuuuaugcuacccuugacacuuugaaaggagccguauuuaauaggaaauagcacuuacggaggagaaucugagacaugcaagccgccauacaaagauaaaucaacaggggcuugaaaaauaaauugcaggccucauaaauucacagccucucuucuaaaauacuaagccuaaagaaauaaguagaaguuccauaauuauucuacaaauuguguauucugaaucucuuggguaauuaucacaacuaaaaauuacguauuacaauaaucacaaccagcaaauuaccugaaauugcuugcucagugaauaucuuucaguaaccaaaauuuguacauaaaaugacuaugcaugagugcuauuuauaaugagcacuuguuaauauuggcuguguaaagacuucuccgauuucucuaauuuaauuuucaucaacacuacggguuuaaauaguaccugcuucaguaucuaagcaaagggguuuuauuuuuagaauaaagcaguuaaauuacacugguguaauggaacacuguaucaaaauauauacauauauguguauaaauucuaagaaaauacuauuuaauucauauguuaaucccuuugcuaacuucauuacaauuuuuuccauuaaaugaaaauuaagugucuucuaaauguuuuauggaguucaaauuaaguaguugaauccacugaugacuauaaaaugugugagcugcuucaauaguuguauccugaaguacagauugaaggugugucuagauggagccagcuguacaucuuccucuucuaagcuucucucccaaaacauaggggcaaguaaaugauuuuuauagguagaugcuuuuaggauuugaauauuuuugucauguauugguguuagcuguggguccguuacaaaucccgugggaccuucauuggugugaacauuaguguaugggacuuccagucugaucuuuggcacccaugcaacuuucucuuauguuuuuaguuggcaacucuggagaauacugguuccuaagcucuuuuggcucacagauaccuuuaagagucuaauggugaccuagggauucucuuuaccggagagauguacauaagcaugugagcgauuuugcauaaggccaaggaggaauuagugagacuaagaagcaaacugggaacuguuccagcuggagaggacacuggugucugccuguuuagguaacugcaaaucuuaugcaugaaagcuacaguaaggaaagaggcuaggggcaggggccgaguaaugaagaaaagaaucugacauccaggaugcugcagguaucuuuggauguaugaguuucucccugggguauuucagauuuauuucauguuaguggcuugcuugugagauuuuucuugaagguuauuacagugauucagugaguuauuguuggcuaauugauguuuuuaucauuucugguuuaaauguauauauacuuucauucacgcauuugaacaaggcuguucucagucccuuuuagaauccaggcaacuuccucaucuuuccccaccauccuguggaucuuucaggauuuuuccaagguuacagcucaaagugucguguugacaggcuggagcuugucaccauuucuaaaguauguuuuugaaugaauucaauauccuugauucuuaucccaaggaguuuuaacacacuuuuugucauuguuguuguuguuagcaguaggcuagcuuagaauuguaacuugcccaugccaaagcaacaacaacagauugcaaaggaaucuucaaaaugggcggugggcaaggcccagccuguuuuaggaaguccccuagcuguuugcuguaccacagugaagaagaaagugaagaagaccauuucauguaaaugaaugcagugauguggguaagcacaucaaaguucuucguaaaaugaaaaaauuguucagaccugucuuaaugguuaaugcuuacuuaaaagucuaaaugacuaauuugacuagccauuuguuagaggauuacucauuuuaacuuuugaguuccuuauacuuaaaguagcuaaacacauuuuaaauaaucuguaauacauuaaaauauuaaaaauaugcuuuucucauuaaaaauacuaucuuuuaccacuuuuauaaguaggguauuuuacacagugauuaaguaucauuuuaguuuccucuaccuagguuuuauaagcuauuaaaguuauagaccauuuaucuguuaauaauggcugcugcugcuuuuuaugcuauuuuccugagugcguuaaagguuauuuuuauuaauuagccaauauuucagcccacaguaaggguaaauccucucuaaaaaauuugguuuucagccugcucaacucacaagcgauuaagaaaaaaacaguugugagaauucauuagugaaauauuuaagaaacauguuuuaagucucuucccgagauuuuuuuuuuuaaagcaugcugagauagccuucucucacuuucucccucuuacuuucacaugacauauaagccaaauggaucaguucuuuuugacaaagugugcauuguacugucauaauuuguuuucauguuuauuaucuaaauucgauuuguguagcaguuugguaaaacccagauuauauguaugucuuuucacuuuguuccuucuuucuuccugugguaauuuacuauaauuguauuuucccaguaagucagaucauauuagagacauuauuccuuaauuaucaguagguguccuuggaauauugcuuagcucacaggaaguggguggggggguuuguguauauuuuguuuuccuagaaauuuuuauguaauucuagguuauugucaacaaccugcuuguaaccagacaaaaccuugcuauuucaauaagucuaaggcuaguuguucugucaaacacgugucuugacagugagucucagucauggugaugcaucagaaaucaucuggcgagcucuuaaagcaauaccagugcuuugguaccgcuaaggcugugauugaauugagccaggaugggcccugguaaugguaggcucuacaaguuccucagaugauuccgauaugcagcucaccuugggauucguuguguguuagaaggaacuaggaagcauccuccuacucagugguuuucagccuuggcucacauuggaaucaucugggggaacugaacucucuaauagccaugucccuuccccagagauuuuauugauucucugggauacuggucugcacaugcggauuuaauaaaauagccaggugauuguaacauacagguagguuugaaaaccacugaccaccgcuucuguuuuucagaugaggaauuugaggcccaaaccaaagagauuaggugacuuguccaagauccacagaaccacaacuagaacucagaucuucagacuuguuaucaaauguuuuuaccaggacaucacauauuuuuaagaaaaugugggcuuugguauuucagauguacuuuuaaaauuaugucccuggcugcuuagucuaaaaaacaauguuuauuuuauuuauuuuaauacuggaaauaugaaaggacaugacuaagauccagccauuaccuuaguuaugacauaagagaccuuaggagcugagaauuagaaacguucauguauccuauaacuuguccacauuuucuagaagcaaaucaggcaaauaaauaacccaacugaaauuuucuuagguuagauuaacuccaugucacuauuucuauagcaggaauuguaaaugccuguguuuauaacaugggucauucucuaggagaauguuuaaaaaaacauuuuauuguuuucuggguuauagggugaauauuauagaaauuuuggaaauauaugaguauaaauaaaaaaaucacuuguauguaaucuuaucauccagagauaacagcacaaacguuauguugcaaaucaaaauggugaaaugccuuuuuaaugcuuguuaugcggguguuuuccaguugugcauagaauaacuuuauaugaaaggcacugaaacacacuucaugaugcaacuguugccucaucuauuuaacaaaugguacuaauugugccuauuuauguaguuaauaaaaauguaaagauagcugaaaaguagcuuuuccaugcucuaauguucucuuacauaacgucuacccaaaauauccuuguuuguuuuuuccugcccuuuguuuugcuaauuugcuuuuuuauuuugauaauacccucuuaauguuuuuacuuuuuucuucauuuucuuaacugcagggauuucuuuuuuuuuuuuuuuuuguucuuugucauuauuuaccauguguuucuuucucucacugcuauucauuauuuucccauuucuauuuuuauuauucuggucauuguuaaacauuucauuuuuccaucuagauacuuuguuagaucuugaaggauuagcaacuaauugucauccuugagaucucaucuuaacuuuuaaucaguauugauauuucuuuuaaaagaaacaagacccuuuacuguucuggaguccaacuuaauuagucaccuuuugucuuucucugugaugcuccugccauccagaacaacagcauaaugccugacccccucugucucacacacauauaaggcaggcaguuaggagauuuugacaucuaggcugcagcuuuucauugaaaaucuugcagaaaaucuuguguuugcauaaaugcaugucacucaaaauaagcagcaaaggggaaaaaaaagaguagcucuuggguuuuaaaagaggaaguuuacuuccccuacccccagucucaauauuuaacaucugguucugacuaaagauggggaggaaaaacagacuuaaaucuccauucauccugucuuaccaccaaacagugugaucacugauagcauuucuauuucuguuguggucuguaugaucagauguuuuuguuaaugauuuguaagggaagauaaugccuuauauuucucugagugguuauaauguaacgugccaacauuucuaaucucuagauagggcuagauuuaaucauuauuuaaugaaacuuugaaggaaauaaguuauugcuggaccucauguguuucugucuuauuucaaagagaaaacaaaaaacagaaaccuuuaauuaaucuacugauaauauuuauuuuauuuuaaaauuuuaauuuauuucaacauuugaauaaguaauacauucaaaugggcagaagugaaacagucuugugagauaccuguuuuuuaaaacuccauuuuagaaaaggaauuaacuaggacuuuauaucucuucguucaauauaauuuuaaagaagaauuguugaaaaguagauauguuuugccauuugcugagaauauuuuguacguuagcuugucucuuacaaaaacuaaauguguuccuacuucugauaauguaugucaauuuaaaauuuggaauggccaagguaaguugcucugcaucugcccuucauauggcuccugagcacagcucagugacuggcccuugcagugcuucuaccguuguaauggguaaaaccaggggaaacugccuugcucuugagcuugagcagguuaaucaaaaggauagagcuuccacuucucauuauucuccuuucuacuuugaugggcagaauaaggggaugcucauggaagagaaauucacacccaugaaaagcaaauugcccugaugucugaaucacauuacaaauuugaauuaaauuacaaacuuaaaucaagucuaauguuaccuacauuguuguacaugccaucagaaauucaaaagcauuuuauuggacaacugaauauuuauugaaguccagaauuuauuauguaaacuuggugguuagauuuuucuuucucuuucucugucuuuuaaccuuuauuuuagguucaggaguaaauauguagguuuguuauacagguaaacuacaugucauggggguuugguguacagauuauuucaucacccagguaauaagcauaguuccccauggguaguuuuuugauccucucucuccuccugcccuucacccucaaguagccccuggugucuguuguuccccucuuuguguccauguguucuuggagagaacuaaacaucaagugagagcuaaacaagaggauauaugguauuugguuuuuugcuccuacauuaguuugcuucagauaauggccuccagcuccauccauguugcugcaaagaacaugaccucauucuuuuuuaugacguguaguauuccaugguguauauguaccacacugucuuuauccagucuaccauugauggcauuuagguugauuccaugucuuugcuauugugaauaaugcugcaguaaacauauacguucacgugucuuuaucguagaaugauuuauauuccuuuggguauauacacaauaauggaauugcuggguggaaugguaauucuguuuuaaguacuuugaguaaucaagauugcuuucacaguggcugaacuaauuuacacuccuaccagcaguguauaaguguucccuuuucucagcaguguauaagauucccuucccagcaccuguuauuuuuugacuuuucaauaauagccauucugagugcugugagaugguucccauugugguuuugauuugcauuucucuaaugauuagugaugaacauuuuuuccuaugcuuguugguugcauguaugucuucuuuggaaaagcguuuguucauguucuuugcccacuuuuuaaugggguuguuuuuugcuuguaaauuuaaguuccuuauggauucuggauauuagacuuuugccacauauguaguuugcaaauauuuucucccauucuguagguugucuguuuacucuguugauaguuucuuuugcugugcagaagcucuuuaauuaagucccauuugucaauuuuuauuuuuguugcaauugcuuuuggcaucuucuucaugaaaucuuugcuaaguccuauguccagaaugguauuuccuagguuaucauccacacuuuuguaguuuuggguuuuacauuuaagucuuuaauccucaugaguugauuuuuauguaugguguaagggaaagggucuaguuucaaucuucugcaugcuagccaguuugccuagcacccauuuauugaaugggaaguucuuucuccauugcuuguuuuugucaacuuugucaaagaucagaugguuguaggugugagguacuauuucugggcugucuauucuguuccauuggccuuuguaucuauuuuuguaccaguaccaugcuguuuugguuacuauagcccuguaauauaguuugaagucagguauugugaugucucuagcuuuguuguuuuugcuuaggauugcucuggcuacuugggcucuuuuuugauugcauaugaauuuuaaaauagauuuuuuucuaauucugugaagaaugucauuguggaaggaagauaaauuuuuaaaaaaucacgguguuggccuggcauaguggcucacuccuguaaucccagcacuuugggaggccgagguggguggaucacaaggucaggaguuagagacaagccugucucuacuaaaaauacaaaaauuaaccaggcauguuggugggcaccugcagacccagcuacucgggaggcugaggcaggagaauugcuugaacccgggaggcagagguugcagugagccgagauggcgccacugcacuccagccugggcgacagagcaagacucagucucaaaaaaacaaaaacaaaaacaaacaaaucacaguguuaugguauucaccauaaaagaugaaaaacaaaaaaccauaagccaacuuucugauauuagccucaguucauggacuucggcuauuucacauugagcuuugggcgacaaguuuugacagaaaguagagguuccucuccuguggucaugagcuuguguuucaaggaguuaauguuaagggugcagaagucucuuucuucuuuauccagagaauaagggggaaauaaauacauuuuauacacacauacucaacauauaucuauccacauauuuaugcauauuuauagucauuaauauguaauauuuccacauaucuaacuaaguaucuguuucuuagauaaaggaaauuauaugauguauacuuguguuuuugguuucuuucgaucaacauuaugauggugagauucauccuuauugcugcauauuguuguacuuuguuaauuuucacugcuguuuagguuucuaguuugugacugguucauaauugaucugcuuauugauggacauuuguuuugaauaauguugccauuggcucacgccuguaaucccagcacuuucggaggccgaguugggcagaucacaaggucagcagaucuggaccauccuggccaacauggugaaacccugucucuacuaaaauacaaaaaauuagccgggcgugguggugcgugucuguagucccagcuacuugggaggcugaggcaggggaaucucuugaacccgggagacagauugcagugagcugaguuagcgccacugcacuccagcccggcgacagagugagacuccaucucaaaaaaaaaaaaaaaaguugccauuauucaaaagaagguucugugcaugucuuuuggugcauauaugcaugcauuucuucuggauauguggaguaagauugcuggguuguuggguauguauauacucuguuuugguagaauguauguauauauuuuuaaauguaguuuuauguauuuaugugguaucuguuauuaacauuuuuuagucauuuaauaaugaguuguggcuuguuaauuguuuagcucacaagaacgucuugccuacuuguauuggggauaauacgauaagguacgcauaguuucaguggaacuuguaguucaaagacucaauucuagccccuaguugguuugugacauugggucugucacagcuuuagguuugcaguuucaccuuuauaaguaagaucgaaauuaauaaaugaucucugaggugacuuccaucuguacaauucugugauuauuucaaaauauccuaaaagacuguuacagaaguaugcuuuuuaaaaauaugcugcugacucuggggaaacaaacugcuccguaagguuaaugucagauuguaucuuuuuuacaguaauuaaguaguauuagguuaggcagaaaucuauuuggauuuuucaguagcaagccugacuuuuaguaauaggcuaguucacauaagaccgauauuaaaauaacaguuuuuuucuuuacaugguaacaguugucaagaaauuucacagaaaauauucauaauuaaauuaaagcacuacaaguguauuacuuacuguuaaguaauuugaugaccgggaauuuuaugcccaaauaaaucuuuguauuuuguguuacauuuucaguugaguucauugagucagaugggcaucaucagucuuauuuuuaguguugcauggguauauuuuaauaauucauucuuuuucucuuggccuuuucccauauauaaacucuauuugcaaguuauuuucagaguuggaaaauaaugagcuaauauuuucauacuucauauucauagaugaauaacuaguuauuagcaggccauauuuaauuuauuuuuguaagaagcuucuuugucacccuuuuuugcauuucuuuuucaaaguuuguaguguauauugaguuguucuucaccugugauuagaggcauguggauguacugcaaaguggaacagcuacaccucggauuuuccugagaguugcuccugaugaguuccuuagcacccauuugugacguggaacuggaaguuauaauaggcauuuuagugaaucuuucaugaaauucaguuuauuucauuuaaauggauacuuuuuuuuuccugagauucuuuuccuuguucuucuugugugaaaauauuaaugacagguaaauaauagauuuuguguuaaugguguuauuugaugaacuaaauaagaguccuaugucaaucccucccccuuccuuuuuuuuuuuuuuuuuguuaaacauuuuagcaucucuuaaagcaucuggaaaccagagguuuauggaaggaacaccuuccuccaucaguuccuuaugaaaagacuugcuuccugcaucccagcuuuucagagccccuuaguucauuuuacccuuggcuuauuacuccagggccagcuucccagagagugcugggcaugcuugugugcuccaccaagaguucugccuuucacuuuccuucucucagguaccagaauguagcggcauuuccuguaggauucugcagcugcuccuuucaaaucacucucuggccuuguucugugauguugcauucaacaucccaccacagacugugucaagaucuuucucuuuugauuagagguucucaggacaaaauaaguuaacagugcucgacugacauuuuccaaggauauuuaugcugguggaagcaaucaggggaggcccugauugcucuuuaauuauuaaguuacaaggagauacauaagaggaggaaaaaucaguuccagaggauaaagcaucuuaguggugcauuuggagaaaauacuuuuuuauuucuuuacugguuggucuuaccuuuuuaaauuuguuuccuccuuuccugaccuuaaggauagaacuagacaccgcagauggauuguuugcauuuaggaaucucagagguuaauggugauugauggagauuauugagggaggaacuaauuugcuccuuucucgaauuaggcagaggugagucacacuuagacugaacuugugaugugccugguccucuuccauuucuuguagugggaggaagcaaggaaagagccgcccucuuucugaccuuuggcagucuguugacccaucggaagaauuuaauuuuucucccaggauagaaauguggggguggacugggguguggugaugagggaauuaucagucugauguugauauuuacaaaugugaaaaguacacgcugucccaggacugggcugucaaagacuaggggaugaguacuucaggguuauugagcaagagggaugacaaaugaaagucccauaaguaguugcccuugaggucugaccugagagagaagcuaacucacucuaaaacaaugaugcuccaguccaguagugacguuagcagccuccccacuugggagggacugacugauagauaugugguuugggacaacagagaggaauugcuuucacaaaucuuuaaguaaguacugagaucuugaagaugcuuuagauguaguuuuaccuagaggcagagcaaugaaaaauaaaggaucuuuugaggguccugcuaaaccagugcuuucagacauuaaacuugcauaagaaucaccuggggaucuuauuaaaguauauauucugagucagcaauucuggggugggaccugagauucugcauuuuuaacaagcucugagguaauugcuaugcugauggucuaaggaccaaauuuugagugccauuauuagacacuuauuuaaauaaaauucaaauuaagauucaccacuccguguaguuuuuccuucuuuacacuuaaauaugaaaaugcuguaaacaagauauuguauuauuccuuguggcauauauaaaauauuauggaauguacgugauaaaaauagauauuaauaaaauccaaauuaaacucaccaacuaacauaauggaaauaaaugcugaucagaaaccaaaugcuaggccacccauugcuauuuacagauauccccaugugguacuguauucauguaugugugacaccagaugucuggaaaacagauuuuugugacaaauuuugacacaggaaauuuaucuugcuccauaaaacuuaauggaaaaauguaaugcuuaacuucaguccauuuuaaaagaacggauuucaguguaguccauagaaucaagugggauuuauucuugagagcugcuaggagucucuuuaucaagagaauuaccuaagacaacgucaguggguggcaugguauuugauugguuauugauaauauguguuuugaguuugccauauucgcucaguauucuauuuuagaucaugaauaaaggauauauuucuuuacuacacuaaauauuuaucagaugaaucauuucuggaagugagggaauuaacugugguauuuugaaagagaaacacaucuuuucagaaguacaucaacagugugauuucugaauguguuucaaacgguuaauacaccaggggcugagacuccgccaaaguagaacaucugcuucuaagacauaggcuucuggugcauucuucucugugcacuauuguuuucuuuugcuuguuuucucaauuuguuaaaucuagauuauauuucauaaggauacagggaagaaacgcuccuagcucauuuguuaucuuacaacagagaaaucuucaacagaucuuuuaaauuuggguaaaaaucuaagaauuccuaaugauuaaauuaugccuggugauaacguauuauugaaagugguuuucuguuuugaacuccccacucaugcaguucucccugguggaagcaugguugcacaugcagaccucugaauuccugagcagcauggauagaagggguccugugcuggugcagugggcagccuggauggggaggcaggguccuaucuaugauguguucuugcuccccuaucagccucuuuccugaauacacaucacuucuaucccuguagucugucauauugccauacuggucuacaucuguaugccuucaucugccaggcuuguugccuggcacguucuucugcauuugcucugcuccucuuaacagaguugaacaccucucuuuaguuccuguguuuuggaagcaccuugaaugaccuuaguuguacaguuagaguguauguaauuguguguuuuuauaucuaaguaaccacuagacugucgacucccagaaagcaaggacugaacuggucuuuaucuuauauuuccauuaccuaauguaguggcagauuuuagcagguccucaaaaaagguucauugagugaauaaacuuuauuaaagucgauggaacuccauauauguugauuauaauuuucaugcauauaaaaucaaucugaaaacagggaaaacugauaguuguguaaguaagcuauacuuguagacaaagaagcagcaagcugugacaugaguaagauguguaagaaaauguaaagauuuucuagugcugcuuugcagccugaucuuuguggauuauuuguagcacuuuuuccucuauuuuaauauuuaauuccuuaagaaauaauuaagcaagaaaucauuuuaaaaaaguauacaaucuuccuaucauuuugauguuuaacagaaauauuaaaauuuguuuuuaaaauuauuuucuuauuuuuauuacgacaaaauaaucaguaucuucagagagaaauaaugguugauucuggugcuuaccauauagauuaaguccugcaagucuuggguauagcagugcaucuauugaauaaccauuucacuaauaacauuuacacagguagacagguacagugaucuguuaagcaauauuuuuaaauaucuucuuaaaaguauuguaaugaaaggucagguacagcuggaugccgaaagaauuacgcuaaaaaaaucaguauguaucuuuaguguuaauaaguaggauuauuaauagugcuugacuuuuaaacagagaccccauugaauagaacuagacaagccaauauccaggaugauuucuuaucuagacauaugucaaaucuaguuauguuaaauugucuucagaaaacacauaauuuaaauggcagcguaauuaaaagacacugcuguuaggucuauaaacauucuaugucuuugcuuacauuuuaccacauacaaugucagggguuuuucuaccuuugagaacuuaaaacuuguagaaauuaagucuauugucaguagaaaucaguggauuagcuuaaugguauuuucacaguucaguucauugugugguuaucuaaguaaauacguuuugggaauuaauugcaguaaauuccuucugauucaaaucuggguaugcugcuuuccaaauaggauaguacaaauuuuuucuaaaaacguucccugguugguuuuuuuaucagagaaaauacagaacuuguaaaauuuauaauuuuuaauguaaaaacuacuuuguuuaacaagaauaaaauucuuaaauaagauguuugauacuuucuacccagcuucaucacucauuucuauucucagagagaaaagagcccuauccuuucaagugcuagaauugaguaucgugauaauaguaguagauugguagcucuaauagugcuaauaacaauuaacauuauugaaugcauacucuuuaucaguuuucuaagcuaauuauuuauugcuguauagcaaaccaccccaaaauuucguggcuugauuuaacagcaauuauuauuugucaugguuuuguggguuuaccgaauguuuuuucugcuucauauaauguugguugggaugcuaguucagcuggaagguccaguggcuuuacugucaugccuagcauuugguacuuggcagcugggaacauacuugggucuuucuacgugauuucuuggacuuccucagaacauggcagcuaaacgcaagagcauuuuuaaagaggcagaggcagaaacugccaaacuuuguaaugccuagccucaaaaauuuauguagcgucauuucuaccacauucuauugaguaaagcaagucacaggcuacuucaguaaaaggggagggaaauagacuccccuguguugggaagagugccaaagauuuuguggccauuuuuaauuuuuuacagauugagcuaaguacucaauccuuuacaaaauuagcuaaguacuuuuacaauguauguuuuagggaucagaagacugagacuugaagagguuaagucaguguccgaggucaucuaguuacuaaguaccuuaagcuuuagagcaagcuuguccaacccgugaccuggcccaguacagcuuugaauguagcucaacacaaauucguaaacuuucuuaaaacauuaugagauuuuuuuugugacuucuuuuuuuaagcucaucagcuauuguuaguguuaguguauuuuacauguggcccaaggaaaccaaaagauuggacacuccugcuuuuuuuuuuacuuuagagcuggagcuuuucaccguuguaauauauuaccuucaaugguauaggcagauaaauuuguccuucugcuccaaagccaauaucugaggaaguuuuauuuauguggcgggauaauugucuuugcagucagugagauuauaaagauauuuggaucacauuauugaggagccaucaugugguaaaaguagcagucucuccaaauuuggaaauuucugaguuguugggugauaugaaagguaaaauuuuuacaucugauguuauccugcgucuacuacaaauauuagcacauugccucaccaagagcaaauaaauaagucagcuucuuaaaccauaaguuucccagugggcauauuccauucuacuacaauuuauauuuuucauaugguuucaguguucuaguguuuacuauucauuaacaugaaacacagauuuuaaauugccuuuuuaaaaauuauuucugcugcuuugugguuuucuuuguuuugagggccauguuauucauggaguuuucauuguuaaaaaaagaaaaaaagaaaugucaguaaugccugugaugguaaagaacaaaauaaaagucaaggcuuucaaauauacuaauugaaaguuuuuaugcuuaugguaauuugaguuuucuauguuagauucuuggcauacugccuucaggauuucuucagucuaagacugaggcauauugaggaaagucuguaaguugaaaauaucauauagccuauuguacuuucauguuagcuguaaguugugaaauggauucacaguuuuugcuuaaagcauauagacauuuuagcgccagaguuaucuagucuccugcugaucagaauaaaagugguagauagccccauagaauguuauggggccauagaacguauguaccacaacccccugguuuuauagaagaagguuuagauaagagaagcuuucacucuuguucauaucauggaauagugugaagggcagaguugugucuagaaaccuggucugucagcacuguguuuucuuccacuguaucccaguauuuccuuaauuagccuuguuauuagaaauguaaaccaaguauccaagaagguccugucaccaccacucagcuguagaauaaguuaaauccagcuuaacuuuugcauuugugaaagucugagaccuuuaaaaaaugcuuagucgucauuguauucagaaaguuuaagacuucuauagugguucagggaaauuguacugcugagaacuaguagguuauuacagccauguuuuucugugauuacuuuuuauuuuucauuuugaaagaaaaaaacuaccuggcauagucucaaugcuuuaaaaagacaggauuuuucugugagaccauugacaucuaaauuaguguucucuugaacuguuaucaugcauauuaagacauaucauauaucuaauaaauggaaguaaaauggaguuaauugaaucaucugguuggguucagcuauaccauuucuuucaugacguuauaugacaaagaacacaugugaugugcuaauuuaucuauauaacuauucugagauuucuugcuccuaauaauaauuuaguuuuaguugcauuuuuuaggagacuauuauaaaggaaggagauaaaucaugaacuagauuuaaggauccagaccccuccuucuguuuaaagcaauuuuagacuguggauuuaaguguuugagcuuucuguugucugguuuuuauuuuaaagauaugaaauuagaacuaagagguuuuucuuuuggggaaggauauggaaaaaauacuggugugccauuugugaauguacuaugggggaaggacuaacacuuuuuagaagauugguaaucaauggucaugcaagugguuuggcuugagugccccagagaugccuucuccguuugaaagccgaagcagcgugguugccaguggagccuuucagaguaccggagacauugcagugagucuggaaaucuauucugucuccaguaggcacaucucagguuuaucagagaacaucaauauaauggcuuuuuaaugacauuuuuguuucuuacugaaaauagggcaauuuaaagaauaaaagaaagaaaaaccauaguaauucuacuaaccagagguuacuauugauaaugccuuuuuguguauauccuguauuuguuuuccuauuuacaacacaucaucuauaaugugguauuuauagccuuuuaauuuaauagaacuaagauuguacugagcauaguaucgauuacccugccuuuuucacucuacacuuucauuuuacccacuuucccccccccgauccucucacacaguguuaugugugagaauagauuuccagacucacugcaaugucucccauccuucaaagggccccacuggcaaccagucuguguuggcuuucaaacggagaaggcauaucuggggcacuugauaugcacuugcacuaccacugguucccaguuuucuaugagguaucuauaucagaucauggcuaaaaugagugggaauugcuuggcaaauuuguguuuguuuuuaucuuuauauuugcacauacugaauaaagauaauuuuaauccuggggaagagguagaaaaaaucucaugauuuuaguuuucucuguuaguauugcacgacauaagcaccagagagaugacuuuuuuccuccuuugguucauuuguauuuuacuuguccuauuccaaaagaacaguauugaaaugagacacagguaucaauaaggaaaauuuccagagccagaagaaggaaggaacugucagggaacaauuagugugacgggaaacuauguuaugcuuccucagaaaguaugacaaauauguuacauuuacuugaguuucuggaaacugcacaugagggauauagcauuaauuuccuuugucuuguugguauucuguuuuaccauucaugaagaaagaaaaaaaaugagagaaaauaaaaggucucagaacucacagaguaaagauauuuuucuaauugaaagucaaacuucagaguuguaauucucuguuaaaguggguuuugguuaaaaauuauuuucuguaaacuaauuuuauaggcuauuccuaucugucuguucauuagcacaguuuuggggucagcaaauuauuccuuauaguuuaaaaauauuuuuuauaaucuuugaaauuaacaaacuuuuauuugauagcuauuuuaagaaguuguuacagguguaagacuuuuucuucucuaacaaagaugugcgcugauagagcugaaacacaauaucuauguaaaauaaccauggugcccuucaaggaaaccuuugugcccuggcagauaaaguguuguggcaugucacauaugggaagggguagggaaaagauuccauguggguauuuugacguaaagcuggugcauuugagaauucaacaggcugagacauagaaacauuguaucagaguagggugaacgaauggcuuaacucacggaaagcagaccauuuggauagcuuggggagaaaacagaaguagugugagaaaugguggaaaggacacuagaaauacuugaggaguuucuaacuauauucuauugaguaaaaacaagacaaaagccauccuugauuugucaaaagugauaaaaaugguguaacaaguagaaauaggauuuuccugcuggguuugggguagaacuuggaaaaaaaacugaucaauuaugucuuuuugagccauguguuuaaaauuaagguggaggaucagaagcaauaaauauggauuaauugacuccauucagauugccacuucacuguuuuaugauagacuacugggaauagcaaauaauaagaaacuuaauguagauuuguuuaaaaaauuuguuacuacuguuguuucaaugucaaguuuauuuugcuuguugaugaaacuggucuuuuaucacauaacucuaggucauaaaaguauaguuugaauuuccaacauuucuaauguuucuuuuucuuuugaaaaauaaucaaagaaaaaguucugcuauguucugguuacuucuguaugaaucucauagcaaucaugauuuuccauuguguuuacagaacuuucauuguguuuuaucguaaaggaaugaaagaauggauuauuuuuucuuuuuugucucaauggaguggucuacauuuuaaagguuuauuuuacaaaaggauacuuguuacauauuagguuucaucaaaagaaguucaauacuaaagauaaagaguuuuccuuauugaaauauauauuguuaagcuuuuaaaccaaaugaaaguaugaguggucauauuuauacuguaguagguuuucauaauagauuuuccggauuaaaaccauuuguugaaaucaucaaagagauguuaauccugcuuuagcauuaaugcaaaguuaaaauaacugacauuaaaaaaaucauuugggaagcuuuauugaauauauugagauaagguuuauuguaguccuucucuucaugcauacugcuguuacaauuccaggagguuucaaaauccaugugaaugaccccauucaacccucaaacuguccaauuccuggccuaauucaccuucacucugcuguagcuaccaguugcaggacuagcugcauuuuggccagaacugcaucacccuggaaauuuuaaacacacucucucucuucugauugcccucuuuuucugguuccaucucagcuuuauucccacugcauuguucuuuaucuuuggagcucucuaaaucccuuaaauucauuggguauaggauucugucaucuucaucuuuguaauaucagugccuagacuaagccuggcguauaauaggcacucagagauuugaagaauaaaugacuaaaugacuguaucaaauacuugcccauuguuugcuguuucugaauuguacaaggccaucaugauaauugaugaucuuaauaaugugagaauaugauucucuuaccuuaguaagagagccaucaguuuauuggaugauaguuauauggaaaaagaagaaaugcuacugugauaaauauuuauaauuuuaaacaagugguaaguagaauuaaugauaaauaacuuacuuauugaagguuuucaaaaaauuagaugcaucagggucuuaccuacaugucuuauguauuuuuauucaaaauuuuuagaaaugaggaaacagguuaaguaaccuuuucuuuaucuuuaaacaggcuaaggauauuaagccaguacuaacaaacuuaaggaccaaacucgucaauauguaagauacuagaaaaauuaaucagaauauauuuugaauaucuuguggaagcuucucaaaggauauuacauugagcaucauaggcuggcauguuauuucauguuuuaaguaaggcauuuguaaguuguccauuuaaauauauuuauuuuagaaagcaaauauauuuguccugugaagagcauccuuauuuugagggauagcuucuugcuguuaauaaaacuucguagauaacauguuggaaagaauaccacaggccgggcucaguuggcucacgccuguaaucccagcacuuugggaggccgaggugggcagaucacuugaggucaggaguuccaaaccagccuggccaacauggagaaaccccuucucuacuaaaguacaaaaauuagccaggugugguggcauacacccucuggaggcugagacacgagaaucgcuugaacccaugagguggagguugcuguuagccuagaauagggccacugcauuccagccugggcaauagagugagacucuguaucaaaaaaaaaaaaaaaaaaaaaaaaagaaaagaaaagaauacuacagagagaucaaagaaugcccaaaguuaccucucccagucagaauuuuggguguaaccucccuagcugugcuagugguggaugagguguuuaacaaaggaaauguaagaucuuccuuuaguugccaguucaguguaguuuuuuggaauuaguuugcuaaauuucuuuuaaagugaucaguuuaguauccaaaaaguaaaauggagcaaguugaaaaauuguccugccuguguuucaguuuagguuguuccuaggcgcacugcugacuucucuuaugacuuuggguagauucagucuuuauugguauuugaacuuuuaaugucuguuguguacucuccuuagacacauuuaaaacuuuaaagcauuugggcagggggaauggguaaggauccaguuuuauuuaagacugucaggacccaucucaauaguaguaucuauucccaugagagaaaaaugaaaggcaaggcuuacaucagccuagucuccucacuuaggaaucacaacauuccuaaggucagaaacagugugaaguaagucucugaacccauuuuggagggcaguacaucagaaauacaguggaaauugcucuuuagcuggaugugaguuucauuuuaagcaccacuguuuauauucuuuaugucuugccuuucuuuuuauauugaguuuguuucaccuuguaaaauuaagaagagcauguucuagcuuuuaaaugugagaauugaauuauuaauaguuuuuggguaaaaguaucaccucccauuucuucuaccaaaagcagcacauccucacagacuuuucaccucacugaaaauggucauuuaaaguuuuuacuaauucagcauuuaaagcuuuuuauuuccuccuugauuuauaacacagcuguuucuugaauagaaaaaacucaaggacuacaugcaaucuaauuagauuacauucuuugugugagucuccugcauuuaguggaggccacuaaucaaaucuugauauauuuucuauuucuuuuauuuauuuauucauuuaauucaucaagucaagauggcuauaauuagagcagauuacuccuaccacauuguauuaugaugaucucuucauguuuuuuuguuucauacuauaugauauucauuaaggguagcauugugccauccuccaucaagcauuauaugcuuccuuugugcuuaugauguugaccguagcaaccuuaaacuguuaagacuuguuuauaaacggugaagcuccaucauuccaacagagucagcaugcuaauucacucuaguucaaauccacauucuaguugaaucccugcaauguaacuugacauuuggagaaauugauucauaccauuuuaaagaaauaugauauaggugacagaauccaggaugaagagguaccuuguugcuuagaugaugacguuguggauucauuucacaucucucucucuuuuuaauguagcucuucucccuccuugguuuuuauuccucccuccuucuuucuucuucaagccuccucuaauguuaacaucuuuggcaguuuggccaguguugacaacuacuuuuugauuauuugguauuuuaaaauauuugguauuuuaaaaugcuuuuauuggccaggcgugguggcucacaccuuauaaucccaguacuuugggaggccgaggcgggcagaucaugaggucgagauugagaccauccuggcuaacacggugaaacccugucucuacuaaaacuacaaaaaauuagcugggcaugguggcgggcgccuguagucccagcuacucaggaggcugaggcaggagaauggcaugaaccugggagguggagcuggcagugagccgagaucgcgccaccgcacucuagccugggugacagagcgagacuccaucucaaaaaaaaaaaaaaaaaaaacaaaaaacaaaacuuuuauuguaaaauuauuuauuacaaacaaaaucccaugcaaagaaaaugaauaaaugugaugguuaauggaauauauguggaaauaaguagcuucucuuauaagugaaagaacugauaucgaaaauuccauguaaaauuaauuaaaauuaaaauuacauuuguaagauuauugagucuuuucuuucugggcagauuuuuauuuaguuaguuguuuggggauuguuuggguuuuaguggcagaaauauauucuucauaaguaucagauucuuuauuaggcagucaucauuuuaggucuuacaaugaugggaaaucccaugggcuuagggaagauuggcuaaguauggaaaaauuacguaauagaaaaaauuccaucuacaaagaugugugauuguuucuuuucuucucccuaugucuagaugguuagagaugacuguauucuuggauuguuuuauuuucaaaauugaaaguuuuuuuuuuuuuaaauggguauuaggcugggcacggugucucaugccuguaaccccagcacuucaggagguugagaugguuagaucaccugaggucaggaguuugagaccagccugaccaguauggugaaaccccgucucuacuaaaaauccaaaguuagacgggcaugguggugcauaccuguaaucccagcuacuugggaggcugagacaggaggauugcuugaacccgggaggcagaaguugcagugagccgagaucacaccauugcacuccauucugggcaacaagagcaaaacuccaucucaaaaaaaaaauagguaucaaaggaugcauagugggauggggaauaaagaaagcacauacuacauagcaaaacauuguaaacaaaaaagucacagcgucauauaaaaaagaaaacguauuuucuaugauaacaaauuuaaaugaaauuagauaccagaauaguuuucaguucucuuucucuuuuuuuuuuccuuuuaagcuccaacagaaugaguuugucaguucuuuucauaccuuggugucgauugcaaccucuauaaauauguuaaauaauggauuucuaagaugauuauuuacauauauauggagugugugugaguguauaaguauaaaguaaauauauauauucuggaauguguauguauauaugcauauauauauucaacuauuuuuaacaauaugagcuugaguuucuuucaagacuaaaggcaaaauguauuuuuucauugccuuauuuugugcaaaagccaaauaaaauuguggugauccauuugcagaagcaagaaaauagaagcauauacacauuuuauagucaaucagugaguauugauauagguccuggugauuauuagagcuucuagacuauaaaaaauguuacuauguuucuuuuaaaguuuagugucugcauagccaguggaucagauacccagaauggguggguaaucacuggcguuguguuucagacuuuagaucuaacaaguaaaaauuaaaaaaauaaauuggauaugauuaaaggacaaagaaucaaggggauggagugcagccaauucagaaaauaaagaacaguugguuuacccuaauuauagccauuuugauuuuucuuuuguauguaucaauuggaaguuugguaaaaauuaaaucuuuagcccaauuauagaaauaaauucauugcagauuuccuaaggugacuuuauacuuuucuuaaacucaaaucuuuaaagucgguuguaguuuguacgagccacaagucuuuccuuugauauaguaaaacaguuuacuuuuuauuuuuuaaaacaauaucuuauaucuaccaucaucuaaauugaggauauguuaacauaaaugacaaaaucauauugauaucaaagauucaacugauuaagagaaauuuuacacuuggauuaggaugaguugugcaaaaguggcugaaucuaauaaaaugauguaacauuuauguauauuauaaugaauuuuccagauuguuuauggguacaggucaagcauuaaaauaaggccuauguuaugcccuccccccuuucaucaaaaagcuuuccguagauaaguuauggaaauaggugacuguuuuuuuuuaaacuuuuuuaaggaagaugaauuuauugauuuuauagaauaucuuauugcauucuucuuauuacuacuuuucccacuuuugaucauggguaucuuuuuucuguauucaucuuauacaggaaguuauguaucuccuuuguaaauuagaaagagugucauccaaugauuuuauugucaggugcauauuaaaugaucuccuugguaaaaaacaugaguuauuauuauuauuugacaguuauuaaacacagauacaugaguaaauauggagcaaagaaacacaacuuucaaugacaaaggucuguugauacacuguaugguuuuauauguugcaaauuugaugacuuucucuguguuaauuucccucuauauuuuuauugaguccuaacacacuugccuccacucacaucccaacacacacacauacacacacaugcacacacacacacucucucucucucucauauauacaggugcacauacacaugcauaauagcugaagcuucaaaaugaaaacauaugcagaauguaccuauugauuucuggucauucugagcaaaagggaauauaaagaaauaaaguuuguuugaaacuggggaaguuauuuaguauuuuguguuuuaauugcuucuuaacuaucuaacacuaguaguuuuaugccgauuaacguaauauugaaaauuuaagaaauguuagcaaggauuauaggugauugauaguacuguuuuguaguaugaagcaugguuuaaaucuugucagaauccccagaacuuaacauggaaauuagaauagagcugacaccuguaucuccauucuaaaccauuuagucauauuacuacaauuuuuuccuucuaaaacagacuucaucaagucuucagaauucugaauccauuaauccauuugacucuccauuuauuucuuuucucuuucauuuuuuguuuuugagacauugucucacccuguuacccaugcugaagugcaguggcguguucaugucucacugaaccucugccuccuggcucaagagaucacaucagccucccuaauaacuggggcuauaggcaugcgcucccacgcccugcuuauuuuuuguagagaugagguccugccauguugccgaggcuggucucaaacucugggcucuagccauuuggccaccucagccucccaaugugguaggauuacaggggugagucaccacaccuagccugacucuccauuucuuauagcaguaccucuuaaugaggaaagcacauuagaauugcccacagagcuucuaaaauaugcauauaucuagaacccuuccucagaaaaucugauauuuagguaggaguggcaagcauguauaacaaaaacugugcauugauucagaugccucuuuaugucaugucccaacuaaaguuucuuacucugucucauguuauuuucuccuguuacccucugcucugcuuucacugugccaaaaaugauauaauaccaauacauuuucauuuuauacuuuuguauuaguacuuuuguacaugcuguuucuacugccugaaauaccuuuuacuucccucugcauccucccuuucucuccucuccaggucuuuuaucugucaaacaaugaguuuucuuccuagauucuccucugauggcaaaucuuuccuuacucccccagguagaaauagucacucucucuuuuauguuuaccauuuauauuugauuauuaauuuuuuaaguguccaucucuuccauuaaucugugagcucagugaaauuauguaauuuaucuuauuuguguuuauguuaaaugaauacauggauaacuaauaaguugacagcuuuguuaggaauuuaaauguacaauguuuucauaaacuuuuuuuaagggcagcauuaaguugagguuuucgugaucaaccaccaagacauacguugauacauacauaacauuguuugucuuaauauauauuaccauaaaaauuugcaugcaucuagguguuuauuucuuaucuucauuuuuuucccuugugccuacagacgaaaucucacaaaacugucccuuaucuucagucacaugcuggcagaaaucaaagcaaucuuucccaauggucaauuccagggagauaacuuucguaucacaaaagcagaugcugcugaauucuggagaaaguuuuuuggagacaaguaaguaaaaaucauuuuuauagcuguggaucuaucuuucaaggguuacuguauccucccuccaguuggauaugguauauauuuuacuugaguguuuugugaauguauuuuauuauuuuugauaagcauuuugauugauugguaauuuuuauagucaccaaagguaugccucaauaaugcaauaguuuuuuagucacuaaguaaauauuauacaauguuauuuauuucaugagcauucauugaguuuguucugagaagcagagguauguaagagucuuuauacaugagaagcugauaacuucuuauaauuuaauauguacuuaauauacaaaauaaaggguagaagggcauagauacuuuaaaaaauggcauaaguaaauugcugugacaauuuagaagggaauaguugcuuugggaucagugaucagggacugcuuccuggaggaggugguauguuaagcuugguuaaggucugaaaucgaggugagagaaggcccuggcacccugauccagccuuucuuuguuuuacugcauagagauuauauaugugugaacaagauaugaggauaauguuaucacaaagauguagucuguugcaaaguaguuaaagauguaugcccuacagagacacagauucuggugagcuugguagauaauggaauugaauaucuaaggucagcauaauuuauauaaaaguugcaaaacuuuugucauaaaugucucaguaaaaugaucaagaaugagcaucaggaggcaagugguuuccccaguaaccuuuuaagaauuaccuuuaaugagagcgcguccucagaauguccuagaauguaggcaaagcccuggcugaguaaguaaggaggaagugugacugcuuacauagauuauuguuuuaaucuugucucaaaggucuguauuuguccuuuaacugaugaaauuagacauaaaaauuguuaguauacacuuuuuuuaguacuuugauauguugaacugcgauauugguuuuccuuuguuuguuuuuguuuuuguuuuuguuuuuucuuuacaaaguacuauaguuuacuauagucaccaccaagauuggaauauaccuacauagaguaauguacauuucauuaagcacacaauuuuuuuggcauccaaaauauuaaagccuauuucccacauuguacuaaaauguauucugaauuauuuuuaggcacuaaaggagaaaaugccauuguugccauuaacauggaaauucuguguuguagcaaucuaguuauuuauaauguucauauauucauucagaaaugaagaauuuagaaaaaaguuuauccuuaucugaauuagaauaacacagacagcuaagacuauacuaauuaaauauuuauuaauuguagaaagcagaacaaucuugccagguucaggguguaggaacugagaggguuuguuuccuguaguugcaguucauguauuaacauuguaagcuuaguucaaacagucgguaaccuucaaaauaaacuuucucuuaaaguuuuaagaaaauauauaggacaaauugauuaugguauuucuuuuugaaaacugaaaauucugaugaguuauaaaauuguuuacuugucauaaggucaauaaaaaauggaaagauugcucacagguuuuuuuuaagagaggaguuuacuuugcugguacuucaagccacagaaaauuaugcauuugagacaucuuuauuucccuuuauuuauaaccacagacaucaaggggcugaaauuucuguucaacugcuacaugagugaaaucacuacuacaucaaaugagggauucuugaaauagugauuagauacuuucccuaccucccaagucuuuucacuuuugucugcuguuuuuacugaauugagaaagcugcuuaauuuuucuuuaacacuuuuaauuuguggaugacugccaaauuucaugcuccuuuuggaacuuauaugcauuaccauagucauacaaauuaauuauuccuuuauuagauaauuggagaaaguauuuuuuuauucuuccuagguuuuuaccuugugguuccauaauauuuuauugaaugaauggacauaugcaugaauaauguguauccuuucgaaagguugaauuuuuuuuuuccauuaugcucuaauacuguuuguauuuucccaaaacuuaguucuccugugggagcaugccugucauuuaucucacuguucauugaggccauguaagaaugcuuucauuuagcccaaccagugccuuuaaacuugaaaacagcauucuuuccuaaaacagaaccauuaauccauucaugagggcagcgcccucaagaucuaaccaccucuugaagguccuacuucuuaauacagucgcaauggcaauuaaauuuuaacaugaauuuuggaaggggcauucaaacuauagcacuguuguuuuugaagacaugguagugcuacccucucugcucagggcccaagcccagcagccaagaggcacugccugccuuguggcccaaggggaacaguaacacauguaucauggcaaauuuguugggggauucuguuuauggucaauuuuuaugcaaaugaauauauuuuaacaaugcagucaugcuuuuccuuucauagucuguugaccaggaguuagaaaucuguaggaaaagaaaagugacauuauugaauaaaugugucuaaguauguucagcaaaaugagaccaauacuaaacugaaucuucacacucuggaauaauaacuuauaauccagaaacuuuaagcaugaagcucgaaaaauauauuacuagcguuaaaaaaagaagcacaucaaugugauuagacucugggugacagucauuuuucuuagcgagucagguagcagcuugugacucauuuaaguacuuuuugacauugagaaaagugauugauugaaguggugauuuauaagauuuuagugcacuggucaccugagcagugcacacuguaccuaauauguaguguagucuuuuaucccuuaccccucucucacccuuccccaccacgaccccaaaguccauuauaucauucuuaugccuuugcuugcucauagcuuagcucccacuuauaagugagaacauacgauauuugguuuucuauuucugaguuacuucacuuagaauaaugguuucuagcuccauccaaguugcugcaaaagacauuauuucauuccuucuuauggcugaguaauaguccaugguguaaauaugccauguuuucuuuauccgcuuguuggucuaugugcacuuagguugguuccauaucauugcaauugcaaauuaugcugcuauaaacaagcgugugcaugugucuuuuucauauaaugacuucuuuuccuuugaccagguaucuggcaguggauugcuggauugaauggcaguucuacuuuuaguucuuuaaagagucuccauacuguuuuccauagugguuguuacuaauucauacucccaccagcaauguagaaguguucccuuuucacaacauccacgucaacaucuauuguuuuuaaagauguuuaacaacaucuauuguuuuuaauuauggucauuguugcagaaguaaggugguuucucacugugguuuucauuugcauuuccccgaugauuagugauguugagcauuuuuucauauguuuguuggcuguuuguauaugucuuuugagaaaugucuauucauuuccuuugcccacuuuuugaugggauuauuuguuuucuucuugcugauuuguuuuagguccuuguagauucuagauacuaguccguugucagaagcauaguuugcaaguauguucucccacugugugaguugucuguuuacucuccugauuauuucuuuugcugugcagaagcuuuuuaauuaggucccauuuauuuauuuuuauuuuuaugcauuugcuuuugaggucuuagccaugaauucucugccuaagcuaaugucuagaagaguuucuuugauguuaucuuguaggauuuucaugguuucaggucuuagauuuaagucuuugauccaucuugaguugauuuuuuaauaaggugagagauggggauccaguuucauucuucuacauguggccugccaguuuuuccagcacaguuuauugaauaaggguauccuuuuccaaauuuauguuuuuguaugcuuuguugaagaucaguuagcuguauuuggcuuuacuucuggguucucuguucuguuccauuggucuaugugccugucauuauaccaguaccaugcugcuuugguaacuauagccuuguguuguaauuugaggucagauagugugaugccuccagauuuguucuuuucgcuuaguauugcuuuggugauauggucucuuuuuugguuccauacgaaucuuaggauuguuuuuucuaguucugugaagaauguugaugguauuuugaugggaauugcauggagucuggauugcuuugagcaguguggucauuuuauucuucccauccaugagcaggugauguguuuccauuuguugugucaucuauaauuucuguguuucaguguuuuguaguuuuccuucuagagaucuuucaccuccuugguuaaauauauuccuaaguauuuuauuuuauuuuuuucagcuguugcaaaggggauugaguucuugguuugauucucagcuugguuauguugguguauagcagugccacugauuuguguacauugauuuuguguccagagacuuuacugaauucauuuauaagaucugggagcuuuuuggaugaaucuugaggcuuuucuagguauaugaucauaucaucagugaaugaugacaguucgacuuccucuuuuccaauuuggaugcuucuucuuucuuuuuuuuuauuggauugcucuggcugugacuuccaguacuggguugaauagaaguggugaagguggggaucuuuaucugguuacaauucucagggggaaugcuuucaacuuuuugccauucaguaugauguuagcuauagauuugacauauauggcuuuuauuacuuucggguaaaucucuucuauacauauuuuguugagggauuauaaaggggugcuguauguuaucaaaugcuauuucugggucuauugagaugauuauauauauuuuuaaaauuucuguuuaugugaugugucacauuuauuaacuuacauauguuaaacuguccuuguaucucugaaacccacuugauugugauguauuaguuuuuuguugugcuguuggauuaguuagcuaguauuuuguugaggauuuuugcaucuauguucaucagagauauuggucuguaguuuguuguuguuaugucuuuuccugguuuugauauuagcaugguaguggcuucauagaaugauuuacggaggauucccucuuucucugucuuuuagaacaguuucaguaggauuaguaccaauuugucuuugaaugucugguagaauucaguugugaaucuaucuuguccuggacuuucucuguuugcauuuuuaaaauuacugauucagucucacugcuuguuauuguuauuggguggcaguaaaccuuacccagcucuccugcaguuggugaggcugaucucacucccacagugcucugcuaacaaugcuugguuuagauccagguagucuauagacagaacucagaccugccccaggucauaagcuucuccacauagaaagcugccauggcuuucaaaaagccaugccccucuucgucuucccaggcauggccaggcacccagcuccuaugcuccugucugcagcacacuucccacuugccgcaacuccucccuccccauucuguucaagggaauuuguuccacucgagauuauauuacaaaauucaguugggagguucuuucacccuguguccuuucccugagcucauuggcugacuuccagagggucccugugagauauauucaggaauagcuucccuggguucaugcuggagauugggaaguccugcugcggcuccuacuuuuuuauuucccuaaaucuguuccagcuauuggaagggugaagggcuucuccaguggccuggauuuucagauucccugguggggauguguacuuggaggcagacucuuccccucucgcacucugaggacuuaggaguuuuucaccugucucacguaguaggcuauagccucccaauucuuucacagggucuguggauucuguuuuccuaaguuccuguguugguucuuugggaaaaaauucacacugaaucucugcacauuauucuguccuuccaagugggagaagcaugcugacacugccuccagucugccaucuugaaaaaaaaaaaaaaacaaaaauuagcauugagaagauuuagacauaaauuuccaaacaaauuauaauucaauuagaaacacagauucuaacucuugaaucuucuuacauagccucuccucuccauacauaaaauucucuucuucaaauuuaaauucaugcucugcauuaccccaacaaccuucugauuagucucccuaucuccaauaacaaccuauccuauuguucuuaggggaccagugagcugucuaaaaagcagagcuaaucauuccagucuuucgcuugaaguguuugcaugaauauuaauucuagguuaaagucuaaaaucacauuaaacaucacaagcuuuagaaacuuuuucgcuggcuucuuuuuuucuacuuaucauuucgguauacuuaacucaucugcaaagaaacaacucaauacuguucauauuucccaaugugugucucauuuuuuacuccucauugucuuuguuuucguauguugcauucacugcuuggauaggcagucacccaugcucuauccaguguugccacuuugaaagcuuuacuuuaguacccuaauggauaucccuacucugugcugccagguaccugagcucacaucugucaaaauauauuacagugaacugcugacaugcccccauuucucaauugagagguuuccaauagacuggaaaguuuauuuggaagcagagacugcaucuuacuuauuuuuguguuuuugagccugacacguuuccuggaauguuuaggcaauaauaauuuuuuuuuuuuagguggaguuuugcucuuguugcccaggcuagagugcaauggcgccaucucggcucacugcaaccucugccuccuggguucaagcgauucucccuccucagccucccaaguagcugggauuacaggcaugcaccaccacgcccggcaauguuuuuuuuguauguuuaguagacguggaguuucuccauguuggccaggcuggucucaaacuccugaccucaggugauccaccugucucagccucccaaagugcugggauuauaggcaugagccaucacgcccggcggcaauaauuguuaacagacuacaugaauaauugcauagauggacgaugucuauccucuacucucaauuuccaaugacuucauuauauauaaauugaucucuuuuuaaaugaucaguuccuacauuucuauuccuuagaugccucucuucccucuuucuuuucaucugucucagaauuuugacaccuuucuuuaaguucaguucauaaguccacuuuucugaguuuuucucauucauauacacccuucuacgugaucuauguuaauuacucuauacuuugguugcuguuguauuuuagacacauuuauauuguaaaauguguuuacuauguaggucuuucuugcuugauugcaagagucuucaaugacuuucuaugcaaaaguuggugaaaacagacacauuuauuagaguuauuguaugucagauuuuguguucagugcuuucacauaugcuagccucauuuucaauauaaucuuuaaacuacuuuguaaaugguuguugaaugagucuuuuacguaccauauacauuguagacauuuaguaguuauuaguugaauguaugaguauaggaugcaacuuuucugccauuuaagcucucucuuccuuuacuuauguucuguucuucagucaaauuggcuuauuuggcucuuucuggacacaucagcaauuauagguuucuaugucuuugcuuauauugcuccuucuacuugaagauuuuuauaaucucuggcauaacaauucuuacuaaucccucaaagauaauauugcucauaauuuuucccauuaguguuauuacuagaucucuucuuaaacuucgcuaagcucuggcuuaucuucugcauuuacuauuuuuaugguuuuauuacaaguauuugucuaguugucauacuucccccuagacuauaugcuccaugaaaucaagcuuauuuauucaucuuuguauuucuaaaguagcucagcacaauguuuuauauacaggcuuucaggaaccauuguacauuuaauucagaugaguugagaaguagaggaaugugcauuagcauguguaugugugagauggagccugcuugcuugauugauugggagacagcauacuuaggguuuggcaugcaggcucugcagccagauuaucugucccuggacagguucugacugcaacauuuacucacuuugugacuuuggggaaucuaguugguuuuucuaugcaucuuuuuccucauuuauaaaauguagaugauacuaauaauaccuaccaucaaugguuguuaugacggcuuaaaauagcuaaaccuuaccuguaaggcacauaaaacugugucuagcauauaauaaauauucuauuuuguggaauaauuaaccaauugaaaccuuuaaaagugguccaaauucucuaaauaauguaauuuacauuugacuuuguaugauggaaguuucauacucuguagcaaucuaaaagcaaaaaaaaaaaaagaaagaaaaagaaaaauuuuaaaaauuauuuuauguguaucccgagaugaagguagaauugaaaauaagaaacugucuugguuaccacagggggaaaaugguuuauuuauagcucaauuuauugccucuaugauugauuuccugcaaaagcaauaagggccuucuuugguuucccguauuuuccuuucacuuuuaauaugaaagaaaggaaaauacuuucuuuaccuuuccagcgagugagauauauauucuucuagcauauuaacuagcucaguuuucccucuagguaaagaaaacacaaccuaauuauauuaaauuaaaagaagugguacacaguagaaauuaagaguuuuuacaaugaaaauuuuuagcagauacucuaaagagaaagaaaaaagaacuaaaguaggauucaaagaaucacuaguuaauauuucuacuaguuagcuaccucccuuuguugccuguuaaaaaaaauuucagguaucuuuaugucaauaaggaaaauaaaaacuuacauaucuauuggaggccuauuuuguucaauucauuguaacaagauacaaaacaacuaagaugccaauuguaauuuucuaccuguaagcaauauucaguuuggggaagacaggauauaaaaagaagauaaauacuuaaaaucagcucuguaccauuagaaaaucacauaaagaauaucacaaauaauaaauuaauuuacuaguacaugcauaccucagagauauuguggguuuaguuugggaccacugcaauaaaguacaucgcaaugaagugcauauugcaauaaagcaagucacuuagauuauuuuugucuuccuagugaauauagaaguuguauuuauacuauacuguagucuguuaggugugcaguagcauuaugucuaaaaaaauauauguaccuuaacuaaaaaagaauugcuaaaaaaugcuaacaaucagcugagccuucagugaguuguaaucuuuuagcugcuggagaguugugccucgauguucauggcuauugacugaucauaugcugaaaguuaagguggcuguggcaauuucuuaaaauuaggcagcagugaaguuuacuacaucaauugguucuuccuuucauguaauauuuaucuauaacaugcaaugcuguuugauaauauuuuacucacaauagaguuucauucaaaauuggagucaguccucucaaacccugccacugcuuuaucaaccaagugucugcaauauucuaaauccuuuauuguaauaucagcaguguucacagcaucuucaccuggaguaaauuacauuuaagaaagcacuuuuuugcuuuucuauaagaagcaguuuucgucuguucaaauuuuaugagauuugcaucaauuuagccacauauuuagguucuacuucuaauucuaguucucuagcaaauucuacaucuacaguuacuucuuccacugaagucuugaaauccucagagucauccaugagauuuggaauucacuguuuccaaacuccuguuaauguugauauuuugaccuccucccuugaaucauaaauguucuuaguggcauuagaaaggugaauccuuuccacgagguuuugaauuuucuuugcccagagcuaucacaauauaugacagcuauagccguaggaaauguauuucuuaaauaauaagacuugaaagucaaaauggcuccuugauucaugggcugcagaaugaguacuguguuagaagacaugaaaacaacauuaaucuccucguacaucuccaucaaaucuuuugggugaucaggggcauugccaaugagcaguacuauuuugaaaggaauuguuuucucuacacagcauaucucaacaguaggcuuaaaauauucaguaauccagguuuuuuguuccauuuguagagcacaggaagaguagauuuagcguaauucuuaaaggaccuaggauuuuuggaauggugaaugaacauuguguucaacuuaaagucaucacuuuuauuggccacuaacaagagucagccuguccuuugaagcuuuuuguuuuuuuaaauaaagaacagaaauuuauuucucauaguucugaaggcuaggaaguccaagaucaaggugcugacaaauugucugguaaggacccacuuccuaauuuacagauggccaaacaucuuuuugcaauauccucacaugguagaaagagugagcaacuaucagggggcuuuuguuuuuucuuuuucaaccuuuauuuuggagguuauuuaggggguacauaugcaaguaauugcauauugcaugaugcugagguuugggguaugauugaacccaucauguagcuuugaagcuagguauugacuucucccuagcccuagcauuuucuagauagcauuuucuuucaucuuaaggcuguuucaucuacauuaauuaucuguuguuuuguguagccacauucaucaaugaucuuagcuagaucuucuguauaacuuguugcuucuacaucagcacuuggugcuucaccuugcacuuuuauguuagagagagcuucuuuucuuaaaccccauaaacaaauuucugcuaguuucaaacuuuacuucugaagcuuccugaauucucuuacccuucacagaauugaagcgaguuggggccuuguuuuggauucggcuuuggccuaacagaauauuguggcuaguuugaucuaaccaaaccaccaaaacuuucuccauaucaccaguaaggcuguuuugcuuucuuaucauucauguguucacugaaguagcauuucuaauuuccuucaugaacuucuccuuuccauucacaacuugccuaacuguuuggugcaagaggccucacuuuuguccuaugucagauuuagacaugccuuucucacuaaacuuaaucauguccauaauuagagacuugugacuauuccuuucacuugagcacuugaggucauuuuaggguuacuauuuggccuaauuucaguguuguugugucuuagggaauagaaaguccccaggagagggagagagaaaagagaacaguguugguggagcagugagaacauauaccauuaaguuugcugucuuacaugggcaugguucauagugcccaaaaacuauuuguuucacacaaaaaauacuguuuugaaacugaaaaacugggaaugauggcaacaauagauaugaauugugauaugacagcaauuggcuagaccugugugccagcuguuuuucuuagauaaucucucuucuaauucaucacaauccuuuccuggacaucuuuacuaauuuauauuauauaccugguccccagauauuugauuuuuuaauaucugaaagcuauuuggaaccacuggacuaauagugugugccccuggauuuauagagguccuggucuuaauccucuaaacauuuguucucuucucugcuggaugugucuacuugggucaauaaagagagagaaggucuccuucuagagcaaggaucuuaaagccuuguaaaauagagguaguauuucucccugggucaaaggauaugcauuauccauuacaaaauauuuggguuccuuaaguucuagguucuacuccagaaucaaacccacaguguaugcagaugucaccuggcccucuuugcaucuuuuaggagaauuuguguuuagggaacaagggcaagaaaaugcugguacucuagccacugcucuugcugugaguaacaaaguccuuugacucugacccaguccuuugacagaaacccaguaucuucugccacuauacaugaaacugugauaggccaacuucuuagcuugcaagaagaguagaaucucauucuuugguuuuuuaggaucauguucugcugguagagaaagugugacuuaauagcaaaguaaauaaaacuuacuuauauuagucuguucucaugcugcugauaaagaccuaccugagacuaauuuauaaagaaaaagaaguuuaaugcacucacaguuccacaugacuagggagaccucacaaucgugguggaaggcgaaaggcacuucuuacguggcagcagaugagagaaaaugagagccaaugugagauuuauucacuaccacaagaauaguuugugggaaaccacucccaugauucaaauaccuccuauuagguccuuucuacaacaugugggaauuaugggagcuaacaauucaagaugaaauuuggguggggacacagccaaacgaugucauucugccacuggccccucccauaucucauguccucacauuccaagacacaaucaugccuucgcaacaaucccccaaagucuuaacucauuccagcauuaacucaaaaguccacaguccagagucuuaucugagauaacaagagucucuugcacuuaugagccaguaaaaucaaaagcaaguuaguuacuuccuagguacaauggggauacaggcacugggaaauacagccauucugaaugggagaaauuggccaaaacaaagggucuacaggccccacacaaguccgaaauccagcgggccagucaaaccuuaaagcuccaaaaugauuuccuuugacuccgugucucacguccagggcacgcuguuguaagaggugggcucucaugcucuugggcagcuccaccccguggcuucgcaggguacaguuucccucuugguugcuuucaugggcugauguugagugucuggcuuuuccaggugcauggugcaaaauguugguagaucuacuauucuggggucuggaggacgguggcccucuucuuacagcuccacuagucagugccccaguggagacucugugugggggcuucagccccacauuucccucccacacugcucuagcagagguagggcucugccccugcagcagaugucuaccuccacaagagcccugccccugcagcaaacuucuaccuggauguccaagcauuuccauacaucuucugaaaucuaggcagagauuccuauaccuuaacuucuugacuucugugcaccugcaggcucaaacaccauguggaagcugccaaggcuugaggcuugcacccucugaaauaaaagcuugaguucaacauuggccccuuauagccauggcugggaugcagggcaccaaguccugagacugcacaaagcagcaaggccuuggguacagccaaugaaaccauuuuuucuuccuaggccuccaggccugugaugagagaagcugccgugaagaccucugacaugcccuggagacauuuuccucauugucuuggugauuaacauuuggcuccuccuuacuuauacaaauuucugcagccagcuugagguucuucucagagaauguguuuuucuuuuuuaucacauugucaggcugcaaauuuucugaacuuuaaugcuccgcuucuucuugaaacauaaguuccaauuccauaucauaucuuugugaaugaauaaaacuuaaugcuuuuaacaguacccaagucaccucuugaacgcuuugcugcuuagaaguuucuucugccagaugcccuaaauuaucucucugaaguuaaaaguuacacagaucucuaggguggggcaaaaugcugccagucucuuugcuaaaacauagcaagagucaccuuuacuucaguucccaacaaguuccccaucuccaucucaguccaccuuaaccugcacuucauuguccauaucacuaucagcauuuucgucaaaaccauucaacaagugucuaggaaguuccaaacuuucccacaucuuccucucuucuucugagcccuccaaacuguuccaaccucucccuguuauccaguuccaaaguugcuuccacaguuuuuggguaucuuuacagcagcaccccacucuacuggcaccaauuuacuguauuaguacauuuucauguugcugaaaaagacauacucaaaauuggguaauuuauaaagaaaaagagguuuaaugggcucacaguuccauguggcuggggagaccucacaaucauggcagaagauaaaaggcacaucuuacauggcagcagagaagagaaaauaugagagcuaagcaaaaagggaaaccccuauaaaacccucagaucucauguggcuuauuuacuaccacaagaauagaaugucggaaacugcccccaugauucaguuaucucccaccuggucccucccacaacaugugggaacuaugggagcuacaauucaagaugagauuuggguggggaaacagccaaaccauaucauuauuaaaaucaguguuuagggggugggugcaguggcucaugccuguaaucccaguauuuugggaggccaaggcagguggaucacuugaguccagaaguucgagaccagccuggcaacauggcauaacucugucucuacaaaaaauacaaaaauuagcuaggcaugguggcgcacacuuuaaucccagcuacuuaacgaggcugaggcaccagaaucacuugagccugggaggucgagguugcagugagccaagaucaugcuacugcacuccagccugggugacagaaugagacccugccacaaaacaaaaugaaaugaaaaacaaaaacaacaacaauaaagucaguguguagguauuuacauuucgguaauagacugcuaaugauugaucuuucuauucuuccuuauuuuaaauguugguuauuaauaggaaaugcaguaguuguuuuucuuguauagauuuguuuuuguuuuguuaaucuuuaauaacaaaggaguuauuuaaaauaucaguaguuuuauuaaaaggacuuuuugauggauuuaauuaugcacaacaauauaugcagaguuuuuucuuucaggguuuuagaaauguuaucagaagcucuuuauuuuuugccucaguuuaucuuauacaucuaggagacuucacucauugguuguuaauuuaauuggcucauguugagagacuuacaaggaacuuuguuuuauuauugacuuuuuuuuuuguuuguaauucugagcucucauugcuaaagggaggaucauuuuaaagccuuacuuaaaccucucuuugguagcacuuucuagaguaugaaauuuuuuuauuuuauuuaaucugauuucagcauaucaaagguaucuugcauaacccaugagcugcuguaucucaugaauuuauccuguauuggugaacuuucagagaauauauacugaagaacaguuguacuuuagaaagaaaagaacaaguauucauuguuuaaaaccugaaucuuucuauuuuuuacagucaguggcuucuaaguggaaaaauuuuuaauggaauuuuuacacauuauuauggauuauacuugcagcuucucuuccuguuccuuuccacuaaugaacuuuauuuucuaaguuggaaaauaaauagaauuauguacaaauaauuuuaugacuauagcaaauuuauuguuuauuauguuccaagguuaggaugugagaccagaaguuagaaagcauuaaaucuaucaugugaacaaaauaauugagaagauuagaaauaauacuaaagacacuauuuccuguguuccugcaaucuuauaaaaauaugauuauagauuuaggcugcagaauaugaauaugugaaagauacuuguccacuauacagagaaguaaugauggccccagcugcccaucuggaguggcugcugcaaagaugcugcaguaggggaggcauggccagggcugugugcucuauggagcaggugggaucugggaacaggcaggagccccacccucuuccgaguuggugggguuggagccccaugcuuccaggagcagcugcagcuauggaccugggcaucccuauacucuugggggcccaggaagucccccuaccccagcaggcuuggaagugccugcuccugcugucuggccucacccugcucacagugccugcucugggauggagcaaagcuguggccaagccugggcacuguugugaccuggcugggugugcacacacucaggguggcgcugacaugccagcccccugccaccgcaucccuuuccagacuuugggaccaaggagcacuggagggaggccgacgggguugggcugaggguagcuccgcaugggccugcaggugacccuccacagaaacagccuguagaugacaugauugguggcagcaggaggcagacaggcucauggguggaaaggggcagguccccauugaagcccuaccuucaagacagggacagccuacagccucagggccgggcugucaguuccugguggaguucacagugggagugaaaacuuauggagcuuuuucugggccugcccuuggaccagucagcacacacuuccuuccuucugagcccaugaaaaacuccagacccagccagacucacacagacaucagacuaccagcuacaggaagaagcuacccaauuugagucucuuugacuccuugggaugaucugccugcagaaaggagcuacccacucuggguuuccugagugcuguucugcugcucaguaaagcuccuuucugccuucccacccuccaguuguuuguauaccucauucuuccuggacacgggacaagaacucagggccugccaaauggcaggacugaaaaaacaguaacacaaacagggcugaaaugugcccacccuccacccccuucacgccccacauugugggcaaugagaaggagagaagagcuguggcccuuuggggagcccacaccuacaggcucccugagcuaggcugugaagccccauuugggagacugcaguuucuggagucuccaagcuuuugggugccacugguuccccuccuccagacacaggugcccacaguggaagccacuugcugugcaucagauccagccacuggcuugcccagagccggugccugugcuggugccuggagcugcccgcccugcuacagcagccagugugcuuggcugugcgcaguggcuggacuccaugcucacuuguucaugcaccacuugcugcuccgcaucugacucguccuuggcaggugugggaucugugcugguagugcauggugagcguggcccgccagguugagucaguggaaugagcccagcaggccugagcaaaacucggguaauggcgcaaccaaucacagagguuucuggcuggaaaagugacacacaaacaauaagcgacaguagugcuuaucugcacuagagacaaaguguuaugagcuuuuugacaaauaaaaauuaugcagcauaaauacccagcaucugugucuuuaucgugucaggaauuuucauguauaaggaagagugguucaaucuaauuaugaauauccuugguaacuaugguugccauccuaucaaagaugacuugcuguauggugacuauguaaccagaguguuuugauaugcuguuucuguggguugcuggaaaacaauugcuuuucccuuauugauagaacagcaagaguaauaauggucccauaagaaucuaucuucauauucuuaaaaaauggagucaugauaaaagaagguuggauuuaaggaauaacuguauacaaaaugucaacagauuuaggaaucacagcgcuaauauuuuguguccauaauguaaucaaaacauaucaaauauguuacaaauauccuauuaucuucugaacaaagcuugcccucuguuuaaagauacugacauugaacauaucuuaguugaucaaggugaauuuucugacaacauuuacauaaaauuagaaauagaguugggcugcugaauauagaacauauuuucuuuuuguuuaaaaugaggaugacaguauauauuccugagcuacaauggaucuuaaacaccugccaccacuaauaccacagcaacaaaacaaaccaacaauaaacaaacauguugauuuccuuguuuguauuaugguaguuacuuuguucauucccauguaucugauuuuuagucuuagauuuuuaguguaauauuuuuuaaaauuuaaauauaugauugaaguuuaauguacauggggaaaaguacacaaaucauacauauagagugagaaauuuuuaugaaguaaacauaauccauguuuacaguauguauccauguuuaucuccuacccagauaaaguaguaauaccuugcugccugcaucuuggaagacgcccucucucagcgcgucagaaagucgcacauagucaccacccaguaguucugauacaugccaucauaaaucauacauaguugaaaucauacuaauuauacucuuuuggaaaaaacuggcuucuuccucucuuuauguuuauggaauucaacucuuuacuugcauguagcaguacuuuguucauucuccuuccuucauuguauagcuguaccacaauuaaccuauucauuugauuauuuauuuauaaauuacccagucucagguauuucuuuauagcacugcuaaaacaaccuaacacagaaacuggauauauaacaucaaggagaagagguuuauugggcccuugguuaugcaggcuguacaggcaugguauuagcaucugcuuggcuuccaggcaggccucagagagcuuuugcucauggcagaaggugaaacagagccugcaugucacauguggugagagcaggagcaagagagagcaaggggaggugccgugcacuuaaacaaccagaucuuguaagaacucauugucgucaggauggcaccaaggagauggugcuaaaccauucauuggaaauaugcucccaugauccgaucaccucccacugggcucuaccuccaaaauugaggauuacaguucaauaugagguuuggggggaacaaauacccaaacucuaucauccaguguuuauauauggguacauaaguuucuaaaauuuuaguuuuguuccaucuauuuguuuaugcuuguaccaaugccacauugucuuaauuaauguaaagaguacauacuuguuaauguuccuagugaagauuaccuuuuuuguucuugacucuugcaugucccauaaaguucagaaccaguuuuuaguaucuacuacaaaaaauaccuccugggauuguuuauuugaguuacauuaaauuuuuagacuaauuugggaagaacugacucuuuauaauaugaaucuaccauuaaaguguuacauaccuuuauuuauguuuuuuauaucucuguguauggguguauguugauauuuuugccuugcucaucuauuguuagcuuuauuucuauuuauuugggacuuuuagauagcauuauaaaaauuaaauguuuaaaguuucauuuucuaguuauauauagccaauauaaaacuacaacugauauuuuauaucaauuuuguguucagcaaccauguucaauuuucuuauuuccuauaguuuaaucuguaaaauuuuuguauuuucuacauauaaagcuaugucauaagcagacacugcuuugugguuuucauugauucuucuacgauuauauacauuuaaaaguuuuaguacaucuucuauucuuuuaguacacuagagcauauuagacauauaaaaaguuaaaaaccaugaacaaauacagaaaauauauuuuugaaaucacuuauaaucccuuccacaagccaguuauuaaauuuguggcaucuccagacauuauaguuuaacauuggaucauaaaggacaaaauuuuaaaaauacuauuuccauuuaguaguaucccaugaacacuuuuccacgacaauaaauauuuuucugcacaaaauuguuacuagugaacguauuuguuuucaaauauuuugcucuuauaaacaacacugcauauaaaagacuuguggaugggccuuuggcugcuauguauuuuuuggacauaauuuccuuaggugaaaucccuagaaguagauguucuuagucauaauguauaggcuuuugaaauuuguuuccaaauugccuucuagaagugcuguguaaauucucauucacaccaguaguauacagaaguuccuguuugcaaacacccuggcuucuguugauguucacccuuuguuguaugaaauguuuuucauuuuuuccuaucaguugaaacuaaaacccuguagccuuuuaugaacuagugguuucaugaaaauauuuuaccuuuuuuuuuuuaaaagaaaucauucuccucacacuuucuauuuuccauucuucuuaccuuuucuuaaaauugcaggauuuucaaauuagaauaucuaauacacuucuccacauuuacacaggagaaaacaagccuggaagauuaagugauuugucaacuacugaccagcugacaccuuuccagauuuauuucccugcaucugauuaaucccauugucuuugaaaagauacuguuuuuccaccgcauauucucacucauaggugggaauugaacaaugagaucacauggacacaggaaggggaauaucacacucuggggacugugguggggucaggggaggggggagagauagcauugggagauauaccuaaugcuagaugacacauuagugggugcagcgcaccagcauggcacauguauacauauguaacuaaccugcacaaugugcacauacauguacccuaaaacuuagaguauaauaaaaaaaaaaaaaaaaaaaagaaaagauacuguuuuucaagacuuuaaagaggauuacuauuguuuuuugguagacagacuagaacucauuaucuaauaacaggauuauaacauagucuuauuuaucauguucuuaucucucaugauauuauaugaacagaacuaucacuuuaacaaaaagucauuaauagauuucuguguaauagauaggugguaguaagccaucaauaaauggcaguucuuacucuuauuugaaauaaaaagauccugaaauuauauuauuauuacaggugcauggcuauccauuggucauguauucuauucuuuguagauugacaguuacuuauacuuguucacuguauuuuaaaagcgauucagccugcaacuuaagugguuuauaauuguaagggucaauagaauauauugaaagauuuuuggauuagugaaaacuuggaguuuaguuggccuuuuuauuuucucucucucucucucucucucucucucucucucucugucucucucucucucucucucucucucucuucccuuuucuucuucccaggucucugccagcacccugaaauuucuacauuuguaaaacaauuugcuauugauauuuucucucauuugcuucaucucuaaaggaagagguaguagaaaccaccacugucuuuuugcagaaguuuaaauggaggugugaaaauucaugcuuucuggguucacuuccucucauauaccucagagaagaaugguagccacuuagucuuaagaaaguuuagagccuuagugcaacaguuuagaauaaucuaauuuuuuuguuuguuuuuaaagacuuuguuguuguacucuauuucuauucuucauucuugaaauccccuucccccuaccucuguuccccagccccaccuccuacacaauaauggguguuuugcugaagugaucaaaugaggguuaucuguugcgcaaacacucauauaugaaaaguuaacaaaauagugcccuggcucccuaaucccuauuacuaccacuaauuaagauuccagugaaugccucuuuggauuugagguuuaucacaaguaaucugacaaaguuucauuuacacaaguacuguggaaauguagcuuguccuuuuguaaauuguuauuaugaagggguacauuagacuaaaauuuucuuaaguucauacaucucguauaacuggcucugggaaaucacugagugcucaaaagaguuaugaauugaauucacuguaaaugcuagauuagaauaauuuuuauaguaacagauguggaagaugucuauuuggccuuuuuaaaaaaacuuuauauguuauacacaaaauaaauauugacaauuugaccacuuuacguuguauacuuuauauacgaaacaaaaaugcuuuaacuucuucauacgaaaaauaaaauuuauacuguucugaagucagugguucccugaucauauuuuuuuuacucugaguaucaugaucaaugucccuuuuguguguugaguauuugaaacuuuaauuuggaaaagaaaaauguacuucuuagacauuaguuuuaugguaauuauaaugaagcuggacauaauugcauauuuauacuucauuguaaaucaacagcuuccuaauauucuuaaaaguguuccuuuuuuuuuuaaaaaaaacagcagcauuuuguuaaccuuaaucagagccugacguguguuucuucuaaauggcaucugaugugguaucucuccucaguucucugugguuuccuguuuuuuucauacauagagaaacacuuuuugagguauuaagccucauauuuuucuucuuuuaaugguaccugaaaccuaaacucucuuauaaauacagcauaguguugucaaccugucucaccauuaauuuaugccacuucccacagacugcuucucuggaaucccuccagcccuugcuguguauccaucacccagcuagcauuguccuuacauaccccacucuagauucuuuagcauuacagguuuuacuucugucccuaaagugugaucuucagagacaaagauguuaucuuuauuucuauaauuguauuuccccaacagugccuuguuuuagcaaugaauagauauaguaggcucucaaaguguugucucuagagcagcagcagcagcagcagccucagggaacauuuuauggcugucaguguucaggccccaccccaaugcuacugaaucauaauaucuuggguugaggaucaggcuauguuaacaagcccuucagauaauuuggaugcaugcugaaguuugacaaacacugcuauagaaaauuauugaaugaauaugaaaguuguaccuuuauggugauaucucauugaagaggauugauauagcauggggccaggcacaauuuaguuuauucugccugagucuuguauuucagagauacugguaaaggaaaccuaagauuuaaauauuugcuaucuuauaagaggauguuaucuuauaagagggacggcuuuuaugcuauucuguuguaaaaauuguaguuuaaguuuuaaaaacugaaugauuucuuucuucugccgaauuaggaauaggcauuauucugaagcaggaagguuaacuaagaaaugcauccugggugucacuaauuuucauggugggaaagaggguaggugaguuggaaacuggucagguggggauagguugagagacguuucccuaguuaccauucugugcucuucuaaauuuuuugaaucauguaacugcauaacauguuaaaauuuugucgaaugauauucagucagaauaaaguaauaaauauugaauaaacucccaugauauaaccauugugguugguuuaaaaauuaaguuuuucuuuuguauuaauaugaaaaguuagauaacguauguuuuucaucucugcagaaaacaucaggguuguggcagaaaugucuugauggcuuucuaccuuagccuucuugaauugguugauacauauuacucauuugugcaaugaauaaaggauuucuauuauuauauggacccaucaucuuaugacuguuuuuagaaaaugagaauuaaaucuugauucauuauuaaauaaccuuguauacacacaugaagaggucaugacacauaagacuuugaccuaauaccuuuuuucagauauguuucuauagcuaucuugauagccuaggacuguuugagagaaaauuaauuuaaauuuuugucauauucuuagcaaaugcaaaauaauugaguuaaacagaacccacuacauuuguucugaaauaugaacaauauucucaaauauuugucugguaguacaaauacaauuauauuaauuuuauuauugaauuuugcugcuucaaagggagguauuucuuaaaugauacuugauucaauuauuucccuuuuuuuccaccuugcacagaacuaucguaccauggaaaguauucagacagugccuucaugagguccaccagauuagcucuggccuggaagcaauggcucuaaaaucaacaauugauuuaacuugcaaugauuacauuucaguuuuugaauuugauauuuuuaccaggcuguuucagguaaguuuauacuugcuuagucuauccauucccuucuucucucucccugucuuuucucucuguuucucucucucucugucucucucucacacacacacacauaaacaaacauauggaaaauagugucauuccuauuagucuguaauuuuauugguauguuuggucauuguuaaaaguuuagagugagccauuuggcuuaaguuuggaguuaucagaugcugugagccugguggcugcuuguuagcuuugagaggauccauccaaaagagcuuuguuuuaaacucucuacuuaguuucuuacuuuauuuuguugaucuuuuagcacaaugauggauagaaugcaacaacuggaggugggcauuugccaccuagaucuaaaaucuuucccuuugccuucuguguuuauuaggucaaaagggaaauaguaaacuuagaaauaucagacuguucuguauaggacagaacuguguccuguacuuauuuuguaaauugcuuugcacauucaaccauguguaaugaacauuuuucaaagucaauaaauauucuucaucaguucccuugucauauucauucaaaauaguaugucaguauuaacaaagcucucuuuugaaaaauuuaggucuuuucccacauuuucucuaauguaaacaacuuuaagaugaacauuuuuguugugcuuauuguuuuucccuuuaaauuaucuuccauaauuguuuucacauagcaaauuagaagaagguagcauuauauggauacuaucauuuucuucuuuugcgugccuuaauggaauuaucuuaaacaugaagacuugaaauuuguguuuugagauugacucugccacuaaaauguguaucaucugugggauucaguucaaguagucacaaaauaaaaauuuucugcuuaacauuuuuaugauuugguaacauaaauuauauaguaaaugagguaaauugaucagacugggcuuacuuauguucugauauuauuuuuuaucauuuuaaucugaaguaacauugauucucuuugaaacaugcuuucaacaaauaucagaguauaauguugauuucauguuuuucauguuacaugaacuucucugauuuauaauucugcuuggcacuagcuagcaaggauuggaugacugguuuuuguaauaaaaaccacaaugcacaggauuagcuuuuaauuuaugaaggaacccauuauuagaagagagauuaacuccugucaacaguacauauaggaugugaaaccccgccucuacuaaaaauacaaaaaauuagcugggcguggugaugagcaccuguagucccagcuacuugggaggcugaggcaggagaauggugugaacccgggaggcagagcuugcagugagcugauaucgugucacugcacuccagccugggcaacagagcaagacucugucucaaaaaaaaaaaaauacauauaggauauauuucacuucauuacaauuacagaaucauaauucuaccuucuauauaggguaagcaauuacauaaaucacugaugaaagugugcuuuugauuauuuuaaauuuuuuaaauucgugauuauucccuugguguauguauuacaguuugacaguuuauguuuuuuucaaagauuuuaagauauauuuuagaaaaaaaaguugucugauauuggucauuuuauaauggaaccucuccuuucuuuaaagguuucugauaauuuuacagaauaucuuauuuauuuaacaugauacaaagacauucuaaauaguaagagcuuugcuucuucaccuugucaaggaagagaguaaaaguaaucuuccuacauuaaaccuaacugcucauucuaggaagugaguauauuuuuuuguggugagccuggaugacuuuuuacuguggguauuaaaugcuagaauuccuugcaguuauauauugaaaguaugagggcaacuuaauguugguuaaacgauuaccuaaacugcuauuuaguauguggacauauuuucuuauaagcuguuuuacuuuaaaacagcacaagucaaccuuaauacucuaaggaauauauaucuuauuuacuuucacugggaugggaaaagaaagggcuauuuuuaagucaagcuacugugaaaaguuuuauaucauaaaaugaaaaucuuaccugggcuagggaaugccuaaucauuuuaaaaacaugauuacagaagcagcugaagaacucuuguuagcccguguauuucugagauucaucauuccauuuauuucuaugcuguaaucaaaugcuuugaauauaaucguaugugugccuuaaaauaugauaaaauugauucuguuuauagagaaguagaugguuuaacuuuugcugaucuuuuauuuuuauaaaacuuuaaaaauuaagugauuuucuuaaauguauuauauuuauuaaauccuuacauuuauauauucuguaugaaaauauguuuugcuaauacugugugacugcgggaacauacauucagcuauagccaugauauuaguaguuaauuggcagugacuucugacuaaauuauugggagugggguauuuagcagaaagggaacugaaggugagcaagguacacuuagaauuuggggucugaaguagagaaacuagcagaagaaggagccagugggggggcaggagaugaaguugagaauugcagagggaaugaaagaaguaaaaauguuugcuuccucuuggcuuucauucuuauaugcaggcagaaccugaacaaauacuugggagucacuggagggaucuuacuguggucaccuuccucauuuccucuucuuccuucuuuccuucucuuuauccuucucuuuucucucaaagucacuuagagaugcuggaaucagcacaugcuaauauuaguccuggaaagaaauuauagggauuuugcuucucccuuccuucucccuggggcuguuguuccccuuuuccucuauauccccacuguuagaaaaaauggggucacugagaaauggggcacuacauuuggggguagcaggauaaggacggaguauuuuaguagaauauccuauugacuauggaauguguagcaucaauggaauagugaggaaaaucaaagaagaggaaaguccucaguuguaguaaagaauuauagagagugucuaggcagaccagccaaggacccucuuccaacuuaaguuguaagucaguaacuggcucuucuugaaaauaguagcauuugggagaauggagggacuugucuccuuuauucacuucauuaauuucuauagucauuuaaaaguaucuagauaauuuuauguucuuguacacaaaaaaauuucuucaaucugaaaaacaaaauaaaaaaaaguuacucuccaaagcacuuuguuuugccuuuuuuaagccaguaguugucgaaauacuuuaaaaagaaaaagcacauaaguacuacauguuucuguuuugaaugggcugcauacaaggaaaacaauacacagacucauucuauuacauaaauauuuuugcaauuagaagcuggcccucuggauuauguacuaagaaaugguugcugaauacuguagcaguuggcucaaaacuccaacuuaauuuuuuuacuuguauuuugaucugugcauuggugcucuauaaaguuuagcauuuuuuuucaaacacucuuccacuaauuuguguggacuuuaauggaagugacccaaauauuuguuugguauuucuuucauccuuguccuucauagauggguagaacaaaacaaaacaaaaacuagggucuagaauaacaguuauugcucaguuuuuuaaaauauaugcugacauuuuccaaguaauguuuaaugcaguuuuuagucaugcauuaggaagaaaauuaaaaacaugcauuuuuuucaaccucucauauuauuauucucuagagcgccuuucuugcccaauuagguauuuuagugugauggggaaauaccccaaagauuuuucuuguuauguugaaaaaggcuaaaaaacuucauuauuacuaaaucauucuuuguuauccucaucucaagggauauaauccuugcagaauucugccuuguaaauuuguaacuugcuuaacaauaaugaggaacaagucucaaaacaaacaaaagcaggaacuuucuaccaguaaucaugucuaggaugacugcuuuaacagcuuuaacauggcaacguaaaaauacuuuuuuuuucuuuuauguagaagauuuaauaaucuggcacaucagauagaguaugcugccaguuccuuggaauaaauguagcgucagccuuaaaaaaaucgcagagaugauucauccacacccuugaguaaaguugucuaucacugacugccuuuuuucucuugcccugguaacuggagagacaacuaaucagauuaaagagagaaugauacagugguacaaaccaaauacuucugugaaaaguuuuguuuuuauguaacucacuuuuaaacccuaaaccuuuccuaagcuuauaguucuguacaguuaagccagaugugacuacuguaguguuaacacuagccuuuuacacaagucacuauuuagaggaucuaucuguucaaugacaauuaucccuggcugauuacuauuaucugacacuugcauugguccuggcaucccaugggugagcaagacaggcaugucccuugcccuuauguagcuuaugguuaauguguaaccuuugccaagucaugcaaguucuaugauaugguuucuuacuguguaaaaugaagcaguuguuaacaguuaacagacauacagggaggugaagaauauggcaagagguaacaauuuuaaauacacuggucagagaaggcuucauugaggaagugacauuuggagacaggaaugagauggauauuugggggaagaaaauucaaguaaaggcaucggcaaauacaaagucucugagggggaagagggcuuuuuuguucaagacaauagcaggcuggagaagaugcagaaagugggagaguuauagcagauggagacaaaaaagggaacugcuggggaucaaaccuuguaaaguccuucuaagugauauaugaggacuuugacuuuuauucaaaguuagaaggcuuugaacaaaagaauuauuucauuuguguuuuacaauggucacaagugccguagcgagaauaggcuguguagagaagagauuuugugguuuucuuuuuuguucucuguauucucuuccugaaaaaucuguuuucugccuaaucauauuucuguaaagaacaauagacuugaacgucugcuguuaaguaacaaagguugaccuaaaccacauaaggucagauuaacuuuuaaaauauccaagauaauguuaaguguauuaaauaugguucaguauguaaucaaaauauuugauauucucuagauacuaaucucuuuuaauuuuuuuauuuuuuagccuuggggcucuauuuugcggaauuggaauuucuuagcugugacacauccagguuacauggcauuucucacauaugaugaaguuaaagcacgacuacagaaauauagcaccaaacccggaagguaagacuuuuuagcaguaauauuaugugauauauccaaagaugaaaaauucuccaugguuuguuccuaaguaagucagcaauacccgcugauggcaugcuugggagggggcuagaaaagguaaaagaccaaaauggugcuucuuaacauaauguuuuaaauugauacauugugcuuacucugaaacuugguauucauaaagugaaaggggauauggucuccuuucuguuuucaugauauccguguuuaugugcaaaauugaauguauauauuugaauacuugaauacugugcuaaagaacaaauaaauagaacagucuuauguucauuacuuuaggguauuuuuaagacauucauuuaggcucucugauaaauauaaguacauauacaugcacaugaacacauaaauauacauguaaguuuaugaacaaauacauguauguacauaagcauauauaaaccuauuguuauaaucaaaaccaauuucguguccuugaaaacuuuuuucauaaugccucguguuuuauuauagccucagaauuuauauuuuauuuuccacaugaugaaacuaaaugagacuuggagagguuggucagccccuguggcuuuggccaagaaauuacaccuuauuaauggcaaaucuggauccagaaaaucugucucuuccaugguucagugcauuuucccauguauuucaucuaaaaaugcauuaggcccauaguaggcauuugugcuauggcaggcaguaugcugaguacggcaguagggauauuagagaccugcuugucagaguccucacauuucagaugcuauucugguauucauuagugcucugauuuucauauagagaacauuccauuuuagggaugaauuuggugcugguuuuuaagacugccuuuuuuuucuaguaucauuuuuauuugguuuaugguguauauaauguuuguacuuuauaacauuuuuguuuuguuuuguuuugcuuuguuuuugagauggagucuugcucugucaccaggcuggagugcaauggcacaaucucuguucacugcaaccuucgacucccugguucgagcaauucuccugccuuaaccucccaaguagcugggauuacaggugugugccaccacgcccagcuauuuuuuguauuuuuaguagagaugggguuucaccauguuggucaggauggucuugaucuccugaccucgugaucugcccaccuuggucucccaaagugcugggauuacaggcgugagccaccaugccuggccaaaacaguuuuuuuuuuaagugcaagccaauagugcugauuuuuucuucucugccauuaugaaaauuuccauauuuuugucuuuuuaagaauuuauauaguguauuugaaaaaggagcuagugaauacaaaaacaguuuggcuuccacugaaaucuucuauuuagacuaaggagaguuaguucucauuguaaccaugagagaaggucaguuauuuugcauauugacagugguuuagaugaaugauuuucuuucauucaagaaucucucaugaccagauuuuuccauaguuuuuacucucuugaaugacaucauauaaaguaucuuucuugcucuuggcguaugaugugaaaaauguguugugguuggaauuaugcagucauacaaaauuuaacaugugaguuauuugauaaauuuucuuguccaaucauagaaauaaugagggaacugaggccuuuauuuuugguuuuguuuucuuguucaguaucauggagaacaugaauuacaauauugagaacaacagccaggucucauuacuauuuggaaaaguucucuuaguaaaaaacuacugcccucugauaagaauaucauaagacccaccaguaaacuuaucuucaaauguguacaauauauacauuuuauacagcuuuuuuguauaucagucauaccuuaaaaaacuagaauaauguccucugagaaaaaaauccuucuuuccuuccuaacuugccauguaaugauuuuuucuacuaaauuuuagguagcuaaugaugaaauaaauaauauauaacaaauuauaauguguaaaguaugacauggguacuaaagauguguuuaggaaaacacccuuaaugaauaaaaaaaaaacuguaacaaauauuugcuuuggagaauaucuguguuuaacauuuuuuuuuuuuuuaucuuggaaaguauuucaugucuuugacuucauaguauagaaaacaauuggauuuacuucaaggacauuuuggcuccuuagguugugcuuuauuauuggggauccaucugacaaaauaugaguuauggggugaagguaguaacauuuggaaaucuaagugaaguauucauuaggugacaagaguggcauugaacccuaaaccaccucgucaacaugaaagauacuucauuuuauaugcauauauauauuuuuuuuuaauuuuuuuuuuuuuuugagacagagucucacuguguucacccagcaggagugcagugguacuaucugggcucacuguaagcuccaccuccuggguucaaacgauucucaugccucagccuccugaguagcugggacuacaggcauguaccaucaugccuugccaauuuuuuuguauuuuuaguggagacggguuuucgccauguuggccaugguggccucgaacuccuggccucaaaugauccaccuugcucagucucccaacgugcugggauuacaggugugagccaccacuccuggccccaauuugauuaaaugaagcauguuguuuaagagagcaaggugcuaaaaauaagccaaaaauucacuugagguugggaagggguagccaccagccaaagggucagcagcaaauuaaauggaauaggaaaaaggugcaugagaggaagaaauuguucuaaaaugcccuuggcucuuaccagauugcugguauuacuaucucuuauauacaugaauugcuugaaccuucuguauaauaaugaguuuuagaaacaccaucccaaaacaauguuuagagcaacagagaaggacaugaauuaaaaaugugagcaauuucacaaguauguauuucaguaucuacuagauucuuacuauaugaauaaauuuggaauuacauuuaaaauuacuagcaaugcagauguguaauuauuuucuucauguuaauacacuguaaacuuugcugagauucauaguacacagauuuuuaagauuuuaacuuuugacuuaauuugaaggaauuuuaucauuaauuuuuuuauguaacauuuuaauaauguccuucugaauuauaauuuauagugacuuucuauuauuuuuggcacuucucauaauaucauagccguaggucucuguggcauuauuuuaucugauuuugauuaagaaugccaauaguugacagauugauauccuauuuucaguuucucuagggauauauguuuuuagacuuuuuugaaaaguucuuuccaaagauucuaucaccaauauaaaguuuuuaauauuuaaaaaucacuucuuuuuuuaaauucuaguuuguccaaagaugaaauuacacucuacuacuaaauauacaaguuaauuaaauccagugacugcagccauuauguauguuaaaguauaucuuucaaguuacauuuauagugcuuggucuaucaaugacuaaaguauauuuugacauacuugugucugccacauacauacagcagcucgaauauuaaaauauagccaacagauuuaaguugguuuguuuuugaucugcuuaauggguaauaaaauccagaaggauauccugauagaaagauugaaugcaguacacucaaauaaagagaaaugaucuaaaaugaaauaaguacauagauagcuaaaugaauacauaaaugauaaugauggauuuaaagccaaguugcugccuccuuuuguuggauauuaguuucaagggacuugauuugauuuauauuuuugaacuaucuuaacuuccccuuguaagauacugaauuugacaugguuagauggcaggcaugaaauuaccuaguuugcacuuuugagcuuuagggaugaauggcaggaauaccugaaagaaaaguuacuauuuuuuuaacaguuggccgggugcgguggcucacgccuguaaucccagcacuuugggaugccgaggcggguggaucaugaggucaggauaucgagaccauccuggcuaacguggucucuauuaaaaauacaaaaaauuggccaggcgcgguggcucaugccuguaaucccagcacuuugggaggccaaggcgggcagaucaccaggucaggagaucgagaccauccuggcuaacacggugaaccccaucucuacuaaaaauacaaaaaaauuagcugggugugguggcgggcaccuguggucccagcuacucgggaggcugaagcaggagaauagcgugaaccugggaggcggagcuugcagugagccgugauugcgccacugcacuccagcaugggcgacagagcaagacucugucucaaaaacaaaacaagcaacaacaacaacaaaauaacaacaacaacaaaaauacaaaaaauuagcugggcgucguggcacacgccuguagucccagcuacucaggaggcugaggcaggagaaucgcuugaaccugggaggcggagguugcagugagccgagauggcgccacugcacuacagccugggugauagagugagacugcgucucaaaaaaaacaaacaaacuaauuuuaaugucuaaauuacaaaggaauauaucgaauucuaagccugggugacagaguaagacuccgucucaaaaaaaaaaaaaaaaaaaaaacccuaauuuuuaugucuaaauuacaaaggaauauauugaguucuacaguagaaacuggcucaguuuuugucugagguaggcaaauuaaauuuaaauuuuuacuuauuuauuuuauuuuuacauuccaagagugauuuauuuuguagcuauuccaugccaucagcauuuccauacaccgcauccugaugaugaugguaaaaaaaucccuaguuuacaaucuuguuuauuuucuuauauauguaucuggaaguauuuaaauaaaaagaaaugaucaguguuucucuuguaaauugauaaauggagaaguacauuguugcuaaaaauaaguuagaagacagaauaugaggaguauucaggaauucuaaaugauuguuuauucuuuugcuuggaagaaaccuaacaaauuguuuaguauugauuuauauucugaauguaauuagauguaauuuucuuauguuuugcagcuauauuuuccgguuaaguugcacucgauugggacagugggccauuggcuaugugacuggggaugggaauaucuuacagaccauaccucauaacaagcccuuauuucaagcccugauugauggcagcagggaaggauuguaaguaugagaaauggaaguuggagugcuuaugauucaugaauuugaaaaauaaagauugcuuugugauggcgaaaauggauagcaaggcugcuuuuuauguuaagacugagaaauaauggauguuccuuaguuuuuuguucaucuuuuuauauaaucauuuuaagguaaccuaauuauuugaaacuauguuauagcaaauacauuucaacuucaaauuacaacaugaauuuuuaucuuucauaugauaaaaacuugggacuuaaagguaguuuuaaaauggauguaaaacuguuuauauauuaagagaaaauuauuuagaauaauugacuucuguuucuucauauaacccuuagaauacuaguuucacuuuuucuuucuuuuuuuuuuuugagauggagucuaacucuguugccaggcuggagugcaguggcacaaucucugcucacugcaaccuccgccuccuggguucaagggauuccccugccucagccucccaaguggcugggacuacaggcgugcgccaccaugcccugcuaguuuuuuguauuuuaguagagacgggguuucaccguguuagccaggauggccucaauuuccugaccucaugauccacccgccucggccucccaaagugcugggauuacaggcaugagccacugugcccagccaguuucacuuuuuuuauuuugauuguuagugccagauuuucuuuucucuuucuuaucuguuucucccuccaccccuuuucuuuucucucuguagaucuuuccuuuuucacacuaauaauaacuccauauucaggacuauauguuaauagcuaaguuuaguuuaucucaagcuauuccuuuuuaaaauuuaaaaauaaguuaaguuucccuuuguuuuuuagauuaauaaugaauucucccccacucacuccacacacaaaguauggacaaucuguugggccccuucauaguaaauaugucugauucuucuuauuuguuuuauucacaugccuuucccuuuguccucuccuuguauucucagugcacuugaucaugcugcuuuuucuuccccucugccuugcuggauaacuuagagaugcucgugaucaaacucgcugcaguaugaauucugguagaaaccuagaaggaaaaaguccaccagaguuaacaaagagcaaaugauuugaguuuuaccuuuaucaaaguaauugcaaaaaagaaagaaagaaaagaaaaaaagugaugagauuuauacaaagaaaaauuaggaauuucuaaaaaccuaugagcuuuugggugggagugguggcuuacgccuguaaucccagcauuuugggaggccaaggcaggaggaucacuugagcccaggaguucgaggucaggcugggcaacauggcaaaacccuagcucuacaaaaaaugcaaaaaaauuagcugggcaugguggcgcgugacgguaguccucgcuacucuggaggcuaagauggguuaaucaccugagccugggaaguugaggcuacagugacaacaucgugccacugcacuccagccugugcaucagagugagaccuuaucugaaaaaauaauaauaauaccaacacacacaaaaccuuucaauaaauuaauuacauaguaauuguauggcaaguuaugguaccaaauguguauuucucuuucuuuuuccuucuaauuuucauaaauuugcuagugucgguuauuuauaccuuucuucuaaugcaucaaagcuuuguguauagauuuugauuuaccaugauuacagauuuuuuuuaagaaaauauacuuuaaaguuugaauuuauaaguagaaccuaucaacaaccuccugauagguuaaaaagaaccuuuaaccuuuccuaugguacccuaaucaugauuuuuguaaucuuuaauuucugaauucuugcuagaauuucuucauauuauuugaaaugugauacauaaaauuuuauauaauauuuuuuuaaauggccaauuuuuaggguauauaaaaaaguugcuuauucuucuuuggauuaucauuccucauuuaauguuugucaaauuuuguaacacacccauaaggacauucuaaauuuguaucauacucagauguaguaaacuccuuuugcuaaaucauaaaaaaaucaucucacugauuugucccuuacuauguaagaauuaucuguccuuuaaguucauuuuucugguuuuccuggguaaauucuaacacuuaacauguuuguagacuccucauucgaggauaaauauuuuuuguuauuuuaaagaauagauuuguuauaguuuuacccuuuaaaauauacauacuacaguacuauauucuuauuguuuuauuuaagaaauuuaguauagaaagauguuaaacagaacuaaccauaauuuaauaaacugaugaaauacagcagugacauuaccacuuuuuucaauuaaaaauaaguauuuaccaacacaguaaauuuuauuuuuuaaugaauuuuucaauaacaaguacaacuucugauuuaacacagcaagaaugcauuauuacuacaacuuuuaguucagauuucaguuuucccugauaauagaaccuuguaucuauagaccauuuuguguuuguaguguuaagucaaugaaacauggaaacguaacauuuucuaauuuuuuaaaauguguaugugccugugugucuguguguuugcauaugugcacauguguuuguguuaggugaggggaagaugggagaagagauauggaaacuguagaaacaggaauaccacagaaguguuugaguaacuuacaagaaaacuguggccuuuaauuauauuuuucuuuccaugugguauuaggcaugguguaaaaugauaccauuauuaccugugccucagaugaaggauguaauaguugcaaauagguauaucuucaaaguguuuuggaauacaacaugauugaccagugaaauaaauucuuaacuuauauaagagacauauauuaaagguauuucauugaaaaugguugcuuaguggguuaggcuauauucauuauguauuucuuauaugaaaauucuacauuuuaaguguccuaaaaacaacauaguaauuuggaaacauugaaguaauauguuauugauauguuacaugaaaaggaaacauccaaauguauguuugaauauagaaaaauuugauuaaauauccuuaaaugcaauuaaaacuuguauauuuaagguaauaaaguuucuguuuaaauucaguuaucuuuauccugaugggaggaguuauaauccugauuuaacuggauuaugugaaccuacaccucaugaccauauaaaaguuacacagguaaggauaauugcuagaaaaguauaauuaaauaaguauccauaaugcccuugaaauaaauaagacucucuuaguguaguuaaaaucaugcacagguauuuaauacaaaauauacuuaaggaauucuaagaguguuuaaggagaaauuauauuacuuucuuagauuuuuugauacaaauuuaugcuguuaaaauucuugcuuuccauauaguauuggcauuuauaugggggaaauaaauaaauccauaagcaaguagguggauguaaggagagagccauaguuuagaaagcuaccaaaaaaagauuagaauaauuauaugccuuagauuuuagagucaaauggguaauugaagccuguugaagauaacaauuauguuuuucuaaauccauugcuggcagccucauagcuuaugaauaggaauguaaguugguaaaaccuuucuugagagugauauucagugauuauaaaaaucuaagugaaaauaucuuuucacuuuaaauucuauauauguaauagaucccauauauaucacuuacacaugcacacaaaaaucuauacaacagguauuuacuguaauauuuuuuguaaaagcgaaaaauuacaaaauacuaagaacuuuaguaauagauuaaauaaaauagacuacuguucucauacuguauugugugaagucaugaacaggagggagguagcucuacauacucacaugggaacuucugcaucuuguacuguaaaauaauuccauuuauguaaaguacauguagguaacauuucauuuggucaaguugcauuauguacguucaacuucuguaaggaaauaauuaauuaauugcuguauaugaacaugugaguauaguuuuuaaaagaucaaaaaaacaccaaacugguaagaagauuuaacugaggaggugaaaagggauugagcagugagggaggggaugaagggagaacuugaauauuuuauuuuauauucagucuaguuuuaaaauauuuuauauuugagauauguucacgccuuguguaauaaguaauaaaaaucuaagggaaaaaacaagagaagaauuacagcuuuuuuuaagacaguagauaauaauuuaccuuauaauucuccagauuuccuuucccauggucuuuacauuauuaugugagacauacacauugacauuuauauguacauauuguacguguaaauuuaauaaaugauugccuuguuuuucuuuuuuugagacagagucuugcuuugucgcccaggcuggagugcagugacgcgaucucggcucacuacaaccucugcccucuggguucgagcuguucucuugccucagccucccgaguagcuggcauuacaggugccugccaccacuuccggcuaauuuuuguauuuuuaguagagaugggguuucuccauguuggucaggaucaaacuccugaccucaggugauccacccgccucgcccucccaaagugcugggauuacaggcgugagccaccaugcccggccaugauugccauuuuaaauuuaauauaugauugccauuuuaaaaguuauguggugauccuguauuuucaaauaugugugaaaggauacuuaggaaagacaguuccucuuuauaaagccauuaaaaaaauaaaucuuuggaaguaauaacauccccuuaaauuacucauaaauacucuuacuguuuagguugcauugagaucugcaucuuugauuuuagcuuaauguaauuuuuuuuauaauugcauauuuuuccuuuggacagucauaaccaguaucaauacuuaucuauuauuucagggacaucagcaauuuauaacuuacuuugaauuacuuuaguuuuauuucuucuccauuuuuaugcauucucucgucucuuuccuuaaguuccccacaaaauuuuuguauauucacacaucauaauagacacaguuuauguguacauguguguaccugcauguacaugcauauguauccauguauguuuauguauauguauauuuuucucaccaggauuauaauauauuuuaguagucuguggacuaaauauuauuauuuauuuauccuacuccgugccaggcacauuguagucacuuacugaacuaaaaguugcuuuauuuacccaaauauugguuucauaauuccuuuucuuuguauuccuaacaucuuuuuucauuauuuaccaauuuauuuguauuuuuucaaauuuaccaauuuauuuguauuuuugucacgaagaucuuuucaguauuugaauuuugaaaauuuuacugugucaaauguuuuaagcuaaaaacccaaucaaucaagaacauugcaguuuuaauaaaaugguuuuugguuacugaagugauuuguuuucuugacaguguuagggaaagcguaugcacuuuuuagucagaggcuuaauuuagaguuugaagcaaacaaguuaaacugauuaagccccaggccuaacuuuuguuaaguucaauauaucuucuugugcuuuggagaugaagugaaauaguaaguguggaccacagugccuggcaugcgggaagugcuugguaaauguuugucacuuuucuugcauucagggauuucuaaagauauugaaacaguaaaauuuaauguuuagccaaguaucauuuuuuuuucaauuugacaguuaaauuauaugagcauguggcauuuauaaaaaagauaaagucauuuuauauuccuauuuuaaaaccauagauuuugucuuuugagucaccaugacuauugaagcaagucccuuccuaaaggaacaguaaaggaaccuuaaauaauaugaaucauuaagaagcauguaagauagaugauaaaaguucaaaccuuuuuaaaaugaauuuuguagaccaaauugugauuaucaauucaaaacaugucucaaaugguaacaaaauucugacaaggucaauugugagauauugacugugcgucauuuuauuugggaaaauuugauacuaacaauuugugcuggaaauacauuaacauuacuuucucccuccuccccaaauuccaggaacaauaugaauuauauugugaaaugggcuccacuuuucagcucuguaagauuugugcagagaaugacaaagaugucaagauugagccuugugggcauuugaugugcaccucuugccuuacggcauggcagguauaaucauuagcaacauggaugucuuucuuauauguccuacuaauauuucucuuuucaguuuucuuaaugguuuaggaaguaaugcugguaagugcuuuguuugaaaugauuguguaaagauuuuauauguuugaguugcuauauauaauuugauuuuuaacuaucuuauauuuuaucuuuaaauguauaaauuuuauuauauuagucaucaguaguucuacuucuguaguaccauggauuucaguauguucacuuauagguauuaccaacuagacauuuuuaugccauuuauugauaggucagaaucuguuuguaguaggucaguuucugaagccaaguaaaccauaguagauaaaucuuauuuugauauuuucaagcaaacuucuuuacuccugaggaggcaugguuccugucucacauaugcuccguagugcugaaauuggagaaucagacaggaaguaucucucaaacacuuauaguucccacagaaacaggcauuaaaguucccuauuuacugaagcauaaucucaggcaaauugccuucccaucugccgcaggcauucaauaaauauaaauugauuugaaguuuuauaggaaggucuggagaauaacugguuuucccaaggacuuuccuuuuuuuuuuuuuuuugagacagagucuugcucugucgcccaggcuggagugcaguggcacgaucucggcacacagcaagcuccgccuccuggguucacgccauucuccugccucagccucccgaguagcugggucuacaggugcccgccaccgugcccagcuaauuuuuuguauuuuuaguagagacgggguuucaccauguuagccaggauggucucgaucuccugaccuugugauccaccugccacggccucccaaagugcugggauuacaggugugagcccaagggcuuucuuauauuucuucaucuguaacaaagauuggggauuuuuaaaauggaucuuuggacagauuuccaguuuugaguauuuggaggagucauggaauauuuugaucaagccauuuugaaacuguuugacauaguuauauugaaguuagaaguauauugauaggguuuagaaagcaaauaauuaaauuuucuagucuuuaaaaaagauuuucggugaagcauaaaguugacauuccuacccuauuucuaagcccucucaguccuugauuuucuuuguccaacccugcaucucugcaugaguugaggaaggauggacauugaggcucauggaagggggcugacagacucagaggggcauugaugccugccgagcuccuuacuuaguaauaaaauauaaugauuuucccauuuucauagucauaaaagggccugcuucuucuuuugugaauauuuuuuuaauggaugaggaaaagaggaagaauuaggaaaugaauuacaguugauuuauauuuucaaaguccuuucugaaugcccagagaucuuugcuaccucaguaacguuguucaaaaucccuauacuucucuucuucauaugcauuuggcuuauauuuuguuuuacguuuuucuuuauauccucucccuuauuuccuuuuaucccuucaugauguuggcgaaauuugcauauuacagggagauguugaaggagaucauucucaacauagauacuugauuccuauuuaaauuacauuaacaguaauaguucugcaaacuuagcagugccuuuuaaacuacauucaauaaauguagauauguugguagaagacagaauuguuugcaaguuuauuucaaaugugucaguaggagguauuauagagauauugacucagugauagauugucuguaauuggacuacuuaggauugguguaccugauaaucauucaguguuucaggauacguguuaaacuaacaaagaaaacaaauuguauuugucacccuucuuugccuucagggugguagugugguuuuuacaaguacaaagaaacuaaaagccuugcauuucucccugaagaaaaucagaauaauaggcugauacaaauuccuaacacucugccuccaugcagggcuuguguauuucagccauuuuucuuggggcuccagucuuagagcauacacaugcauacauguugcaagacuucacaucuguaacucaauacugugcuuaguauuuggagguuaaguugguuaaaagucagaagcugcuaugaguuugacagaaacauuuguuuaguaaaauguuuuguucaaagcaucauacaaaauaguuuacuggccaggcauggcggcucacaccucuuaaaucccaguacuuugggaggcugagacaggaagauccccugagcccaggaguucgagaacagccuggacaacauaaggagaccccgucucuauaaaguaauaauaauaauaauaaaauaguuguuugccuugcagcccagggugaguagaaaaguauggcugaauauaaagcaacaaauauuuauuuuacuuucuauauacuucuuaaaagaaaguuuauucuuaguaaauaaauacuaccuuuacuuaaguccuaacuucacauugucaguacauucuuggaaacugcaacuuugagcaaagugacauacuguaugcuguaggaaccuuaacucuuguuucuaucaauuagccuaggguaaaauggauuucauuauacaguaaguuguuucacuuaaagucucaauuuccaagaacuaauuaacaauauuaauugaggacuuacuguauuuauuuguuagguuugugaacuauuugcaguagguucauuaugugcaaaaggcauaggaacauuucccaguugucuuucuguauuacuaaugcuguguaaucaccacaacauuuuacaucaccacaacaugucuauguguuacugugcauucuccaaauugguguaguuccucuugcuuguugcuuaucaauuccuugaauuauuucaugauuuuuuauauuggccuaaugaccuuauaugaagauauguucaguaauguuaguaaguuguuaacauuuacuauuucucuuuuucauucucagcuacuucucaguuuuacuuuuauaaauugaggaaguacauaauugucaagcucugaaaauuguguuuagcuaaaauuuuaaaaguuaugugagaguaauaguuuacuaaguaaaguagaaacaaaaaugacaaauucaaaacuauucagaagguugaaauaauaaauuacauuuauguuacuagacaguaauguuauugucuuaaucugaucauugaauuuugcaccuaaauuaaugaaaaauaugcaaaccuuuauuuucaguauuguuuuugaauucuccucacacaaagcagcucaucauuaauaagcauccuccugauacauuuuguauauguuucuguaagcucuuaccucauuauguucauauuguaaauauuuccauauuuauguauuuucuuucuagaauguggauuacuuuaccuauuuuagaaucucucugcuagcauguuaucugcacauuggucauuacgcaguaaauacuuauagauugcaugcuagguaauguaaaagaaaaggaagucuaaaaguacauuaaauaaaaagacaguauuguagguugugaaaagcucuuacaauacuuuucugagaauuauuuaugaucuuuucaaagaccuuuuaucauacuuaguaucugagaacgaauccuagaauaucuaaggcuuaguucccuuuguuccauucacuagcuauugugugauuuccuuaacauuuuacauugugauuuuuuuccacccauucuugaaccauguuauuuuacguuuauuguaugcaguacuaccagcacuaacacagaagcaguaagacugcauuuuuaucgcuguuuuacaccaaaaaaaaaauaugcacaguaauccccgguucauguuuucucucccccuaaagaaaauuauucuuaggucaauaauucuaaauugauauuucacagucucuguaucucagugggaucuuacuggucaaaggaaguuucaacuuuugaacauuucuacuuuuggauaaucuaaauauuuuuacauuuagauacagucuucacguagugcuuccugccaacuagcguaucuguuuuggcagcuuuuguauuauugcaugaacaggaauguuuguugaucauuaaaauauguuauugcaaaaugccucugguauuuaauaaaaauaaaaguccuauaaaguuaaucuaguuaaagcacaguuguaaaacauuagauaugcugaaggucucguaucuguaaucucaccuagcugugcucacuugacuuaaccuaauugaugauaaauaugucaguaagaagaacaaaauuauagcacacuucauaguuccacaaaauauugccaaaagugguaucuaagcuuguacauauauagagaaauguucucaagguauuaggugucuggacuuagauuaaaauaacuuacgucucucuuguucaauuuuuuccucauucaaaaaugguaccuuaaagacauuguuuuuguuuuauaugauuaaauuugcaagcuuaacugugcacaggaagaauuuguuauuuugcuucuuccucuuacugguuugguagaagcaaaccaagaugguuucaacuaucauuuuccauuuauuuauuuauuuaggaaacauucuuugagcagcugcaauaucccauguucuguaguaugcucugaacugaaaagaacucugagacacaauccuuagcuccaagaaguuaaaguuaaaauuaaaccugaaauuucuauuaaggggcaugguguuaauaauuacuuaaaaugaguauccuguuauccuucaaauuuaauuauggcugcuagacauuuuuucuuacuuucuacuacguugguugggcaugcugauaugaacaugauuuuaaaggcugcgugucugccaagaagcuaugauaaaucaguuagaauccaauaggaaauauuaaacccugaccauaaaucauacucugcucagcagugugcauuuuuagcaagucauucuucaccaacuuuuccuuccaucugaugcccuacuuugguuuaauugaaauucauuagagacuuaaauuuuauguaauuaacagaaaacuuaagaaaugcgcaguagcugugucaguaguuauaggcugcaagugguuacucuuuaauugcugucauaauggcccauuagucaugccucugaagaggugucagaugcuuuuuucucuuucugaaacaucuguguuauuuaauaaauugaauaagcaagcagaguuugcacagaauacuaaguaaguugaauaaucaccuuucuagagacauucuuugaaguaauacuacucugugugcaacauuuuugugcuacccuuaguaauaaaacuuggagaguugucuuucacauccacguguuaaugggacauuaacaaaacguuuaucuucucaacccugaacuucugcacaucuuccuuugugagguaguauauuaugcagcagugauucugcagcauuaccauguaagguuaaaaguuaaggaauuguuuucauucugugcuuauuucaggaaucuagaaaauggcuuuugauuuguaguucuccuugaagagguucuucacaucccuuguaaguuguauuucuagguauuuuauucucuuuguagcaguugugaaugggaguucacucaugauuuggcucucuguuugucuauuauuggugcauaggaauguuuguuauuuuugcacauagauuuuauauccugagacuuugcugaagcugcuuaucagcuuuaggagauuuugggcugagacgacgggguuuucuaaauauacauucaugucaucugcaaacagagaggacauaaagaaagaaucaauaucaugaaaauggccaaaaugcccaaaguaauuuauagauucaaucuauccccaucaaacuaccauugacuuucuucacagacuuagaaaaaacuacuuuaaauuucauauggaaccaaaaaagagcucguauaaccaagacaauccuaagcaaaaagaaaaaagcuggaggcaucacgcuaccugacuucaaacuauacugcaaggcuacaguaaccaaaacagcaugguacugguaccaaaacagauaucuagaccaauggaacagaauagaugccucagaaauaaugcgacacaucuacaaccaucugaucuuugauaaaccugacaacaacaaacaauggggaaaggauucccuauuuaauaaacgguguugggaaaacuggcuagccauacgcagaaaacugaaacuggaccccuuccuuauaucuuauacaaaaauuaacucaagacggauuaaagacuuaaauguaagacauaaaaccguaaaaacccuagaagaaaaccuaggcaauaccauucaguacauaggcaugggcaaagacuucaugacuaaaacacuaaaagcaauggcaacaaaagccaaaauagacaaaugagaucuaauuaaagagcuucuguacagcaaaagaaacugucgucagagugaacagacaaccuacagaaugagggaaaauuuuuacaguuuauccaucugacaaagggcuaacauccauaaucuacaaggaacuuaaacaaauuuccaagaaaaaaaaacaaagucaaaaagugggcgaagcauaugaacaaacacuucucaaaagaagacauuuaugcagccagcaaacaugaaaaaaagcucaucaucacuugucauuagagaaaugcaaaucaaaaccacaaugagauaaccaucucacgccaguuagaauggcgaucauugaaaagucaggaaacaacagaugcuggagaggauguggagaaauaggagugcuuuuacacuguugaugagaguguaaauuaguucaaccauuguggaagaugguguggugauuccucaaggaucuagagucagaaauaccauuugacccagcaaucccauuacuggguauauacucaaaggauuauaaaucauuguccuaaaaagacacauucacauguauguuuauuguagcacuguucacaagagcaaagacuuggaaccaacccaaauguccaucuaugauagacuggauaaagaaaauguggcacauauacaccauggaauacuaugcagccauaaaaaaggaugaguucauguccuuugcagggacaugguugaagcuggaagccaucauucucagcaaacuaacacaagaacagaaaagccaacacugcauguucucacucauaaguggaaguugaacauugagaacacauggacccaggaggggaacaucacacaccagggucugucagcggcuggggggcaaggggagggauagcuuuaggagacauaccuaauguagaugacugguugauaggugcagcuaaccaccauggcauguguauaccuguguaacaaaccugcauguucugcacauguaucccagaacuuuuaaaguauaauaaaagaaaaaaaaaaaaaaggaaaauggcuuuugagcuccugaauggaacaaaccccaaacuguguucuucauaucuuccuuccaaaauaaaaauguauaucuuugucaguuggauaugcagcuauguuuugaauuacugccaaggacuuuaauucaauuaaauguaaaauuaauuuuccugugguuauucuuccuguauauuguuugauauaauuuaaaagaaagauaucagcguauucaaaauaguaauuuacaaaaaaaucaauaaacucugauuuuaauguggaauaugauuaaggagauuuauagauguuccauauguagagaguguuguugggaaaauguauauaguugucugagagaggugagaaacaaguucaaaugaucacuuuuaaggcaauaagaaauaaucuuuggccaggcgcgguugcucacaccuguaaucccagcacuuugagaagccgagguggguggaucacaugaggucagcaguucaagaccagccuagccaacauggcgaacccuguuucuacuaaaaauaccaaauaacugggcgugguggcgggagccuguaaucccagcagcuugggaggcugaggcacaggugaauggccugaacccuagaggcagagguuucagugagcugagaucacggcacugcaccccagccuagguaacagagugagauucugucucaaagaguaaaaaaaaaagauaaaauaaaauaaauguuuuacucuaucuuccuucaaaggcgaccagucuucacauuucuagccucagugaaauuuuauaacuuagguacuacaaauagaaaauaauacuugccuuuacgaacguuuuaaauuggcacuuuugucuuuaaccacccguugugucuuuuguguaaaugagugauuaaauguuggagcuucccuuucacguugggaguaauaaagaagcugcgagaguuguccaaacacguuauaguaacauuaugaacuagagcgaugcacuagaaaaggaaaggaacugauggauaugagaaaauaaaaucugguagaauaagugcuugauucuuaagucuaaugacuaaauuagauggaugcccacuauauuguagaguguguggaccguaacagauacuggcacuuuggaaacauuuucaguugacuccaacauggaucuuuuauagguguuuuuaaaguugacaccauuuuuaaaaaguguuuagaauguagacucauucuaaaugaccagcucauucuagaccaacuucaugcauuaaaauuuuaaauuggauucaagcaacaaauguuuaaaacaaaaagcuuuuacuauguaaaaacguguccucagaaaugguauaauuauucagauacauuuuaugucuuccuguuaaagagcugaaacuuuucaauuagagcgaacagaauauucauugauuguaguaguuuuuuuaauuuugauauuugcaauuugaacaaaauaguuuuaaauuuuuuacauuuaugaaugaucaguaguagcaaccggcuauuuuucaccuuuauuuuaaccuugacuaugaaucugagauugaaaaaccacuacaugcugauccuauaguguaguguugaaaugauuagacucuugaaauagauccccuuguugugauuuccuacuuaguauuuuuugcuaugugaccuucaucaaacuaguaaaccccuuuuucuuguuggggaacaauaauuguaccuaccuuauaggauuaaaugaauuaauauuuagagagugcuuacaacagugccuggaauuuuaguuauuauuguuucuaauaaagugcuuaggagauaucucauauuuccaguuaugauuaaucuaugcacauugauaauucugcagguuuaaaauuguauucauuacauuacaaaauggaauucguauagagauacgaguuuuuucaaaaguuaagauauguuuccuuaguuuucuuauuauauuuauucuugagacuauuuuuauacuaauuaugccaacuggaauuuuuauagcacuuuauaaagcuuuaaacuaauuuaucucauuuuaucuuuauggugucucuaaaugugcauuaucucauuaugcccuguaaauaagaugcaaugaauugcccagugucacacagcuguaauuggggaagguagaaguccaguccaaguauccuaauucagaaugucugugcuccuuuucugauuuacuaugcaggcuuuuaugggcaucccaaaucaaaacuaaaagagucuagauucaccaaugucuuuuuuccuuguccaucauaauaaaccagaaccaaagaucucuccugcucuggggcauuuugucuaagauuacuauuaacuauccuuccuuauucuuucauucguucuuucagccagaaguuauugaguuucugugggagauacugugcuuugaaaauucuugguauggauccaaccuauucucagugcauuuauauacauauaauuuuuccaguuauaauugcuauguuuaaaaaaagauuuguggcaaccucauagcuacaugaaauauagcaagguaauauaaauuagaaguuauugauaaaggaaaaaauacauacauaugcauacacauacaguaaaaauauaaaaugcacuccaaaaugagacuuaggaggcccuauguauauacccuacagcccuugauguauauuacauaugugggaaggcauaaagugauugaccuuaagucaaaguaugccucuaauaaucaugcugagagcaaauaauuuauacuauauauaaugcuaucuugaaaaacauuuaaaagaagguauuuaagauauaguaugucugucuuagcaauauuuaaacaaaguauggaaggugauugauacaugaugaugaugagaugguacuaacaauauucauuuggguuuuuacauagaguauuuguggagaauguaguauuaugaagguuuaaaauuuuuuucuauuuguuugucaauguuaauuaucugaguuuaccuaaaguuauauuuuaaguaaugucacugacuuacaguauuaaugguugaaaugugagucugaauuauuuuacuguauuaugagaaaugacagaauuuaguuucagcuguguauaguauucacugauaacuucuguauccuuugguuuagaaguauuucuuauucgaggaagugaaaccuacugagucauuuagaauagacggaguccucaguacuuccucuuaacauucacagaaugguggaaacuagaaaaugaguuauuuauuggucuuuauucuccauuaaugcauauuauuugaucuugcauuaaguauacauugacagaaacauuauuuuaauuauuguauugaagacauucuucauguguauuuaaucaaccaccugacagaaacuagggcagaguaaccaaaguaacauuugagacuuuaugguuagacgucuaauuugcaugugacaguaguccauuuauaaagugugauggaugaagucauauuagaguaaguaccauuagagacacauucauugugaucuguguuuuugcaaaucaaaauuaauggucauugcagcuguuuguugaucuguugaguaauguaaacucucaacaacaaagcugaagagaagauguauuuugugauaucuacucuuauaacaggcacucuuaacaacaucaguaauuuguauaacauuaaauguucaaguagcauagagaaaaaucuaaauucaguuuuagaugaacaguucuuuguuuuuucuugugcuauaaagacacaguuauugccuuucaccuccucccccuucaaaacucaauauuuucaguuaucucuugugaggaaauauaucacauaaacuggaagucauccuuaaccagagcaauauguaaguugacccuggagguucaaagagaaacuuacguagccuaauaguguggcuugcacauucuaugcacuguacuaaaaaauaauguaacuuucaugauuucgauuggguggaauaauuuuuaguuacgauuaggucuuuaaaagguucuugguuuuuaguuaugauacuaaaauauuuaccagugaauuuauaugauguguaggagguacuucaaaacgaucuaagagugaaaggaacaagagaacauauagaugaaacuggacuggggaugaauugauaauuguugaagucgggugauagguacauagaaauuuauaguuuucccucaaauuuuauguguaucugagauuuucuauaauaauuuuuuuaaauguaugagacuauguacgucucaaaguacugcuuuccauucuucauguguuaaagacagagggaccaucagaucuucagaucuugcuuucuuuuuuucuuuucuuuucuuuuuuuuuuuuuuuuuuuuggcacggggucuuacccuuacaccuaggcugagggcagucaugcugucguagcucacugcagccucaaacuccuggucucaagcgaagcccccagcucagccucacgaccagcugggacuucagguguguaucacaacaccuggcuaauuuuuuaaacauuuauuuuuuauagagacaaggucuugcuauguugcccaggcuggcacagcuugcuguuaaauaaaacuaucuuuuugaaauugucuuauguaaaucuguaaaaguauuccacuauaggcaccuaauauggaucucuuuugacuuuuauaacaaggggaguuuugccuaaaugauaauauauauugaauaugacuuuaaauuuaauacucuuuuuauaggagaaagauuuugcuuuucuuaaauauuuacuccuguguuagaaaauaucauugcaaggagguuaucaaaaauagaagaauuaaaucuugguuuuguuaucuguaaaaugauggagcaaauaauauuuaauguguuuugaagcccccuggacaugaacauguauggugguaaaccuugaaggauucuauauuuauaugucuguauuucuuuauaccaccuuaguucaacuguuuuaccauuccaaguuucuuuuccaaauuauguacaagcagaugaauaagaauauguugcaauugauuuuucuuaagcaagcucaguguuuuuuguuuuuugacacuuuguuuggcaaaggagguguucaauuuguugagcugacugagacuuagaaagaauaaacuaucacaggaucugccacaaaguagaugugagguaguuguucagugagaagagagugagagaguuauuccauccuugauccaaacaucacuguugggcagguagaucacuaauuuccuauuaaaccaaguggacaggacaguccugaauuaauuauggaacaguuucuuuaaagacgucagcucucugcaucccuugucuugccacugaaauggugcuauuucaucccauuucucccuuaaaguaauuuugugauuuuugccacuuuuaaauaacacauugcuaaagucaggguauaaugcaaaaccaaaaaucggguggagaauaucauauaccaucuuaucucuagaaagcaauguugucuguagggcaagaaaacagucuuuauuucccugcaaauugugaauuuuuaauguaguuaguuuugagaaaugaauguaggaaacuuugagcaaaacauccaauaaugaccaguaaauacauuuccagcccaaaaguauuugcacaaaucuuuuuguaucauauuguuuaaaagcaagauaagggcaaaacuuaguaucucacagagaacuuuauauuugagcugugugucaggaugacaggcuuucaggacagaugauggcuuuugaauauaaauguacacauuuuaauuuuuccuaauuguguauaaagauuuuaaaauacacaggcaguuaaaacaaauauuuagccacaguuagaugcacaaguauuguauuuuucucaccgauacuacugcuuuauuaugaauuuuuaccaaaauauacuuuuuuauggaauguuugguuaguacugcacucuuuucauaaggagagauacgauucaauuuccaguuuucuucaggacucuaaugccuugauacauuagaauaauaagugaacagucaggaaaauaaagagguuucuucucuugggaaaaucaaacuuucuuaaaacuuuauuuuuccuucggaaacugaagauacugaccauuuauuauacauuuuguuggcucccuguucuauacccacuaccacuucaagagaaaucuucccccaccuccuaccccaaaaagucuuuuugggggugugacuuuuauaguuguagaacauuauuagcauuucucgguacuguuuauuuugaacaaaaccaauccaugcauuuucuauuuguuuaggagucggauggucagggcugcccuuucugucguugugaaauaaaaggaacugagcccauaaucguggaccccuuugauccaagagaugaaggcuccagguguugcagcaucauugaccccuuuggcaugccgaugcuagacuuggacgacgaugaugaucgugaggaguccuugaugaugaaucgguuggcaaacguccgaaagguaaaacuagaaacauggguuuaguuaaggugaugugaccauaugaaaaggaaaugaugccgucauaaauggaguaugacucagcguauuugaguuuagaaaagaggcacacacacauacuagccuaggccuguacagggucaggaucaucaauaucacugucuucuaccuccacaucuugucccacuggaaggucuucaggggcaguaacacacguggagcugucaucuccuaugauaacaacgccuucuucuagaauaccuccugaagaaccuaucugagacuauguuacgguuaacuuuuuuucauaaguaggaguauacucuaaaauaaugauaaaaaguauaguauaguaaguacauaaaccaguaacauucauuuauuaucauuaucacauauuauguacuguacacaaguauaugugcuauacuuuuaugcaaccagcugcacaguagguuuguuuacaccagcaucacacaaacacgugaguaaugcuuugugcuaugacguuaagguggcuaugaugucacccaccaggcaauaggaauuuuucagcuucauuauaaucuuauaggaucaccaugauguaugugguccauuaccgaaaugucauugugcagggcacaacuacuauaauguugacaggcugauauaaucauaguuugagagagaacuagauucuccucaagguacucucauugguuuuaaacaucauaaugagagguaaugagaguguuuguauaaaauuaaacgucaucuaacacuggcaauagcaaaucugugaagaaaaaauuuaagaaaggaaauuauuaaauuuggaaauggugaaacugaauuugauuaaaaauauucuuuguucaaaucuagaagaagugucugauagaguuuuuucuuaaugggaaggcugucucacuguuuggcuucuaagaggucacauaagauuuacuuuugugaauuuaccagaaucugaguuugcucauuaauguuguugacucacaaaaauugaccuugucaguucacugagaauggauguuacugcccaguuuaaguuuauauaaccagguacacaacagacuagucaaugaaccagaaugccaacugauuaauuuacagaccagaaauacaguggucaagagagguagacucuuggauaucaggcuauucccuguacaggaagauacaugaaaucccaauuacuuucacaaauuuuuugcucucaaaaucagagaaaugggauugaguggugugaaaggucuucauauauggugccacccuuccuccugacuugggcagacauggcuaaucagucaugauacuuaccgccgcugaguucagacuuggccaacagagccuuucaacacagcccugaagaucuuccacuguaguucauuaggauuuggcagguagcaugaaaccuauuugccauugucacuagguggagugaugauaauguguaauggcaucagauuguauucaccguauucaucuaucucuguaggaaggaaaugcuugguaguggaauuuugacaaggcauuucuuuggguuacuucauuuuuagggcugugugcgaguuuuccucuugggaaacuccugcauuuucucccuuccaauguuccaugcugaccaaauacauucccuuaggauauuuuacauacaaauuuuuacauaggaagauauguuaacaucaccaacauggcuacucucaaauuuugcauuuuucuggaaugauuuuuauuauuuaucuuauugguuuuucauaaauguuauaauuuaacacucagagaaacuacacgauuucacucuuuaauccugaaagauacaguuuuuauuaauaguuugaauuaugugauuuuuuuugaccuaagaaauggaagaaaguaguuauuccucagaaauccugaaggaugaacaagaaaaaauaaucuuagauugaaacagacuugagacuugagucucaaaacaaaguuaacuuaaggaagacguggaauaaagcaccaguucugcuacagaguaguaauggcaugcuaggcaaguuauauaaccucuuucuuccucaguuuaccccuucguaaaacagaaaaauaauaguagcuucucuguuggguguugugaugaucaaacgggaucaaggaccuaagaaccuagaagaacgucaggucaccaaagucauaaaugcucacuauauuauuaccaauguuaauuaauaauacuauguaauacauauucuaggauauacuccauaaucugaguuaguagaaaucauuucaucacuaugcaugugagagagcuacauaugcggagcuggugauauugauguacuguuccccagaagacauaaguuugaauacuggcucuacaauguacaaauacaaacaaaucacaugacuagucugagccugauuuccucuucugaaaaaugagaagaauaauaccucccuaaauuguugaaagaaugacauauguuauuaaugcugguuuuauugauuugugacccuuuuuacugcaaguuaaaaaugauuuuacauuuuaagugguguauauuuaaauuccuauauaaguaccuacaaaauguccuugauuuuacaucuuguccuaaaauauucacuaccuggcccuuuaagaaaaaguuugcagccccaggucuaggacauaguaagcauuuaaagaaugguuauugaauggauggauaauggagaaugacagaaaaguauuugagauacaacagcucaaguaguugaagugcuccagguagcaguguuuuuuuuagcugugaagacauuucaauuuucuuuacuaaauggguuuucaucuucagugauccaugugagaggguaggucuaggcuuuaagagaaauuuuaaaaagaauuuuuguauaccuuacugcuugggagaaaacaguaucugcccuaugugaauuugggaaaaguugcagucucaaccugcuuuccauugaauuaaguugaagcuugagccucuuuucaguaguggcacuaacaaucgaaaggaaaugcugggaacauaacaugagaagcagaauguuccaaggugacucuaguguuucuccuugaucuuaucacccgcucccaagaccauucauauuucauucucucuggcacacuggugagcuuucugucaagggagcugagacauuuucaaauugauccuuucuguuuuuuaccccacaaagaguagaaugaugaucucaagcauuauuguccuagaagucacacuucaguagcuuauuuggcagucagcagugucauuuaauaaagcuuuacuucacuacaaucuuguuauacuuucuuaugggaguuagauaguuuagaaauuuauaucacuuguaauuauuuguuuuuaaguugaagagguauauuucaguuaaaugucuuuaugucuacuaaucugccucuagucaauuaaacugauugugacuuuuauagcauuucauaaauguguaccacuuaauuuucaauaaaaccuaaauuuuuauauagauacaagcauaauucuuucugaauaauuuggaagaauauugcuaugauguuauguucuuauaguauuuuauauguacuucuauaucaggaguuacacuaaauuguuauuuaaaggacugucuuuaaggccagggacaaugccuuguauuuguguucccaggcaccuaaaugcacucaauaaauauuuacuaagugaacuaauaaaugcacacuccugcacacauguuccuuuagggcaaugaccuaaucuuaugcauauuuuaaacuuuguuccaaccugaauacuaaauauauauauacacagagcaucaaacugauagauuuuauccaguuuuuucuuauaggagugguuauaaacaaaugucacauggucauuuugacacaguaguucuucuaccugaauguucuuccucuguuuuuuaaaucauucuuuugucauucauucaugcauuuucauucauucacucauucauuuauucauuuauuuuuuaauuaacugaugaauuaauuuagagcuggagucucgcuuuguugcccaggcuggacugcaguggcacuaucuugguucacugcaaccucugccucccugguucaagugauuuuucugucucagccucccgaguagcugggauugcagacgccugccaccacgccuggcuaauuuuuguauuuuuaguagagacaggguuuuaccacauuggucagccuagucucgaacuccugaccucaagugauccagccgccucagccucccaaagugcugggauuacaggcaugagccaccgugccuggugccuggacuuacucauuuauuuuuaaaacauuuuauucucucaguuaaaagagugacugccagugauuguccaacagaaugguuccauuguuucuaucugccauuuugaauacucaucuuuuucuucuuuuaugagcgggccaaugauaauauugugaaauuguuucuuccugucuucagcauauuacauucuuuaaaugaguaaugcugccaucguagcauggaaaccugcuuugauuguauauuccuguuaccauggugauaucccacagcuggaguucauaaauaguagcauacuaaacauauaguguauuucuauuauuucuuuuauaguuaaauguguuuaauaaugcuaauccuuacagaagcaauagaaccuaaaagucuauaauacauacuuuuugauucccucucugauagaaaguauuuugugauacuaacuagaauauguuuuagauuuugcccaagucuguaucguugccugaguuuucaagcugucagaauccugggauaauuagaucugaugugagcccucagacaaaguccaggaugugacugguaagaucacagccuucucucugacuucauucagaucagagcuaaaaaacaguaucuguugcuacccagugauuugcuucauuuugccagaggauuaagaggaaucuuaacaguuuuucacaguauuagucaccaaauacauaacauuuacauuugaaauaaauaaaaauuugcauauaaaaauaaaauguugacagacugaacuagugaaugagcccagauuaguucuuauugucuuaaacauuguauuuucuuaaaauaauauuuaaaaucuuaauggccacauuagaacaaaaauggguaugaacaaaagucaaggaaguuauucuuuuuuaugcauucuccuuuguugccuucuucaauuaaaauacaucuugcuaauuagaaauguaacaugucaucuaaguauugcauuuccuaauaagugugaagaacgucucuauagcagggguccccaaaccccaggccauggaccaguaccagucugugaucuguuaggaaucggcugugcagcaggaggugagcaacaggcuagugagcgaagcuucaucuguauuuacagccacuccccacagcucgcauuaccgccugagcucugccuccucucacaucagcaguggcaucagauucucaaaggaguaugaacucuauuuugaacugcacaugggaggguucuagguugugcgcuuauuaggagaaucuaaugccugaugaucugucacugucucccaucaccccuagaugggacugucuaguugaaggaaaauaagcucagggcucccacugauucuaaauuauggugagguuuauaauuauuucauuauauauuauaguguaauaauaauagaaauaaugugcauaauaaauguaacacauuugaaucaucccaaaaccauccccuuccccucccugccaccguucguggaaaaaaugucuucuacgaaaccagucccuggugccaaaaagguuggggacugcugcugcauaguauuccugauccuaaggaaaggggugugugugcauaucacaguguuuugcagcuauuuuuaggaggauguugccuuuuuacguugucuauuuaaaucugaaucacaggauuagaguccguguuggagccguaagaucaaaaauuacaacagaagugaaauacaaaaauaaaaauagacauucgaaaugcagaacaugguucucaacuauaggcaauuuuaccucuugaggguauucaguaauauauggggacacuuuuguuuuuugcaaugacuaaaggauggcaaauacugcuggcauugagugggaagggccagagauacuaaauauccugcaagcccaugggugguccuacccaaaagaauuauucugaccauaguacuaauagucuaguccucaccacugccuucccacaacauuuagguagagccgugagugacaguaagcaauccgaaggcacagguuuguuguucaucguuuacuugcacucuguuuacugaucuucuaaaagcucuucgugcaaaauagugguauuuucuuuauuagcaugugauuagcaaaagaaacaacugcaucauccaagugcugugugaugucguaggauaccuugaagacauuguuacuuauuucucaaaaauaacuugaauacauaguauauuagaagaagcaacacuugaacucuaaaaguuuugaguccacugccucagguagauugucagcuccuugaggacacaggcuaugcuuuauucuucuuuccauucuuagagguuugcauggugcuugauacacaguaggcccuugagaaggauuuuuuuuuuuuuaaugaucaguggugacacuguucuuaauuguuauauucuuaaguagagcugcccucuuggagugaaacugccugggcucaucuucuaguuuuccuacuuaguaucuaugugccuuguuuuauuuaacacccccucccacuccccuucccccaaguacuugguccauaaaacucugccucuuuaagauuaaaugaguucauauauauaaaaagccauuagaacagugcuggcacauggaaaaugcuaaguauugguuguuauuaauauuauuuuuaaaguaaauuaacaaagauggggucucacucuaaugcccagcauagucuugaaauccuggccucaaguuauccuuccacuucggccucccaaagugccaggauuacaggugugagccaucacaccuggccacauuuuuuauacuaguguuauuuaagacuccugaaauauugcuguacuucuaagaauuaaguuauuaguauuuuugaguugucuauggaagguuuucuuuuagauguugauagcauuccauuaggaagaauuagaugccaaaauuuuauugguuaccaagcaauugguuguauuucuuuaacauauuaacaucuauauaguuauaauuucauugcaugaccacauuaaaauaauuuacuguuaaaccaugcuucaaguuugaaacucagaaaaugcaaacuugucaacaugucagcugaaacacuauuuugaggauuaaauaauuuagauaagguuacaauguucuuauuuucuguauaacuaaguugaaaugauuaaguauuaucuaaaguagggugaagaacuacaguaaccaaauagcaauugcuuguuccaaccagcuuuagcuggcauuuggagagcaauaaggguuuucacaugaaagcauuuuuucagugaccaaaauuuauuccuuuaauucucagaauguucuuguuucuuggccauuuuuauggaaauauuucugaauuauaugucacccuucccugccuucucaaaauugguuaugcagcugagcgaaccaaagggcauaagaagccacuguagucaacaugacacauuucuaaaagcuuacauuuugcuacaagauuugaggguagcuugcauaaagagaagagaaccauaaauuuaaauuaaaaucacacauauauuuggaucaggauauaaaauuuguguaaauguuuaaaguaaaauacaaaacuuuaaagaaauuucaagguuauggaggcugaucauaggccaggagaucaagucccucucauaagaagguacuucaaggagaagcaguaucaucacuuguguuaacaguguuuaauauuucaguagagcagugcccuuaagguuauccccaagugugagacugcacuacuuuaaaggagaccugucggcaacuuuauugaccacuucucugccagaccucaaagagaaaucagcucuuauuccauuugguguuucuuaauauauagguuucuguuuuccuccgcuucuuuauugcuucuaauuugaaaauuuccagaaguuacuaguggaacauagacaguaauucagccuuugaauuagugaacuucauuuuacacagaaaucaaauguccauauucuuaggaagguagcagggugccuacauucuguuucuguauuaagaaguagaaaaaaaaauguuccuccuacuucagaggacuuuccuguuucauucuggguuucuccccaaauuauuguagguugagacuucuggaaguaugaccauggguaaccaggaaaugauuguauugcucuaacacaauauucuucauauaagcuuuuguuuauuaucuguggagguacucuaaaauagauaacacaagucauuuacuuaagcuauaaugccauaugaauaugugaguauguguguaagcauuuuuguagcauauacccucucugaauaauauucuguauaggcuacuauuuuaaauacucuugauuuuuguuuuguucacaaaauaaagugaaaaaacugagaauaguagcaaguaaaauaugcuuagacuauuuuaucaugugauaaaaguuuuaucaaugucuucauuaauuuucacgcauuuauagaaaaacauugacucucugaguccuucucaucauccuuauuauaguaacuguauauaccuuuuucagauauggaaauucauuaaguaaaaaucuuguuaaaaguauuauaaaauugacuuugauuaucucugggacugucagaacucucaucuuauuaguaauuggagagguuuucucuuguccuguuuuuauaauaagccugacugugcuugaaguuucuuaccaaauguuuugccauuuccauaauaauggaucuuauuaacguuuuuauaaaauggcucuuuaaagguguggauaaaaugaagagugacuaaaauagaaugaguucccaauuauuauugguaauugcugaacauagugagaugggcuuuugacuacuuuacuucuuaggguuuuucugucaggauuuucuguuaagauugaacauguggauuucucuguuccucgugguaguuauaaaggauucugugcauuuugucagaaaaauaaauaauaguauuuauuaauuuccaaagcaaaaggaugaguauguagacguaaaagaauccaauguggucuuuaaauuucuagaacaccaggauucuaguuuguaaaagauguucucaucuguuacuaggauugaagaacuuaagagaaauuguuaguuagacaaauauacuggugugaugauaauacaggaaggaaucaaggcuggcucagccuuuggauuuggaaagaagcugaaacagauaauuuaucauaaaguuuuagaaacaaguguaauacuagaaaaaugugagaaucaccuaaaaucaagauaaaggaaugaagugauacugaucaguaucuuuuaacuugaaaggauguuugugucuuucccaacuuuugcaguuaccucuacauaaggauuuuggauauugugaauaaguucuauacaguuaauucuguguucacauucuacuuucuaugcuuuaugacuuaauuuuuccauacuuauauuuguuugucuuaagauuagagagaugaacaugaaggagugacaaagaaaggaacucauuuaagcagugcucaaaaggacaugauacuuuagucauucauuaacacaugaaaaccagaagagcacaggcgaaaucucuaccaugaaaaagucagaaaaauuuaacugcagaaaaaauagugacagcaauuauaacagauagaaagagguugacuauccuaauauauaaagagcacuuucaaaucaacaaagaggaaauuaguggauauggggaccaaaaaaauguaaaaagcuagugacccaaagaagaaguacacauguccaacaaagauugcauuucuuucaaauuauuugucaaggaaggaagggcaaauuuaaacauugguauggcccauuaaaaugacaaucaagcaucaaagcaaacaaaauauucuuugcauuugaguuuuguguaaugguaauuaucacacauggcuggugagagaauaaauugguuuuaccaucuggacagcaaaagagccuuaaaaauauucauaaauucgacacgguuacaugucuaguaucuugugcucaaaaaaauuguaugauucuuuccuuaaaaacuagcacauauaugguuaaagauuucuuuaugauacuacuuuauaauaaagaaaacuugaaaacagcauaaguguucauugcacaggaaugguuuuguaaauccauauaugcauacuuuaaaauuauauucaugaagaauguuuaccgcuaauuuuuuuuuguauaaugcuaauaaacauugaguagacuuaacauuguguaugugauuaggaaccaucaccaauggcuauauguagguguucuuuaaaauaucuuuauauuucccuauaauuccaaaauuuccuagagugaaauuauguucuuuauaaugaagagagaaaaagugaaauaaacagaaaauugaaaagauacaaggacagaacugccaaaaccaguaaaacguauuuuuuaugggaaacaguuugacaacaugcauaccccuaaauuuauaagccuaauccaauucuuaaacuacuuuucuuguuaucauuuguuguuuuuguguuuaagacccuuucuagguuaaaaagaaagccuaaucauguuaaauuaaauuuuaaguuugcuuuuuuaaaggucagugcuaauaauagcaaauaauccaagaggcauuucuauuugacuuuugaaugcauuuuuacuuaauuuaauuauuugguuagauauuugauuuuguuacuauugcauuaagagcugauagugggaggaauugucugggacaaaauaagaaauaacaagggugggcauuuuguuuaacaguaacuuuaaugggauuaccuuuuggcaguguagaugggcaagcuuugacuagaaauuuggagauaauauaauagauuacauucugucccuuuuacaucaaaauaauccauuuuccuaacaauuucaucuaaauaaaaauuaaauauuuuacaucagcauuuauuuuacauaauguuuauaaauguuuuacaucagcauuuauuuuauaaugcauuauuuaauuuuauuaacccauaauguucugucaaaugcauuaauuuuauucuuuaaucuacagauaacaccaccaauagguggugacauuuucaagacugcauggccucuuuauauuauaacugaaauuuaaauauaagcaauuugaauauaggaaauuuaaauauaggagaucugugguuugaaaucagguuauacauuuauuuauaugauuacucaaaugcaaaaaaaaauuguucuuuauaaccaguuggcauuagagcuuagauagucauacuugaaauuuacauuuucuaaucaagaguauccguaugaacaaaauacuaacuguuguuauucagaauuuaaaugaauccuuugcuacuuuucuacccaagauguuuuauacuuauguauuuggucugcauuuuuauacacaauggaaguaguagugauuaagaggaacaguggacaaaucaguaagugauaauuagcacaguucacagucuuagaauuuaaaccugagccaggggauuggcucuauguuuguuuguuauuauuguuuuaccccaacagcucccuuuaucaccuaucacauguagaaaaagauaaauggccugggugauuugagcuggggauuagaacuguggaagaaagcccagaaaaggguggaggaaauggcugauaaggagucaauuuaggggauaauaugaacuggugggcuaaagaugaauucccacauucaggucccagcuauagaggcauuugaauuaccuggugauuaccuguacaggggaaaagucuguuacucuagaauuuagucuuuuaaaaugcaaaaauaaaaauaaaaaaugcagcuauuacaaaaagacagcauugucuuuuaaaggagaaauaauuuuggucuacauugaauugauguacuuuguuuuuuuuuauuuucagaaggauaaaaaagagcagacuuuuuauucuuuaaagugagcugauaaauuuugauguccugaauuuuuaauaucucauccaauaaauuaauuauggacuggauugugcaacauugugcuagauuuccuuuuuuuccguagacuuucaaauaggaaggaaaaaacacaauuugugaugacucaaauaaauuaaaagugaccuucuauaugaacauuaccuacuaaaaauguuuacaaaucuucauaguguuugaauuuuaccagcaaugaaaguuaaggcaaagcuucaguacacuaacugcauaauuguuuuuaaaaauaguaaaagguucagcaaagaauaaugcauuacuaucaaaagagcauuguuaaauuaucuacucuuagguaggaauuuuacucuaauuuaggagaacucaggaaaaugagguuuggugaguuuaguacauauaaucaauaaagaugaaagauauuuuuuuucuucacauacucuccauaaaauccuucuaacuaagccaacuuacagauacuguguagcuucuaaaugaauuaauucuucaaaaggacaguacauaaucaccuucagaacacaguaugaauugcgcuaagcaagauaugcuuccaauuacauucacaaagcuucagagagccugcucgucuggaaguaucuaaaaguucaagguuauuacuuugccacacacauugguuuggaugucuguucugaggauuuucauuauacucuuucaguauccaacaggcucuucaacacaucugaaaucaaauuuaccccauuuaaacaugcuagaaauuuacuaacugcuuaaauauuaguaauuaauccaaucuagggugaaagucaaguccuaauacugauaaugggcuguuagcucuaucacaauucugugucuuguuucaguuaaugagagaaguaggaaaauauuugcagaaaaaaagugcuuggaggagcacaggucucauucagcagucuuugcaguguguacaucuagcccugaaaaguguuuuugcaaguaacuaaagaacugugcauucuuucuauauauaaaaaaauauauuguuugggcuagaaacaguauugauagcuuugcuucuugauucuucuuuguaaaggagaguagccauaucaacaaagcauuuuuuucagguaauagcuuuucuaguucucagagaauauaauuuauccuaauaggaaugguggagaauuagauguccugugacaauugcugaucuacagugucaagaugcugugaugcaaauagcuuuacaugaggaauuuuuucugaucuaugaugauuuugggauuaguuuugcuccagaagguucaaauuuauggaacaugugaggcccugugacuuucuggguagaacuauucuuuuguuaagaaucacuggcuguacucaagucaguuugugacuauagagauucuuuauuuucuccuucagugacaauugaauuuuuuugacuuaccauaaccgagcuaaaagaaaugaaaaagaaucauuaauuuuuaaaaaagaaauguuucuaaaaauuguaauguaaaauuauguugaauuuuguugaaugauuuuguuauucggcaccaacagagacaaagacuuugcaguuuaguaaugucaugacaauauucaggcauaucggagguauagucuucuguuuagcuacucagauuuauuuauuuuauuauuuuuuuagagacagggucuugcucuguugcccaggcuggagugcagugguacgauuauagcuuacuguagagucaaacuccugggcucaaggaauccuccuaccuuagccucuugagucgugggacuggaggcguguaucaccacaccauucuaauuuaaaaaaaauaaaaaauuaguaaagaggaggucuugccauguugcccaggcuagucucaaacuccuggcuucaagcaguccuccugccuuggccucccaaagugcuggcauuacaggcaucagccaccagggcuggccucagauuuauuuuuaaaaagucuuuacaaaggacgcauaaauuuccaacuauauaaaugugggcugugcagugacuuccuugcaaagaguauacuaugggaaggaggagaaaaaaagaaacuuaacagugaagaagucugauaaacaauaccacggucagguaauuaaggucagcaacagcagugaugaaucauguugauagcauggauccuugauaugauguggucaaaaugacacuuuacuuccgugguccuacuccucaaaacuuuuaaccccaggcuaauuauuuuuaaaaauuagacaaaucccaauaaagaaacauucuguauaaucucuaaccaguacuuuacaaaacugucaaagucaucagacacaauggaugucugagaaacugucagagccaaaaggagaguagggagacguaauaauaaaaacuaauacaguauccugcaugaaauccuggagaagaaaaaggacauuggguauaaacuaaggaaaucugaauaaacuauggauuuuaguuaauuaacaaaagccuuauacaauguaacuaagugugaaugugaacgcaaauccauuaucucaguuaaagacagacuaaaugauaaagcugcugaguucauauuaaauugucaaaugaugacaucagcaauucguacaaagguaaguaauguuaggaggaaaauggcuuacaaauaaguuuaaaacuauaaauacuagcauucagaaacagaacaauaucaaagcaugauagauaguguuguaaacauuaagucuaaaucuucaaagagcuaguaacuuagacuuggaaacugcccaguauuuuagaacagaauauuguuuauccuguuaaggcuacuugauuaacuguauggcuuuuauaacaaauagaaauuagguuaugcugcauuaaaacacauagacacacacacacaaacacacaacauuaugcaauaggaaguguuacguacaaauugaaauacuuacuggcuuuucgaugcuacuuuaucuaccagacaauauggaaaacuuguaguaacagaaacuuaguuuuugccagaaguacagacagacuuuccuagauauaguucauuguguuucaagaaaaauguuuaacuugagaaucuuuuccauguguaguauuaaggaaaaaaaaauaggcuuaaaucaguuuguuuuaaacacacaauuauuuuuuuaaaaccccaccugauuuaauugguuugcaggaaaauagacuacauacaagauacauguuuggaacaaagcaauagcuaaguauuagaauguacaaagcucgagcaaaaaaauuuauaauauagagauccaagagcaaugugcauuauugcauuauguguuucuggauuccucauaaaauauagaugguuuucuugaagaauaucugcauuugauugucuuuauacuauacuuuugcuguucuuuuuucuuagccccuuucugcaauauguaggaaaaacuuaucagucuuuucuuuucguaauacuacccuugagggacaguaugaacuauuugcuucuauuaaucaggguaaacuaagggaauucauuuuaacaaauguauggugccagaaaccuucuuccaaccaaauauauucuuuaagaacagagaacacucugcacagcuaauaaacagcggcaucuuucucuuuuucuguucuagugcacugacaggcagaacucaccagucacaucaccaggauccucuccccuugcccagagaagaaagccacagccugacccacuccagaucccacaucuaagccugccacccgugccuccucgccuggaucuaauucagaaaggcauaguuagaucucccuguggcagcccaacggguucaccaaagguagaucaauuuuauuagaaacacagaugaaaauuuuguaagacaauuauugauugcucagauucuuuuaaauuccauuacucauauuuuuuugcuuuuaauugugaauaaguuugaugaguuucucguuuaguuuauggugagcccacauucauauuucuuguuuuauuacuaugagaguuacacauaauuuuugcagagagcauaugucuguagccccaugauuugccagaauaagaagcagaguaaguauaguuauuuuguaaaauagauuuaaaaggucauuauaugcauuaaaauaauuugcaugcuguuaucaaaugauauuuuacgcucauuuuuauagugccaugacaagaaaaaugugaugggaguauauuugcaaagggcuuaagguaugacaaauuaucacccuuguuucaaggcgacucagaagagggaauuauauguaguuuuuaaaccuggagaaauuaauuacaaugaauugcaauauuugcagaguaauuauauuacuguuuaauauuaaagacauaauuuuuacucuacaguuaaaccuacaguuuauuuuacuguguggauuuuuuccucgaauuugauaaguauaagauuuuaaaaauuaauuuuauuugguaacaugcucuguugucuaaaauuuguuggaagcacaauauauuuaguaguguuugauuuuccuguauuaccaguuaaccugguuuuaagaucacacauuauuagaauaucauuuagaauuauguaaacacaacagauuccuuuuuucucugcuauuuucuaacauuaaaauuacaaaucaaucaucagauuaaccauguaaauaaaagucaaaagcuacgaaaagcauacucauucaauucauugaucuauaccuuuauauuucuauguaagaaucagccugaucuuuuaaaauacuguaagaauucauaaaauugaaguaauuccauauguagugcugcucuguuacuugugaucuuuuacuauucugguaauaaccgauaaagaagcagagcacauuugcccccauaucaguuuugcuguaucacagugaugaaaacaaaaauaaagaaaaagcuuuuaaucuucuaaaaauauuacaaauauuacaaaucaaguuacucuuuaaaaaaacugaaaccaugacaacuuuucuccucucuccuaaaucauagagaugugcaaauaaauuauugacauauucuuuuaaugucaaagucauuguaugauuuugaucuucuacuuguuucuguaucauuucuauaacuuaacauuuggauuuauguacucauuucuacuuuuuccuaaugaaauguauuuaugaguuuuuuauucucauuuaaauuucauuaacuaguaauaaaagcaacuuauuaaaagauggcacaggaaucuaguaaaacuccuuguuuggcuuagaaaauuaaagcaauaauacacuaguuuggaaguucugucagugcaugguacaaccuuuaguuuuuuuuuuuuuuuuuuuuuuucucuucuguuucuuuagucuucuccuugcauggugagaaaacaagauaaaccacucccagcaccaccuccucccuuaagagauccuccuccaccgccaccugaaagaccuccaccaaucccaccagacaauagacugaguagacacauccaucauguggaaagcgugccuuccagagacccgccaaugccucuugaagcauggugcccucgggauguguuugggacuaaucagcuugugggaugucgacuccuaggggagggcucuccaaaaccuggaaucacagcgaguucaaaugucaauggaaggcacaguagagugggcucugacccagugcuuaugcggaaacacagacgccaugauuugccuuuagaaggagcuaagguaagaaauacgcaaagcagaagcuagagaaucugcuuauaaaugcuucugauggucaguagcauaaaagguugggaaguguuuuuuuuugccuagcauggcacuucccuguaagucuuuaauuauccccaaguuauaaauaaucagaagcucauuaaaacuugaacuuaagagaagucaggagguucuaaguaaugauuuaauuuuaaugugaagacacuagacaauuugccagagauuuauuucaccuucccguauuucauuugccaaaaauuucuucuauuaacaacuuaguggugguauaaucagccugcauuuuuuuuuuuuuuugagacgaagccucgcucuugccccccaggcuggagugcaguggcgugaucucggcucacugcaaccucugccucccagguucaagcgauucuccugccucagccuccugaguagcugggauugcaggcaccugccaccacgccuagcuaauuuuuguauuuuuaguagagaugggguuucaccauguuggccaggcuggucuugaacucuugagcucaggggauccacccgccucagccucccaaagugcugggauuacaggcaugagccacugugcccagccagcacgguauuuuuaacaaacuccuuuaguuccauccaauuuuuacaaguuguguuacuauacaugucauaaaucaguuguuggaguuaguuauuguugccugggacagugcacauuaggcagccagguaaaaugaaccuccuauauacuuaaaaacacuaaaccaaguuuacucuuaaaaaucaaguucuuuucccaaguucuuuuccccuaaaauugagagauucucacccuuguugacuucucacuugaaggauguuacuacuaucauuuauauguccaggaaggaguuuaugugugcaggaaacugaagagacagcagcagaaaucauuuacuuuagaauucuugguaguuccuuggcagagguauacuguaauaauuucugguauuugguuccagggugcuuuugacucugagauuagauccuugccaucuucccucugcugauggaggccuuggcucuucugaagacuauaauauuaaagugaucucaucucuguagaccuuaaauugauauuuuacagaaguagucuaguccuucaauauaaugguuaaaguuggugaguucaucuuauauucaggauauaaggaagaagcgugacuugcacucagcuccucuguguguggagguacagugauaaugaacacuuuguaugacaguauuuaaccucagugauaugggguagccaggaaaggaagagucacaacucaguagcacagcauucaaaaccaaaggcaaggagugguggcaguuugcuuugacucuuugcuggugacucaccuugguaccuucagucucaucuauuauaaauaugaggaucucuaaagguuuccucagguucaccuaaauauaauguaaauguaagagaacauacuaauaaaaccaauuuuauaauaaucucuguuaguggggagcuccuccucaaaagaguuuuuccacaaccuagaaugcugauuggaaggaccugccauucauuuucaaaaauuuucagguuuuuuuuuuucccccuuuagcuuuacuuuuuauucauaugugaucacacuugucuugggaagaguguuagaagaagcuguaauuaacuaguuauaucucagcagcauguuauaauuuauuuucuaaacggacuucaaaaauacuugaaauauaauaguuguuauagccauuucauugaagauaucuugucucgggguucuuuuagauaacauguuauaguuuuaaugcuauuauaaauuugcccuccuaagcucuagaaaacuggcuguuaauuuuuuuaugagauguuaccccaauuucuuagguuauugguaugagauacuguuuuuauuuuauuaacuauagguaugaaauauugugaguucaguuauaaaaacauuccuuuaaauauuucugugugaacuuucauguugugaucauugaaacagauuaguauaauagagaacacugagugaaaauuuuaucucuuauugaaagcugaacuuuaauauugcuuaguucucucuaaauaauucucauuaagauuuccuaaguucuaaucucauauauuguggguauuuauauugcaaugcuaauauccuccaguuaauuucauguuacucuuagauuugguguuucaaccaaaauuagacuucugagauuucuaauuucaaccuaauuguuuaacuucuggagugagcuguaaaaaagaauuuauauauaguugauucauugaaugccacaaaacuauaaaacagaccaugucuccucuuuuauuacuguuauaaaggaaaaaugauucacuucauuagaucauagggcauaccagaacuuagauaaauuagaaaaggccuaauuccucuucucauuucauuguugggagacuuaagagguuggcuucaacuaacaacugacauaaucacuuaggauccuguaauucucaguuucugugauccuggguuggaguuuguuaccaggcuccaaaaucaggccuggauuucacuuuuugcucuagaauauacuggcuuuguccccaaccuuacuuauuuuccuuauaaauaaaguggaacuuuauuuuauuccuuuauauaaaauggaauaauaauaauaccugguaucuaggauaauaguuagcuuccagcuaucuaaauuucuaaaccccuugguucaggaauaaaaccaaaaauaacagcuguacauagagugucaaaauaaguuguaacacuuggcauuuuuauucaaaauaguugucuguuuuuuaaaccgaaacaucuucucuuuguuucacuccuuuuuucuuuuauuuaacguaguuccuaaugaaugcuugguaagcacucaauaaccaaguuaauaacuugguuaagcauucaauaaccaaguuaauaacucggugcuuauaauauaauacuuacuuggugcuaguaaucuaacacuaaagccagugguggagacaaacaguauaugugcuuggguuugagugugggcagguguaggccaggagagaaaagguggagggagaggauggcugugauaugcaaggaguuacaaagggacagguuuuuauguaucuugcauaguuuucuuauuuaaaauaggauuuuuguuccucugcagaagaguagucauuuuaaacauguagaucauauacaacaagaaaaggagagcgggugaagagaaaggggagauauuuugauuuuuuaaaaagacuaagauuuuuaaugaaaauaguagauguuaacguauuuucacccuucauaccuaauagugccauuuuguuuugucuuacuuuaucauuggauuaaagagugggagauuuagguauuuggaggcuguuuuauucacauaauuuaucaggccccuaauauaagcaaaugcgcuuuuuuuuuuuuuuuuuuuuuggucaaaugguaaaaacugccgcuuagguuuaguaguuuucauaagcggcaaagcuucaaaucuaguagcaucuucccauuuuagagauaagaaaauguagauaaguacuaaaaauuuaagugaaaacuaauuauacauguggaacacaagggaauuuauaaaagucaauacccugucaaugggcgaggacucgcuucccuucauuacucguccugucauuaugucaguucccaucauccagaagaaccauuugccuuuucuguuugcauugucacuagaacaaugaaugauaggggaaauggaaauaaauuaagcucuaauuacuccauuugguaauuguagagagcucugaggaaaaaauuauucuagcucauaguuaaagugaagucuaagaaguuuuugugauauucauuuacucccuuuacucuuccccuccuaccuagcauaaucaaaagcuagccaagguaauacuuuacuuuaaauguggaucuacaagcuaagaguuauuguuuauuuaucugauuuugaugguaagagauuucuauccuauagcauuguuuccauucucugaaagucucagauuuuagucaccuuauaaagcuguuccuuaauaaacaucuuguuggcuagauauuuauuguuguuggugguuuguuuuaauuaucugagcaaaauaauucaccaaaauauauuaaaauaugacuaaaaacuugcaauguaucuacuuauuucuagauauuaacauuauacccaacugucauuauuuguucucuugaggcaguaagaauacugcuguuucuuauaugauaaaacuaucuuuaacuggucauguaacuuacggugacauuguccuaaagaugaccuuugcaugauaaucuuuugaagaugcugcaagauaaauauaucaaaugauuucccuuuuugcaguuguggcuuguuguacuuuugguggagaggcacauguuuacauucaugaccuuaaaguuaucuauaaauuucaagggcugucuuucagaaaaucaguccugugugugugcugguuucauguacagucugacguugaaggacaaauuauagggauacuuuugagguagcauguguagggguuuacauguguaggauaagguaaaggcuuguguuuuguaagauuuuuaaaagauguuuuucuuaauugugcuaagauuuucacaaaauuguuuucucuguaucucaagggucccauauguuuuaaucuucaguuuuuaaacaauaucugaaucacaagaaaacauuuuacacuuuaggauuagaugauaccuugaggcauuuagagaaauauuacucuaagauaaccuagauuucuaauaaauuauacaagccaguuuauacuucuuucacaagucuacacuuccacuauuuucuuaguucuucaaccucauuaccuaauucagcuauaugaguaccuaggauguucaagacacucuggggaauacaaagaggaauaaagcacagaaaagcuagucaggaugagacaggcaugugauuaagagguaaggcauaugagaagcauccagaaaaugugugggauccccaagaagaaaaaaaauuccaagaugcaggacugaaaaaggaauaaagaaagcuucaugcaagagggucacuggcuauaaacauuaaaagauuggcagcuguuguuuuuguagguaugacagaaagaaauagcauggaggugggagaauauguauaguaauaauguagucaguuuuggauagccuauagcauaaaaagaguaggcaggugagguaagaccauggcaaggaaaguuaaaaccaauuaugaagugucuugaauucuacauuaaguaaucauaauuugguaggcaggaaagaauauuuaaaguuuucuuuucuggcagaggaaugcuagaaacagaauugggaauuuagaagauuuaaauugguagcauuuccaaugcaauugugauagauuucagacagugagcuaagaaugcagaggacaaaaaaauguuucuuaguugaggauucagugagguuucagugugaacugcuucaguugauacuaucagucugugcauuugaggaacuauaguucuuuuuuaccauuugcaaacagguuuuucagauaucuggaaaauauauaaaguauuuauuuuuagcccccaaaguugugauuuauuguacucacucagguaguggcagcuaaaaugauuuuuggguguaaagaaaugguugcaggugagaacaugaaauucagaaugacauaauguuaaaucuuguccucuagccaccgucaauaaauaugaacagccauuuuagaugaacggaaacaugaucaucauuuuauaaaguaccugcgcauuuagguccuuugcuaucucaaucuacuaauuaggaaagaacuauacaguucuauuccaaguuuuguauuaggcguauugucaacucucaguacauauuuaugaacaguuuauaggaauaacagccauuaagcaaauuauauauauguguguguguguguauguguauauauguauguauguauauauauguauguguauauauauaacauauauauacucacacauauuugcugagaguauuucaguaauaaugaauuucuuucagcuaaaccuaaggaaagugauuucacuaguuaauacuuccauuaauaagugcaucugagccaaucagcagucaauauuaauuuaagccuuacuguguguaaagcacuguaaggcauaugcuauaaaaugguaaaggaguaauagaauuuuuguccugaaagaggcccaguguggccuaaauucuccuugacaaaacguaaguacacagaacaugagcaaaauauuaucagaugccaaacaucaaaugaaugguucagaaaagacacuacagcauuucaguggccauagaaauccuuuaguuacuauacaucaguaacaaaugguauuucugaaacaguuagaaaaagugacauuugcauuuuaaagcagauuaauggauuguuucaaaaaauuaggaauaagucacuuaauuuucuuagguauugcccuccaagaguaaguuaccucauuaauuguacuuuguggcuuuacuagugauagacaucauugccuguaugacuugucuucaugaaauuuaauaguaguacauaaaaauaugcaaacucuguuauuaguauuuuauucucauuuaccuaaugugcaagaugaaagcaauuucaauaccaguaaauguuugaguguauugguauuuuuuaaagauacguucauaauguucugauuauaaaaucauaguugguuuauuguuaaauuagagccaauacagcugaaacuauuauucccauaucugucuuuuauuuuauuguugcugaaauuuuauuaagcaucuaucuauguuggaugcuuuguccuaaaauaacaaacuauugcauauaaaauccacauuacauuuucccaaaugaguuuuauauguauuuguaauaugaauuaaggaaauuugauugcagauaucuuacauugugucuauuccugcagcaugcaaagaauuccaaugaagaaugacuuccaaugcucaauaucacaaugagcguuugugguuugauauguguguuugucuguuaaaaggccuuuuuuuauguuaaaggauuuuauuaaacuucaaaaugauuaauaucuauuaggaaauuucuucuuucuggcacacuucagaacacuuugccuuguucuguuauuuggccacagucaaaagcccagauaaaaucauuguauuuaaagguaauauuuugucaugguauggcuacaguauauugagucuaaugaagggaaacaugaaaaaagagaaauugguacuaaagcauaagaccagucucuagugaaacuuuaaagcuauaaaauuugauuuuguagcuuugaaauacgaacguugauacauuucaaauauguucuuuaaacuuguuucuuauuuuaaguugauagguaaggguauggucuuuuaaauuuuguauucuaaagcuuccacaucauuuuagaaauaugaugggggaaaguaauugguaaguccuugacugaauuaucuagcacugcucaaauuacuuuacauguauuuagccccaccaucagucuaccuauuaaauaugaauuaauaagaguuugcaaaauaacuccaugauaaaaaucuaaugauugcuuauaggucuuaaaauguguucaauuuuuucuugugaauauguuucugcaaaauuauccucucauaaccgccccccuuuaaguugcuguaauuucaaauuguaggagaaacgaacaguuuuucagacauuuccuguaguguaacagaaaucuagacaucagaaucuccuaauucagaguaauugaacacuggcuuuggauggucccauaugagcaaguuagaaauugugguuuguguguucacaaacugaaaauuuuguuuaaauuugccugcacuuggaaagccagaacaggucucuaguuaucauuagcacagaagcuucaaccaugaaagaacaaaggcacuucugauuauauuaauguacuguuucaucagaaaguuuaagaauguuccguucaccauggagaaauauaauuuagagcacuuuaauuuggaaggaauuaaaaaaagaauaacaucagugcugcuuuuuucuuuaccccuuauagagaaugcuaacuuuucaauaaaaacugaucauaguuggugaauuuuacugucuaccuauuuagccauuaauaucuguaucugguguauauaaauuauaguauucccucucaguguuuaagaaucaugguguaacauuuuuauuuuuuguguaagcuugaaccccuuugggcaguggugaaucaucaguguggugcuacugacuccugaauaaauuguaugacauuucacuuauuuaaauauacugaacuuacauauugucuucagaaugguagagcagcuauggcuuuaagguccuucagaaguuaaauucuuggaaacuaacaauuugauuuacuuucaggucuuuuccaauggucaccuuggaagugaagaauaugauguuccuccccggcuuucuccuccuccuccaguuaccacccuccucccuagcauaaagugaguuuuguugaauuuggagaucacuugucuaugcaucaagauaugguagagugguuuugagagguucucaguacagacacuacaugaugaauagaaagucauugauaguaaacagccagcuguauuuacaaacuaaauuaccauaaauuaagauccuucccuauacuuugcugguaaccacaacaucugugagacuuaccuaaacucuugagguuacauagagcaacagggagagaaagcuacgcauuccuugcaucaaagaggguagaguagcacaaugagguaucccuucaaauuuaccucuucuccucagagguaucccauuuuaucucagcuucccaguuugacaucauaaaauaaucuuugguuccaccagguuucucauuucucacauccauucagcuacuaaguccuuuugauuauucuuuuggaguuuuucauauuccucuaaucuucuccauugcucuagcuuugccucagagcuggacaacugaaagagccuuuuaucugauaaucucuuaugaucggagaguuaguaucaauggguuuacggcuaguaaaaugagauaacuggguaucucauuugaaaaauggggccccagaggcacacuagauaucucucauugauaucuucccaaguuaaaccaggauaaacuggauaucccaauucuaauuuuccugcucuuuauaugaagucaggaugucugccuuuccuccgguauauuuuguucacuguaacugaguucauuuaauuuaacuucugccuuccccaggucaccuucccacucaaaaacuagcauuguuucccuuuuuccauuaaauuaacucuaugcacuucugcuaacaguaagauccuacagaauuuuacccaacuaaaauauuuuuuagugauuccuaauacuugcccuguaauuauaucuggauuguuuuuucugacuuugugagauuuuuaugcuguuccuccugugcuucaccuuuuccuaaucuuuauccuaaagguccauaucucagacucuauuucuuugugaaauguucugugacuucuucaauuguagugauuaagacugauuuacauuccucuuccugcaguuuauuuccuacucauuuaauuauauacucugccauacuguuuucuaauuuuaaugugacucuccaauugaaaagauuacaagacuuugaggacaaaaacuuuguguucucuaucucccauaacaucuuacuguauuugauauauacuaaguaaaugauuugcauauaguaaguaaguacacagagaauacguggaugcuugguuuauugauuuaaauuuuaucugcugagguccuuauuuacaauagaaggucuuagagcuucuucauuccuucaucugcaguucacugaacucccacuauacauaucaaugcaaaagaaaaauaagguagaucccagccccccagaaauuuacagucuacuuuagaaaauaacauuaauguauaugaaaucauuagagaauggugugcacuaacauuuauaaugcuaacuuaguaguuucaaaugaguuuggaggagaggcuguuauagacuuugugaaugaaggaugucauggagggaugggcauuucaugacucaugaaguacaggcacaauugggaaaggcagaaugugagaaaaaacaagggugugaaauuuggcaucauucaggggacggugggaaacucagcgaauuagaucauucuccagugggaacuucucuuggaacugcgagauauuuagcaggcauaggaguuggaagcaauuauacauacucuggguaguaggcucuaaaucagugacaacauaugauuauauucuagugcuaaaugaacucuggauauaugugcauguaauaaaacaucuaagcucaauuaccuuugauaacucagagaacauuagaaaaugaaaucuugcuaauuagagauuaaauguucacauucuguuuauuaaauucauauuggcaagcgagcuggaaguugcagugugcuucauuuguauuuaacauuaaauaccugcuucuccuguaaaugaagcaagaauaacaaauugauaguaaaauguauuuuuucuaauacuucaguugguaagugcaucuaaaauuagucauacuuucucccuauuuacucuugauuuuucccucagaaacagugcaauuguuucacuuaacuagagaaauauuuuaacagugcaugcuugccagcaaauuaguuuucaauuuugcaugcugcaagucagccauaguuagcaguacaaaugcuagcuuuuaauggcacaguuaucucuccaguuuauuuuuguuucugacucuguggguagcaguuguucacuguagacaauaugcaaaguauauaagagaaagaaaaaagugagauacauaagcacaagcauaugcauaugcuaaauaucaauguccagaguuuuaacauuuugacauuuuuuauuuaaacuuguuuuuaccuuauuuagauuauaugguagagauaauuuuaugcccuccuuucuuaacauuaucauaagcauuuuucuuaauuguuuaguuaugcauuguguuuauuacaaaaccagcauggaaugcugaugugaacaguagaauaaaaucagacuguguaccacaccugacuccgccauuaaguauuugucuuuuuuuuuuuuuuuuuugagauggagucucacucugucgcccaggcuggagugcaguggcgcgaucucggcucacugcaaccucugccuccuggguucaagcgguucuccugccucagccuuucaaguagcugggacuauagucguccgccacuaugcccggcuaauuuuuuuauuuuuaguggagacgggguuucaccauauuggccaggcuggucucgaacuccugaccuugugauccacccgccucacacucccaaagugcugggauuacaggcgugagccaccaugcccagccuuugucuuauuuuuaacaggaaaacuucucugggccuuuccccaucugguagaagagaggaucaguuuaacuuaaauuaucuccaaaauccuuuugagauucagcuuuuuagguucuauacaguguguuuuuuuaaaggauacugauggcaaaccugacaauaacagugagucaagagucuuggcuguggauggucuuagaacagaggucuuagcaaaaugccacucacagaaauaggaaugucagauguucgagaguucauuuccaucuuagacucuugguauauguuucaaaaucaggccaaagcaaaauuacgcauuccuaccaaacauacacuucuguaguucuuacaaauguugaaaacuccaauguuaaauccaagaaugucaaagcuaacauuuaccuuacauuuauacuauguuguuauaaauauuuacugaaauagaauuguuaaauauuugauauuguuuacucugauucccauuuacaugaugucagaggcugcugucauaguguuuccuguuaaacuguaucuuugcaauuauuugacuuuuauuguguaauuugucuugagaccuagaagaguaugaaauuuacuuuuaaaaaacauacuguuguaaaagcaaucugaaauuauuuguaucuauauacuuaauuuuucuaaauuaauguuuuuuucuaaaugguuucugcuuaacaucuuugacacuuagcuauaaauauaaaauuuuaaguaaauccuagaaacauggguaauuauuuuuuuggagggagaacaaaauaauccuauguggauucuuuuuacuuuauaguuuaaauuauuuauuuacuaaauuauauuuauuuugaaauaauuugauuuuucaaaauuaaaacuaaaugauacucugaauaguuaaggaaauauuuauuuuacuuggcacacaauagauuggcaaaugaacagaggcauuauuacaaguaauaauggaguaauuacuuccagguaagauaauguucugaaaugcugaggaauaucuuuuuuuuuuuuuaagaauuuuuuuugugugugugccuugucuuuuagagauggaccuuuuguacuuuugauauauuaaacuuaggcuuucaaauagccaugaaucaauauuacuugguuuugcauuuuuguaagaaagguuuuuuuguuguuggaggugguauuaucuauuuuuaugaauauauauucuuauaauauauauuuuucuaaagagauaaguccuuguauuuuugguuccauaaacagagaauacaaauuucaccuaacuguccuguuuucauucaguugcuuuacuuacuagagguucaguuuguacaagauaaaauccuuuauccucuuuggaauuuaagcucuaguuagggagaagagaaaguaaacaaauaacuauauuguauauugucagcuagugguaagugcuaggaggaaaaauaagcagggaagaggauaaauaaugauagagagguuuauacuuuagaugaggucauuaggaaagaccucucugaaaggcuaauauuugaacagaaacuugaaggaaguaagggagcaaaccaugagguuaucugugugaagagcacagaggcuggauagaacacaaguacaaagcaacuucaaaucuguuucuccgauuuacaaacaaguuagugaaaaugcuuauaaguaaagcuuaucuuaaagcuugauaguauaccacacagacuuuuuuuugaugucaugaaagacccuugaaaauuagcauguauaugauaaaauuuaguguuuugaggaaaugauuuauauguggcacaugugcaaaaaucauuucaaauauagcuauauuuuguuuugucucuucucuggacuauuuauuugaguuagacauuuuucccuguuaggauugggauaauguaauauaagaaauaugguguaauguauagggcaagcucuaaagauucuauuuuaacagaagauauuuuuucguuacuugccuucagauacuauuaaaggaagauagauucuuauauguagaaaacaagcuuacuaauuaagcauagcauuggauacuaucuccugugcuggcgugaaaauucacuuguuucuugguuuguuucaagugugcauauguagaagaugaauguauuuaucacugaaggcucaaauaacuaacacaaugaauuuaauaaaauguccagguugugggggggguggugacuaugcaucuuugagaguguaugucccuauguauuaccaguguauuaacucaguaauaacagcaucagugcagaacacuccgggaauguaagaugagaauauaaagggauugcaguaauaaguguaaugguaggcuuuaauguggagucagccaaauacaauuuguucagcuuuauuccucugguauccuaaaaauuucccguaaguuuagucaaugacugaaaauugucccaugccccauaagauagaaauuuuuucuacugccaaaugucacauacauggauagauaaugacuaaauauaaaucuaauuauuuuaccuguuauuuaguaguaaguaaaauuaaaccuguuuuuugaaugaguuuguagaggaaaauaaaaccccacauguaauuccagaugguauaauuaguuacaugacucuaguuuuuuauuuugcuauuuuauauacaacuucuuuaucucauuuguaccauccucuucuguuauuuuuuuugauagaaaccaguuuuuuuuuucagaacuggauaagauuaauuuuuaauaaaaacuauguaaucuugaauaaaauacacuguaauguuauucuuuugguuuauuucuaauccaaauagacuauuauacugauauuaaacauuuucauuaaaaaacauaagcagaaaaauaaaaucugaaucuuuagaacuuuauuaaaauggugauaaauggaacaccuaaguauuuuuuucauauuuagauacaaacaccacuugaaaacuauuuuuucacuucuagauauaauucucuaaaaucuguguaaguugacaauuuauacuaguaaguuuuagcaauaagccuuauuauuccaugaaguauuagaugagcuuugcuuuucacuucauucugaaauaaucuacugauuuguggcaaagcaaaagagugggggaaauuacucgagaaauucucuaucaaugaagguaaaauaucaaauuagccacaacguaugugauuuaaaaaaugguccauuguugacucauaaugaacugcuucuuuggaaacuuaaaucuuuggagggaaccugcaacaggcagaucuuagaacauuucugauauugaauaguuguugaauguuuagugaaaaauacuguuuucuuuuuacauaguguaugcuugaauugcauagaaagggauucauuauaaaugaaaguaucuuaggcauagagaggauguacaguauauauuucucauuucauuugguaauagaacccauucugguccuugacuuagcuaaauugauggcuguguuuacaggaauuuauggaaaaguaauauuauaagucucucccaguuccagugccaucagaucaccauuuugcagcccauauacuuaacuuccuuuaauuggaaaguaaauccuccaaaguuaaaccauaauagguguaauaauagauuauuauuaaggcccuuagcuugugcuguagguagugacacuggaccuuuugucacuaugcuuuugucucugugcuuuugucucccuguaacgcucaugugaauucuaaaguugcucaaacaacaagaauuuaaagaucaguauugaaauuuuuuucaaagauagguaucaauaaacauacacuugaaaaaucuuaguuuuucuuugaucuuugaauguccuaucuaaugacuuagauaauaugguugaaacuuaaaucuuuagauuuuucaaaaugccuucuuguaauggucacaaagaaaagccccuaaaauuguuucuguucuaacuaauaaaaagaaauaaaaaugaauguuaauucaggcauguuuguuuaauauaccaaaggccucuugcucccucuauagaaggugcugcaaaauugcagucacuuaguuuuuuuguuuuuuuuuuuuccuuccuuuuuaaauugaacagauuucucaugagguucaugaugauuaacaaaaagauuuggauccauguguguauucccaaugccuugcaaacuaguuggucguccuaaagugaaucaggaugaguuugugcauuucugccuuggcauuuuucauuggcuucagccaggguuagauuaaacucugguagcaacaguuacgaaaaacauuguuuauguuugcccauuuguuuggguuuguuuuauuugguuuauuuacucuuauggauaagugaaaugcuuaauguuuuugauauuaggugaugguuuuacucauuuuaauucucuuuuauuuagccagggaauuuaaaccauaaaaauaauguacuucaaagacuuaaaaauaaguucucucauuaucuacaucuaaucauuccauucauuucuagcucucaguuguugguaggaagaaaaaccuaacaacuucaacuauaauuucacaggauaguuaaguuuuacagaauuaaacuggauauuuuuccaacuauagauaauauucacaggagacaaaaaguuugaccauucuauaaagacuucuuuaauauauaaaacaaccaugcuuauuauuguagcaucauauuuuacccauuuaauuuaaauuggaacaaaauauuaauauuuuaauagauuugguuugaauaaauuuguacauuuugucuuacaaauccaacaucuuuuuauuuuauucgacagguuacuaguuuuuccuauugugccauuuaaaauugugaggaugaaaauucuuuuaucccaucaagggucuuaacaaaagauugaaaauuguuuucauuuguauuugauauaagaacagcuucucugaugauacccuguaauugaaaaaugaacauaagugauaaaguagcuucuuugacuugaauaugucacaucagacuugccuguuuugaauauuaugcuuaaacuagauuggauuuuuuuuccccugguagguguacugguccguuagcaaauucucuuucagagaaaacaagagacccaguagaggaagaugaugaugaauacaagauuccuucaucccacccuguuucccugaauucacaaccaucucauugucauaauguaaaaccuccuguucgguaagaguaugggcagauuuuugccacuuacaucugcauaagcauuaucauuuguaauguuuguuuuuaaacaauugauucacgucuaauuaaaaauccuuaauuuccagcucaaauccuucucuuccuauuauaccauuuccagcauuacuuuuaaagaaaacuaaaagaugcagauuucucauuaaucaggaagucacuuuauuuuaucaguucuaaacaccuaucucaugaagaaaaauuagugcucagaaacuaagguauuauucugaccuuccuuagaauuuuucuucaugauguacauacuaguauaauuuaaauucauuuuccuucuugauguacuugcuaccuacuucuauucagauuuugaagaagugggaaaaaaauaccaagguguuucucuuaacuuuuuguuuuucuaucaagugcuauuuaccuuccuuuagaucaaauaagaaugugaggaauaggccaggcgugguggcucacgccuguaauccuagcacuuugggaggcugaggcgggcagaucaugaggucaggaguuugaaaccagccugaccaacauggugaaacccugucucuacuaaaaauacaaaaaugagccgggugugguggugggcgccuguaaucccagcuacucaggaggcugaggcaggagaaucgcuugaacccgggaggcggagguugcagugagccgagauugugccacugcacuccagccugggugacagagcgagacaccaucucaaaaaaaaaaaaagaauguguggaauaauggggguuuuuuccuuacuuuuguggcuuauucucacuuacauggggauagccuuggucuuugacuuggaagcuccaucgagguaaauaagaguuauuaauaauggguuguuuguauugaaauauuacuuuaucuuuaaguaaaggcaugagucugcauuuauauuauugaauuuauaaacugaaaucuauuauuucuggguuuguuuguuuuaccugacugaaauauaugagguacucaguacucccagcuacaaaacuuacuuucugaguucugguuuccuuuguauaacauuccuggggccaugcuuggcacauagaauagggcucaaguacugcugguggcccuacauuccagcaucucuccaugacugacugagggauaggggagauggcaauuacuucagucaucugugccaucuuuacuuagugugccauuuccuuuugaggucaagucaaucaacugaaaacauuuuauaaguacaguguucccuucuuuuccaaugaaaaacuaaaaaauguuuuaauguguuucuucaggcaucucacugagguaggaaaugcagcacuuggaaagagaagcacauuuucauuuuaagcagaugucugucuuaauaagugacccugguuagaauuaucaacauucugcugaauuauuacccagaauuguuaauagucuacagcgcaggacuuuauuuuuuuaaaagcaagaaccuaaacacuccuugcuauugcugguguuuagauaagacaucuguugauaaaaucauaucauugagaagacaaagaaauaacgaggagcuaauuuuauguaucagaagaaccaaguagcuagugauguauuugagaacaaaagauauuccuucucaucaaauauaaguuguuacaauuuucgguucuuuggcucuuacaaaugugcaguaauuuuuaaaaacuaaaguaggaugagcuuuuuuuggucucuuugggagucuuauuuuuuuucauugcuggauaagugaggaguauaauuuuaauacguuaaauuuuaauuguuacaucauauuggaugugauuuuuuguggcagagcucccaaaucuugaaaauaaauuugaauuauaaccaucauuaccauuuuucuauuguuacagaaaaguaauaaacguugauaaucccuaaauguaauuggagugaauucuuuaucuaauuuguucuugaaagcugauggaugaaguaucuucuuuugugcucuccaaagagcucuuuaagcuuaacacuuucuuucccuguguguauuuuucccccuuuggaacaucaggagaagugaauugucaauauguagaaaaagugacccaguaaaugaguaauucaauuuaauuucaguaaaaauccaucauuauuaugaagauucaauacaugauaacuauuuuuaaaugaacuauaucuggccccuuaaagagaaguggccaccagagagaauagaaaugaauuucagaugaagcauucuugcauuaucuauucaaauauccgucucuuccauuacauacgcacuuuuacuuugcucuaaaaauucagaguaaaucagagaaaaguaaaauguaaacucugauuucuauagcucuuugucaguugauuguuauagagcuauaugcugaaggcaaaauaugcuccuuaucuucucuuccugcugcuaucuucccauggcucaauuuuaaccauuguguucauaguaugauuccgaagaauuaauaccaauaauuuggcuggguucgguggcucaugccuguuaucccagcacuuugggagggugagguaggcagaucacuugcggccaggaguuugagaccagccugggcaacauggcaaaacccuacuaaaaaauaaaaaaaauuggcugggcgugguggugcacgcuuguaaucccagcuacuugggaggcuaaggcaugggaauugcuugaaccugguaggcggagguugcggugagccaagaucaugccacugcacuccagccuuugcaacacacagauacacacacaacaaaacaaaaaaagccccaacaacucaagcauacuuuucugguaaguaguacccuuuacaaacacauuaaaaacuguacuugucguguacccaaggccuuugcuaaagucauuuucuguagugucagagggccagaauuuuguucuuggcaguggugaaauaguaccacaggcucuaguucuuugaauguuccugucagaauuguaauggaauuauugaaaguucaauaauuuuucuucuuuuaugugcuguagcuuauuuuuauuacaaggaaauuuuaaguuacagaagcaaaaauaugauauuaaauacuaucaacaaauaauaaagucauugagacugcuauauguuuuugccuuggcacauacaucuuuuuuuacuucaaaaacuugaccagguucuauugaauucuuccacagagauaaguuaauuuuacauaguguuuaggauaucaacaauuuuuguggcccuuguaauucuugguuauaguuuaaaaaaagagagacuguguuacuugagauauuuacuucuacauuuuaaaauaagggaugaguaucuugauguuauuacugguaauuuugagaaaagaaaaauauauguucaaacuuuauuaaauaaacaggaauacuaguucccucuaccucucaaguuacuuuuaauuggaaaguauucuccuuauauaauuuuacucugaacuguccuuuaggucuugugauaauggucacuguaugcugaauggaacacaugguccaucuucagagaagaaaucaaacaucccugacuuaagcauauauuuaaaggguacguauagaauauaauuuccuuugugauguacaucuuaauggucagaauuuaaaggcaaaauuucaugccauuguacugaaaauacauuaagguuuuguguuauccucuaggagauguuuuugauucagccucugaucccgugccauuaccaccugccaggccuccaacucgggacaauccaaagcaugguucuucacucaacaggacgcccucugauuaugaucuucucaucccuccauuagguugaaaccuuuaaaaaaguuuugaacaacccaccccuccuucuuuuaauuucagaauuuucagaauucagaguucaguauaacacagacucacuggguugugaauuugccugaaauuugaauggguucuccaggugccggugacucccaaguucacgagaccauuacuccauguagaugauuaagguaguaguguaguaguugggcaucagucagguuuuaagcaaguuguuuuguccauacuaaauguagucuaaaaacacaugagagcuuugugcucuaguaguuuugaagugaugacuugaaguguugagauuuucuuuaaguauaauaauucuuaauaaauaugaacuugcuuuucuugcagcaugagcaccaguuccacuuacgcuaauuaaauuaugcaaaauuaaauaguuguauguagagaacugauaauaaauucuguuuuauucuaaucauuacaacuguaacacauucaaaaaaaucucaauuuccuuguuucaaauuauaauaaugaagaaacauccuauguguauuuuuguuuguauccacaggugaagguauauguagguguguguauauguugaaguuggcuggugccacugucacuguuaauuucauuaauucuaauuaggaagcaucucacccuguuuuuagaagacagaaugucugcacaccuuacauaacgcuucacaauaacaagucacuguaacauaaaauaauauaugaugaaagucaauuuacaagcuuuucugaacuggcuguuaggccaccagaaauacgaaaugaaccuuuccauuuucucacaaguaccacugacuaguauuuugaaugacacaauugcaguaucuuuugcuccuguucucucuguaguucaggacuuuauucucaccuacaucaauuacaaaaggcuccuaacucuguuaccuacagucuuucucucccuuccacuucuuccugcacacuuguuuuugacauauuacccagaucuucaucaccuggauaagcauuguucaauaaagcuuucuguggugauguaaaggaucuguauauuugcauauggguuaagugugauuauggaacugacuuuucauuaaauuuaaauagcuaaauguggaugggugacuacuuuauaugacaaaguagacagauuuuccaaccugucuuuuuaccuugaccuuuuucuaggucuucuuaugcgugucauuuuuuucuucauacuguuuacucuacuuagacgauccuguccuugcauuugaugaauaaauuuuugagccuucugauaucccaggacuuccuguucuucaacacuucacugaauaccacuugucuacauuucucuuuccucauccaaugcauaugucucuuuuaugggaccaauaaaacacuuucacuuguaaaucauaccuauuugugagcuuuuuuuuaagcuccuuucauggaaucucagcuccuugagucagagccuuauaauuuugauuuucauaucaugcaugagccuggcccagugucagauguuuaagggcugaaaaaagauuugaauaaauaugauaauguaggaaauagcugaagguuaaaaugauagcaaaacucugucuugugcaucuucagauguguuaauaagaaaaauaugauuaaagaaauuagugugccaauuuuuucuaaagcaaguucaguaaauaguaauaucuuuuuuuuuuuuugagacagucuuucucugucaccaggcuggagugcaauggcacgaucguggcucacugcagccuccgccuccuggguucaagcgauuccccugccucagccucccgaguagccaggauuacagucacguaccaccaugcccggcuaauuuuuuguauuuuagcagacaugggguuucaccauguuggccaggauggucuagaucuccugaccucaugauccacccaccuuggccucccaaaaugcugggauuacagacaugagccaccacgucaagccucauuuuucuuuaaauaugccauuauguuuaaaucauucaacuuaaaagugugaauuuuuauuauuagaauauguguuuauguauacccugucucauuccuaaaguauuuugagauagcuuaccaaacaugugcuuuuuuuuuuuuuuuuuuuuuuuuuaaagacucaagguaaugaaaacuaugaguagaauaguaaggugugacaggggacaaauaaguagauauaaaacuaugcugcaauauucuaguuauuaaagcugggaaauaugcaaauguaaguagugcuuggaaccagagaagguucuauauuuagcuguucuucuguagcuaaaucugacaaauugaaaaauaucauauucucugcucuagguacauuuuauguauauuuugacagcauaucaaauauaugaaacauuagguuaaauaaauuaaaauccaguggaauaaacuauaugggauaaucuaaacuauucuuugacauuaaauuauauguauuugaggugauuuuccaguuaaaggcugugaacucuuuuugcuacacagaaaauccuguuuucauagugugacugauaauaauuuuuaguucaaacucugaguccuaauauuauaaagguuacaagugaacuaugagcuguuucauaaguuacaaugcugcuuuuuauaaaaaggccugauagaaaaaguuugcauggguguguuuguacguauguauguauguauaugugugcauguguguguuucucuccagacucucccacaaaauaauuagaucccauuaucaaaguuggugaacugcuggauaaacccugcgagugaaauucuuuauaagcagcaagagaaaaucaauuauuacuuuuguuagaugcuguguauuuugauuaaugaaguucugcugcugauaucgaccuuucuuuaaaugcaggugaagaugcuuuugaugcccucccuccaucucucccaccucccccaccuccugcaaggcauagucucauugaacauucaaaaccuccuggcuccaguagccggccauccucaggacaggaucuuuuucuucuuccuucagguaggagggaaaagccaaagaaaacuauucacuuaaagcaaaaauauuuccaaaaccauacuaucaaauaaauguuagugauucauuagucucuaccucccuagcagaacagaaaaaucccugggugguaaaaguagcaaucguggguacguuuguuugucaguugauugguuuaaugccaacauaauuacagagauggaaagagcaauaaggaacuacaguagaaaugaugcuguagagauuguccaguccagaaaccuccuuauguuacaaaugcaacccugagaaccagaacugcuaagggguuaggcuaauaguaaugggaacaauauuuagacuuugucuuccgauucccaaugcaauguuuuuuaauagguuuuuaaaauuuuacuagauaugccuuagugucauaauuuuguucaaaacauaagauuuugguaaauuauguuguuauaacaagaauagagaaguuuuucugaaauagcugcauuuuauuguuuuguugugauauuuuuaaugccucaguguguaucuacucacuaauuauugguauucuaaggaaaacuaauuuuuucuuaguaacuauuuaauauuauuauuuacauauguauauauuauauaauauuauuuguuuaauauuaguaaacuaauuuuuuauauuaguauauuuuaaaauuucaaaagaggaucugaaauaaaaaugaagacuuaauaaacuaucuguugcauuaguuagaauuaucaggaaaaagaaaaaaaaauguuauauggaaucugcugauacuaauuaacaguuccagucugucuuguuagugauacugugcccugaaaccuuugccuccuuggacuugauuugggaaaauacaggguaaagauguucuuuuuuucauaguuccuuacauuucuacaugagauaaaucaugaaaaucuuuaaaaagugcucaguuuguccuuuagcuacguauaugccucauggaaacuugagaaucuuuauucccaacugauucccuuaucagcuuccucaguugauuauuagucaugucuaccauuaguuuuucuuaguuuuuuuuuuuuuuuuuuacuugguuugauaguuuagaaaguuugaagagauuugauaagacacacaaguuauggacguacaacuuggaauacacagcuucaauuucuuaaagugguuuauuuuucaagaauaaucuucugcuuuuacaucaguaaauauugauugagccauucacuguuuacccauuugugauagaugccuccugaccuguggaaccuuaugaguuuacuggauucugccaaugaaagcacuagugucauaauccauuccgguccaagcaggaaguauaguguaugaguccguuuucacacugccauaaaagcacuacccaagacuagguaauuuguaaagaaaagggguuucauugcuucacaguucugcaugccuggggaggccucagaaaacauacaaucauggcagaggugaaggggaaccagggcaugucuuacauggcagcaggugccagagagagugagcaagcagggaaaaugccagacauuuaucaaaaaccagaucucaugagcacucacuaucaugagaacagcaugggggaaccacccccaugauccagucaucucccaucaguucccucccuaacacguggggauuacaacucaaaaugaaauuugaguggggacacagagccaaaccauaucauaacugcuugggcuuuuauucauauaguuaguuacauguaaacacugcuguauuucgcuauuuuuuuucacuuauucaaaacuuugucuuauacauagacuuuaacaugauuuuuagaacaaugagucauuccaaaucuuaguuacuuaaauuuccugaugcuaaguucaagauaguuucuggcucuccuauuaccuuuuauaugcguaacuuaagccccaauagauggaacuuugaugauguggcuuuucugacaaauaaagucaagcuuuccaagagcuauaauaaaagagaacauuuuacacaaauacacacuuuuaccuguuuuugucaaaagaauuguaaaagguuuuaguuauuuauuuuaucuuaauuguucauuuccuuuuauauaaaaucuucauaaagaaaccccucaagauuaauugcuaaaaaaaauuacuaguuuaaaaugaaaauguccccucuuauuagcuaaaaugcaauuuuuauaaaccguuguauuuauuuuauagauuugccuguuuuguguuugcuuggcugccagggagcucaacaacacuuauccuuaacuuagagugucaggcuagcaugggagucagggcaauguuuuucaagccuguugacucucucuugacuuucauuaauagauggacauauucuaauucucuucccaauaauaucaacaucccuuauaauaaguauuucuuaaaaaaaaaaaaaggcaacuuuuuuguuuccuuuuccagucuuucauaaucauuuacaugacagauuucuagucugguaccagauccuuuaugacuuuuuuuuuuuuuuuuuuuuugagacagggucucacucuguugcccaggcuggaguacaguggugcgaucucaguucacugcaaccucugccuccaagguucaagugauucuccugccucuacccccuaaguagcugggauuacaggugugcaccacuacacucggcuaauuuuuuauauuuuuaguagagaugggguuuugccauguuggccaggcuggucucgaacuccuggccuuaugugaucccccugcuucaaccucccaaaaugcuagaauugcaggcgugaaccacugcacccagccccuuuaugacuuucauugugacaauuauuuugauucaaauuuaaaaccguguguauuagcuuuccuccuuuucaaaagaaauauuuuaauauuuuaaugcuauugcauaucauagagcauaaagauuuuuuuggcugauaaaugagcauuugaguauuguuuugcaaaguauuuaauacauuauacugucuaaagaaauguaaaagauucauuauagcaguucucccuaagaauugacuuuauuaagaauaugcuauaaaugcuaaaguuuaacucaguaguuuuagaauuauaaaagguaaauaaaagggacugcaaaauuuaaacaaacucugugagcauuuuaccguuguuuucguuguucagucuguaaaaucuuagucugguguaaugauacaucuuuucuaaacauuauugagauuugguuuccugaggaaauaauuauuucuaauuaaagacaaaugauaggugucuuaggaagagagguugaauuuucucaugauauuauacuaaguaccuaaucaagccuacauuuuuauuccagcauucagugcccugcacaguugggccagguucagcuuuucagccuuauagcucauugacuucuauauaguagugauugucaaauugcaguguccuaugucucugcaaaagugccucaguacuguuguaggaucaagggggcagggcaagcagaggcagggcucucauucuucuuuuaucucuuuucuauuuuaggccuucauguaagauuucuuuuggcagaauaguaaugccuacagcuguacaugagcccucaguuuuggacaggccaaucauaucuuaacaaaaccugaaguccccaacaaaagcuuuacacucuuuugucuccaaucccaaggcuaccacuaguguauaugugcuuuuuuccauauuacaaaaaaguacuuccuuuuugcugguagauugaaguagacaccccuaccucuacuuugugccaggucagggcucaagaaacaaagcaaagacuguauuuaaguccugcucauaaccauaacuaggugucuuugugcagugcacaaaauacaguguuuuugucagucuuuaugcuaccuuuauuuugcuguuucucuaaccuguaaucucacuugaagaucuuaucuaaucuuaaagucacaguucaacucugaaagcuagccaaauugacuuuauuaaagauaaauggaaguuuuauucuuggauccagaaaugcaacugcauaaguaaaauaugaagaaaauccagaucauuagcaacaauuguugaaaagguuuuagggguuuuguugacuacaaucuuuauaaagcaucaucaugaugagaaagcgcaugccauuuggggcuugaacucacagaauucaaaucugaggagugaaguccuccacaguacucagccuuuguggagaccacuguguucagauguugaagcauuaaugggcuagagcagcaauucucaaauuguguucuccggauucacaacauuagcaucuccuggggauuugcuuuaaaaugaaaauucaagacuuaauaaaucagaaacccugggaaugggacucaguggucacaagccuuccuggugauucugaugcauguucaaguuugaaauauacugggcugggguauucucaaaaaagugcaaccaggaugauaaaguaaacuagaguggauuaaaggaacugagaauuggcucagagaagagaagaccuuggauguagacgagaguugucuucaguuacaguauuugggaaagaaggauuauauuuuuuccaugucacuucagaagguaggaguaagaucaaugggaaauguuaagaaugaaaauugcauucauccuacaaagaaguuuccuaaaucauuacgaauuguucuaccuugaguguagugaguuaucugacacuggaggauuuaaaccaaugguagaucauuacauaguagagauaugaacaugagcuaaagcaugagggcagcaaagaggggagaacuuuguuucaccuaaauggcucuucaaaccuuuuuuagcauuaguuucugcuuugauauacucuauuaaaauuugggggauaauugauaaaucuuccaggugguuuauggauggccagggaggaaauuugccauuguuuuaauuauuuaauuuuauuugccucuguuuuuacacuugguaaaaauuuggaaguguuucagauagugaagaaaaaaaagaauuaagaaaaacauuccaggccagguacaggcucaugccuguaaucccagcacuuugggaggcugaggcaggcauauuucuugagcucaggaauuugacaccagccuggccaacauggugaaacuccagcucuacaaaaauacaaaaauuagccggguguugguggcucgcgccuguagucucagcuacuugggaggccaaggcaagagaauggcuugugcccgggaggcagagguugcagugagucaagauugaaccacuccacuccagccugggugacagaacaagacgcucucucaaaaaaaaaaaaaaaaaaauccauacuuccuccuccuaaucauugauagguauccuuccuuuuuuuuuguuguuuuuuuguuuaguuuuguuuuguuuuuugccuacgaguauguaaguucacauuuauguaaaauuuauuucucauaguauaugcuauuuauaaccauuuuccaguuaauaugucaugagcaauguauauaguuguuaaauauuuguacacaauauaauuuuuauugauguauauuuccucauuucuuuuuuaaguagcaaaccauuuccucccagucuucccuuaguuuuuuauaaucucucaaauaaguacuaaauuuucaguuuugcagugcuguacuauaaaucacaggcaguaguacuuugcuuuuuacaacagauuagucucuguauguguauccauuuauuucucaaacacuuauauaagugauaaauuggcugugaucauuucaguuuguuuuaauccuguggauauaauauuuuucuuuaguuuuugaagaauuuauuuuagaaaagcuuuauuacuuuacaaaguuuucuuaucaggggacaauugguaauuauuauacucuguguagcaauuguguuauaucuaaucucuuucccuuuaaagccugaaugcuuccaacuuuauaauuugcuuuagagagcccaguuuacccuauggcugacaaauagcaaacuuaggauaugaugcaagauagaacaugauaaugauucaaaacagaaccauaagcagguauuuuugcuauuuauaauaauauuuugaguguaucuaguaccuuuuaaauaauauaguuuaauggaagaauauaguacagugguauauuuuauagucuauguauggcucugaaguguauccagaguuuacuuuuuaaccuuaaauaaauagaugauuagaaauagcauuaaguguauuugacaaaccuauaaauuucccguaaagaaauaagcaaguguauguauuguaaaagacagucuuuccucugacuuaauguuguaucaggggcauuuagagucuacaagaaccuaaaguaaauuuuaugaaauaucuagugcaaaaucuuugggaaauuucaaaauuuaugcugaaaucaccauauuuguuuccuuugguuucucuaacaaaccaaaagaucaacauugucucaugcgauuuaucuucucauuccuuccuaaaaauauuucuggaaaauuaauggagcuggaccaccaauucuucaaauauugaaaacucaaaaucuaagaguuauuuuaaucuugaaauuaaugaaaacaaguuaaagagccuugucuaagucaaaaaguccucagcaaagcuggugauaauuauuauacuccaaaaaaggugaaaagauaauggcuucaaauccugccuuacauuauccagucaaaaacuaauauaaaaauagucaauauuuaagccuauguuuucaucguaaguaaucaaauacuuacauauuauuaaugucuaagggaguggaaguuaaaacaaugaaauucaaucgggucuucuuuaauauuuacaauuuuugcuuuacauuagcaauucagguuucacugauuuuaaaauugugaacaaucugaauuuguguggauuuauuugugguaguuaaaaguaaauauuaagugcaagcuauuugccaagaguguucuaggugcuauguuugauuuaggagguauaauucaaacaugagaaguaggaaaagaucccucagaucccuguccucagaagaauugacgguacuuucagagauaucgacaacauaaaaguacuaugagaggaaagcagcggugccugaggugggagugauagcuagauaaauuauuagugaaccaagguuuucagauguaauguuugucuacucaaaaagggaaucaauucucuaagaauuuaaacccauauaauacuaugaauguuaaaccaguuggguuuaugguauuaaugauuuaauacagcaacacugacaaaaucucuuuuucucccuuuaguuccaguuaguaaauaucauauuuuuuacuauuucagaugccccgucucugacugccaaggugguaaauuaucacauuuuacuguauauucaaauguuaauuacuaaauggcauaauuuuaacaauuaaauuuacuauuuugugagccaacuaacaacaaugauguuaagcauaggaugcccaauauaauaauaagcaccuuguauguacagaagauuuuacaugcacaaauucauuuaauccacacaaauccgaaguuucaggucuguuuuacaaauuuuguaugcccaaugcuuagagagaucaaguaauuugauaauacucuuauagggaggauccaaacccaugguuuuauguauauuuguuuguuuguuuuuugcuuuuacuuuagaacaguuucuauacauuguacagguuggauugggacagaaaauaaaauuuagaagcuguuuuuauugucaacaaucuuauaauuaaauauaucugcaaaauauaaauauaaaacaaguagucuuuauuaucuggaaauaaaugugaagagcauauuuaagcaagugaugaauaaauuagaaaauaugcaggcaguaaaaaaugguuaauaucagucaugaauuuaauuuucuaauuuauuuuugaaagccauaaucuucauaaaauaauucuagaauuuuuuucuucagccaaucaacagagaucauccuuuuaauuugaaacuuguuuuuauuuuuaagaucccuuuguugaucuagcaaguggccaaguuccuuugccuccugcuagaagguuaccaggugaaaaugucaaaacuaacagaacaucacaggacuaugaucagcuuccuucauguucaggugaguuggcuaguaacaguaacaauaauaccuuauuguuauauagugcuuuuugcuuuucagaacaccuucuuauucauuauauaauuuaaugaauguuguccacccaagaaaguauuuugaucaucauugcauuuugcuuauaaagcuggcauugugagaggaauggcuacagaacugccucauugaaaagaaaaauauuaagcuuaauauuaucuuugaucacucaguggagccacuucuuugauucaaaauguauucauuaucuaacuuucauuuugucucagauuuaggaaaugaggaaaaucucuuuguacauugcaaugcuguuuuauagcaaucucuauggaauuaauacuggcaccaaacuauucauuuucuuagcuuauuuagggcuccaaccagugcugcacugacagccaucaaauagaaggauguaccauuuuuguaaauacaagucauacucacaaccguuaauaauggaaugcugcuucuuugcuucuugaggaggcuuucccugaacauaucuaaauagcuccuaucuucugcaguuauuuucuuuccuuuuuugcuuuauuuuucuucauagcacccgucacuacuuaaaauuuuguuauucagaauucauuugguugauuguugguuaucugucucgucugcuaaaguauuaacacuuuggagauaagaauguugucugguucacugcuuguccuagucaguucaggcuacuauaacacaauaccauagacuggauugccuaaacagcaaacauuuauaucucacaguucuggaagcugggaaguccaagaucaagcuaccaacauucagugucuagugagggcccucuuccagguucauagauaacugccuucauacuguguccucacaagggcaagggagugcucugggaucuguuucauaaggaaacuaaucccuuucaugagggcuuccccugcauaaucuaaucaucucccaaaagccuccccuccaaauaucauuacaaaagggauuagguuuuaacauauggauuugcagggaaaaggggacagacauucaguccauagcauugcuuuauccucaaguguccaacauagugcccagcauaugucucuuugauggauaguuggggauggauggauggauggauggauggauggauggauggauuugaguggacaaauaggcaaaaggagggaagaauagcugaugucuguauuaaacuaaaugcaaauaucugauaagcaauauuuuugucacauauuugugaauaucagaaguuuuccuauaugaacuuuugucuuauuucaaaauuuuuuuaagcuaaaaccucaguucauagaagacuugcuaauacuauuagcaauacauucugaaacuucugaaucaagauaauuaaugagcuguuuuaagaauugucaguacgguaguucuuacgugcucgaugccaugcaugggagaugcagaaaucccuguguauuuauauguuuaacugcuugcauguaacucaggaaagcauagaaaaucuuuuuaaucuuuucaaauuuuggccaguguucucuuaucaguuuauuucuagucauucuaagguuucauauguauccaugaguagccuguaauuccagucaaaauaauuugaugacaaaacaugaaagucaagaaagaaagacaauaucugacagcuucuauauaauauaaggaagcaauuuuuuuuaaagaaaauaguauuaaaauauaacuuugagcaaagugcuaugacugauuuaaaauaacauauucaguaccaccagcucuggauuaaaagaaaccuauacuuuaguuaggggaaaacuuguagccaaaacacaguguuuucacagcuucuuuacaguuuucuccauaauaaguggguguuguagagcccagaggaacaucauucacauauaugauuucaagcaguaugaaucccuauuagcauuacacuagaaaugucuggaagaacuucaaaucacaaaccuuguugaaauauccccgaauagccauuugccagaagccugaacuggcuuuuaccuaaguaauaaaagacuccugacuauuacucugagggcccagcuagcuguaacaucaaauauuucaaucuacucccuaaauucucuuuacaaacacagucaaccacagaaaauaagauacuuuuuuccaacauauguuuguucacaugaaguucacaggccuaccaggcuguucacuaguuuauuuuacaucagcagagagacugagcuugccuucuagaugaggucuuuccauucaacccuugagacugaaugcauaugcgccuuuaggauucuaauagcucuuauuuugcaguaauuaaucuguuuuuauuaaggccuuuuuaagaugaccaaaugggguucugguaugauugcucugccuuaugaauucaaguucuguuaucacuuauggcugucuaaauaauugauagucauuuaugaauaggcuucuauggaaaguauauuucuaaagaaguuuaaaauguaguuucauugauuuuaaaauaucucccuuguuuucuuaucuaaaaaguaugucugcauguauauguaugucuacauauauaaagagccuucuaaauguuuauuccucccaaagaaaauauuuuaugcuuuucuuaaaguuuuucuaaauguauaauugaaauuuaaauauaugaacguaucauagguaguccagauauaagaagagcuuaccagcccauguuaaauucacauauaucgguauauaggacaaacauuuuugcuaguaaucugcuuguuucuuuacauggauguauuauucacauggggcacaugucucuucuaucuaugugugagguuuuacaaauuucucaguuugcuuuucucuuguuguaagacauauuguacuacaguuugaauaccauucuuugaaaacuaaaaggcuguauuaaugaagugcaccauucacucuugaggugauuuuucauauuguuaguauuuagaaggaaguucaagguaacacuugaaaacaaugcuugauuuuagcacaacucaaauguguuugaaaccauuaaaagaccuuauugccaaauaagccaaucucauuauaaaauaaaggagaucucauuacaaaaugaauuaauuucaauacuaccauuaguuuacuagcuuaaaggagaauuguuggaauguugaauacauuuuauauuaggaccaaguauucaauaguuuaucucuguuaagaucucaauuggaaaucguggcuucacuucacgcaaggguuggaauuuuaagguagauuaugugucuuuaagauuuuguguuucaacaaaggaaauggcaauguugaguuuucccacaguuuagcuaugugaaauacuggggcuuacagacagcuucaguuugaaagccagagaaccuagaguuguuuuccuuacaaaucuaagauuaaauaaccauuuucuggauauauuuaaaacaguguaugugaagauuuuuuuauuuguaauuuaguuuauuaaaucauguccuucuauaggcaguauuucuuuuuuuuugagauggagucucgcucugucgcccaggcuggagugcaguggcgugaucucagcucccagcaauuuccaccucccagguucaaguaguucucaugccucagcuucccgaguagcugggauuacaggcauccaccaucaugcccggcuaauuuuuguauuuuuaguagagaugggguuucaccauguuggccaggcuggucucgaacuccugaccuugugaucugcccaccucagccuccuaaagugcugggauuacaggcuugagccacugcgcguggccagcaguauuucuauagaggcaguaauucaaccuuauggcauaaaaaugaaucccagaauuaauugauccaacuucuaguagaauaacaaaguuaaucauaauguguuugagauuucuuuuauuccuugaucaauuaaguguauuuauauuuuuuucuaauucuguuauuguuauaguugagaaggucaguagucuaagaguuuugauaucugucccaagaauugucacugguuuacuaaguaaauuuagacaguauguuucagauaauauauacaauauuauuuugucuaauuaaaauucguuaaguuuguuaagcauuuacuauaguccugaugcuuugcuaaguauuuuagagacagauauauaauuuuuuuuuuuuuugagacgagucucacucuguugcccaggcuagagugcaguggcacgaucuuggcucacugcaaccuccaccuccuggguuuaagcaguucugccucagccuccugaguagcugggacuacaggcgcccaccaccaugcccagcuaauuuuuacauuuuuaguagagacgggguuucaccauauuggccaggcugaucucaaacucuugaccuugugauccgcccaccucggccucccaaagugcugggauuacaggcaugagucaccacgcccagccagauacagauauauaaauuuuauauaaguuaauauuauauauaauuguauuuauauaguuaugcaguaaaauauaaauauucauguuauuuuauuuaauaauguauauuuuauauuaucuguuuauaauuauacauuuauauauuugauauuguuauacaaauauaugguuauauaauaugguauagauauaaauauaaauuuauuuuuacuguguaauauagaaauagauauaauuuuauuucuccuaaccacucugaaauauauauauguguguguguguguauauauauguguguguguguguauauauauauauauauauauauauauuuauuuauuuauuuauuuauuuauuuuuuuggagacagagucucgcucugucacccagcaggcuggagugcaguggugcaaucuugucucacugcaaccuccacguuccggguucaagcaauucuccuguuucagccucccaaguagcugggacuauaggcaguuuuuauauuuuuaguauagacaggguuucaccauauuggucaggcuggucuugaauuccugaccucaggugauccaccugccucagccucucaaacugcuaggauuauaggcgugagccacugcgccuggccugaaauagauacuauuaaugucaauuuauagaagaaagaaagacauaacaaaguuuaguaacuaacucaagcugcugcagaaaguguaagccugauagaauuuacaucaguuucaguuuuuuaaaaauuuguuaauaaaguuuauguuguuaucccaucaucaugccagaauuaaguuagaaaaaaauguacacaugcaucucacgucuccagacugaguuuggagauguucagugguaaaaucaugauaauagugauggaauaguagugaugacaaaauaaugaaggguuuuagaaauaguaaaacuguacuagaaauuucaaaaucuagauucugauuauuuuucacaugaccuuaggaaagccacucacuauguacuuccuauauuuuucacaugagcgaaaucgaucucugguucucagucuuagauacuugugcagcugaggccuuuaagaguaucagaggagaucugagacuauuuuguuguugguggugguuuuucuaauuaugcgcauauuauacacgcauuggaaaauaaaaggaaauuacagagaaaacaauuaauaagaaaaagcaaucacuuaaaacccuaucuucaauaaggaacauuauugccauuuucaagugcagccuucuaaauguuuugucuaugcacauuuucacuuacgaucuuaagaucauacucaauaugucaauucuaucucaguuccauuuaggaguauuauaaguauuuuaccacauuauuuuaaaaaauaaaugucauuuuaaauuauuguaugacaauccauuauuuuuauguacuaucaaauacuauuuuuaacauuuugaaagucuaacagaaacccuaacuuuauauacuagaaaacuuucacauuaaaucccuuugcugugaccuagauauacagaagcucaguguuauauuuauuguugaacaugauccaguauaauagaaaaugggaaaauguauucaucaauacaauagcauuugcuuauuagacacaucuuucagaauauagaaaaagaaaacccaacccaaucuuuagaugaugaggggaguaauaaagacuuuuuguggcaaaauaauugacagccacugaaaugaaauauccucaguucuuuaaauggagguuauguagauauacagcagugcgucucacuuaaaaaaaaaaaauauggucugccuacgggccuuuuggacacuuuuuuuuuuuuuccuaauaagcuuucuguccccagcaauaaugaaaguuuaaacuacagaugugcuuaguagacauagagauagagguauaucucuauguaccauggcucuuuggaaggccacaaaccauuuuaccaucuaaaauuguuuucuuucaucccacaagaaccaaugauugcccccgucuagaauguaugaccuagaguaaucauucuggguauuauuccaaccauguuaggcuaauucccaugcaauccaggaauguucuguuugucacucuguuggaggcugaaagaaugagggucgugaucaacucacuauaccacuggaggcuauaugagugaacagcaaacuguucucauaaaagcagaauguugacaaacugacaaacugcaucugcugcccaggaggaaugcugagggcagucacgacccaggcacaaguguugcuuuugauuaggcacaucugaagccuguuaacaauaaugugaaccugugaucagucaagcagcugaccaaucguuaccuccucaucccugcucuuucuacccaauaaauacaaagggcuauggaagcucagggcugcugccuuugcucacuucuucuuccucagacccuuuccuuaaaacaguuucuuuuguuuuuuguuaucauuucuagguucuucccuuaguucagucuuguaaugauggucucagguaguaacagaaguaacuguuguaaugacugucucaaauaguaacagcaguaacugugauagugaaggucucaaguaguaacagcaguaacugugauagugaaggucucaaguaguaacagcaguaacugucauggugaaggucucagguaguaacagcaguaacugugauagugaaggucucagguaguaacaguaguaacucucguagugacggucucaaguaguaacagcaguaacuguuguagugaaggucucaaguaguaacaguaguaacucuccuaaugacagucucaagugguaacaguauuauaguaacuguaguauugauggucucaaguaguagcaguggcggucggccacaucacucucuucuuuuauaugcucagaaaaggaaagcugaaucaaaauuuacuccuaaaccagggcuucucaaaucuuucuuucucaaagaagaguugacagugaacaacacaagggcugggacauuagguaaaagaggacaauauuuaguuuuuuagugcaagacauuguuucuauuuugucucaaaaauuugugcaaacuuuauauuuuacuccuuaguguaucuguauucauuucagugcuuuaaaauauuaaugaccuuauaucuuuuaagaaaauugguaacccagaagauguacuauuuauauucuguggcucacauucuuguacuuauuuugauaccacugcaauuacucauaagaguucaaaaauaccaugaacauggaugguagcacuagagcaaacacaugcuuuuccaaaauaacuauuuuuaaggaugauguauauucagguacagaaauuccacaggguugauaaaauuuauaguuauuucagugugcucccaaacugcaauauaauaaucuuaggggaccagaagauaguuucaucuucauuucauugcuuccuuccacuacccuacacauucgaaagugcuaaaguaaaugaggaccugguguaauccacuuuuagguacugugaaaaagaaaaguggagaaagugaaggcugcgucugggcuuugggaagagacagaaagaguaaucgguucuaagcaauuugcucuaauggucaguguggaaaugaucuccuccuccccacuuuuuaacagcuuccacuaguaguucagguugcaccagaucuugcuuuuuaauauucugcuagaaggcuuucuguagaaucagauacucacaacaaauuuuguguucuuuguucuuucacacuucucuggcauuccuguuauaguaauugcugguuuauagcauuugaguauagcacuuaucauuauaaauauuaauucauuguucuuucuuuuuaauggucuccucaguccauauacuguauauuacauuaauuguuauacuaccugguugaaagggauaaauaauaccucuaaacacagauauauaaaguagauuuggagaaugagaauugugaaaguaaauugcuuagcccaagaucuuagcggccaaacugagauuuaagauucaauugccaguuauaccauuuauuagaggcauucgucauaguauucaucccacuuguauacacagcuguucuuuucaaacaugccuggcauucaugugcacaucucaguauccuggacagacaaaauaacaauauuaaaaaucucuuagaaaauuacccguagaaaacaaguuaauuguuuucuaagucuagguacuuuuguaucaaagucuagguacuuuucucaucuaaaagugucucagaacagacaugauuuaaauguaugaauuuuuugguaauugauuaaaggaaagcuuucaauaauuucuaauaguuuugaaaaugauuaaaagcaaaacauaauuuauuguccauuccuguaugacauaaugaaaauaauaggaaaauaaauggaacuacaaaacauacuaagaaacgcaguuuaucagacgauaauaguuugagauguuuaauuacagaugcaagaaacaguacagauauuagcaagaaccagaaauuauauguucuuauauaugggcauacuuuaauauacauugucuacagcuauaauauuuucuaaaacuggacauuuuguuacaaaaaaggaauaauuuaaaauaagacugucaucauggccggacgugguggcucacgccuguaauuuuagcauuuugggaggccaagauggaaggauugccugaggacaggaguucgagaccagccuggucaacauaaugagacuucaucucauuuaaaaaaaaaaaaaaaagaagaagacauccuauuugauguggaaacaaaugcuuuuauccuagaggcuuuguuuuauguauguuauauugauauugcuauaauuguauauaggaugauguuuuuacaaguuaccuucuccuggaaaaauaucauacaucuuuugauuuagaaaggaaaaauauugaauaauacaucagauuagcuuuuauuauuuacguuuauuauuauugaaaauaucagcuuacaguaucuccugaagccauugggaaaguugcugaggcagcaggaguggggagacaagaugggaacauuaagcaugagacguuuggcuuuuaaccucacaucaccauucacuuaacucuguccuugaauuuauuguuuggcauuugucaguggucugagagaaagguauuaaauauuguugucuagauagucuuaaauccauaaguguauuucaugacauaaagaugacauuuuaaaauguauauaugggccaggugcgguggcucacuccuguaaucccagcacuuugggaggccaagguggguggaucacuugaggucaggaguucaagaccagccugaucaacauggugaaacccugucuccacugggaaaaaaaaaaaaaauuagccaggcaugguggugcacgccuguaaucccagcuacuugggaagcugaggcgguaguagaauugcuugaacucgggagguggagguugcagugagcugagacuacgccauugcacuccagccugggcaacaagaguaaaacuccaucucauguauacguauaguguguguauguguguauuuuuugucuaggcuuuugagauaaagugcuauacauaaccaggaaauacaugaugaaagugcccugucaaguuagcuagcccaugaccugggaccuuuucuuuuuucuuaagguuacucuccauucaugggugccaaugucauugguuuaaauuggaggcuguauuaucaccaagggacuaaucuagaacccaauucucuacuccuaauauuucuucuagguuugcuuuuucuugagcaaaacuuccuacauugcaaucuguauaaaguauuugagcaaagcacugaguuuccuuccguucagccuguugacuaacaguagagucaaagcaucuacuauuuuguuuuuuuuuucuccuagcaucaguaaggcacagauuauuaacuugaaaaaucagcuaggaaaaugcuacagagcaucuguuuuagagcaguucugcugugacauggaugggacucaggaccuguggggacguucugccauggcuguuugugagcuugugaacaaaguuuccucucauagaaaccucccaagauuguuccucuggagaaccaucaaccagagccugugcuguaguagagugugaacuguauugcuaaacaaagugaaaggcuucccuuuuuagauaguuauuuuaauuauuuuuuccuuucucuaucucucugaccacauauggcuugaagaauaaaauguggaauagagaaggagauguguaaauuucucaguggaacuaccaacacacuguaccuuaauuuucuguuguucaaaaugaggauaauacuaccuaucucacaauaguauggaaaaauugaaaaaaaguuuauuuguaaagaaaacaagaaauaauauuuccauaggaaaugagauaaugcuguuauguuaucuugccuucauuuuuauuucacuguuuaaauaguaucucucuuuaaaaaucuacacagaugguucacaggcaccagccagacccccuaaaccacgaccgcgcaggacugcaccagaaauucaccacagaaaaccccaugggccugaggcggcauuggaaaaugucgaugcaaaaauugcaaaacucaugggagaggguuaugccuuugaagaggugaagagagccuuagagauagcccagaauaaugucgaaguugcccggagcauccuccgagaauuugccuucccuccuccaguauccccacgucuaaaucuauagcagccagaacuguagacaccaaaauggaaagcaaucgauguauuccaagaguguggaaauaaagagaacugagauggaauucaagagagaagugucuccuccucguguagcagcuugagaagaggcuugggagugcagcuucucaaaggagaccgaugcuugcucaggaugucgacagcuguggcuuccuuguuuuugcuagccauauuuuuaaaucaggguugaacugacaaaaauaauuuaaagacguuuacuucccuugaacuuugaaccugugaaaugcuuuaccuuguuuacaguuuggcaaaguugcaguuuguucuuguuuuuaguuuaguuuuguuuugguguuuugauaccuguacuguguucuucacagacccuuuguagcguggucaggucugcuguaacauuucccaccaacucucuugcuguccacaucaacagcuaaaucauuuauucauauggaucucuaccauccccaugccuugcccagguccaguuccauuucucucauucacaagaugcuuugaagguucugauuuucaacugaucaaacuaaugcaaaaaaaaaaaaguauguauucuucacuacugaguuucuucuuuggaaaccaucacuauugagagaugggaaaaaccugaauguauaaagcauuuauuugucaauaaacugccuuuuguaagggguuuucacauaacauagaggagcuucccuuuuuuguuuaaguuuuguaaccuuuaauccuccauauucucaugucugucaucccaggggugucacaacuguaaaaaucuacaauauuagaaagcagcuacuacagauguggaagagagaacacuuguauaagacaaugcuguacugaaguuauauaacaagguccccugauacuuaugccugcauuacuuugagggaugcugaaugagaggaccaucucccugaaauauauuaauaauuuucagauaaaauuaugaacauaacauaccuuuucucaaguggaauuagaguucauuucccauuuaagugauuacacucuaucuccuaagagcugugggaaccaguucauauugcaguggaaacauuaacucuucguugcacuguugagugucaaggcuacuguggcaauguuuuuugcaaaguucucaguaauuuucucucugcaaucaaauuagaguucauauuuaauuugcagauucucucauucauugcuccacacugcuuuaucaaaucaggugaaagaaauuaauguaguuuugccuauuuuacaaaauggugguugguucuuuaaacaccauguuauuacucuuaauaaaucuacaaauauuuauugagcaucuaugauaugcuuggugcuguuaggcacuguguuuuuaaagcacaaacucucaaaagcugauuccagcguaauguuuuauuuuuguuuuucuguguuuuuuaugacaaagucugucugauagacaaagccuggaagguuucccccagggcuuuagaauuuagaauuagcugguuuucauuucaaaugggaaauuaauggagaaaugagauaaaaucaucucuguguaaaugcuugaacccacagaaaguuuucuaaauauggacuaauuguggguuugugcauauuucugugucuccucuuuucacuucacacccaccaugauauaaaaagaugcaucagagagugagccugccuucaggaccugaaaggacaugacugaacaucuaguagaucugguggaaauuaauguuauacaaaagacacguagacuaaguugacccugggagaggaguuaauacauuccuuugcaaagugacaugugcccuuuuuuugacagucuggcuuucaugguaugagaugaggacucacaggccuuggguaauuucugcuuuuguaugaauuuuuucagaugguucugagcugguuaugucccuggaggggaauuuuucauuugccuuagauguucuucccaugaguagguacaugagugaaguuucuuacacuuuuaaaauugcauuggcaaauuuucuuuugcuuuaugaaccccuguuuugucauuaugauuuuucacuuguuuuaacaguuucagaugucaccuuggaauagcacuguuuauuuuggccuuuuuaugauugcugaugauagguacagucuaaaggccaaaaguugccacuucauugugauaacauuguugcaacauuccuaauauauuagagaaugauguaaaauaagaauguuagagaacauagcacauucucauucaguuuauaaacaauauuugaaaauuuccagugagaauuaaaaaaggacuagugaugauauagcaaaccuggaccugaaauuugggggugggggguggggggauaucuguuuugcagagaaaauuuaccagccuccagcaaaaucucugcaucuuguacucaauagcaaccauuaguauugucauuuaaaaagaaugaaucaaaaauucauacguaauggaaugaaaagaggaaaacuuucuauuaaacacugucaagaaagacccauugcuaucuaucaccuaugaaauuaaaccuaaaaaaauuuuuuuuuauuguaaaagcgacugcucguugaugucuggaagugauccagacuuuguuucacugugauccaaaaaguuagacauuccuuccauuucucaagauuugguaacaauuuuuuuuuaagucagcauuucauauaauacauaaaauuaagacaaauuaacuuacugauauguggccaauaucaacccuucucacccaacccaaacauguucuggagauagaaggacuuauccucaauuauauuccaguaaauuuaucuccauaaucuguuuuauccccuaauguaugauauaucucaccaaauuuuucuagaauugaauaaaagcaguuuuugcuuaacuugaauuuccuuccacaaauacaaccuucagcucuucccucucuguuucccuuuugcccacauugcaaauagucuucauaauagaacccucacugcaacuuaaaagggucccauuucuuaacucagcauuucauauaccaagaacacuugcaaagauuucuucauaaugugauuuuuuaauuuuucaguuccagaagcauuuccuacaguucgaacguuauuuuuucucucagauuuucaacuugaagcuuugauuugcacugaauuaacuuggauaaaauuuuaguuucucucuucagcuaacagauuuggaagcaaauuacaguauacuugaauaauucagguacuaccuguugaccuggaauuuuagugauucugggaaaguuuuccagacaaagacaccaauagagugaaggguuuuuuccccaauuacuauuuuauuguuuuuuaaaaugccuuuuuaaaacuugugugauguggcaaaauagucauauguucaauuaauuuauauuuuauucauuccuuuucaauucugguuauuauguaaccucaaguacuuuaucuguucuuuuaaaguauuuuauaaaaugaacguuaacuaaaug

SEQ ID NO: 18132 - RNA, 8599 nt, Homo sapiens
ugacaaucuacaaacacuuuuauuagcaaaaggaguaagugcagcaugggagaaagaggggcuccuccuuccccucaaaggcaucacugccccuucccaaggggcaggccagcagggaacaagaggaccccaggguugcaagcaggcuggaaucagacaaaagugauccguguccgggaagcauugaccugccagacauugagcuccucauauucauccagagccgccuggaacugggcgggugugaagccacgagauacacagcgcugcucugccucagagaaccggacacuucggcccccugagaccaguucacggacgguggcaaauaucacaucugcuggucucugaguccugaaggaaaugaguggguguguaaggucaggauacaaacaggaaugcucgacaucaacagagaacaaugguggccaguguuagaauugaggccaaccucagacacauggccacagaagacaaagugacacagcuuuguccuucacuaaaccacucaccuagcugucugccccuugucuccuagaagagaguccuuugacaucuccauuagccugauggcuucauucacaucuucuuucuccaccacauccaccauucucagacgugccuaaggggaagguaggggggaaagaugggaacgggaggagggcaguggaacgaggucaggggacacccuuguucuggcuuuaaggcugggcagcccaugggucgccuacucacaaaacaggaguggaauccccccuccccccagcauccgcaguguugggccggcacugucagaccgagacaagugcaaugcccagggcagcguccagcaauugcccaagucuccgccucucaacacuggccagucccggaguucagcuguccugugagggagaccagacccuuuugaacgccacugggcuccccagcaugacagauggagcuuggggagcucagccaagaagacaauuggcagagagaacgugucccgggggcucgggaagugcuagcucagcaguagguuggguaaucacacuaccugcacgaacagcacuuuggagcccccaggacugagguccaagacgggaggacagaaaggaaggucuguagcacaggaucuaggacacauggagugaaacagaccccaaccacccucucagugaagguuaagaaguggggaaaaggccuuucccuccacggacgcugugcgugcccugcuggagcagcaaguacccacagugcgguagcacggagaggaccacuaucugcacugucagcacuuuagccccggcagggcuggagcgggagguggggaggcggcaaugagagcacgguaaggagcuaccccuuuaagggucaaaacagauggcccuccagcaauuugggcacuuaccagagcaguggaaaggcgcaggauagccagcaggguccgggcagaaguauagguggcauccuuacuagcccaagccucucgccucaucuccacguaugcugcugugauguagucagccagagacucuggcaccaugggcugcuucucgcggcacauggcuauguaacgccugugggggaagguucauggggaagcagaagagggagauggggaagggagugaauaugagcccauguuguuuucuguaccagggcuccccauuuaacaugguccccuccaagaauuuuaaguggaaaacacaaauuagugggugauuauuugcuuggcuugaauaucacugauggauuucaccaaacguauagcccccaccaguauccuccaaguuauuuccuauuuuuuucgggaaaauggccuuuguaagacaaauccgucugucauuaagagaggauccagaccccuccucugagcgcaugacauggcaaaacauauauuuuauuuaaagagaacuguuuacagaauauuuaaaagggaguaaaaaccggaaagaacacuggaggcucaugggaaaauagcgauagagauuaucauccagaaugccugggagcagguguuuuaaacuuuaaauuuuggaguauuugcauaugcaugagauagcuuggggaugggacuccagucuaaacaugaaauucaccuguauuucauauacaacugauacacauaaccugaagguaauuuuauuaaaaauauuuuugugggccaggagcagugguucaugccuguaaucccagcacuuugggaggcagaggugggcauccuggccaacauggugaaacugcucucuacuaaaauacaaaaaauuaaccaggcgugguggcgugcgccuguaaucccagcuacucaggaggcugaggcaggagaaucgcuugaaucugggaggcagagguugcagagagcugagaucacuacacuccagccugggugacagagcaagacuucgucucaaaaaaaauaaauaguguaggaaacaaaauuuccugugucccuaugauaugaaguguggaauuuuccacuuaaaagcugaucugaggcucuggacaugucuguagcgggaagugguggugugaaaaacacacacccuaagacuaauaagcacuuuuucaggaggcucgcacggcccacgccaacguuugcccacccgcacccagcucuccuaccucaugagcuucauguccagagguucaaacugggaggggggcugccggcugugcuggugcacauaggugaugugcugggccaaccuggacagagggaagguuagaaggaacacccuuuuuagggcuacgcacccauguccucuuaggugucccuccuuuggcucugccacuuccucacaguguaggagggacaagcuuucccgggaaauccucaucagcauuucagccccaacccaccauuucccugagaaccauggaccagccccugcugcaaaggggaggcucugggguuuccaggagcguggaauuuguuuucugauucaccucuccuccucccuacacagaucauuacaggggaccucucuuuggguguugagcuucauucaccguaggucauugucucggucgggccgguccugaaucagccagaggaggucaaaccgggagagcagugcagcagguagcuguauguucugcuccaggcugcggcgaggguuguagcgcccguaggcaggguuggcggcagccaggauggagcagcgggcauugaguguggugagaaugccggccuuggcaauggagauggucugcugcuccaugaccucguggauggcugugcggucggccucagccaucuugucgaacucaucaaugcagcacacacccuggucagccagcaccagggccccacccucuaaggucaguucuccacucacggagucucucagcacagcugccguaagccccacuccugaggagccccggccuguuguguacuggccuggaagagaagaaauaaggaaccaugagagagaaagaacaagaaagagaacaagcaaaagacaacaaacgggccagggaggcgaggccugcgcugggaucauuccacucccuccaccaggccuucuugagaugcccgaggaucuguggggcacuggcaaugucccccuuccccucccacugguucucuucagaacacaacuguggcucacugaaaccuuggcuccugggcucaagccauccuccggccucagccucccaaguaacugagacuauaggcacucacuaccacacccaaccaauuuuuaaaacuuuuuaguagaggccgggcgcaguggcuaacuccucuaaucccagcacuuucggaggccgauaacaaggcgggcagaucacgaggucaggaguucgagaccagccugcccaacacaguaaacccugucucuacuaaaaauacaaaaaguggccaagugugguggcacgcgccuguagucccagcuacucgggaggccgaagcaggagaauugcuugaaccugggaggcagagguugcagugagccaagaccaugccauugcacuccagucugggugacugagacuccgucucaaaaaaaacaaaaaacaaaacaauacccaaacaacaaaaaaaacuuuuuaggccgggugcgguggcucacgccuguaaucccagcacuuugggaggccgaggcgggcggaucacgaggucaggauaucgagaccaucuggcuaacacggugaaaccccgucucuauuaaaaauacaaagaauuagccaggcgugguggcgggcgccuguagucccagcuacucgggaggcugaggcaggagaauggcgugaccccaggagguggagcuugcagugaaccgagauagcgccacugcacuccggccugggcgaaagagcaagccucuaucucaaaaaaaacaaaaacaaaaacaaaacuuuuuaguagacauggaagcggucucaaaauccucgccucaaaugauucuccugccucagccucucagagcauugggauuacaggcgugagcaaacaugcaccccuacuuuuugaauaaacacugugguccugucugucacuauauucaccucccgcaaagcccaacuacuuacugcgaggcgccagucgaucaauguaugacaggagcugagacuuggccacaccaggaucccccaucagacagauguugauguugccuggaggaagggaaggcagcccuggaaugacucuucucccagugcuuggccaacaacagagcaauuuugaguucugccuaccccuaacacccagcacuauuucuaagcccucccuguguccacgaaggcaagauguccacucauacugugaccuacagggacacuugucauccuuuuuuccuccuaaaugacuucauccacccugagccucucccuuguuucuucuuaccccggauuuucaugccucgaggagacugguccacacccccgacuagcaggagcagcagugccuucuucacaucuucaugcccguauauuucuggggcgauugaagcugccagcuuuucguagaaauccuccucuguagagaaguuaagguuguuuuauuuucugggggaaaagggagcuaggauguaaacggaauuuccucucucuccccugccccucaccugcaauuugccucagcuccucccuggugagcucuccagccccagacucaucauccucacucuuguucaucuucacaauccgaugggcuuccagguagguuucugagaguaaacccuugggcaggaaaaugccaggauacagauguaaucccuucaacuugcccaucacuggauucccuaacaauuucuugacaaaucccuggguucuguuuuguuugggguuuugcugcucuuuucucuguguggguagaaugaguaggugagggaaaaggggaugauccauuccucaugucaaacucuuccuuaccuguaccaccugucggaacccagugcgcaggauuggcaagaaaauaccagugacgcugacguggucuccaggcugggcaauccuuguguucucuccuucuaccagcaccgugauacuacgagggauauuucccacaggcaccugaucacucuaggggagggaaaggcacauaagacuaggagaaauggacaaggacccaaccuucccucccuaggcaucccacucaaaggcucccaggcuacccagccacagacaagcccacagcaggggugcugagaccuccuuuccccuucccaaggcucccaggaaauucuaguuccaccucccuccugcacuucccucuuuuguucuucuuucuuccugccauuccacaagugacuacaggauucaaguggacucccgauccaccugcccagggccacguaccccaaacucacauguucuugcaucuucaucuccuggaauuugaugaaucuggagccccgugucugcagauacagccgcccuccugagcgguugguuuggcacuccuggcuugggcacaugaucagaggcaugaaagugggagacuggaucuaggaugugagaacagaaacaccaaaggaacucagaaggaaaagagccccauugggucgguccuuugaaucacauuuucucuucauggcagacaucuuguaagugucaagaacccucugaacuuacucugggucaacaacaaacacccagaaaauagguagaaagaccacuacauacccaagaaugaaaggcgaacacacaggcaacuuuuacaaccaaauaaaacaauaggcaucacaggaucaaauuaaucucuacaaaacaacuaauggguaagugcuuuccugcuucuugcuccacacguaccggcugguaggucucugccccacacuggucacaaguguaaguggccaccaccaucuuggguuugacuucagagacacgagugacgauuccacgcacaguuaccaacuuccccacagagucagcccgcacuucccggaucacacgaggcuuguugcugcuagggccuugaaaauacagcucacuaaggggagaaaacagucacaaacaagauccuggagaaccaaucccuacaucuuucccgacagagaccacucacaaucugcgcaugaguucagcaggguacugguucugggggcuucggaccaucccagggucccgacuccgcugcuccaucauuagccgaugcucaauguaaacguccaggacaucuuuauuuaccaccuaaaggagaagaacaaaaaaaaaaaaaaaaaagagcaacaggauggggaaaggagagcacagagaacaccaggcagaagugccccuccuuucugccugcucagaaaacaucaguaucugagcagccucucuacagaagcuuaaacgccucgcccuuuguuugccauuguucucuaaccacucacuucccucuccuuguacugaggcagcagcucuuguacggcaucagcaaagagcuucgcguagcgccuggcauucucacaaauugaguccaccaacucggggucauccucggcuacgucguccagguccacauacagagccaccuguucccgaugagccagccgaaccucaaguggggaagagacagaaacaccucagagccacauucacuuugcucaccaguguucauaugugaaaaugcaucacugagaacucagcacaggcucugggcauccacaggggagaacgcagcgccacacagagcgauacucgcuuuucagcccucaaacccucuaauuguuaugucuuuaauaaaacaagccaagcugcugcuuauggcuccuuaagcaccccgcuccccauucccuuuacccaaucuuagacuuaccaacugguucccauacuugaacugcuucuucccgaguucaucauccugguagaacucuuguaagaacuucuuaaccuuuucuguaacaugaaauguaaaaccguaagacacaaacuuuaagacaaaucuuagauacccauuuucgcuuaaaacacgaccuaugaacuaauuaauaauaugagcauuuaaauaaaccuaccgaagucuccccaaagugggcauaacucuuuuucacaagucuguuucuaaccagcgaagaauaaagagcccguggcagugcacagggccauccaacaucuccccaggggaauuccggucccuacuuuaguuuaaaauucuagcgcccuuccccguuggccccucacacuccggucucaagguucucagcuuucuuuccaccccuaugaucccccgccuucuuuggguccccuuagccccugauuucaccgggaccuccgccaccgcaccccgccaccgcaccccacccccgcucccgccaucgcuuccgcucuuaguaaacaaagaagcacaugggcccggauuccagccgcuucacagcucgggauuccuccgcccagggcgggagccaguccagccauuggccaucacacccagagacaccgcgaucccagcccacugccgccuuucccgggcccgagcgaagcuccggaucccaggcacgcccccccgggccgcagcucucuccgcggccgccgcgcggaaggacacuguuuacacgacacucccuccagccuccucgcgccacuuccgcccggcuccacuuccgcucggagggcggccucaaacggccaaucccggcgcgcagcggccccggccugcccgcccccggggccuacgcgcgccuggggagggcgcgggaaccugggaaugcccaaaagcgcgaaggaaagcgggcacgggagcccagagcccuuaagacucuccugagguccugggcgcgacuuuucccugugcagcccccagccggguuagcgcgcccccaagcccccaaccccacgacccuaacaccuuuaccaggugggauuacuagcuuuucuucaacaucgauggccccccgcacgcuucccaggccccgugggccuuagccaggccgcagcucgacccugccucuggccucgcgcaccccagaacccgccgaccccggucccccaagaccccagcucacaccaacagguguuccccgggaggcuccccgcgcaggacgcccucccgggcucguagacccguacccuucucuagcgcguaguccuucagugccaucgcugccgagggccgugcggccgcgcuuggcgggcucagaggucuugcuccuggggaagcugagaaucuccgcgcgguggacug

SEQ ID NO: 18133 - RNA, 991 nt, Homo sapiens
acacguggcuccuuagaaagcguggaaaagggaaaaaugaaaagagaaacugccaggacuuaagaugucugcuuaaagacucccucgaacugcagugaaggguccuacccgcuuccaaaauguccacccgcauuccugacgucacuggaucggcuccaucaagccagaaaacgagagugcgcuccaaucagggcucaguccccgcccuugccuugcgucacuuccgguggugcagcagccauuuugucagucgccagcggaucccgcgcgcuggagaagugcaguucccccugguuaccaacucgcccgcuuuuccuucggacuaagggagccgucgaagagcgcucgccaaaggcgcagccguuucucccuacggugccgccgcuccuccugcagccgcccguagguagcgggccguuuuccucaccugucccugacaggcgcccucagggagccgcgguccgcgaugucaagcgaggaaagcuaccgggccauccugcguuaccugacgaacgagcgcgagccguaugcgccgggcaccgagggcaaugucaagcguaaaauccgaaaagcugccgccugcuacguggugcgcggcgggacucuguauuaccagcggcggcagcggcaccgcaagaccuucgcggagcuggagguggugcugcagccggagcgacgccgggaccucaucgaggcggcgcaccugggucccggcggcacucaccacacccggcaucagaccuggcacuacuuguccaagacguacugguggcgaggugagaccuagcccgcggcgagggggcgggcuggcgacucguugccugggcaaggcucgcuggcgaggccuaugcguacccacgagucggagggucucggacgccucugggcggcggagcugcugccaggcggagccgagagggugggggacgcgaaaggagccgcacuucccacaggaaggaggccggcgaagcugggggcgggcccuggcccu

SEQ ID NO: 18134 - RNA, 39534 nt, Homo sapiens
guccacgcgcaauaaggaggggcgaaaggacauuuuuuuuuuucuugcucccgccucuguucuucccccaccugccacguacagagcccaaguucucgcuaggcuuguugggucagcgcgauuggccggggcccgcgcgagccugcgagcgaggugcggcggucgcgaagggcaaccgagggggccgugaccaccgccuccccgcgacgccccaguccaguggccucgcguccgcccauucagcggagaccugcggagaggcggcggccgcggccuccgcaagccgguauggccacuggagacggggguugcgggcgcucuguccgaggaggccgggagacuaggaggcgcugggagggccucguucgaaccgcgcggcagcuggggucggaggcacugugggaaggggcuggagggaggagggggugggagggaggagggggugggagggaggacgaggccgggggggagggcgggcggggccuugcauggggggaggggaagggaggucgcggagggggaggggagagaggcaaccccuggcugcgguggccaggaggcgcgccuggggggcuccgggaggggagugcgccagcuaaugccuuggugcagccugccuccaagcguuuggauugagaggagaggggcuuugggagguuuggggcggccggcgcccaauacccgaaggagcucggaaggguguggaguggcgccuacgggaauaaguugauuggggucauagaaucggagccuaguuccuuggcuaagucagcgcuuaaucaagcgccggcuggaggcccagccugguuuauagugaugauucuagcuaacuuuaagaguuugcuuugcuggacacuacaguaaguauuuuggaugcacugucucauuuaaucaucacaaggauuccuccaaauucagauaugguuguuuucauuucgaaugugaugaaagugagccuuggaggacuuaagaucacauagcuaguagugagaaucuuuaccgucuugcugcacugccuuugaggcaggguuugaggccucuuggcauucuuuagaauaauuacagguugacuuggcuuaguauuucuugaaggaaacugcuccccucaggaggugcuuaagccacagccucugaaauugagcagggucuuacccuuagagguaguagaaccagaaguuuguccgccgaaccuagaaccugguucaggaggcaggcuuuuuauaugaccuugggcgugucagauuauucccagugcugagaaaaguguaccugguagaggguuauauuauacaaguuagaagccgagucauuucuggacuucagagggggcggggcaaggacaagaugggagaagagcuugucguagggcuccuacuggcaguucuaggaacuaguuaauaccagucucuacuuuggaagagaaaaugaguaccagaauucuguaugugaaguaauguuggguugggauuuccccuugaagggaaaguuuuguugcacacuuacuuuugagauacuuuuguguuuacucuggggagaugacugcaagagcaaacgacagcuuuaggaaagaagcacugguuccuggccacaagauguuuacagucaauaggaaacacaaaaagugaauuugcagguaaacacggcagauagaaaguauacgugacucaauuuuuuuuuuuuuuugagacggagucuggcucugucgcccaggcuguagugcaguggcgugaucccccagcucacugcaaccuccgccucccggguucaagcgauucuccugccucagucuccugaguaucugggauuacaggcgugcgccacgacaacuggcucauuuuuguauuuuuaguagagacaggguuucacccuguugaucggucuggucuuggacuccugaccucgugaucugcccgccucggccucccaaagugcugggauuacaggugugagccaccgugcccggcccucaaauuuuaaauccauugaaauugggcaacaaacccguaccccagucagaaggacauaccaucaauuaucuucaaagcuggaauuuuuuucuuaauuaggagugugucugauggaagucacuucuagcuacauaaagaagguacagugugaggggucggauguaaaaacugaucuauauuacagcuuucuucucccauaauuaaaaaauuuaaacaaagucuuuaaauucuauaugucaggcacuuuucuaggugcugcugggaauagauaguaccagcucacugaagcuaagcacugguuccuuuuacauuauugcugguuuacacuucuuguaggaaggagaagguaacaaauacauugauuuauugaaaggucuuuauuacucuuaggcugccagagcaagcaagauggaauauuuaccaucuuggugaaguaauuauacuuuagaguuggcacauaguagguauuuaauaaguaguuccugaauaccgaaagcauugcagaaggcauugcagaaggcgaagaguugguuguguggagauuucuguuaaucacugucuucacgagaaguccauugugagaacuggcagauaaaaagcuaacuguauucuuauuuugcauuaagauaagcauggcaucccuagaguggaaugcaguucacucuguucugcauugaccuuagaguguuauauuuaguuuuaaugacccauuucauugaagauuuauuaauaaaauaucuguugagagcauggugaggggucuagagauauuaauuuaaggacuaguuagauggaaggaccuagcguauuuauaugaagaauaguagggcauuaauauauaauauucauauaauaggauucaugaaaacuuuuuugaaguacuugaaggguugauauguugggggaguaggugagugcuuucacauaccccgaaagaauaaagaauaauugcagagaagugugguguuaaugaaauaacagauuuaagaggaggaagcagaaagcugcuaguaguaaggcgggaaguugaaacuagaauguggccaguaguaguuuguaggauaccuugaaaagucucaagagaucauuuucuuggggcaggaggaggaaggaguuaugcuuggaaaauguucagcgauuauagauaacauucaggaacaucuuggccuugagaagaagagauauuaauccauuauuuuucccuuuauuuaauagcuguugaaugacuguugucugcuaggcacuguuguagacucugggaauauggaaaacauaaucguuuacuuccuaccaucaaguggaaaagacaauaaaauguuauaaauuuuuaaugucugguaguguuaagugcuuugaagaaaaauaaagcaggauaagaagauaaugccaggggagccauuuuaaauuagaugguuaggaaagaucucucucaguuaacacuugauaaggaaucugaaucauaugagggguaucagaaagggucaagacaaagggaaaacuugaaguaugggaauagcaggggugagugaagaagagagguaggaaaugaaguuaaauacuuggccagggacuggaggccagaugauuuuauaggucuugcuuuuugggaugagaaugcauuggaagguuuugaacagaaugauacuagguuuuacuuaacaguguuaacucugguguucugagacuagauuaaaagugggcaaagguaaaaagcaggcagacugguuaggagucuuuuccagucauuuaggcaagugaugaugguggcuugaaucaaguugauagcagugaaggugcugaagugguuggaccccagaguuauuuuaaaggcaguggcaaccauauuuucuuggcaguuuggauguaagguuugagagagagagaucaaccaagauuuuuuugucuuauacaacucgaaggaagauaaagaagccucuaggagaggcagguuuuagguggaagaucaggaauuuauuuuuagauauauuaagaaaaaucuaaauggucaugucagaugaacaguuaaauaugagaaaaaauaauaguagacguaaaauaaaagcuuauuuuauuaucccuacaguaaaauaauguugccuccagaccauuuuaacauaaauaugguaacauggggauaaugaaucuuuuggaggcuagaguuucuuagcaucuaauaguagcuuugcucucaacuuuuacgguauguuuuguuguuuaauuaucaaaaccacuuuuaucagucuuucucuagaguuguauauauagaacauccuggaguccaccaugaacggacaguuggaucuaagugggaagcuaaucaucaaagcucaacuuggggaggauauucggcgaauuccuauucauaaugaagauauuacuuaugaugaauuagugcuaaugaugcaacgaguuuucagaggaaaacuucugaguaaugaugaaguaacaauaaaguauaaagaugaagguaagaguguuuuuaaagcuauuuuuuaaagucuuuuuaaaaaaaaaaaaaaaaagacagagccucuguugcccaggcuggaguacaguggugugaucauagcucagugucaccucaaacuccugggcucaagcaauccugccucggccucccaaagugcugggauuacaggcaugaacugccaugccugaccuuaaagucuuaaguauuguauguguuauuuugcccauuuuuauuggacucuuucccauccucucuucacgguaguugagaccucacuuucuuguauugaaugugauguuccuauaguuacuauaauucucucaucaguuaaaauuagcuaaguggggccgggcgcagcagcucaugccuguaaucccagcacuuugggagaccgagguaggcggaucauuugaggucaggaguucaagaucagccuggccaacauggcgaaacccugucucuacuaaaaauaccaaaaauuagcugggcgugguggugugcgccuguaaucccaacuacucgggaggaugaggcagagaauuacuugaacccgggagguggagcuuacauugagccaagaucgugccacugcacuccagccugggugacacagcaagacuccgucucaaaaaaaaaaaaauagcuaauugguuuauuagaagggaauuuuaaguguuagaacauuuucacauacauuuuuuuuacaagcauuauuuucuccuuuuguccauauaauucugguuucuuuuagcuuaaaaaaauuuuuuuucuauucuuauuucccgaaaugaaagguuuuaguauguauugaaugaaaaaggauuuuauggucaacuaaguaagggaaagcugguuuaaacaaagacaaaaguguuucuuuauuguaggaguuuucagauuauguaauaugcuuauauacauuuucagaaguuaguaguaugcaguguucccagacucauuuguugacaaaauuaucuuuauggaaauagguuuugaaugaaaaauguuucggcaaacacacugaguagaauuauaguaguagacuguauuuccuauucuucaaccugccuucuuuguuaauaucucugcugaaauuuucucuuuaggugguuaccaguguuuuuuacuguggaacuuacuugcaguguauuuaaucuugaccucacuguuuagcacugcuacccacaccauccuuguuuuuaaauacuuuuaccucuuaacaucucugacacugcuuaaccuaguuuucuuaucacuaacaguuuuuucucugucuguguuaggguugggcuuaaaguaaugccagcagauauaauagaaaucuuaaaaucugagugguuuaauaguugagaaaucuuucagggauccagguugaaagaagcuguuaccuucaacacauggcuuauaagcucaccauaggcauugacauuggcaagcagaugagugaagacagaguaugaagaaucauaugggagauuuuacucacuaggccugaugguguuguaugucauuucugcccuuaugacauuggucaguacccaguuacauggcuuugcuaagaugcaaauggguugggaaguauagucccuggcugagcagccacuuagcacaacuuauacuguggaggagaaguguaaaucacuggugaucaguuaaauugaccaucuagcuaaagguauaauucuccuuuguuuuugugauguguagucuaagaauacccaaaacaaauuuuugagaguugcccauguuaagaaacaauaaaggauaguacuuuuuuccuguuuucuuaugcuuaucauacauugauuugcaccucugugacuuugaaaugugugucuuaauuugaucagugaauuuuuuuuuuuuuugagacagggucucacucucauccaggcuacagugcaguggcaugauuauagcucaucauaaccuuuaacuccuguccccaggcaauacugccaacccggccucccaaaggcauaagccaccaugcccagccuacaauucagauuuuuaacuuuuuuuuuuuuuuagcaaagucccaagaguacuuuuuuuuuuaaauuuuguuuuaauugacaaauaauaauuguacauauuuaugggguacauaguaauguuucauuacauauaaugggauuagaucaggguaauucgcauauccaucaccucaaauauuuauuucuuuggguuagaaacauucaauauucuccuucuagcuauuugaaauuauauaauauguuauuguuaacuguagucauccuauagugcuauagaacacuggaacuacuucuaucuaguuguacuuuugugucuuuuaauaaaucucucccuaucccucuuuuccccuacccuuugcagccucuacugucaucuguucugcuuuuuacuuguauaagaucaacuuuuuuuagcuuccacauaugagagagagcaugugguaucuuuuuaacuuaaugucuuccaguuccauccauguugcugugaaugacaggacuucauucuuuuuuauggcugaauuguauuccauuguguauauauaccauauuuucuuuaucaguuaaucuguuguuagacacuuagguugauuccauaucuugacuauugugaauagugcugcaguaaaaugugagugcagauuucucuucaauauacugguuuccuuuccuuuaguuaaauauucaguaguggcaucgcugaauuguguguuaguucgauuuauaguuuuuugaggaaccuucauacuguucucccuaguggcuguacuguugacauuccuaccaauaauguguaagaguucccuuuucucuucauucuugccagcauuuguuauuuaucuuuuugauaauaaccauccuaacuggggugaaccuuguuguggucuucauuuuccugauaugugugcauuucccugaugauuugugauuuugagcauuuuuucauauauuuauugaccauuucuaugucuuuuuuugagaaaugucuguucagaucauuugccgauuuuaaaaucggauugauuguuuuuuagcuguugagauguuugaguuccuucuauauucugaauauucauccucugccagaugaguaguuguauuuccucccauucuguaaguucucuuuucacucuugauuguuuccuuugcugugcagaaaaguuuuccaguuugagauaaucauauuuauuuuugcuuuuauugacugcacuuuugaggucuuauucaugaaaucuuuucccgaccuauuaaagagguuauccuuuuccuaaugaguggucuugucaaaagucaguuggcuauagauaacauggauuauguucuuuuguucuauguguucuauugaucuauguguuuguucucuuggucaaugggucuguuuuuaugucaguucuguuggucuguggguccguuuuugugccaguccaugcuuauuacagcuuuguaguauauuuugaggucaguaagugugacaccuucagcuuuguucuuugcucaguauugcuuugacugucugggguuguauguaguucuguacaaauuuuaugguuuguuuuuaaauuuuuaugaauaauuuuauugguaguuugauagggauugaauugaaucuguaaauugcuuugaguaauuuugucauuuuaacaauauuuguucuuauauaagcaugggaugucauuacauauguaugcucuuugguuucuuucaucaguguuuuuuuuuuuuuuuguagagguuuuucaucuucuugguuaaacugcuuccuagauauuuaaaaaaauuuuuguagcugugguuaaugggauugcauuuuuuauuuuuuauuguauguguauagaaacacuacuuauuuuuguguacuuauuuuguuucuggcagcuuuauugaauucauuuauugguucuaaggguuuugguagaguuuuuagguuuuuguuuauauaagauuaugucaucugcaaacagggacaguuugcuuccuucccaauuuggauaccuuuuauuuuuuucucuugcauaauugcucuggcuaguacuugcuuaacugucuuuuuuuuauuuuuuauuuuuuugucuugagacagggucuugcucugucucccaagcuggagcgcaguggugugaucauggcucauugaagccuugaacuccugggcucaagcaguccuugcaacucagccucccguguagcugggacugcaggcaugugccacugcacucagcuucuuauucuuaauguuuaucaaaaugggggucucacuguguugcccaggcugguccugaacuccugggcucaagcgauccuccugccuuggccugccaaaguacugagauuacaggcaugagccagugugccuggccuuuaacugccuuuuuucccacuugaagaugcuuugccuuuaucucaaacugaccucauugacuggcuuucucuuaacuacuguuuagggcaaaggucagcaaacauuuucuuuaauagaucagagagaauaaauauuguagcuuugugggucacauaaggccucugucucaucuuuuuuuuacaauguaaaaaccauuuuucauucacagaccuauaacaacacagggauuuuguccguuggucacaguucauggacccuuagcuugagguguccucguuguaguuugucuuccacauuuaguuacaacuuuguauuucaugguuuuuuuuuuuuuuuuuuuuuuuuuugagacaaagucuugcuuugucguuuaggcuggaguacaguggggugaucuuggcucacugcagccuccacaucccagguucaagugauucuccugccucggccucccaaguagcuggaauuauaggcacacaccaccacacucggcugauuuuuguauuuuuaguagagacggaguuucuccauguuggccaggcuggucucgaacuccugaccucaggugauccgcccaccucagccucccaaacugcugggauuacaggugugagccaccgcacuuggccaaaaaguuuuugauuguuuugauuuguguccguuagauucuguuaguagaguggagggauggcuuagguaaaguuccugccaucagagauacucuguuucuguuguaggauucagaaaagaaaaaaagaacaggaaguuuucuucuuuuacauacauacuuuauuuucuuuaaaaaauguguuuaugaaaauugaacauuaaacaaguauguuaugggaagugggucuggcuauaaggagcuaaaaacaguuauaaaauucucaguuuugucaucuuugcccaaaauaaauccaacuaauuaguguuaaaguaggugcagcagagcaucccagaaguagucuuguggccuccccaggacagaacuccuccccacccaacuguuugugaagacacccugcagaggucccugaugaacuccuugucucuggcugcuuuucuguucuugcuuucuuuagagaauguauuuuucccuuagcccuuugaaagcuuuugagacacacaguugguaugccaauuauagcauucuuuaucccugagaucugggggauuucacggucauaaauacacacuguuuugaauauauaaauauuuuucuggggagaguugauuguuuucaucuuaauaucaaaauggucagugaccugaaagaauuuacugucuauccauucauuaaagcaguuuugcaacaguaguguuuuacucuaccuaugauuaagauuugaacuuugggaaacuuuuuuauuucuugguaaaagauguaaauuuuuuggaaugaaaagauuucagucuaaaccaacaauuuaugauauugcucucuaugaaucucuuacuagugacuaauaaauauuaaggcacuuaauggauucacuuuagcuguauuuuuucauguggauauguguaaauaccuugccauaagaguaauaagcaaaauugauuuaguauauuuuugaacaaaugcauuuuugcuagaccuuuaaaguuuaagguuucuaugggagaguccaacuauguucuacaaucuacauuuuggauuuuuaauuuuuacuaguuuacugcuuauacaaaucugaaaauuuaaaaaauuaaaaaacaaccuuuuuuuuuuuuaaauuccagauggagaucuuauaacaauuuuugauaguucugaccuuuccuuugcaauucagugcaguaggauacugaaacugacauuauuuggugaguaguaaacuuucuaaugaauuuacuauuuuauucauuguauuuuaaagauguuuggcuuuuuuccuuuuaaagacucagguaagcaauaacuuauucaaauauuauuacauuuauuuguguucagguaguuguuuuagauuacuugaagcuuauggcuguguauguuuuuaagaaaaugauagaaguuuaauucaguaagaacagaguguuaaguauguuuuuuuugaaaucagguauaacuuagguaucccuggugcaguauuauaguuuuaauuuagcuguauuagaauuuuuaaauuguaauuaucuuccuucacauuacaguauguuguuacuuauuaucagggcuuaacauguaagucugauacuugaaaccaguagucgccaaccuuuuugcacuggaaacugguuucguguaagacaguucuucuauggaagggggcaggagaagguuuggggaugaaacucuuccacuuugcaugugcaauucacaauaggguucacacuccuaugugaaucuaaugccacugcugaacugacaggaggcggagcccaccacuuaaccuccugcugugcugcccagcccgguuugguuccuaacaggccacagaguagcacuggguuggggacccuugcuuuagacaguauuucccgagggguacuuaaagauuaaaaauaguucugauaaaaaccaauagaagacuaauuuuaaucuuuuagauuuuuucuuuuagaucuuaauagauaugcaaggcagaacucuuaagggacaagauagaaaagauuacagaguuaaaugguagugugauuaugugaaaaauaaaauguguacacuuuuuccggcuguuuuguuguuuuguuuagcauuaauuuuauuuuuuuuuaauuuuguugcaugaaacuuagaguucagugugaaauaugaucauggucuauugauuuaauuuguaucuauuucaucuccaucuaggaaggaugaauaugaauaaucagaauuuaaauguuaauaacaaaaacuguuuaaaauuauuuaaaauaaagguaucuuuuuacaguauugaauguaaaauacuuaacuauugacuaggcauaaagcagauuagauaaucugaagacccuuacuuuaaacaggaucugcuagauaaacuuacaaauguguuuucugaauucuguaacucagcuugcacaggaaaguaagggaaauauccagggaacaaaaaaguagagggaacuaaaggccugauguaccaaaagcugaaacuugggguguucuugguggugauaguagagauuuuagccugcauaauuuaaggaauugccaucuggugucuacaugguguaggcccuugguccuagucccucaguaggccaugcuuucaaaaagaauauuuuagaaaagucuaccuugauacagggaaagucaaggaagcuuaacucuuauaccuugggccgucaggggcuugggaagucucccuucaggauucauaauugugguccuuaggugaguuggguuuaaauuuaaacuauccauguaguuugguaacucccaagcccagauguuaccauuuuagaaaaaucucagaagaaaggccaaaaucucucuugagggguauauucucaauccaggucacauagguuucucacagacaaaaccguaagacacaugaagcugucagguaagcaagaaccacuggacacaacuaauagcaggauuagauuuucaacaacuucaguuaagauaugugauagucuacaaaauuaaaaguuauuuaagacauagaagaaggaauaagaauauaaaagcagccggccgugguggcucacgccuguaauuccagcacuuugggaggccaaggcgggcggauugccugagugcaggaguucgcgaccagccugagcaacacgguaaaacccuaucucuacugaaaugcaaaaaauuagccagcuguaguggugugugccuguagucccagcuacuugagaggcugaggcaggagaauugcuugaaccugggagguggagguugcagugagucgagaucgcgccacugcacuccagccugggugacagagugagacuccaucucagaaaaaacaaaacaaaacgagaacauaagagcaagaugcuauuguauuauggaaaaacaauaaacagauuuuauaaagaacuuaaaguaacuuggaaaugagaaauauaaucauugaaauuaaauacuaaguggauagguuaaacacauuagucauagcuaaaaagagaauuagugaacugaaaaggaaauccaaagaaauuacagaguaaagcacaaaaacacaggcaaaagagaaguugaaaaugagaacauccagaauauuucuauucagaguuucaagaaggagagaaugggagaguggaaauacauugagguaaugacuaaagaaauuuucagaguuauauaaaagcuauagacccucagauucagaaggcacggggagccuugagcagggauaaguaaaaguaaauccccacuggacauauugucaugaaacuggaaaaugucuuaagacagagagauuaccuuaaaaguagccagagagaauaagacugaucacauaugaaacaauuagacuguuaguagacuucuucauaguaauaauagaggcuaaaagacaguauuaucacaguugcaaacaguaaagaaaaauaacuagaaaaguagcauccuauacuccacuaaauuucacgaaugaggagaaguaaaaauacuuugaaagacugagaauuuaccacucauggacccuuguuaaaauaauuuuuaacaguggucuucaucaagaaggaaauuuaguccagaagguggugaaagaugcaagaagcaaugugagcagauaaacuguugcuuggucaguaggcuaugcuuucaaaaacuauuuuagaaaagcuuuuccauugauacagaaaaagucaaggaagcuuaacucuuaaaccuugggcugucaggggauugggaagcaccaaugaaauuuauguguacguuuuaaugagcauugauuguuacaaaauuaauagucuuagggaauaaaaacaauuugggacaaaaauacugggcaauaauauguaagaaaggaagggaugauaggaauaaaaauauuuuaaggacuuauuugggaggaacauuguaauuaccuuuagauuuuuuuaauugcauacuacauaugcagaaguaugcaugguguacauguaagaguuauaauugaaaaauuagacauugucaggaaaggagaaaaaaagaaaacaaggguaccuguucaguucaguagaaagugguggcggaauaaaagagguagaaagcucaauagauagaacagaauacuaaucacaguacacagaaauugacuacauauaucgguuaaaauaaucucuuaauggaauuuuaaaaaaaauccaguuccaugcuacuuccaagagacauaaaagauuauuaugcaaagcuugaaaguaaagggcuaggaaaagagacuagacaaaugcaaagaaagcugguuauuaacagaauagacuuauauaaaaacuugaguaguaauagucacuuuaugaugauaaaaagaauaauucacuaggacuauauagcaaucugaacacuuaugcauguuagcuuuagauguuuuccccuaagaaaaauugacagaacaaagagaaaucaauaaauuuacaauuaugggagagccgauaaaucaagcaggcucaaacagcguuggucuuguacaucuagcaguuagggagaaauacaguuuuuuuuuuuuucgaguacucauagugcauuauagaaguugacuguaagucaagucuuccagaaaaucccaaaauguaacagauaauuagauaucuuaaaggucauauucucuggcuucuuuagagacuauuggacagaauauguaacccaaauuucccuacuuuuggagacaaaauaugguuuuaaauaagucaaagaagaaauaauaaugggaauuauaaauaaguagauaaugacuucuauguaaccaaguuuuuagagaaugcuaaagcuguacuuagaguaguacuuacagccuuaaauacuuuauauuaguaaacuggauuggaaauuuuugagcaagguauucaaacaguuacaaaaggacaaaccucaaauaacuuggaaggaaauaauaagagcagacgugaacuagaaauuggaauuguuaggaucaacaauuuugaaaagaugcaguuggcaaaucuuuaugaggauuaguuaaggagaaacaaggcacaaauaagcaauguuagaaaugaaguuuauaguagaaacuuuaaaaauuuauauauaccaugaauuccuuuauuuaaauuugaaaacucaggugacauggacaguauccuagguaaauuuaauguacuguuucaagaaguagaaaaauugguugccccaauuaacauuaaagaaauugggccaacuauuuuaccaaauaucuaaggaacagaugauucuaaauuauacaaacuauucaagagcauaggcaaagagggaauauacacuaauucauuuugugggguuaauauaacauuaacaugaaaaccagccaaggaaaaugcaaaccagugucacguaugaacauagauagaaaauauuaaguaauauuuacaaaucaaacucaucagugaauauuuaaacacaccagugucaaaauugcucacccaaggagucuaagauugcuuuaaauuagaaaaucacauacuauuuuccauaaaacagauuaaaggagaaaaacuagaucaucucuagauaaagaaaagccauucauaucucaaucauguugaaaagucguagcaaacuaugaauaaaagggaauucuuuuuugugaggcagagucucucacuguugcccaggcuggagggcaguggugcgaucucagcucacugcaagcuccgccuccggggcucaccccauucucccaucucagcuucccgaguagcugggacuacaggcaccugccaccacgcccggcuaauuuguuuuuguauuuuuaguagagacgggguuucaccguguuagccaggauggucucgaucuccugaccuugugaucugccugccucggccucccaaagugcagggauuacagauaugagccaccacgccuggccaaaagggaauucuuuuaccucauaugggggcauuuauuacguagaacaacugcuguaugccuaauauaaaaggauuauaaauguaacuaaaauaccuauuauaauuauauacaacaaaagauacuugggauaaaucuaacauggcaagauuguuuuggaugaaacauaaaauuuuuuaaaaucaaguaggggaauggguuuugaggaaagguacucugggagauuuaauuaugucuaugcuguuucauuucuuagugguuaggagcaaagaugaaaaaaauacuaagauuuggccaggugcgguggcucacaccuguaaucccagcacuuugggaggccgaagugggcagaucacgaggucaggaguucgagaccagccuggccaacauggcgaaacuccgucucuaccaaaaauacaaaaaaaaaaaaaaaaaaaaaaauuagcuggguguaguggugcgugccuguaauccagccacuugggaggcugagacaugagaauugcugaaccugggaggcagagguugcagugagccaagaucaggccacugcauuacagucugggugacagagcaagacucugucucaaaaaaaauauaaauacauauuaagcuuuaacaaagauggguguuuaguaaguuuaucuuguugugugcuugaaaugguucauuaaagucuuaugauuauauucacacuaaugaagauacauuauuaugugugcuaggguucuccagagggauggaaccaauaagauacaugggaguuuuuuagggagaauugcaaggugauuacaaggcgaaguccggugauaggccaucugcaagcuggggaaagagagaagcugaugcugauaguggcucaguggcucaguccaaguccaaaagccugaaaaccagggaagcugauagugcagccuuugucuguugccaaaggccugagaguccccugggaagcugcugguacaagcccuggaguccaaaggccaaaaaaccuggagucugauguccaagggcaggaggaguggaagcaagcaucuggcauaggagggagagcgagcuaaagacccagcaagcaaacuuauccuaccuucuucugccuguuuugugauagcugcacuggcagcugauuggguggugcccaccaacacugaagaugggucuuccucuucugguucacugacucaaaugucaguguccucuggcaacacccucacagacacacccagaaacaguacuuuaccagccaucuaggcauuccucacucuaaucaagcugacaccuaauauuaacuuaauuaauuuaaacuuagcuaauuuaaacuuuuaauugaguauaauuuggagcuuagugcucuuaaacccacugaguagauaauaacagauuauaggccauacuaggaauguaaaugcaagguucuuaaaaguucugguaagauguaucagugugcuccaaagaccaccaggaacacaccuguaguugaaugaaguuggguuuacugacuuacugcagcaagggagaaugaauaccacggagaacaauaggaugucuuacaaguauguuagaaaaguauuuuuuuuugggcuuggguuuguguuaccugauuuuggauaagguucaaggaaguagagcuuugcucugcauuggaugcucucaggaaguagagaugauucuauguuuggguaucuuaucaaaucuuaucuagaaggugagaggaaugaaucuuacuaaaucuuaucuggaaggugagaggaaugaauugaggcuaaagcugcaguugguaaaguaguagcaguuacucauauuagccaggauaaaagguuguuuggucauuuuucugguguggucaguguucuuguuuuugucuggaguuuugacaugguuauggacuguugaucuaucacagauuauagucuugugugauguugguguucuuugaaauauuuauauucaacgggagaacaccacagccuaccugugagugccaggccagcuuccagcaacacuaaggccugucuuacuguaccagaccaguuucuggcugcuaggagcuguuuuucucaucaaauauuggagaaaaaacaguaauaccaagugaaaaccaauaauugauguagguaggagauuguauugaacuucauagcuaugcagggaguaugugaauuacugugaguuuucuucuaaaagcuuauaauuggugguuugauuuugaaacauguuuaacaaagaaucgcccugaacuuuuauuuucacguagauguccuuuucuaauuaggugcuucaggaguuuguauguauguauacuggcaaugugcaaagcauuuuaguuuaauuuuugaacgccugucuugggguuugcaaucagagccuugugucacuuucuuuuuaaaaauaaccugaguggugacaguguuuguugcugaaugaaggauuucauuuuuuucagucaacugaaaaucauuuggacaaaaugaauaauaagugaaguaauguugcuuucauuaaaaaaucacaacuagagauuaccgaguaaucucuggcauuuuguggcuuauauacuguuucuggaaguaacugcuuugaaggacagucaugauguagauaaguucugcauauauuuuuaaauuuauauuuauuuuuuaaaauuuuuugagacaaggucucccucugucauccaggcuggagugcaguggagugaucucagccaacuggacuuccccucccgggaucaagcaauccucccaccccagccuccugaguagcugggacugcaggcaugugcugccacacuuggcuaauuuuuuaagguuuuuguagagaugaagucucacuguauugcucagguuuuucuugaacuccugggcucaagcaguucucccuccuuggcuucccaaaguggugggauuacaggugugagccaccaugccuggcccugcauauauuuuuuuaacgauuucuuuuaagaucagcuauuuuaguuagcuguuuuuuuucaagacaaaguuaugcaagagggauaacagaccuaucagucauguuauaucuuuaaacauguauagaguaagguauuuuuguauuauuuuaagaauagcgugaaauaaaaugagcuuuuuaaguuauauaauuuuuauuaaauuuaauaauuucuauuaaauuuaauaaauauuuaagaacagcaugaaauaaagugagcuuuugaaguuaugauuuuuauuaaauuuaaucauuucuauuaaaaaguagagcucggauuuuccuaccaaaccuuuuuaccaguaaggucauaggcuauagguauggcaucaagaaagacugauaauucugcuuuuuuuccaaaauaaguuauuagccauagagaauucuuuuuuuuuaaaaaaaaaguuacuccauuacauugauaucuuguuuuuguuuuuuuaaaggaauuguauuuauuuuuccuuguugcauauuauuaguauacuuauucaugaacuucuaauuuuaagcaaauaaauguuuuuauuucaguuaauggccagccaagaccccuugaaucaagucaggugaaauaucuccgucgagaacugauagaacuucgaaauaaagugaaucguuuauuggauagcuuggaaccaccuggagaaccaggaccuuccaccaauauuccugaaaaugguaaacccugaauccauuguauucugacuuauuguucuuacgucuuuuuggagguuuuaaaaaacucuuuuuaaguaggagaaggauggcauccccaaugucacucuuguuucuuccucugccucucuacuaguauuuaugucuguguuccuaaacuuugcuguucaucagaauuacuaggagguuucauuauaccaauuucuggaucucaucauagaccuacuggagcguagcaccuggaaaucccauuuuuaaaguguuuuuugggugauucuuucgcaacuagucuuagacuuuuggauuuguuacacaggucaguuuucaaauccuuuugacacaugaacccuuuuuaguauaauagauaaguaaugaaccuugggaauugaaaaucauuucaugaauaauuacauaguguuggaaguauuuucaacuaaaaaucacuuagauuaguaauguucauuaaaaaugguauguuguaaauuugaaacacaguuuuuaauaauaauuaaagaaaaacuaauuuuuuccccauuguauaaugacauguacuguuuguguuaagauaaagcaaaaugugucaacauuuggaacugacauaauuuugggaccgaauguauuuuaaaauguggacugaccuuuaaguauguguuaaugacuugaaaguacaguuaaaaaacugcuuucuucuuuuaagauucuuagauguugcauuuaaagaaaacucuuauuauuauuuuuuucuuuuuacaaauucuuuguuugcuuauaauuuucauaguuuaaaacuguccauauugugaaauaguaauuuaaaaaaagucuagacuggaugacugcauauaaagggcuuaacaugagauaauuuuuguggauaaaugguauguauucuauuuuuggccacuaaauauuuuggaaguuuuuguuuucuauuuuuauuuuaguuacaguuuaaauaaagauguauuuuccaucauuucucucuuccugucuucuaauagucauauggaauuauguuaaugauagauguuuaauaaauauuuggugauugauuauuccuaguugcacuucuauuucagaacauaauggagauuugcugaauacuauaaugagauccucuuggucacuuuaugaugaaaccuuuuauauuucaggucaaagaagguugccuauucugagcccuaccucuccaaacaaaaauuuccaauuuuagaucaagaaucaaugaaaaaguuagacaauuuuuccagaagaauucauagaugcugacacaacauuugcauauaauuucaggggauuuaaccaucugcagaauauuaagaaguguagaugagaauuuaaccaguauagccaauacuguucagaaauuagcuacaguggcccacauucuacucuaaggaauggauuuaugaguuuuuugcuuuaggugaaacuuuuuccucaccucuuucuugcuacuguuuauacuuuauucuuugugucuauauuuuuuauacauacuguuagcuuuuuaccuauguuaauguaaaagguguuaaaauugguuucuucucugcauuuuggaaaucaugccauauguuguuuucuuguauggccauuuucuaguuauuguguccugucugacauaucugaugauaagaugauauaagaauaauacaaucugcauuauauuuuuagagauaguucuuauuuuuuuagaaaacaaaaacaacaagaaaaccauacaucagaaacugaaaucuaguccacaaaaugaaauugccaaucagcuaucagugcuauuuagaaccuguggcuuacccucaccaagaaauguggccaccuguggucuucagcucucuauuacagcgguucuuggaugcuuguuuuccuuuaagaggcaaaugauguguaaacuaccuuagauagaagauugaccuguugcaguaucuccagcagcuaauggagcaaguaguaggacguauaguauguuuccugaugguuuuaguuugugauaagugaaaagaggcauagguagugagaugugaggggaaacaacuuguaagacugacgugguaugcucuugggauuagaggaaggaaguugguagggaagauagauaacugguagacauguuuuaaaggaauacuucuaguaguaguuuucuuuuuccaaacauuuagaaaauauuaggguagccuggaaugguauguuaggaaugaaugagcugccagccagugugugcuguggguacuuauauucgguuuagcacuuaacauuuuuuucagaagauacauuuuguauugauuacaggggugaucuaagaacugauguucauuuacuugcuugguaacaaaagugauaaucauugucccuuaauugaguaaaugguuagcaacagucuuuuuguuuacuuguucguguuuuuuguuuguuucuuuugaugucuuuuguaucuuggacuuggauuccuauuuguaaaauguauguuaaaauucuugaacucuuuuucuuucacaagacaguaguauaaaugccuguggaauaucuuaguauccugagaagaaaagcaugauuuuaaauuuaaccugcucauaauauuugacauuuuguuuuucuguuguuguuuuaaacauuuuauuauagaaaaguuuaaguauauaagaaaguagacauuauaaugaaucccagaaacccacauccaguuucaacaguuaccaacuuauaguaucauauaauuacacuauacacauuuccgccccuccuguuacccagaguggaguacaaucucagcucacuacaaacuuugccuccuggguucaagugauucucgugacucagccuccugaguagcugggauuacaggcaugcaucacugugccuagcuaauuuuuguauuuuugguagagauuggguuuugccaggcuggucucgagcuccugaccucaagugaucuacccaccucggccucucaaagugcuggaauuacaggcaugagcuguugcacccggcuccccuccuguauuauuuugaugcagaucccauauacaucauuucaucuguaagcauuuuaauaaguauuuuaauaaguaauacauauuaaaauagaagguagcaaauucaaaaauguuuuuaaugugcuauuuauggaagauuaugaauuaauuaugguuggcuugauuuccauguaauuuaauaguggaccaguagacaguagaaauaaaauguaaaauuugagauuauaaccuuaguucaguuucuuuuuauaaaauaaagccuuaguuccuauaauuauuuuuuccagagugcccaguggguaucugauacuaggauauagguuauugggcuccaaaaaaaccaaaaaaaguaaaauguuucucuuuaucaaggagcuuguauuuuuuucaucuaauguuucuuacaaaaggagguaaauaauuuuuuuggaaagcuuuuguucaucuucuguuucuuuuugcccucuucucccuguuacuagaaggaaaaauauaaaaaaaauaaaggaauuaaaaugaucuguaauccuauauuccgacaugcuuaacauuccagacuaucauuauacaccugcauuauuucccuuguacuuuuaggccuuacugaauauagauaaaaaggaaacaaguuuuuguuuauuccucuauuuuuacagauacuguggaugguagggaagaaaagucugcuucugauucuucuggaaaacagucuacucagguuauggcagcaaguaugucugcuuuugauccuuuaaaaaaccaagaugaaaucaauaaaaauguuaugucagcguuuggcuuaacagaugaucagguuucagguaaguugguuuccaacuccuuuacacccuucguuuccuucaucuuuccguucuucccuuuccuucuuucuuuaauugaagaauaacuuggauauggugaagugcacaaaucuuaaggguucugcuuaacaaauuuuuacauauguguacacuuauguaaaagacuaacuagauuaagauguagaugauuuccagcacuucagaaagcuuucuuauguccucuccccaagaguagcacccucccccuuaaagaauaagcacuguuggguucaaguaaauuuuugaaaguaaaauuuagaaaguuuuuaaaaaucugaacuauuuuauaauuugauuaguugcaguauucgaauuauauuugauuugucuuaucuccucaucuuagagaaauugaaaauuaaauguagauuuucuuguuaaauugcuugaguauacaguggguuuuuauauaaauaaguuuuuaaccuuaaagcaguaccuauauuguuuuauucuguuuaacuuuugguuauaauuucuucauuauuuuuuccugcuuuuucucuuuucggauucuaauaacacauacauuggagagcuugauacugucucaugggucauuaagguucauuuuucuucagucuucucucuguucuucagguugggugauuucuguugaacucuucaaggucgcugugauuucuaauaugcuguggaaccuuucuagugaauuguuuaauugugcuuucagcucuagaauuuccauuggguuuuuauaguuucuguuuuucuguugagauucuuuauuuuacauucauuaagucuauauuuuccuuuaauuguuugaauguauuuauguuugauucuuuaaaaauauuuagcugcuuuaaaauguuuaucugcaauauguaacacuuggacccauuuggagucaguuucuauugacuggguuccucucccccacacacacuccccccaacuccaguagggucacauuuuucuguuucuuugccugucugauaguguuugguugaaaacuagacauucugguuaauauguuguagugacuuggacuuauauucuuuugaggauuuucuguuauuguugaucuagcagggaguugauuuguauggacuuaacauaaauaacaaacagaaaagcgcucucuaaaagaaaaagguauuugggaauagagcauugcauugaaaauaugcaugccauaguaaacuaugugcauauucagugagguaaaggcagacaaagguuuuuaaaggaaaaaaugaggagaauauauaauuguuuugaaauaauuauuguuggcuacaaagaucauuagcaagagugaugccagucugagguuggacaggcaguuucugggcagauguccucacagucacagaaguuuuuuuuuuugcuuuuuuuuuugcaaaguugugauggccuuuguguaggcuugugguuuuugaacucuuuugugauaguuuuugcaagaauccucucuucauggccuuaucagaguuuuuaauuuuuuuuuaacauuaaugacuucauuuugguuuugauaacuuucacauacucaaaacugcuccuucuuucucccuaugguguauagcagcugauauguaugcucaguccuuucagcuugcucuaggugcugcauuuuucucugagccuucuugagauauccucgucugcucucccagcccuauagucagcuggggauuuggacagaguguauauaccuagaucgugggucuuacccuuucaguagcaccuucacuuccgggauuuuccuccuaaaucuucagcugcuugucuagccauaagguuguuaacacugugguuuucugccauuggagcugcagaggucagcgcuuuuaauucuuauccauucuaauuuuauugggguaaacuccucugguuucugauugacuuucaguuauuucaaauaguuucuuuuguuuuguucauguuuuuaguuguuaccugggagagaguuuaucugauggauuuacuuugccuuuaucaguaguuggaaauguguacaguccauuuuguauuucuuagagacuuucauggaauuacucacaaaagagaauugugugaaaauuugaugaggucagacuuuuaaauuuugauuuaaauguaguauauuccagacuagaauaauauuaauaugauucacauuauuugaagaccauuuuucucacagcuuuguauguugaauuauaguaggaaaaacuguaugcauagcuaggauacuuuuguaguucuucaggugugaugugguaaaaauguggcuuauuagaauaaugaauguggcagugggaaggagggauaaaauauuacaaacauggaaugaauauuaacuguaauaaauuacauauaagggaggaaagaggagccaaaguaauaaauauauauauuuaggcuaauaacagugucuuuugugggaagaauguguguauuuaucuacauagauauaaauuuaaguaaaauggugguagauagaaaccaucauccauuuuauuuuggcaaucaucagucucucuugcauuaccacuauuauauccuaguuuagguucuuauuaauacuuggacugucagcugucaacugugccuaauacugugguaaguucuggggauacaucagagcagaagauagagguuugcccuuagagaaauuagucugcugauaauagcaaguacuuauauggaacuuucugaguaguagucacuuuuauaagcuuuugcuguauaauuccuuuuauaagcccaugcuauaagcucuuguaaacucauaauccucacaauaaccuuaucaaguaggaauuaguauauccuuuguacagaugaggaaacugaggcacagaaagagauuauguaacauguccagaguuacacagcuagugagugacagcacuaggauuugaaccuggguagucuagcuccaaaaccuaugcuuuuaaccacucuucugcauugccaaagcagaaagaauuuaaaggaauaagacauauuuacauuguccucagaauaucuuuuuugacugucacagcauuggaacuguaauauauucucuccauucauuucuguguucauuauuuuguaagaauuauaguggcuccauauguaaguuagagugcuaggccuuguucggcagacaaaaagaaucaacagucaggagcccggccaaaagagugcagagucuuuaagagggaaagugagagcuauucagaaaugcaaaguagaagucaguaugaguuaacaaaaguaaacuagauagaaguucacuaguagaaaaaguauucaugagucaagaaggcuuacuagaaguguggaauuauaauuggauuuuaaauaauguuauauuuaaauaugugaauguuauauuuaaauauaugggaucuagugggagagaaauagaggucaaaaaaauauuagcuauguuaugggaguagggagaagguuaguuuagcugaaagggaggcaugugagaagagaaauugugagaaauaauguuuggacccuuaaugccaaacuaggagguugaacuuaauuuauggucagugaagaccccuugaagaaugaagugacaauuuugguuccugugcagaauacauugcuuggaguagggggauauuggcauugcagacaugaguuuugauuuuugcagggagagguuaagacucaggaauauaguacucuacacuuuauaaggaaggaguuccaguuguagcuuuggauuaagagauuggagcaaaggaaaaaauaaaguacauacauuuaauguaaaaaggcguauuugugguuauauacuuauucuauaguacuuuuaguaucuuuuaaccaaacuuauuccuugagcuugcugggggaaggccuuguguuggauacuaaacugacuuuuuuuugacuauccagggccacccagugcuccugcagaagaucguucaggaacacccgacagcauugcuuccuccuccucagcagcucacccaccaggcguucagccacagcagccaccauauacaggagcucagacucaagcaggucagauugaagguaaaauagaguuuagaacacauguuugggaaaguacauguguagaaguguuuauuacagcauuguuguaaacacuucauguauuuagucaugccuuaaacacaggaaaaauuuugauuuacugacaugauuugauguuaaaaaaccaaauagaacaauaugucagguauguuuccaauuauuggaaugaaaaaaauaccucaaaaaaguguuucuaugaauauagauacagagugaaagaccagucauuagucaguggugacccuuggaggggaggauagugaaguucagacuggugauuucacacuuuauuuuguguuauagaugcuauuuuaucucccuccuuucuucaacaucugugcaugauuuuucuaauuuaaaaaagauuucugaauagagguaaaggauaacuuuaguuguaguggguuuuuuuuguuaagauuaguagccuuuuauaauuuuguaaauuuagcaauaugucuuuaauggaaaaaaagcaguguauuuuaagucagacuuuuucuucugaaauaaucuguccuuggauaugcaguuuagucucucuggguuuugauauucuuucacuguaaaaugugaaaacuggacugaacccagugguuucaaaagaaugucuuuaguucugaaugaaauauaaccugaaagcuccauauuuaaaauaggggauugaagggcaacagacuucacacagcaggcacuaaggugccucauugaaaaccuuggaguucugcagaaugugacuaaguacuuaacuaaucucuagggugccuuccagauaaugaagugugauuuuuguauugucuauguguguugggaccuuuaaagccgcauuccacuucaaaacaaacaccagguggugcucuaacuauuuguuuaacgggucagauagugguauaauguauuuccagccccagaagcaagugauuaagguuaucaauuacauuaaaacaaaaacaaaacauaggcuaaaaugaacugaccacuuuuggaauagaauccuaucauccuguggugauacuuucagaguuaccuggcuagguguggugccucacgccuauaaucccagcacuuugggaggccgagccaggaggaucacuugagcccaggaguuugagacuaggcugggugacauagugagacccugucccuacaaaauaaaaaaagauuuaaaaaaauuagccaggugcuauggcaugugccuauaguuccagcuacuugggaagcugaagugggaggauuguuugcauuguugaauugaaguggguggucuaggcugcagugagcuguaucacuccacugcacuccagccugggcaacagaacgagacccugucucaaaaacaaacaaagccaaaaaaaaaaaaauccacagaguugucuguuggaugaacaccagucauuauggacuagcaggugacauuuugcugaugaaucagugguuugcgaagaauuucuuauugcuuaagccuuuucucaaccaacuuuaauuaacuccuccucugcaccaaaaugcuacugccaaaacuagaacaaacuagaacuaaagcagaugucagcugaaauggacaaaagcagaguauagguaugaugagaguuuaaugccuacaucaagcgaacuaaagauuuguuuuuaaauaaaucccauuuuaagcaguguauacugugauacaaugacaguuggaaggaucauuguaccaaauaauguuugcuguuuauguauaaauaaaugggaauuaaggcgcuacuagcaauaucuaaacauucuaugaaguguuuaauugagcauuuucaaauaaguaaaauuuuaaaaaugcgaaaggacauacagugaaaauucucucucccaccucuguccacagcaaccaaauuccuuuuuucagagguagcagauuaacacuguuuauaugcauuuaauuuuuagaguaguauuguaugccuugcugcaauuaacuguuagcuuacauuaaaacauacaguaugaaaauuguacaauuaauaugugacaucauuuaaacuauuaauaacugaucuaauucuagaucagugcuguccaaaagaauuacgauagaagccacauguaguuuuucuauuuagcagcauuagaaaaauguuuaagaaaagguaaaauuaauuuuauuuagccuaauguauccaacguguacucacuauuaaaaaguuaauuuuuuugguacuguguauuggaagucugggauuugacacugauuuggaacacuucaaacaacaaacaacauaucacauuucaaacaagccacauuucaggugcucaauagccacauguagcuagugauuauuuuaagagcacagcuuuagauaaauauagucguuauuuauagauucccagcaugaauuauaggcuacuuuuacuuuuuguuguauaaugagucuuugacauugucaguuauuuagaucaacuacugguuauaauuugagcagaauuaccaacauaaaauguauuacuuauaauuuguuaacauagcaaucucuuacaauguguuaauaguccauacuaaaauuaagaauucugaguuguuacuuaacucccauaaaagggacuuuggaacugugaauuuuauuccaaauaaauguagucuuaauauguuuuucaguuaaaaggaucaacaagauauugagcaucauuaaaaaaaaaccaaaagggauaauguuacucuuuuucauauaaagccagugccuguuacaggaagacuaugugauguugccagaaauguaacugguaaggagaagaacgcuaaaaaucaucagagaucgggagauauugcuguuugacagccuaaaaaaaugaaaaagcauauaauuaaaaucuuuaaaaucauaugccaauauaaugaaaagcugaguagccuuuauuauguaaauauugaaacauacauagaauaaucaacucuucauguagucauguggcuucaacacuuaccaauauuuuggcauucuuuuuucaucauuuuuuccccacugcaccccuuuuaauuugcuggaguaguuuaaaucaaauuaugaacagcuuauuauacucagguauuucaguauauauguccaacugauaaucuucuuuuuaauauaaccaccaugcuguuacuuaacagugauucuuuuuauuuuuaauugugacagggugucacucuguugcccagguuggaguguacuggcuugauuacagcucaccugcaaccucaacagugauucuuaaugucaacgugugcuagucuguguuugaauuucccuaauuguuucaagauucguuuguuaaauugacuuguucaaaugaggggccuaacaagguucacacuuugcauuguuaaugugucuugagucguuuuuucuaauagccauuagaaaaaacuuacauguuucuaaaaucccuuacauguuucuaaaaucaaaacuauguguauuauuuauuacuguguaacuauuaucccaaaacauagauacuuagacaacaaaaguuaauuaucucauacaguuuuagacagauaucccggaaugguuuagcugggugauuuuggcucagcaucucucaugagguugcaguuaaaaauggcugcugggguuauagucaucugaagcuuaaccagagcuggaggauucaguucuuuaccauuuggacuucuccauggggcugcuugggugaccucaugacaugacagcuucaccagaaugaguaaucagaagagagugagguagaagauaaccuuuuauagccuguccucagaaaugucacugucauuucugcaauauuuucuugguauacaggucagcccuauucaguaugugagggacuaacagggagcagauacucaugugcuuguugcuuauuuggucauuuuuguauuguggaguuaaaucuuucuaauuucuaagaauauaaacgauaccaacccauugucauaaaugcuauacaugugcagaagccguugagggucaugauagagguuggcuacucuguguaauaaauaauucccagaagucuuaccauuacucuuugcuucauccuguucucuuuuccccuuaauuuuuuuuauuacuuuuuacuuuauucugucauugauucuuuuugaaaauauacauaaaacauagcuuauauauagucaugcacuguauaacauuucagucaacaguggacugcauauaugaugguggucucauaagauuauaauggaggugaaaaauuucuauugccuagugauguguagccaucauaauguagcacaaggcauuacuuacguguuuguggugauucugguguaaacagacuuacugccagucauauaaaaguguagcucacauaauuauggguaguaccuaauacuugauaaugaugauaggugacucucuuacucauuugugaauuuacuauacuauauuuuuaaaucauuagaguguacuccuacuuauuuaaaaaaaaacaaagcuguagaaccaggcucagauagguccuucagaagguauuccggaagaaggcauuguuaucauaggagaugagagcuccauggauguucuugacccugaagaccuuccagugggacaggauauggagguggaaaauagugauaucaaugauccugaugcuguauaggccuaggcuaauguguauguuugugucauaauuuuuuucuaaauguuuaaaaaaguaaaaauuuaaaauuaaaagaauagaaaaaugcuuauagaauaaggauauaaagaauaaauauuuuuguauaguagcacaauguacuuuaagcuaaaguauuaaaaaaguuaaaaaaucaaguuuauaaaguaaaaacauuacaguaagcuaagguuaauuuauugaagaaauggaauuuuaaaaaauaaauguaguauagccuaaguguauagcguuuguaaaccuuuaguagugcacaguaauguccuuggccuucacauucacucaacacaaguaccucacuuggagcagcuuuuaauccuacaagcuccagucaugguaagugcccuaggcaggcauaccauuuuuuaucuuuuuugccauauuuucacuguaccuuuuuuauguuuugauauguuuagauacacaaauaauuaccauguguuagaauugccuaaguauucaguacaggaacaugcucuacagguuuguagacugcuauguaccauauagccuagcuauguaguaggcuauauacaucuagguuuguguaaguauacuauaugauuauacagugacacaauuuucagaaccuacucuugucauuaagcaaugcaugaccauauuuuuuauuacucaaaacauugcuuacuauaaacaaugucugcauuuugcucucuucauauauccuauagaucucucaaguaugugaagaaguucauccuuuuucuuuuuuuaaacaauuaaacagacuucuuaauuaauuuucagaauacugugacagucccauuuggacuugaaugagguggguuuaaaguaaguaccguaaauccucacuuaacauuguugauagguucuuggaaauuguaacuuuaagugagaugacguaugaggaaaucaguucuaccauaggcuaauugauaugaguaaguugaguuccuacagcauaucucugaucacaaaaauacccccagacuucuagauaaagacuaaaaacaaaugugaguuauagauacauuuaagaaagauuaauaaaaacaaauaagauaaugauuuaugcaguuauuccaauucaggguuguggguggcugaaaucuaucccaucagcucaguagcaaaguggggaccaacccugacagguugcuauuccauugcagggugcauugcaaccacacacacacccauagucguucagacugagaucauuuagacaugcuaaguaaccuaacauacacaucuuugggaugugggaggaaauugaagugcccagagaaaacccacacagacuuggggagaaugugcagacucuacacagaacaguaaccccaacugggaauaauuuuuuuuuccuucucaguguuuuaacgaaacaaugucgaacaaaagauguuauuugaggaucugcuguguaaaaggaaucuuguguagagauauaauaaaccucugaaauuuuuaacucuagggauguuuuucaaaaucaauuuauagcaguuuaugaaaacaugcaaaaaaaaaaagcuuuaugaagaguuguacccuauaaauuuuuauugaggggaauaacugugguuuugaccaggaguuccuuacucauugaugaccacagucuacuacuacguggaaccuuaaucucagccuuuuuugaugaugcccaaguuaauauuuauauuguuuuguucaugggauaauauaugcaaaaugacuuuauaaacuaaagcuuuggaguuaugccugaguuccagugaugguucuuagcucuucaugguucuguucuuagcuauugacugcagguaaguugcuuaauuuuucuguaucugagauaaggaauacuaauaugguugaauuuuuuuaaauguguuuauugccuguuugcuuauuuuuuuauuguggaguuaagccuucuaauuuucaagaauuaagaguucauuguuaugugcuauacguauuuauuccccuugauuauauuucuguaccuacuuaccuuuuuauuuuagauucuggucacuucuauuccgaaaguuaguuaugaaguacaauccaggauuaagguggcaucuaaauuugguuaauuucugugcuaccuuuuaugcuauuagucuaaaucauuaagaaagcauuuaagaaacuuuuguaagcguuucuuuuuuuuucuugucauauuugggaauaggauaaauagcuuaaaauaguugagcugauuuuuauuuguauucuuuuuuuauuauaaagaaacauuugcuaggaaauaagcuggauauaaacauaguuguaucuccuuuagugcuacccagcacuaaaaacuuagacacguauagggcugagcagcugguauaauagagugggcuccgucucauuuucuaagccugugaguccuagcugccuacugcagcucgauuugagugggaguugauauaaugucuuuuuuuuuuucucacuucagcaguaaguaucugguuugcucauagucuuuugauuaauagguaguuugaauauuuuucaaagaaucagccaacaugugauuauuuuaaagauuuaaauaccagauagauauuaaaaugcaagguuauugcuacuagauauuacaucuagcuaaaucaaccauugugaaauaauugagaaguagagauaauaaagacauaaaccaauaaaucuuugcuugaaaaucacagguaugggaacagauugugaggacagaaaaauaaaaaguaaaaagaaaaaucauagguaauaagugucuaaaggguuucuucauaggaacagugguuguugaccccaaauaggacaaauaggacucccauguucaagaacacaucaccguuguuaaaaaggucugccauuauuaaauagugcaaugaagaaccauuuagacuuuauuagaguccacguuauuggcaaaagauguuggauauucauagaaaaucaaacuugacaaauuccaaaagugucuuucagcucuggaacaaaagaugucauauaguuccuugcuaccaaagaguuuguucauaugguaauagaggcccauaccuuuagagggcaaauacagugcuuuaggaaggacuuagaugauauaaaugguauuugucccuuuucucauuuuuauuuacugauuuucaacucacuuggcuuuuaaugaacauuagcguuacuuaucuguuggcagcuggguuggaaaacauuuguuuuucuagacuuuaugaaaugguagccacugguguugcacuuaauguuuauugccaguuaguucucugcaguuaauccacagcagaggaaucacacuucuaaaaugguucauucucuucuucauagacauuuaaaguugaacaaauacuuucuuguauauuguuacucuguuuggauggagagggaauguauauguaucuuaaaaauauuucucuuugccacauuaaacaugccuuuuuuccuuguguguguguguguguguuuucaggucagauguaccaacaguaccagcaacaggccggcuauggugcacagcagccgcaggcuccaccucagcagccucaacaguaugguauucaguauucaggugagcagguguugaaagggaguuggcucaugguuuuuuguuucuauacucauuaaacuuuaaguucuuaauuccuugauuuguaguacauugauauaauagguauuaaguuuuuauuaggggaaacaacauuuguuuuauuuauuuuuaaauauuuuacauuaauauuguaaaucaacauuucaguuuucugguggggagauaaaacuuacaguagaugauucugcaguaacuuguaguauaaaaaguuuuuaauacaaagcugucuuacuaacauuaucaguuuaucucuuaggcgacuuagugcaaguuuucccccuucccuccaccucuccauuuauauguaacacguaauuccaguguacucuuaguaccuguagaaauaugaacaguuuacuauacauggaaaggugauguuauuuaaauaagagcucaauuaagcuacuuagauuuuaaaaucucuugcaaguauguaggaauaccagaaauaggccauaaaaauaaaaucguauaaaauguaauucaggcaacuaagaacauuguuuaguuguuuuaaauaagcauccugaguauuuuguuucuauuuuaccaucuguccacugaagauuauauguauuuaaguaugauaaauauuauuaauguaacuuuggcuauaauuccaguauuuuuuacaguuaugucagagaguuuguguccaacucuuguuuuacagccaaagauugaaguaucagaauuucaacuguaauuagaaauaauuuaugcagguugaaucuagucuaaauucuauuuuauagaguuuugugguaucagcuagagcaggagucaguaaaguauagcccacaggccaaaucuggacuauugccuguuuuuuugaauaaaguuuuauuggaacacacuucuacuuuuauauucucuacugcuacuugggcacuagaauggcagaguugaguaguugcaacagaagaccauguggcccacaaagccuaaacuauuuacuaucuggcucuuuacagaaaaguuugcugacuccugaccuagaccauaacauucugucauuaauuaaaauuugaaauauuuugacacaauuuuauuuagauuguauuugcuguagagugacuuaacuuguagcuacuuguuuuuaauuguauaaaauacauagaacuuaaguuuggauuauaucaggaggaagguuauuuuuaggaugcaguucuuuuaaaaaaaucaguguuacaaacuauguuauuuauagaaagaauagcagagcugaagagauuuagucaucauuuaaucucgggauuucgguccucacuaugcuuuagaaucaccugggggaggcuauguguggggccccauucccagagauuuugaauuucauuugauugggugugggacucaggcguuugcauuuuauaaaugaggcaacuaguuuugaaagagauugugacuugucaaagcacauacagccauucaguggagggagcuggaucaguucaguauuucccuguaucauucugcauucuacaaccuagacuggaguuggcagacuuacuccauaaaaggcuagauguccuauguauuaaaaaaaaaacucacauaauuuccauauuuccauuuuuuugcuauuucugauguccuucaccuaaaguuauuuauuauuuuggagggacggaagggagacuauauauauacacacacacacaugauagaagcauugccacauuauguucaagagacuggugggcugcuaaugaaaucuucagccuguaggguuauucccuccccuaagcaauaauuaaggaucagauuacuuccaggcccaguuaaaaaaaaacaauucagauuucaggugccaggaugaaaaggcacuuuucuuuuuucucgcaguguuaaaaugaauaggcauuuucaguauaaagcugaauccaucuauuucuucaaaaccuuauagugaaaauuuaaguuuuauguagaggauaggagaacuuguaugacauucagaauuuuuuaugaguugguuucaggucaguauuuagaugcuaccaugaguuaaugcguuaaagauacuugauuuacuuauuaagaacuaagcuugcucuuaauaaauuuagucagggucuucacucugaguaaaauuuagucuuuucaaauuauuaucuuuguauuucugauccuacuagucuauuaacuugaauuugauugagagauauggaaauagucaacuaaauacucugcuuggagacuaagaggugguggugguaacauuggaccaucuuugacacuguugguuugccaguuucccucugaccuuuuccaguuuuguucauggacuaugucauaaagguuucuuucaugaguaaauuuugaacccagguucaaggugaguucagaauauacucaaauucauucaauccuuuuuuuuuuuaaugcaggguuguacauauuuuaauaauuuucuuauguaucugguauuuaaugcugacaggauuccagucaauggagagguuucauugcaaguagcugcagguguguuucaugguagagauaaaaguuuucagugaagcagacuuucguuguaaaaaaaauuacauccuaguaaauaaugaauauagauguugcuuuuuauggggcaauaugguaugcuuuuuauguguuaugcuguacugcuaaguaaaaauuuugaguuguaaaggcaaaaaacaucagauaccaaaucuaaaaggaaugauuuuaaagauugugaaaaugguacuuuuuauuuauuugcaaaauuuaaagcaccugauuaguacaauaagauguauuuauaguauuauuucauauaaaaauguucauucuccgcaauguguuuuuauuugauacuguuaaguaggucuccccugaaaaccugguuaaugacuauuuagcuuucccauuuuuggucuuccuagaaaguauaauucuuucauuuaucauuugagcaucuguucuaggaauuaugcuaugucaggaauuugcucucagggauuaugucuuagagaguuuaaaaaauuguagagaaugccucuuugauaacuacuuggucuugaaauauuaugugauggaaucuaccacucugcuuguuacauacauauuuauuaaauuucucaccauuuuugguccaccuaacaguaagacuaauucuuuggaaaaguaguuuuacuaaaagauaagauacauguuauuuauuuugccuuuucagcaagcuauagucagcagacuggaccucaacaaccucagcaguuccagggauauggccagcaaccaacuucccaggcaccagcuccugccuuuucuggucagccucaacaacugccugcucagccgccacagcaguaccaggcgagcaauuauccugcacaaacuuacacugcccaaacuucucagccuacuaauuauacuguggcuccugccucucaaccuggaauggcuccaagccaaccuggggccuaucaaccaagaccagguuuuacuucacuuccuggaaguaccaugaccccuccuccaagugggccuaauccuuaugcgcguaaccguccucccuuuggucagggcuauacccaaccuggaccugguuaucgauaaggaggcuccucuacaccaauuaauguagcugcuagcuauuggccucccaaaagacuccaguacuauuuuaauuuguauugaagaaguucagaaauuuaaaagcagagcauuuuuuaugauaucauuguugguguuaauugaaaguauaauuugcuggaacacaaagaccaaaaugaaaguuuuuuccucccugcuuaaaaauguagcagcuucuuaguuacuuuggaacacuacucuuacauguauaaagugauugacuugacuuucuagcuucccuuguccggaggauauuaaaaugcuagggugagguuuagccaucuuacuuggcuuuuuacuauuaacaugauguacuaaaguagagcccuuugagaauacaagauauuauguauaaaauguaacacugaugauagguuaauaaagaugauugaauccauuagu

SEQ ID NO: 18135 - RNA, 20611 nt, Homo sapiens
cgguccgccggaucuccagcgcucaguccgcgccgcagguggugcuugucugcagagucaugaccuguaaguggcgcggccgcgcgcugcagcucgaguucgggccgcgggggaggcuuuggagcggcgccggcgguggcucggccggcucagccccuccgccccgcguccccgccgugcgcggccuucccugaggcgggcguccgcguggguccgggaucgcguggccgggcggccgggcgcacucccgggauuccaggcuuccgggguggcgggcgaggcccagaaagcaccaggccacccggccgcgccggcacccgccgcguccugcuugacagaggcugauggacguguauuucuccacggugugggccgcggugguaggauccaacucccuuggguguuuucaaguugcgugaccuccuccagccccgcccugcacaaaggugcccaggcgguucuucgucuccccacucacuuuccagcuccagauuuugacuuggauucuugcugugucacuuacuuuguucagugacuuugugcagcuuucccccugcaaguccccuguuucuuuauuuguaaaaugauguuaaugauaccucacacaaugauguuaaugugugaaggaccuggcacauugcuuuaaauguuauuccuuuguuguuuccuucgcucacaguauuuuauucuuuuuuuccgccccuugguaaggucuucguuguuagauuaugaugaauauuagggcagccuuaaaagucuucacuuuacagaugagauggagugacgggcgucuccuccucagcaugaggaacugcccaguggcgggguuucccugcugcagcaugucuguagagugggucauuugcagaaugauaggcaguccuaagcuuaguugaggaccccgcccuugugggugagauguguaggagaggaagccaucagcguagccauggugagcuuuaucuuucccacccucggaagcacagacauggcccggcacguggcucacgccuguaaucccaacaguuugggaagcugaggcacgaggaucgcuugaguucacgagucaagaguuggagaccagccugggcaacauggcgacaccuugucuguacuaaaaaauacaaaauuagcccggugugguggcacgccccuuuagucccaaacuacuugggaagcugaggagggagaauggcuuaacgcugggaaauggaggggagacguuuaguggauuuaucugcuguucugauaacagcucaaaauaucuguuugccccagaauaaucccagcuuuuauuuccuguuuuaguuucccuucagauucuauaacuauuuagcaggcugccuucaggguuaaauuuagugcuucucacuauauuuaggauagaucaaggaaugggacaucugaguuuuccuuuuaguuaacccugagccaaacaggccuucaucagaggccaggguuugucauuguugccuuuucuggagacauuugcguuguuacaggaaacacccaaaagagauagcucucuaaugguaggauuuucagacucuggagcagaggugggaugggaaguucgggcaggccauuacuaauugaagggguggguugccccuccacaccuguggguguuucucguuagguggaacgagagacuuggaaaagaaaaagacacaaacaaaguauagagaaagaaguaggggggcccaggggaccagcguucggcauacggaggaucccgucggccucugaguucccuuaguauuuaugaucauucuuggguguuucucggagagggggauguggcagggucauaggauaauaguggagagaaggucagcagauaaacacgugaacaaaggucucugcaucaugaacaagguaaagaauuaagugcugugcuuuagauaugcauacacauaaacaucucaaugucuuaaagagcaguauugcugcccgccugucccccuuccagcccuaaggcgguuuucccuaucuuaguagaugggacauagaaucggguuuuauaccgagacauuccguugcccagggacgggcaggagacagaugccugccuuccucuugucucaacugcaaagaggcguuccuuccucuugcacuaauccuccucagcacagacccuuuacgggugucgggcugggggacggucaggucuuucccuucccacgaggccauauuucagacuaucacauggggagaaaccuuggagaauaccuggcuuuccuaggcagaggucccugcggccuuccgcaguguuugugucccuggguacuugagauuagggaguggugaugacucuuaaggagcaugcugccuucaugcaucuguaacaaagcacaucuugcacagcccuuaauccauuuaacccugaguggacacagcacauguuucagagagcucgggguugggaguaagguuauaguuuaacagcaucucaaggcagaagaauuuuucguaguacagaacaaaauggagucuccuaugucuacuucuuucuacacagacacaguaauaaucugaucgcucuuucuuuucccuacacuaauaauuccugaaguuuugcagagcuucauagauuauaaugugcuuuggauccuuuacugcugcgucccaccagaccauaagcaggaacuauguauccaucaggguccagacaggacauggaaacaacacuaguaacucgaacaaggaaaauuauuuauuuauuuauuuauuuuuuuggagacugagucucacucugucguccaggcuggagugcaguggcgcgaucuuggcucacuguaaccuccaacucccagguucaacugauucuccugccucagccuccugaguagcugggauuacaggugcccaccaccacaccuggcuaauuuuuguauuuuuaguagagacgggguuucaccacguuggccaggcuggucugaaacuccugaccucaggugaucaccugccuuggccucccaaagugcugggauuacaggcgugagccaucacacccggcggaaaauuuuauauaaaaaauuauuaucuggccaggcgugguggcucaugcuuauaaucgcagcaguuugagaggcugaggcaggaggaucgcuugagcccaggaguucgagaccagccugggcaacaaagugagacccugucucuacaaaaaauuacauaauuaaaaaauuagcccggcaugguggugcauaccuguggucccagcuacauaagaggcugagacaagaggauugccugaacugaguaggucaaggcugcaguggaccauguuugugccacugcacuccagccuaggcgacagaacaaggcccugccucaaaauaaaaaauauuagcuaauggaaagugauuaucauaaaagcuaaaagggaacuuuaaagaacagaagaaaagcaaauaugauguauagcuacuaccuccaggaagaaauaagcuuggaagagcccccaaccuccuugcuccagggcugagcacagaccuugucagggcuggcuacauaauuuguggggcccaguucccuuguucagauagcaagagaaaagugcuguuagcuuuuccuucugcaguaucucuuucaaccucucaugguguuauuugcuguuuaauaucauguucucuuggacacaugaauacuuaugggguaagugcagacuuuuagaggugccugggaccccuguccugugaauaggcaugugugcagcucacuggcugccagguuuucccucugccagcagcgggaucgaugugcugugacccagccaguaguggggaaacugagacagacaucuucccuucccaugagcugggcugcucaugggaauuaugugagcagcuuccaaggaaucacacuuucugugcugggacauacucaguauauggauuggagguagacgagaggcccaugaacaaacaguaagggacaggaccauauucaaacccagucuuuuuacuuuaagccauauucucauuucauucccuacacugcguaguaagaagcugguucacucuagauucuugugccuggcaugggacuuugcccauggauauugcucuaucuccagauagauuuuagacuauugacauuuuggacaggauaauucuucguuguguuauggaggggguuguccuaugcauuguaggauguuuggcaguauccuuggucucuauucauuagaugccacucauaccucaucaguuguggcaucaaagguaucuucagacauugucagauguccccccggggacauaacugccuuccauuugagaacuauggcucugucugaauccagcaguucgaucuucugauagcuguuuucuuuugucuuuguucucagcuuuccgcuuggcccucauccagcuucagauuucuuccaucaaaucagauaacgucacucgcgcuuguagcuucauccgggaggcagcaacgcaaggagccaaaauaguuucuuugccggucaguaugggagcagccauucuguucuagccacuguacacccaagcagaacgguguuugcuagcucugguuguccucuuguauccugggguccagcagugucccuuggagcccauagauuguuccgagucugacuggaggaugaccuuagcaagguucuuugugagauaggaugugccaacacggucauaggucuuuagguuuuggaucuuccucuuuguucagaugaggaagccaaaauccuaguauauugagggacuuacggaaaacuaaaauacucagugcuuggauacuuuguuccuuauuuaacuaagucuuuauagaaccagaacauauugguuuuagcacuaagccuccaacauuuuuuuuuuaaaugagcucugggagaacaccugugauuugucuccuccaacccacuaggcuagcuuuguagucuuaccuguggcuacaggcucuuuacccuugagaugucaguguuuuucuuauuagcuguguuuuaacccuucgacugaaagcagagcuagaagcagcagcuauggccucuuacagcagaacuuuaaaauggguggguguuuugaucuuuuuuuuucucugccaauauuuuucuaggaaugcuuuaauucuccauauggagcgaaauauuuuccugaauaugcagagaaaauuccuggugaauccacacagaagcuuucugaaguagcaaaggaaugcagcauauaucucauuggagguaacuuccuacccacaagguauaaugaccuaaacauuagaaacaucugaaugagucaggugugguggcgugcgccuguauucccuacuugggaagcuucagcuugggaagcugaagcagagaguuucuuuuucuuauuuauuuauuuuuuuugaggugaggucuugcuuugucacccgugcuagaguacaguggugugaucauggcccacugcagccucacccuacgaggcucaagugauucucccaccuccugaguagcuaggacugcaggugugcgccaccaugccuggcugauuuuuguauuuuuuuguaaagacagaguuucaccuuguugcccaggcugguuuugaacuccuaggcucaagcagucugcccaccuuggccuuccaaagugcuaggauuacaggugugagccaucaugccaggacuguuuuuuacuauacuaauagaggauugagaaaaaaaauuuuuuuccauagaggccacauacauaaagguagcuuuauuuuugugguuuuggaauaaauguuuaaagguuuuauuugcuuaaauaaaaaauaaacacagaaaaauucuauaaauauagcaaauacaauuuuuucuguaugaugauauauuaagaauuagaaaugaaggcaaagcaagaagccuggagaugaaacugcauucagugauggagaggcuucugacuuuacguucucaucuuuugggacacaguuuuguugcagaaccuggugaauucaaguuaagcaaugggaaauuucucauuuugcccuaauguuacagauuaaguguuacucaagaucauggcugaauuucaggaacaguuugguuauuuuuuaaaccugucuuuggcaucuaaccuaaucauaucccaucuacacucuggaguuuaucucugaaagaucauauucaagaaggaaaaaaaaaaccaugauuaaguaacccauagaagggaauacuuauucuguauuauagaaugagguguugccuuauucuaaaaacaaaaugaauaaauaaaccguaaaagauagguucuuuauuuuuggacccaaguuaucaggcuuuuaucccuuucucacaaaagaauugcucuauucuuuuucuuaugguauguuucuucucucaaugaaaggcucuaucccugaagaggaugcugggaaauuauauaacaccugugcuguguuugggccugauggaacuuuacuagcaaaguauagaaagguaaguaggaaguguggcauaagaauuuguuaucucuaagccagcaacaauguguggaaaaaaaauuugcuaugaaguucccuagucccucucauuauaucacacauguauuaggguuuugacugauuggcacaggugguuauucuuggccauuugcauuuuuauauaaguuuuagacucagccugucaauuucugcaaaggaacaagcuauaguaauuuuuuuuuugacagaaucucgcucugucacccaggcuggaguauaguggcacaaucuuggcucacugcuagcucugccuccuggguucacaccauucuccugccucagccucccgaguagcugggacuacaggugcccaccaccaugcccagcuaauuuuuuguauuuuuaguagagacuugguuucaccguguuagccaggauggucucaaucuccugaccucaugauccacccgccucagccuccuaaagugcugggauuacaggcaugagccaccgugcccagccaaccuauaguaauuuuuauuaguauuucauugaauauauagagaacacugugggaagaguugccaucuuuuuaguauuaaaugcguauacaugaccaggugcaguggcccaugccuguaaucccagcacuuugggaggucugaguaaguggaucaccugaggucaggaguucaagaccagccuggccaacauggugaaaccccaucucuacuaaaaauacaaaauuggcuggguguaguggugcacaccuauauagucccagcuacucaggaagcugagacaggagaauugcuugaacccaggagguggacgcugcagugagccaagauugcgccacugcacuccaaccugggcaagacagagcaagacuccaucucaaaaaaaaaaaucauauacauuuaguaucauuaagucuucuugaugaguugacccuuuuaucauuaugaaauaucucuuuuuuuucuuguaauaccucuugucuugaauucugcuuuaucucugcuaucacuauagccacuccagccuucuuaugccuaauguuugcugguacgugguuuuuccaguucuuuguucucaagcuauauguguuuuuauauuuuaaguggaucucuuuugucaacagcauauaauuguaucuuaauuuuuucuuuauucugacaaucugugucuuuuaauugaagugguuaguccauuuauauuuaaugcacuuauugauaugauugaauuuagggauagagacauuuuacuuuuuuuucccuuuguucaucuuuucuguauuauuuuggauuaauugaauauuuuuuagaguucuguuuuaauuuaucuauuggcuuuuuaguuauacaucuuagcuuuuuuuuuuuuuccaguuguugcccugggaauuaucauaugcauccuuaacuuuucacaggcuacuuaagaguucauauuauaucauuucaugugaaauuuaagaaccuuauaaugauauagguccauuuuucuaccccacugccccugcccucauucuuuaugcuauaguugucauuuguauuccauguauauauguuauaaaucccacaaaacaggaauacuugauuuaaauagucauauguauuuuaaggaaauuaagaagaaaaaaaucuuuauguuuacccaaauauuuaucauuucugguguuuuucuuuccuuccugaagauccuccuucuaucugguauauccuucagaccaaaggaucucauuuagaauuuuuguucugaggaucuguuagcuaggaauucuguuaguuuuucuuuaugaauauaucuuuacauuguuuucauucuugaaagauauuuuugcuggaauagaauuuuggauugauaguuuuccuuuuuuuccacuaguaguuguuaucuagccuuuuuuuuuuucuucccugaugagaagugaguaguaauuuguauuguucccucggauauaauuuguuguuuuuucucuccuucuuucaaguguuuucauaaucuuuaguucuuaguauuuugacucugauaugccuagaugugguuuccuuugucuuugccuuccuugguacuucuugaaacuguaaauuuaaaucuuucacuguguuugggaaguuuuuugacacuauuuuguuaaauauuuuucuguuccuuuuucuuauggagcuccaguauauguauauuauauuuuuaaauauuuuuccaaggucaccaggcucuguuuuucuguuuuugucuuuccaauacuuuuuccuucucuucuacagauuagauaauuucuguugaucuuucagacuuauucacuguuucuucugucuucuucaauuucccguaagccaacccagugaaauuuuaaaaaauugagauauuaaaauuuucaguucugaaauaccccuuugcuucuuuuuuauaguuuuuauuacucuaugauauuuucuauuuguucauuaaaagcauauuuuucuuuacaguguugagcuuaguuaguuucuauagcugcuuuaaagucugauaauuaucacaucugugugccacagaaugagacuauuaggccuuuaaaaggccccugauguaaauaaacucauauccaagcaaacaacaagaaaaaaauuauaacaucugggucauggcaggaucuguguucauuugauugccuuuucuuugcaguuuggaucacacuucuguuucuuugaguaucuacuaauuuaagauuguacaguggauuauauauuguagagauucaagaugcuauuacagucuuccaaaaaguguugaauauuuuguuuuaacugaugguuaacuuggccgcacccaaacaccaaacucuuaucuucuuugaaacgugggcagcaacuuuagcugcucuguucuaucugguuguucugccccacuucuauuuaacucagugaucagccagagauuuagaaagauuuuauaugcagaauuuagggcucucccucuuugcuuucuccauuucaggauuuccccccuugguuuccagcucugguucuucaagccagugugauuaugggucauuuucaccacuacuuaucacagcaacugggaccuugcuucaggguagcagcuguaaauagcaccaggaaguucacccagggcuguucccugcuuccacaugucuguguucuucucuucagauuuugucugcuuuguuuuggucauucuucagugcuuuaaguaguugugccuuuuauuuuguccagaguucauaguuaaccacaagaaaacuggucugauaggagcuacuguguaccugcuggaagaacagccagcauuggacuauuaacccaacucuuugaaguauaucuuuuuaguauuaaguuuuccaguccaugaaugugguauauauccugacauuuauuacgcuuucuuuacuuucucucaauuucuuuuuauaguuuuuuggguauaauuuuguuuaacauuugugagauuuauuccucauugguguuuuuagaugcucuuucauuuucuguuuuuguuuuuguuuuuuugagauggagucuugcucugucgcuuaggcuggagugcaguggugugaucuuggcucacugcaaccuccaccucccugguucaagcuguucucuucuuucagcuucccaaguggcugggauuauaggcaugcaccaccaugucuggcaaauuuuuguauuuuuaguagagacgggguuucaccauguuggccaggcuggucuugaacuccugaccucaggugauuuuuaaaugcccaccuacuuuccaccucuccugucaauuugucaguuugauucugauaaguauuuuuuuuuucuuuuuuuuuuugagagagagagucuugcucugucacccaggcuggagugcaauggcgugaucucggcucacugcaaccuccaccucccagguuugagcaauucuccugccucagccuccuggguagcugggacuacaggcacgcacaaccacccccggcuaauuuuuuuuucuauuuuuaguagagacaagguuucacuacuuuggccaggcuggucucgaaccccugaccucaggugauccgcccaccucggccucccaaagugcugggauuacaggcaugagccaccguguccggccugauucugagaagucuuuauuuagcauuuauauuuuuaaaaagcaacauauuaguuaccucccaugagaaaccuagagguugauuugcagacugcuagaaaauagggguuauaaaagguacaguaucauuuuuccaguucccugugguagaauucauuuugauaaggugucagccagcuugugggguggauuauaagcaguuugggggugcuguuuguauaguuaaucuuagagcaccuuccguaucugcccggggaaagauauugucauuacugccauggacccugcuggaaaagagguaaccaaauccauuauuugugaugcagauccaucuguuugacauugauguuccuggaaaaauuacauuucaagaaucuaaaacauugaguccgggugauaguuucuccacauuugauacucguauguaccagauaaguuugccucuuuagcaaucucaguagaagacaaucagguauuuauuucuuuuuugucucucuccgauuucuucacauaaccuaacugaaagaccauaagugagaaaggcagagaaucaucacagaucuggaaaguucgggcuuauuugagaacuaaggauuugacacgauuuugcccuuugauuugauuguagcuuccuguuacggcuuccagaguauaccuauuaggcuacaguugaguaccucccaucuagauaauaagcauucaauuagaaugaauuucucaucuuuacuccgcugauguaaaugaugucuuuaugagaugaaguccaaguaggaaugagcuuguaaauuaucucuguccucagguccuguguuaauuuaucccugucaguguuuugugaucauuaugucauggaggauuuccccugccacaccaugcuguagggaguuaacuuuucauuugugcauuuucuguuuggaaacagcuuacugcagagugggucugggcaucugcuacgacaugcgguuugcagagcuugcacaaaucuacgcacagagaggugaggcaguguaauagcuguguuaugugggugcuuggaggcuugguucuaggcuggucuaugugggauccuuagucaagaaaagcugggagagggcucuuuaauuucuccaucuucagcccuuucacccccaugaggcuucccagacuuuugcuguguauggaugacaggguuuuugggggguuguaauuaaacacaucauguagcuaagguaggagcugugcucauaaaggucuggucuacccuugaguccuuguuacuguguuuggagagucacuugaagcccaguagaaaugaaguggauuucaccacucaguaccccuagacauuggguacaaguagaaauguggucugugauauuuugguccagacgaggagaaaugugccaguaucugggaagagcgaguucaaaagauguggguucuaguuccaacucuucccuuuaauuggcacaguacuuugcuaaaaugauuucaccucuagagcagugugguucucaguuuagucacaggaaugauaugaggauuaagaagagagaaccuauaaagccccucgugugguacucaacaaauaccagcauccuuacuagacugcuugaagcuacuuccaaauagacugucacuuaaccaagugaaguggguggaaaugguuugacugccugcucagaagguggaggugcaugggcucuggggucaguagucucuguugagccauauaucaauaagccuuagggcaacuccucggccccuaauuucaguugaaaagaauuacaaaacguggucauuggccauguggagcugacauauggagcugagauaaauuuguuuuuuuuuguuuguuuguuuguuuguuuuuuugagacagaguuuagcucuugucgcccaggcuggagugcaauggugcaaucucgacucacugcaaccuccaccucccagguucaagugauucuccugucucagccuccugaguagcugggauuacaggugcccaccaccaggcccagcuaauuuuuguauuuuuaguaguuaugggguuucaccguguuggccagacuggucuugaacuccugacuucaggugaucuacccgccucggccucccaaagugcugggauuacaggcaugagccaccgcacccagccagagcugagagaaauuugaaugacaguucucuaccuuauuuuuguuuguuuguuuugaggcagggucucacugucacccaggcuagagugcaggcgugaucauggcucacugaagccuuggucuccuggacucaagugauccucccaccucagccucccaaguagcugggacucuaggcaugugccaccacaccuggcuaauuuuuaaauuuuuuguagagauggggucucucuaugucgcccaggcuuuccguccuuuuuuuaagugaaguugauaccggugggcuaggggaggcccccaaacaccagucugaccuugaccccagccaguguccaugcuauugacacuauugcaagaaggaauucaaggaugagucagaaaauaguggaaguauggagauuuauugcaaagugaaaaguacacacucaaaaaagggaggguguguguacucaagagagucaugcgcaaggagguuugggccaucuaccuuuauggguuuccuuuuuuuuuuugagacagagucucaaucuguugcccaggcuggagugcaguggugcgaucuuggcucacugcaacuucugcuucacagauucaagcaauucuccugccucagccuccccaguagcugggauuauaggcgcucgccaccacgcccagcuaauuuuuuguauuuuuaauagagguaggguuucaucauguuggccaggcuggucucgaacuccugaccucaggugaucugcccaccucggccucccaaagugcugggauuacaggcgugagccagcgcacccaccgccuuuaugaguuucuuuaccaaggggugaaauauucaugacgcuuccuagaaaaagguggagauuucucggaauugugccacucauuuuuucaccaaauacggguguuccagaaacuaucauggcacgggugggugugugauuuaguauguuaaugagcuuauaaugaggauaaugaaguccuaggugaaaccuaggucaaacccagcaccauauugaguccacugggucuuagcccuaguuucucagggucuuagccccuagcguaggcagcuauuucaacaguuucuuuuugcuagucauaugaaacugcugccuggaauuuucuguucucuugcgaccguccuguauuauuucugucucaaagucacaugugauuuuggucaucaacaccacuuuucuuguguguccauaugugugugacuuacguguucguauuaaaggaauucagagccauaucuuaauugcugcuggcacugucugacuuggcugacaucuuuuuauguuugggaaaguuugaguucaguuccugcuagauaaggaacaguggggaggacugguuuuguugagugcucacugcauccacuguucuuuggcuuuucucuccccaaggcugccagcuguugguauauccaggagcuuuuaaucugaccacuggaccagcccauugggaguuacuucagcgaagccgguaagaaaggaaccauauauucaagccucucggcauguccucuuuguagaaagauuuccgguuggguggaggugccagccuuccugauguggauucugucccugacucaggaugcccuuguauccaaaugcaguuggaaaggaugaagcuauaaggaggacuucuacugcacgucacuuucuccucagaagccacaauaccaaccucauggauuuuggaaacuguacuuuuuuuuuuuuuuuuuucuuuuuaagagacgggucuuaccauugcccaggcuggagugcagugguguaaucauagcucauuacagccuugaaauccugggcucaagagaucguccugccucagccuccugaguagcugggacuacaaacaugcgccaccaugccuugcuaauuuuuuauuuuuuguagagauagagccucacucuguugaucaagcuggucucaaucuccuggccucaagcgaucuucccgccucagcuuuucaaagugcugggauuacaggugugagccccaagcccugccggaacugugguuuuggcauuuucaauauucaguguauuagaugggaagggauuucauuuuucugugauuagauguggauuggucccucuuaagucaguuccagcaacuuuuacagagaaauugagaaccacagagcuuaugucuucagagccccagaagccaauuaaaaggcagggauuaguuuagcuugaccuagggagagauuuguggucuguacccagcugauucuaugccauucagaucaggaugcuuauccuacccccuccuucacaccauccuacuaguccugaggguacugugccaagaaacucaugagaagcucuuguucuucuaaccuauaacuccagggcuuugcacaagcaucuuuggcaggucacaggugccuuuccuuagucuucuaaggcugagagguggugaagggcaaauagcauagguggacauaagauggaagggaaaaugaaugugacugugagugugucugucugucuguaaagugcucuacagcccaugaaaugcuggucugagaugaugguuuucuuuagaauuuuuaaaaguugaaguaauacaaaaaaaguguacuaauuuuaagcauagagguuggugaauuuuuguguauucaccugccaccaagaugaacauaacagaacauuuccagcccccgaggaugcucccuuuuuugccccuuucuaguuaguacuccucccucugccuagagguagcugcuguucucacuucuagagauggugguaauguuuaauguaagggaaagagguuuuagcugguugcaugguggaagauggggguagggguauaagaugccaugaguaucagugaagguacaguuuugucaaaagugagaaguuucugggauacugagaugacccagcaugggucuguuaagucucgagggcuccgaggugaggugcuuugguguaccuggacugcgagcugcaauuuuuguucuauuugagguggugggacugccaccaugggcauggaagcgccauguggccugcaagguguauugcucucauaaggccacuccauucucuccggccaccuugacuugcuuuaaccagagaagcucuucucuuauguuagcuuauagcaggcuuucucagcaguggcacuguugacauuuagguguguaauucuuugugugggggcuguccugugcaugguaggauguuuagcagcaucuguggccucuaccugcucgaugucaguagcaucuccuuagucacgacagucaggaagaucucuagacauugucaaauuuggugggcaacauugcuccuugcugagaaccacuggcuuaugcaguaagguaacuuugcacaaugugcagguuaguuacauauguauacgugugccaugcuggugugcugcacccauuaacucgucauuuagcauuagguauaucuccuaaagcuaucucuccccccugcccccaccccacaacaguccccagagugugauguuccccuucguguguccauguguucucauuguucaauucccaccuaugagugagaauaugcgguguuugguuuuuugugcuugcaauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuuguuauugugaauagugcugcaauaaacauaugugugcaugugucuuuauagcagcaugauuuauaguccuuuggguauauacccagcuaccaaugacuuucuucacagaauuggaaaaaacuaaaguucauauggaaccaaaaaagagcccgcaucgccaagucaauccuaagccaacagaacaaagcuggaggcaucacgcuaccugacuucaaacuauacuacaaggcuacaguaaucaaaacagcaugguacugguaccaaaacagagauauagaucaauggaacagaacagagcccucagaaauaacgccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacacuuuauacaaaaguuaauucaagauggauuaaagacuuaaacguuggaccuaaaaccauaaaaacccuagaagaaaaccuaggcauuaccauucaggacauaggcaugggcaaggacuucaugucuaaaacaccaaaagcaaugacaacaaaagccaaaauugacaaaugggaucuaauuaaacuaaaagagcuucugcacagcaaaagaaacuaccaucagagugaauaggcaaccuacaaaaugggagaaaauuuucgcaaccuacucaucugacaaagggcuaauauccagaaucuacaaugaacuccaacaaauuuacaagaaaaaaacaaacaaccccaucaaaaagugggcgaaggacaugaacagacacuucucaaaagaagacauuuaugcagccaaaaaacacaugaaaaaaaugcucaccaucaguggccaucagagaaaugcaaaucaaaaccacaaugagauaccaucucacaccaguuagaauggcaaucauuaaaaagucaggaaacagcaggugcuggaaaggauguggagaaauaggaacacuuuuacacuguuggugggacuguaaacuaguucaacccuuguggaagucaguguggugauuccucagggaucuagaacuagaaauaccauuugaguaagguaacuuuuuaaagagaagguuccauggcucuggcuuccuucuacaucugaguuagccugaacuauccuauuuuuuaaaagaaggaucuaucuacuuggguuagaaaaaugucagauuuauaauguacgauuuaccucuuuccugucuauugacuacagggcuguugauaaucagguguauguggccacagccucuccugcccgggaugacaaagccuccuauguugccuggggacacagcaccguggugaacccuuggugaguaaggcuaagugagaauaggcucagucggagcuugagcuugagugguggcucguuggcagauggguuuucugguuccugagcagccaggcgcucacuucucacucccauuuccccacauauccugccagcuuucugccugucucugugagaggagcuuccauuugaaaaccaugugagaagcaaaucacccugcucucaugaucaagcacuuggccuuagcccucuucugaguuucuggugaccuucacugucagucauacuuggaucacauggggaaacaaggcagcagugacaggcagguuguaguaagagacucugaaauuuuugguuaaaauuuaaguuggcugacuagucccaggguaggaaugaguuacagggugaggacuuugcuuccagcauaaugaucagaggagcagucaggaugguucaauaagugaaacuaugacccucuccccaacaaaagggugaagcauuuuauuacucaguggagccagcacauaagccugcccagacagaauuacagucauacgcucauacgcauuccuuacagucuacauuuguacaguuuacauccuacuuucacaacauggucucaacuugaacucucaggaaauuguucuuauuaagcccaguuuauagaugguagaauuacagaggaagcgacuggaauuccagauguagcggcuagacccaguguuugaauccaggauauuugccuucagaacuuggauguauuccacacuaguucucuguaugaaagcacacacacacacugguauguaugucuacauuucaggaugaguauaccaguaacaagacugagaagaguuaaauguuacugugggguuccugaggguucugucuucugccuuuauagguagggcucagagcucaaugugugugguggggaggccuuggaagauaugacuagugugagauuccaguuggccuccugcacauuaggcuuggggacauugaaggacuaaguugacuugaaaauuuucuugaacuugcaucagguuccacuguccagaaaucuuugaaugccagggcaaauggggaagaaucagaaaagaauucaguuacgugucauaaaugguggugcuuguauuuguaacucauuugugccaaaagucugucuguggcuaucugguaaacagaaucaguuguuaugucagauuauuuuggagaagguucauuucucuagguaaggguuugaacccuugcucugggccaagagacuagacacuggagauaguuucuuuuuucuuuuuuuuuuuuuugagauggaguuucacucugucgcccaggcuggagugcaguggugcaaucucagcucacugcugcaaccucugccucccggguucgagccauucuccugccucagccuccgaguagcugagauuacaggugcacaccaccacgcccagauaauuuuugcauuuuuaguacugaugggguuucgcuuuguuagccaggcuggucucgaucuccugaccucaagcgauccacccaccuuggccucccaaagugcugggguuacaggcgugagcuaccgcacccuuccuggagaugguuuuacaggucagccuuacccuggauugaugaaggaguguggcuguucccuagugcagggcuccugccagugugagguuacccuccauccccccaugccacuucuacccagucgccagagguugaacucuuucccucaaaucugaaacugaagcccauuaacacagggguucagguaucacagccaccagggcagagaccccagcagaucuggggcccugccuaggcccagcuucaccacucucagggaggguagcagcccaggcagguaugaagagugggucuggacugccauuguaaaggggggguccacugaaaugcacucaugagggcaugagauggagcuuccuguuggugguagguagcucuauugccagaucuuuauaaucaucagauaaccaccgucuccuagugauuugcaauuuaugaaacaugauccauaauuuuaucacuaagcccucacagagcucuuauuuccacuuuauagauuaggaaauggagauuuaaaaugccuucccauaaggucacagagcuauuuaaaugauagaacauaaaucuguacgacuaccuucuuguuuucaaucucauacuuuccccuuuggccugugagcuugggaggaaaaaacagagaccuugaauaucaccaaacaucagugaauccacucauucucuucugcaucuuuuucaggggggagguucuagccaaagcuggcacagaagaagcaaucguguauucagacauagguaagauuuuccugggcaugguuuaggucucugauguccccauuguucugaggccagacuccauggcugggaagucccugucauuuggagggguuccuuuaugccccuucucauugaucucuggggauauucuagggucugguucucuggccaaucccuggggaguguaucagcuugaauuuucuugguuugguuugaaaugaugccaggccaucugugcaccuagauaagaccuauguuacuaaguuacuuacuaagacucuggugguuuauacagucaggggaagaaauccccuugguuagugaggaguugcaaauuauuaauagugcacuuuccuguuuuuugcagaccugaagaagcuggcugaaauacgccagcaaauccccguuuuuagacagaagcgaucagaccucuaugcuguggagaugaaaaagcccuaaaguuuauguuucuaaugugucacagaauaggacgauaugauucuacaacauaaucaacucccuauuaaauucuuu

SEQ ID NO: 18136 - RNA, 15702 nt, Homo sapiens
uguuagggaauguaucauuuuaaaaguugguaauauccauauuuaauacuuuguauuuuuuauagaugaaauugacaguucuucaaugucagaugaugauagaaaagagguuguaaacauucagacuuggauaaacaaaccagaugucaaacaucauuuuccuuguaaagaaguaaaagaaaguggacacauguuucccagguacuuuuaaaaaugucuucauaagaaguaaaauugaauuuggggaaguuaauaauacaaaacugaacuacagaagaaccuuuauuuauccuaguacaauaagauauaauucccuucugucuacuuguauuacaggucuugaauuuacaguauuauguaauuuuuauuuugaaaaauuuuauacaaaaauguugaaggaauaguacauugaacacccuuaugauucuuuuuuuuucuuuuugagacggaguuuugcucuuguugcccaggcuggaguguaguggcacgaucucugcucacagcaaccucugccucccagguucaagugauucuccugccucagccuccagaguagcugggauuacaggcaugcgccaccacccccggcuaauuuuguauuuuuaguagagacgggguuucucuauguuggucaggcuggucucgaacuccggaccucaggugauccgcccaccucggccucccaaagugcugggauuacaggugugagccaccguggccggccaugauucuuagauuuaucaacuguuaccaccuuuuaauaccaccccauuucguauguauauauauauacauaugcauguauauguacauuuuugucaaaccuuucaaaagaagucuacaaaugugacacuucaucccuaaaugcuucagcauaaacuucccaaguauaugagcauucuccugcacaacuucaaugccauuaccccaccuaaaaauuuuuguaaauuaacaucauuuaacauacagaucauaccccaaauuuucaguguccccaaaguaucuuuuguaguguguuuuuucuuuggugauccaugauccaguucaugguuuacacauugcauugucuguuaugugucuuuagucucacccuguguacagcagaacucauccccccacccccucgcuucccuuuucucuucaugaugaaugaauccuuugaguccaggucaaucauccuacagaauguuccacauucugcacuugucugauaacugucguauuguauuacuguacauaaaaaaugugagaguauuauauuaaaaagaagcugagauacagggguugggugaguguuaauaauacuaugcucauuuugccuucaggauccaguuacagaauguuuacaaaauauguagggaaacccaacaauugccuagugaucuuggauauuagauauaggauauggugcauugaaugagaauaguuuaugaauauagguaauagcguuaaaaaaucugaaacguaauauacuccauuucaauaaaaaauauauuauuguagugauuucuauguuguauggaacuuuuuauuauauuuauuauauuuucaaucauugcaggauuaucuguuaauaaaauauuaauuuugcauacaauuaaaagguguuaauguguagcuuacuuguuuauagauuaaccucuguuuauaucuuuuaacucaauuuuauuuagaguugaacauuucuaauaauugagaugguugaaacaacaccuguuuugaauuaaauuuacuuaaaaauucuuuuucuuuuaaugcuuuuuuugucucaagucaucuguugguuacugcaacacauauguacuguuuaagggagauuguuucacggaaaggauuggcuuauauacagucucgacaagcgcugaauucuguaguuaaaauuacauccaaaaaaaaacauccugaacucauuaccuucaaguauggaaauagcagugcuucaggaauagaaaucuuggcaaucgaaagguaagauuuuccuuaagauaauauuaucugaauucagauauuaucugaauuacuguaguucacuauaaagaguuuguuucuuuauuuuggggaauggaugguggaauaggauagcugaaccacuuuuaguguuucuuaucucuuucuccggaguccuuagucaugugugguuuagccauuagcacaugauuugaguaagugccauagcuaauuucauaaaguuucugacccaaggauccuuauuguuaaucuguaccagugcugcacuaauugcuggcuugcagagaaauaagaaacuuguuuuagaauauguugauauuuuuauuuuccuucaucgaaaaauucuuguuuugacaaacugucagugaacuaagcagugugcugggugauauagguaauuuacagccugguacaagccccccuuugucucauugugggucacuaacaguucacagacuggcccaagagcuguggaccacacugauauugauacuaaaccauuuuuuaauuauagauaaaaauaugaagcccagagggguggaaugacuucccagauccuaacacuuaguuugugacagaaccaaauauagccuuccugacuccugauuugugguuuauuauaccuugcaucaguucaaguuguucccccacugggauuuaggauuacacuuauuauuuacaggagugcuuggauaaauaguaagcuuaagguuauaucgcagcacuuuuaaauaaucaacuucaguuggaagaggaaauuauucagcuucuuucaucuuguacugacaauuagguagcaaacaucaugaaucuauacuguuuuauguaauuuguuaaaagaaaauaauaccugauuuguaaaaaaaaaaaaaaucacuucauugcuuuauguaagaauaaauauuuacauagugauauuuucaauuaauaauauaaagaauaugucauucuaauucucuguuaacacauugauguguaucuucucagauuuuuuuuaaugcauauguuauuucucuacuaaaaacuagauaaaugugauauaggcuuguuuuuguguucugauuuuuuaagaaaauaguauagugugaauauacuuacauuuuaauaaauauaaauuuuuuaaaauuaauuaauuaauuuuuuugagacggagucucugucacucaggcuagagugcaguguugcaaucacggcucacuguaagcuccgccucccagguucacaccauucucccugccucagccuaccgaguagcugggacuagaggcgcccgccaccaugcccagcuaauuuuuuuauuuuuaguagagaugggguuucaccguguuagccaggauggucuccaucuccugaccucgugauccacccaccuuggccucccaaagugcugagauuacaggagugagccaccgugcccggcccaauaaauauaaauucuuagcuuuuuaaugguagauauucuguuauaaggauuucucaggagauugauuuaacaagccucauguugauuggcauuuacauuguuuucauguguuucacuauuaaucuucuagugggccuuuaaaaacauguauguuuacauaguuguccaauuagucuucucaggauaaauuccugcaaguagauucaaugggugagagguauacacauuuuaauaucuacuuauaaauuaauccuaaccaaaggagauuugaauuaugacucucucauguauaguaaaaguugggaauuguguuuuaaaggcuuucccacaaauuuugcuaaauaaauugaaguuuauuauauauggaucaacaucuuuuuuuuuuuaauucagaguuuuggaagauagucuuaauaguggaagauaaaguaacuagauucucucucucccuuucuucauugauauuuaugguucucuauucugccucgcauauaacacucauagaugauuuauacaguggaauuguuagguuuuaccgaagaugcuuuuuuaaaaaaauaccacuauuuuuauucuccaagaaaagaaaauugacauuuaaucuaugguguugauauuuugcaauaguuaucauaagucuuaucuuuuuuaaauauuucagaccucauaacgccauuuuauuauguacauaacccucuguaaaguuuggauaacuauagcuacuuuuuauauaggaaucuguuuuagugaacuuaaauuauuugcuuaaagucaaacuauuaaguguuggaauugucauugucuuuggaauuggauaccaacaauucaugugugauuuuuguagcuaauugaagguacaucuguauuggggaguggaauauuauauuuuuuaucuuguguuuuaucuagcuauuaccuauauuuaauaaugguucaaagaauuuuagcuuuacacuauaugaaaaaucacauugccuuugcauuuagauuuucuuucgaaauaagcuuuggauuauguucaaauaagcuaugggaguacauaggaggcaucucugcuggcuuuguggguuagggaaagcuucccauuggaggugaccuaucagcugagucuugaagggaaagcacuguauuuuuauauacauauacauauguauauauauauguauauauauguauuuuuuuucccccuuagguauuugauuccaaaugcaggggaugcaacuaaagccauaaaacagcagaucaugaaaguuuuggaugcuuuggaaaguuaauauaaaagaaaauuauauaaaaagaaauuaagacaaccaagagaaacauggacauauaccuccugacugaauacuaacuggagaccuuucauuugcucauggggcugcuuaaauagcaggucuaagaaaguguaaauuauuauaaucaaucuguggacaguaaacuuuuuaaaaauuuuucuucugcauuuugguuuuauaaaaugauguauuauaaaggucaguuauuaaauuacuuugaaguaacugacccugugcccuuauggacuaaguaaggguacagaaugcaguucuguuuugaagagcuguuuuaagggaacaugcaucacuuucgggaucaaaaacaacuguacacauacauaucugcagugucuucacugaaaauuagagauagaauuaguugaagagacuuccuuaauugcuacauuguuuuacucacugagcaauaucagaaacuaaaacauagauuaauaauucacucacuguuucuauucuucuuaaaaagagugaaaucuuuuuaauggaaugguugaagauuccugccaacucaaaauacaguacagcuaguaaaauguugaaacaucaguuucuaaaucaccuuugcuccauuagcuaauuuuuuggacacuaaaugcuucaaagauaagaaacuucauccuaaugauuucuaaagagcaguuaaaagcauuaaaauaaguagguaggcuguuaagauuaaaauuaacauuuuggggacagaauugugucuguaaaaaugucauugguuuuauuacaagcggauuauuuuauucauauuuuaaaacaaauguuuaagccacauugauuuauccucauugaggauuauggucugugaccacaguaauauccacuuauauaaaugccaaauaaucagagagcuuauaaaguacaauuguuuuugucaucauuuucugaauuucuuucucuucuuuugguuuuguccucucauugaaguuccagugguuugaaauuaguuuuggacacauugucuuaauguacugaaaauugcucugcuguauuuugcagcguucuucauuuaauuuauaaugguccauauuagacacauuugguaagagaaguccaggaacacauuuagggccauggaauaguauuuuguaaaauccauuugggaaguugcaauacccacaaucugacauguccuaaaauguaagggauuaucucuaagggguugaugggagaaauauuuagauguacccuguuaacagccagucauuuugauuuacuuauggaaaucaagugaauaaaaggcaacauaauuugggaaauuuuauucuaauaucuaauaaaaacaguuugagugguugaagacaucugcaugaaauugcaccuaggugcauuacuugauauaacucuccccuaaaacuguuguaauugcauuuuuucccuuuucuuggcaccccuuuagaaauguacugaagucucauuuuucacccauuucagccaugggacauuuuucauaauauuaauguaaagauguuuguguuacuguuuauaaauuacaauuguaaauaaauuacuaguuugcccaaaacuuuguucuuaaagacacugucucucucuuucuuuucccuauuugcaaaucucuuaaggucacaaaauuagagaauugaaggcauguaguaaguuaccuacuaccaugaacuacacaguuacaggauuauuuaugacuauuaaaugaaaauacauuucauugacuguucuaggcacuuguguagaucauccucccuucacuggcccacugaccacagagcugggaaucacucugggguggccaccucucaugggcucuugugauugcaaagguugcaacuuuaggagguuguuuuuuguauuuucaagauaaggaaaccaaggcucaaagaaauugagugaaaagagaaaguauuccucuuaucuccacacuccuuggaaauuauuuuugucugugaagguauacaauuauuucuccuauauaggauugaugccauuugcccaccauuaauaaaacuuggucaguaugauaaauuuguauugacauacucaaccauuuuugucacugguauguuucacacaggaccuuuaacuccuuagcacgauacucuuacauuagacuaaccagccauaaauuggcaguccuaguuaaaauucauaguuugaugugggggaaccccaacucuauagguugaaugaguaaugaauguaauaucucaguuugaucacuaacaucuugaacuuaacauauuuauugaaguauaauugacaugccuuaaaguccccccuuucaguaguuauuggaauauccacagaguugugcaauucuaguucuagaacauuucaucaccucagaaaaacagcacaaauccauaccuguuaguagucacucuccuuucccucuucccuccagcccuuaccaagcaccauccuacuuucugucucuguggauucuggacauuucauuauaaaaggaaucauacaauaugugguuuuugccagcuuuuuucacuuaauauacauauuuuguuuuucuaauuuuuaaaucacaucuaacuucaaaacauauauacacauauacuuuuuuuuggguagggggcggggauggagucucacuguggugcccaggcuggaguggagugguaagaucuuggcucacugcaaccuccaccuucccuguucaagcaaugcuccugccucagcuucacgaguagcugguacuacaggugugcgccaccacaccugacuaauuuuuguauuuuuagcagagacaggguuuugccauguuggccacacuggucucaaacuugugaccucaagugaucugccugccucagccucccaaagugcugggauuacaggcaugagccaccaugcccaaccucaaaacauaauauuuuaaagcuucauuugcauuguagcauguaucagaauuucauuuuuguggcugaauaguauuauauagauauaacucauuuauucaucagaugguggacauuuggguugcuuccacuuuuuggcuauuaugaauaaugcccugugaacauuuguguacagguuuuuguguuaacauacguuuucaguucuuuuggauauuaccuaggaguaaguggaauuacugaguuguauguuaauuccauguuuaacuuuucgaggaacuuccaaacuauuuuccacuuuacauccccacuggcaaugugugaguguucugauuucuccacuugcuugccaacacuuguuacugugucuuguugauuauagagauccuuagaguggccacuggguacacccacaaguucacuaacagggcaaggaaaaacagguugcccauuuuucauaucaguggaguuugauggaaagagaggugcauuuuuggaguuguuguuaugugucagagacuuuggagaaauugauuaaggaaggauuuucauuuuccugauugauaagaaaagaauucagcuauggucacuuaccccugcuagaauguuaugcaguguauuauguggcaugcaguguguuacauagugcuuaacaaaaauauuuuuuaucaaggacuuuuaaggaucaaggacuuagaucuaagaccugaaacuauaaaaauucuagaagauaacaccagaaaaacccuucuagacacuggcuuaggcaaggauuucaugaccaagaacccaaaagcaaaugcaauaaaaacaaagauaaauauuugggacaauuaaacuaaagagcuuuuuucacggcaaaaggaacaaucagcaaacagacaacccacagagugggagaaaaucuucacaaucuauacaucugaaaaaggacuaauauccagaaucuacaacaaacucaaauuagcaagaaaaaaaucccaucaaaaagugugcccauggaauacuaugcagccauaaaaaaggaugagcucauguccauuguagggacauggaugaagcuggaaaccaucauucugagcaaacuguugcaaggaaagaaaaccaaacaccgcauguucucacucacaggugggaacugaacaauuaaaacauuuggacacaggguggggaacaucacacaccggggccugucguggggugcagggcggggggagggauagcauuaggagauauaccuaauguaauugacaaguuaaugggugcagcacaccaacauggcacauguauacauauguaacaaacuugcacguugugcacauguacccuagaacucaaaguauaauuuaaaaaaauucagggcauauaaacaaucaaauuuuguucuaccacaaaaaaaaagugugcuaaggacaugaauaaacaauucucaaaagaagauauacaaauggccaacaaacauaugaaaaaaugcucaacaucacuaaugauuagggaaaugcaaaucaaaaccacaaugugauaccaucuuaccccugcaagaauggccauaaucaaaaaauuaaaaagaaaaaaagauauuggcauggaugcuguaaacagggaacgcgucuaugcagcuggugggaauguaaaguaguacaaccacuguggaaaacaguguggagauuccuucaagaacuaaaaguagaacuaccauuugauccagcagucccacugcuggguaccuacccagaggaaaagaagucauugguuggucacggugacucacaccuguaaucucagcacuuugggaggccaaggcagguggaucaccugaggucaggaguucgagaccagccuggccaacauggugaaaccccgucucugcuaaaaaugcaaaaauuaguugggcaugguggugggcaccuguaaucccagcuacucgggaggcugaggcaggagaauggcuugaccccaggaggcggagauugcagugaggugagauugugccauugcacuccagucugggugacagugcaagauuccaucucaaaaaaaaaaaagucauuguaagaaaaagauaacuugcacacacauguuuacagcagcacaauuugcaauugcaaaaauguggaaccaacccaaaugcccaucaaucaaugaguggauaaagaaacugugagauauauauauauauaugauauucagccauaaaaaggaaugaaugaauggcauucgcagcgaccuggauaauauuggagacuauuuuucuaaguaaaguaacucaggaauggaaaaccaaacaucguauguucucacucauaaguaggagcuaagcuaugaggaugcaaaggcauaagaaugagacaauggacuguggggacucggggaaagagugggaagggggugaaggauaaaauacuacaaauugggugcaguauauacugcucgggugauggguguacccaaauuucacaaaucaccacuaaagaacuuacucagguuaccaaacacuaccuguuccccaauaaccuauggaaauaaaacaacuaaaauaaauaaauaaaaugaaaaaaauagacccccacaaauaaugggcaguuguuuugagcaaaguuucaaaggcaauucaauagagaaaggauagucuuuucaacauacacuguuggaacaacuagauacccauauacaaagaaauuaaucucaaccuauauaccucaaaccuuauacaaaaauuaacucaaugcaucauacagcuaaaugugcaauguaaaccuauaaaacuaauagaaaacaggagaaaauuuucaugaucuuggguuaggccauaguucuuagacauaugaaaagcacaauccauaagaaugaaucaugucuauuaucccagcacuuugggaggccgagacgggcagaucacgaggucaggaguuugagaccagccuggccugcaaggugaaacccccucucuacuaaaaauacaaaaauuagucgggcuugguggcgugcgccuguaaucccagcuacuugggaggcugagauaagagaaucacuugacucugggaggcagagguugcagugagccgagaucaccacugcacuccggccugggugacagagagagacuccaucucaaaaaaaaaaaaaaaaaaaucuuaaauuuaaaaauuuugcucugcaaaagacacuuaauagaagggaaagacaagcuacauacuggggaaaaauacuguacuugcaaaacauaccaacaaaggauuuguguucagaauauauaaagauuuucacuacaacaauaagaaaacaaaacaauggggaaaagaagcaauucuucagagaaagauggguggcaaauaggcaugugaaaagaucaucauuagcuguuggggaaauguaaaucaaaaccacaccaguuagaauggcuaaaauuaaaaacaaaaaaugacaauaccaagugcuggugaggauauggaauaacuagaacauucauacauugcugguggguguacaaaaugguacagacacucuagacaacaguuuggccauuucuuguaaauaaacauauguuuacuauacaacccggcaaucccucuccuagguauuuacccuagggaaaugaaaacuuaacauccacacaaaagaguucaugguuauaacugcuauacugugccaccucuuugcuguuugcuguccuggaaacagcaggcgagagcuaguggccuucucaguguuugcuuuucucuucagguugccagcuuuacucaguuaccugucuaacccacguggguauauuaaauuggucucccaacguuaaguaacuuguccaaaguuacauggugugucagcaaaguuuugaacucaggucuccugauuugcagagaacugcaucagaaauuuaaaaauucuguguaucuaugcauuuauguguauauuuagaugcauacacacucuuugacuccucccuguacacaguucuaacccaauaugauaauucccaaguuugauccuuugcuuucuguaguauacucuuuccuucuccgauugcaucuacucauagauuucuucucuuauucuuugcaaaugacugcaauucugauuuucagccccuaauuucugacugcuguaagucacuugcguauugugguguuacgagguauacacacacauacauacacacauuuucaagcacggucccugacucccauagccuuguuaagucuuuuguuauaaugccaguuguguuaggccucaggggcaggccucaggaaacagaaucucucuggccucuccugcucuccuuucaccugccccaaggcagaacucuaaucuugcugauugugggucuuaaauaccuccugagagcuccugccccaucccuuggaggaaggaaugcugauaacauaaaguucccauaaaggccaauagaacuggguuuggagagcuucuagauagcugaccacguucguggagguucuggagggcauggaagcuuugugccccuccucccauacuuugcccuacacaucucuuccuuguagccuuugcaacauccuuuauaauaaaccaggaaacauguuuccaugaguucugugagcugcuccagcaaguuauucaaacccaaagaugggaucauggcaaccccaacuugaaagugguuggucagaaguucuggaguccaagacauaugacuggugccggugugucuuccucagguagacaguguuggaauugaauaggaggauacccagcugguguccgcugcuuggugguagggaggaacccccucacauuuggucccagaauucuucugugaugaugauuguugugguggugauguaagagcagaggaaaaacacggagaguuuuccuggaacacauauccaccucucccccaaaaacugagcucacguuccccuagacucaccucauacuaugaagcggcagcuggaggaaugcugauggaaaggagagaccaguuaggaagugccuguagcagucuccccaaggugaggaaggccuaccuguggacggugguggugggaacugaaaggaggaaucagggacauuuccugagaguaagaagagcccugucccuuaccagagguggggaaugaaagacucgaaagucacugaagugacuuagguuuucuuggagggcuggaaagcagggagaauuagaaaacugggcauaaauuguggugccuguaagugcuggguggagaagcucuuuuggaggugauacauuuaguuucacauaguugaguuggaacugauguugagacauguaaauagagauggcggcagccggagauguugaaauagguccucuggaguaaaaauaaaaaucugacuaguaacagccuggaaauggucauuaagccugugagacauggguagaaaugagaauagagacugaaaaggcacaccagauuuuuagcugggcuuucaagauccauuuggccugguaguuuuguuuuuuggccuauuuucauacgucagaugaacaggaacauggaaacgaaggcagagcugcugcagagaagggacagugaggggaguggugguggggagggcugcacaaacuucacccuucagccagauucuucuuccuuugccucuaaauccuuucacauacaggugaggaaaagguccugagggugaggugauuugcccuagguauuaacaucuaaucagugucagagccagaaccagaacccagugacuagcuuuuccauugugcccagaaaguucuaaagaaagguuuaaaaagcgcacuuucauuuagcuuuuccuuuucuaggaacaccccuagugcccaagucagcaguuucccugcaugugacagagggacacaguacccauaggcuuuuggucuugauggccuucuccugguccugcuucucucucucucuuuuuuuuuuuaauggagucuggcucugucacccaggcuggugugcaguggcacaaucucggcucaccgcaacauucgccucccagguucaagugauucugcugucucagccuccugaguagcugggauuacaggugugugccaccacgcccagcuaauuuuugcauuuuuaguagagacgggguuucaccaugcuggucaggcuggucucgagcuccugaccucuugauccaccugccuccaccuccugaagugcugggauuauguuaauuauuaaaucuaggaggaggacacagcuguuccuccaccaggcaguggcgcccggccugguccuucuccucuaauggcuccuucccaggcuccacaggcccuucuucuuuugcgugugccuuucauacuccgcuuguguguucucauccaaauucagagcuuccucuuaguuaaaacugcuggugacucccaagucaauuuccagcccagacaucuucugagcuugaggcuuugguccgguugccuacugggcaucuccaccuggaugccauggcucaugccuauaaggccagcacuuuuugaagccaaagugggaggaucacuugagccuaggaguuugagaccagccugggcaacacuguaagaauccacuucuaaaaaaaugaaauaauuugcauuuugaacaagcacuucaaauaacauuuccagccagguuuaggaccacuauuaguuacaauguuaguccaauaaauuuggaaaucuagaugaauuuuuuuaacagguuguaagugaccacagguugacccugaaaccucauagguuaauaagcauagcagaaaugaaaagguuuuuaaagaucuuccugcuacaaagccaaguccagauagucucuuaagcugcagaaagaccauaacugcuauguauuuccccccaauuuuuuuuuaugaaagcuuaaaauuuuaaacuucuacaaaguuuuaaucuaguaccaugaacagcuguguccuccuccuagauuuaauaauuaacauuuugccauauuugcuuuaucuuauguguuuucuuuuugcugacgauuuucaagucaaacauucugaugguucaucccuaauacuuccucauuuucuaagaguaaagaauugucacaagcacaacacuauagcacacaaaauaauucagaaaagcaucaaauaucucguucauauuuaaaucucccuaguugcccccaaaauguuuuuauaguguucuuuuacaaaccaagaucuguuucaguauaaacuauucuggggcauuccaaaaggugguuaaguuuuggauuuuuguuccacaagucugacaaggcacaaaaacacaaaacacgaaaauuaaaaagcaaucuaauaaauaaaaaugcaaaaaucauagucuauaggcugggcgcagcagcucacgccuauaauuccagcacuuugggaggcuaaggcaguagggucuugagcucaggaguuugagaccagccugggcaaaauagcaaggccccaccucuauuaaaaguaaaaaacuuaaaaaaaaaaaaaaaagaaagaaagaaagaaaaagaaaaaaggaaaagaaauagcuaggugugguggugugugccuguagucccagcuacuugggaggcugaggacggaggaucgcuugagccgggagguugaggcugcaaugggcugagacugcugcacugcacuccugacuggaugacagagugagacccugucuaaaacaaacaaacaaaaaaggauauuagcaaagagaugacaauguauucgaggacugacuuguugagggcauggcguugaacccucagcaucuuucccguuggccuagcagccuuguagucagauuuuacagacgucucgcgugccuaaaccaaccagggucauuccguccccgucacagagacuuguucaaauagcucaagcccaucagcauacgguguuaaccuggccacagaggugauucaaccagcuagaaguucaguccuuuugcggagaaucagcaaacgcuacaaaucagggcuuuccucccugaaaagucugguuguuaagacauucaccagcacaccaccucgacuuaggccguucccuuuugcccuuugccuuucgaggcaugcuuuuuccggacuguguugcaauuaaccauuucucguugguccguccugguguuacaggcgcacuggaaugaacgcagacccuucucuccucccggccggggccaggaggagggguggggcggggccucugacgc

SEQ ID NO: 18137 - RNA, 448 nt, Homo sapiens
guuugguagauaagauuuauguuacaaaguuggauagguaaagaaucuugcaacuuagaaacaaaggaggagaauaauacucaaaaaggagggaggggauaugaacucaacaaucuuucggauucaccaccaccauccugcuuuauguuucauauuuucaguuuuggaaagcauuucauggaaauugugaacuuacugcuaaguguuacauaggaauagaucaguguaaagucaaccgaguuucuugaauuucaccuaccaucauuuuuccugaaagguaaaagggaauagagcaggugcauuccuugucaaaauuagaggcauuuucucgcaguuuugcacaauuugcacauauucuuguguaauuaaucugucaggcaaggaaaaaaaugauuaauuaaaagguuacauggguacauaccuuaaaauucaaaucuggaguccaccc

SEQ ID NO: 18138 - RNA, 29241 nt, Homo sapiens
ggggaccauacuuguaauuuaaauguucccugaaagcuguuguucucugcucagaaguauggauuauccccagggacucccaugaggcagauaucagaauuucuaggaggauucggcugaguuauucucaucuauauuguaaauggcauaauaaucacagaagaaauucacacuauauuacuucuuucaacuaacauacuguauuuuuuaaauaugccuuuucuauagcuuauguucauaacuaucuuuggcuuuuauuugcuuguuuaaaaaaaacuguaagagguuaaaacaaaaaaaaaaacuguaagcuuuugaaugcaggccccuuaugaacaggguagguagcaccuacauuaaguaauucaaacuguuuugggaaccccauaggaaaaagaaacaagaaugacauuuucuuuuuuuuuuuuugcuuugaaguagaguguucaagaguuuaugucacaguggcugguuccagauuugguuguagacauacauguucuaugggagguuugaucucugguagaaauacagucaacucuugauuugucaauguaacuauauuuccaaauguacuuucucuggcuuccuaucacaugucagagcuuuuuaauuuuaucaucugcuucuaugugcucaugaaaaccaaaauuauucgguaguauuuuauuucauuauuauaaacauuuaaguuccuaauguagucuaagcacugugcugggcucuuagagauacugaaauauaucccaagcaugaaguuauguuugcuucugaaagaucuuauaguucacuuugaaaucaaagagauguaauuuuuauuuauuugaaccacuuuucucuccucuaauaugugauuagaaguugaccauaaaugggacauagguccuguuuguuuuuaaggaagaauuaauagagacuauaagcaaaagacaaaauucuauuguacaugcagaaauauaacacagaaugaccaaaagaaaauucagcaagcaaugguaaaaauaacaaauuauuuacuguuuuauaauguuaaaguauuucaccaagacaaguugcagucaaauuaaagugaguuauggaaaaugaaauacauaaagauguauuuauacaagugcagacuaaauauuuuccauacaaguauguaaaugaaaagauauacaguaagugcacacucgauaugacuaugcaggcaacaguuaguuucagauacucuuguauaguucaugcacaaaccuucccaaaguacgaguucagucagucuugggggauauggagggaugauuaaaaaaggauugaguuccuugcaaaaauaucaguauggacuggaugagggugagcguggucaguuauauauauuacuuacuguaauuugugauugucgaggaagagguguggcuguuggugugauaguaauacugcuggugacuuuauugguuguuuuguuuagugccccguuaauuaagccuugaguucgguuauccugcaguggugcugaagggcuggcaggucucacagggcuggcuacagcuugcauguaaggacuuccuaagugaauguggauuuuauuauccucaguaguuaucacacuugagcuauugcuguuugaacgcugaaacugccaugaugacugccggucuggggagacucugaauaucgcaugcuuggcacugauuucuguugguucuggggagcgucccugcucaggagagcuagcugaaccagucacagccaaaaccugaauaggggacauuguccuuucuggaguuagagaaccacaagacucuggggucugugcucuggcaaagguugccaugguaauuggggacaugccuuguucuaaauucaugaggucuucgguagagguuuuggacuuuacugguguuauggaggcguuuuggaggaugguuauccuuugcuuuggcgugccacaguucgguaucacugcaguacucguguaagagugaggacucucugugguuggacuugugauuucaagaguggcuguguuuuguacauggucuggaguaaccuuuauaugaaguggcugcccagguguguggcuuaggacuagaucuccagguugcacaaaguuggcauuggguuuaguuugcauuuuuccauucugaagauggcccuccuuggauuucauccagggaauccauagcuuucuguuaacaggacauggaguagacuggcugcauuugaaggacagcacagaucccucaucauuaggguccucgucuugauucucacucuccucauauaacugaccauugaugacugcacguuccagaggaaugaggcucuuguaaucaggugguucauugucuacugcuucugucugaacuucuuuagaaaauacuugaggaucggaaauucuucuuccauugagacuaggccugaggcucuuacugaaaugccgguaccucucuaacuccuuagugagguuuucaaucucucuuccuaaaucucuguuccuguuuucuuguugauuuaguuuuuuuugcaggacugagugaucucccuggaggugacauauuaggucuucaguugccauguauucaugaauuuucucuuuuaaugcauccacuucucuugagaggugcccugacuuagcuucuucuucuugaagccuuuugaaaagccauuguucauggcuggucucugucuuuucugcuaacuuguacuuagcaaguuccauuuuaacauguucuagcucuuuagauaaaaauugagcuuugucucguucauuagcauaccuucguucuagagucucauauucaucuucuguuuucaugaggucauccucaauggcuuucauguccuuuagcuucaguuucagucuuuccacuucuugagagagcuccuuaaucuuauuguuuucuugguguaaugcuguuguggauuucccagagucuugauuuaauuuguuuuuuaggaaaucuuucucaauugcuuccaaugauugaagccuauuuuucaacauauuaacucuugacaggagaucauuuccuuucucuucuuccgcuuucaauuuguuuuuuaaaucaucucucuccuugguuacgcuguacaucuuuucuucuacaucgguuuuggacuugagcgcccuuuuaguuuccucaauuaacuucucaguaacuguuguuacuuuauuuugcuccacuugaagcugagaagaagcagcuuguaauuuaucuucaguuuucuuuaauuuuucacucauuguuuuccguucaucuacaaacaucacaguuaauguuuucaguuuaguuaaauccucuuuuagagugaauucugucuuuucuagccgacuuucaauggcuucuagcucuuugauccuuacuuuuaaacucuccaguucuugagacaacugcuuuguggucauccuuucuuuuucuaaauugcauuucagagaguagcauucuuguuugcuuuuguugaaagcgucuucuaacuuuuccagagccauaauucuuuuacugaguuuuucaaccucuaguuuaaagucuuuacucuguaacgucucccuuucaagccucuuauugagaucucugcacugcuccuccauuuuuaugagcucuucaucuuucccuuccauaucuagcacacguuuccugagcucuuccacuucagccaugauaccagcguuuccauauucucccuuacugauuuuuucuuuuauaucuugcagcuccucuucugcuuuucguaaagaccuguuugucucuucuaacucaucaaucugccggcugagugcugccagcuuuuguugaagcuggcgauuuugacuguccucauuggugagcuucgccauaauugugucuuggucuuggugaaacuuuguggucugcguuugcaguuccuucucuagucugguugccuucugcucuuccuccugaacucuggcuucagcaagggcuaguuugguauguguuuccuuugcauuuguggucagcucuuggauuuucugucuuugaagggugagcugugccgucagccuuugcuguucauccaccaccaucaaagcaaaagacuucagcuuggucagcuccucuuucaggguggugacccuuuucuccuuuucuugcuccuucuccuccugagacuugauuucuugaucaauuagcuucuuuaaucugaaaaauguaaagugcauuuuauuuugugauugaugcuuuaguaacucaucgaauguacuuaaauauauauguaauuuagaaauuauguaauuauaugagcugugucaguucauauacaauaugcaaaagaguuccugaauuugaugacagaggaaaaucuugauaaaguuaucuugcuuuuuuauuugacuaccauugaucaguaacagcugcauuucaccaggagccuuaguaaaagaguaagggcaagaauauuuaguuuaaauugcuuggguaacauguaauuaguaggcagucuggccugaaggcugugaaaauagccacaagcuugagaugaugcaguuagaccuggcuucaaggccgacccuacucuuaccaacuaauugaucugggcaguuauuuaacaucucugagccucaauuuccucauaugaaaaaugggggcaauaauuuuauuuacuucaggggcuuuuuaugaaaauuaaaugcgguaauucaucuaagauucucauuguccuggcacaugguaagcauuugguauuaguuguugcugcugucuuuauuaauaugguuauuauauuuaucaaauggcuugcuugaaccaaaguguucaauuaauguuugauguucaaguccuugauucuuaguuaagaaaaaauuuagucacauugcuuagaaguuaugcacuucacugauagaccucugugccaauuaaaacuugguuugcacuagcacaacauuauucuaggaacuacuucacauauaucuuauccucauaguggauagcaauuaaaugaggagaauugagagacaucuguauggguuugguguuuucauaacauuugagaagagcaugcgguuugguaggaaagugcuuauugaugagagucugaugcuagacaugacagaagagaaacucuguuaucaggaacauaauaauucccucuuaaaugaugacuacuaugacaugcuauuuucuucuuuuauguuuuaaauuugucagcauaacaggaggguauuuuacauguaguauaaacuaucucuuccacuuaaguagugaggucaaaguuuuaaauuuguggcacucucaauuauacugcgaaugggcugauuauagaggauguaauuacagcuuugcaguacuguuauacagaagcuaaaauagaauggaaucccuaaggaauugaaccaaaggacuugucauggaugaaguuaugacuacuuacauucugauagguauagagaauucauaaaacuuuaauguaucuuuucuauuaggaaugaguuaauuaucaaaugcaugucuaucauccuuaucacagaacuuacuuuuugaaaguuguguaaggauuugagagaacuuuuuauuuauuuuauuuuauuuuauuuuuugaaauugagucucacucugucgccaggcuggagugcaguggggcgaucucgacucacugcaaccucugacucccugguucaagcaauucuccugucucagccucccgaguagcugggauuauaggcacgcaccaccacgcccagcuaauuuuuguauuuuuaguagagacaggguuucaccauguuggccaggauggucucgaucuccugaccuugugauccaccugccucggccucccaaagugcugagauaacaggugugagccaccgugccggcugagagaacauuuuaaaaggaaacuaauuuagggucaucgucuuggaaauugaguccuucuuuuugagauucuaaucugcucuuuucuguaauuuucuguaauuacauuccauaggaggaacauguugaaaauaauuguauaagaauucugcaucuuuuuugugggaguccacuuuuaguuuuuucuguuuugagaacuuaacaggaggcuggcccaagggcuguggcuuauaaaauucagaagaugcuaggcaggaugcuggggugucguugaugaugaucucauccaaggucuuggcaaaaggcuugcccaugguuucuggccaugccccaucccuaucugagacacaugagagccugaaaagauaagcauagcagcuucuucucaaauggucaugggacuucucaacccaguggcagaguccauggguaaacugcuuugguggugaaauaguuaaaaaaaacuuuggcaaagugcuucuuucuccugccuuagcauuagaauucauucgauguaaugguuuugacaaugccuugagcauaauuacagugaaauauuuuuccccucucuacaccacaguucuuacaguuuuauuagagaacaguuucacaaaagcuuuuaaauauuuauuuucaacuuauuaaauuauagcaugugcuaugucauuuuuaugagaaggggguguguuuucuuaggauauaagggagggaagauuguuuugcaguauaauuaaaagaguauuaaaagggaauggugauuagugagugcagugcaguaaccugcaaaaaagguuuagaaaaaaauucaguugcuuccauuuuguucaguguuuuuggaguaggcaugaugcauauuuuucagccuggggcauguugcguauuuuucagcaugaugcaaacauaagcaucuuuuucaugguuuuuguaaauuaguuggcauccccaucuguuccccaaguucugucugauuauuugaaugcauuuucucuaagcauuuccuuacuacuuguuuuccaauaaccugcuauuuucuugggccacucucaugagcgcaccauaggacagucagcugucuagucuaguaaagccugucgggaagguaaacaagaauuuauaugcagaaaaaacuauacccauagccaucaacuugggagcucaggacaaggaaccagugagaacugagagcaggaggcccugauggaaucuuuucagagccaguugcuugcguguaaugcuguuacacauugugugguuguacaugugugucagagagagggaaagacagcugguuaugcuacugaauuugaaggaauuagcacuucugauagugaugaaugguccacccuaaaucguuauuucuugccuuguauccaggagcauuugaagguugaaguuugaggcuaguuuuuggucuugaagaagguauagggugaggaggguguggaguugagccuccuaagccugcuuccuacuuugaguaggaauggauuuuagacaacacaguaacuuaauuuucugucuccauuauuuuucuuugcauauguacaggauuuagcauugauacuugcauuauaugcuaaugcagguuaucaugaacucucgguuugcuagccaaagcagaucaaugauuuugauugcuuuuaaccagguuuuuaugaucuucaaaguagcauagaccuugaggugcagaacucugcagaucuaaaauucauucccuaagagcuguguagucaaauuaugacuccuuuuuccauuaauaguuccaguuuaugugccuuuauacagggauaaucuaugccaggguuucuccaucuucagcacuguugauauuuggggccagauaauuuguucauuguggagaucaucuugugcacuacaagauguuuagcagcaucccuuuguugugaauuaaaaauguuuccagacauugccaaaugucuccuggggggcagucaccuccaguugagaacuacugaucuaugcauguguauguuuguggcauguguguaugucagucugucaguagaaguuagacuccaucguuuugcuuuacucagcuuuaauuaaacaggugcaacugagagcucccaccugaauuacauguacaccuggugauuuuaucuucccugcuaguggccuauucuuuaccaaugcuucucacaguguaaagugcauuugaaucacauaggaaucuuguuaaacugcagacuccaauucaguaggucuggggugggccucacaauuugccuuauaacaaacucccagaugaugucaagucugcuggcccuuagacugacuguggguaacaaggcuuuaccauuuacaugucagauguuuccuggaaaugggauacuguuugaauauuaacucugccaauuguuguucauuauugauuuauacccagucugcaguaccacagccuguauuccugaccuacaugaccacccauuuuuuucaaagaagauaccaggugagagaauauggcuaaauuaacuaaaaucuguccacauuucuggggaacaaaaugacucaaaaugcauaccauaguuggugggucaguagcuacauuuucaugcaaaaagggcguuaaaugauuuuaguuccaauuugugguuuuucucacacagcacaaagacuaaaauauauauauaauagcugccauucuuuacuuagugccagugauguguugccaagcagugagcugagucuguacaucugucgguucuaauucucaugacaaauuuacaggguuuaggauuaucuccauuuuauagcugugaaaauugaggcucacaaaggucaagaaggagcaaagccugugcgauuuccccacauuauauugcaaagaacacaaaccauugcauagggcugguccacacacaaggauuuuuaucaagaacacucugaauggagaacuaucaacuuaaaaaaucuuacuuaacauugcauuuguauucuuuuuaaaaaguguguaucucucagagcagggguuuuuaaauguuuguucuuauaucugccaaaagaauguugaaaaacuaaguacuccuuuucacauuuuuaacuggcaucuagauucuuucauucaauguuuaaauaguuguaaaaggauauauuuuaacauuugccaucuaauguaaaaguccucauuaacaaaucggacagccaaaccagucauucaggaaaagucugacuucauuuuucaaccuaacgaaaucuguaaauacauaucccucugguacccaucucauuucuaaaagauaaggcaugaggacuugcccugcauuguccucagcugaagaaacaaggcacugcuccauccauuguuugguucugaaccuguugcugcugcugcucuugcugcucugcucugcucugcucugcucugcucugcucugcucuguccucauaggacucucaggauuaaggcuuucuauaguuguaccuuugucugaugccccagagggguuuccaacccaggaagaugcacuugauaagaguuugcuaagaaguuuguuuugaaaguguuguuggaaaaggagaagucauagaacacaaagaguauagguaugaauaguggacguagacguugaucccuuaaaucucuccaugccuguacccauagaaagucuuuauguacccucagggguacauguaccccaguuuaaagacuauugucuuggaguacucauauucauguucuaguacugacaccacagcauuauaggaacauucagugaauccgcuccaauaaaaauggguuguggaagcugguuuuauggacacaaaagugagguaauuaaauccaaacuggcuuaaagcaguaucuuauuacagcuuuccguuagaguuucuacuauggcucagaauuguuauaacuuacugugguuuaucacuauuauuauguacaauaccaguuccuuauuuuuucaaaaacaucacaucugucaucuucaguauucuuugguacuaaccauaauucugguucuucauuacaaaugauacacucagaggguuuuuucaguuuuuauuugcagacacauauaauauaugucagcacagaugugugccuauauuuuaucuccucugugagacacugaguauuaguaauaaugcaucauauaauacacauaugaaacacaugguauaucuaaaugcuauaauaccagucauacccauaauaacuuauauuauaauucuuaccgcuuuugauuuuaucuuauuuuuuguacauuacagucaacccuacuaaaauacagacuucuugagaacaggaugaguaucacugucugauucauuucuguguccuacagugucuaccacaaagcacuuauauguagagggaaccacaugaauuuuuuuugaauaaaugaaagaaugaacaaauacucccuuuugugaaaaauacuguagcacuguccuaaguaguuuuauucacuauuuaagaggaugcucuaauauuuaccauguacauguuuuuaggcauuuaagaaaaugagguaugaguggguuucccaucaguguucuccaagaacauuauuuucucuauuucauagcuacagagccucuagaaagaaucaacacuguuggaacagguccuucucuccuuucuucagaucccugcauuagaacuguaugugcuugcuuguuugaggagaacaggguuaggugguaaacguccacauccuagcccaucagucuccuuuggcuuuaucaacucugcuaacaaaggagugacuauuuuauguuuuccucagaguccagagaucuacuggacaaauauguuuguuuauuacauaagcaacauuguaucaacagcagugacaguggaaaggaaauaucuauaaucugaccacccuaaaacaucaauuauguuucuguuuucacagauuguuuugcaguuuuucagaugcuugguccauagaaauaaacuuagggugaucaucaagcaauaaaacgaauuccacaagccauuaaugguacuguauuguuucuauuaguuucagaaaucagccuguaaauagagaauaacuucagagucagcuuagcuucucaucugucucuuuaaggaaaccuauuuuucacuauguucacuauguaaaucuugaauuuaauguuucugauguuaugaauauggcaagacuuuuauucauuuaauauacaaacaacaaagacaaucauuaguacuaaggcuauccugagaugaacaggggauagaggauccuauucucaaaguguuuauaggcuaauuaggaaagaaaaaggagauaguuccagcacaauucaguaaaggcuccagagcaguaguucguaaccuuuuaggucucaugaccccuuuacacucaaaaaauuuugaggacccuaaagagcuuuugaguguaugggcuguaucuaucucuuuacuguauuagaaauucaaacuaagauuuuaaaaauacucauuagugccagaugcaguggcucacaccuauaaucccagcacuuugggaggcugaggcaggcggaucaugaggugaggagaucgagaccauccuggcuaacauggugaaacccugucuccacuaaaaauacaaaaaauuagcugggcaugguggcacgugccuguggucccagcuacuugggaggcugaggcaggagaauugcuugaacccgugaggcagagguugcaaugagcugagaucacaccacugcacuccagccugggcgacacagcaagacucugucucaaaaauaaaauuuaaaaaaaaucauuuguuaaaaauaauaaauaauaauaaauccaucaucugcuaaauaacauauuuuuaugaaaaaauacuuuuacaaaauuauuuagugagaagaguugcauuguuuuacauuucugcaacuaaugucuggcuuaauugaagacagcuguauccucagaucuguuucacacauuccauuagcugucagagaaaucaucacacgucauggagccucuggaaaacuccauauacacuucugagagaaugagagagaaaaagguuguguuauuaugaagauaucuucuucacucucaaagggggccacacuuuaagaaccauuacuccagaggauagacaguugaaacaucaguggcaaauuugucuuucucuggaaaagcgucugguuugggcugucaccuugugcuucuucugucagccuuuugcuucauccugaugaagucccccaauucacuggcuuagucacugcuuugauguuuccaucauuaauaaagccagucacuugcuaaccgucaaacauagaugggagauucucugccuucaaauguucucucccaguccacagaaaaguccuaaaugacaaaacuguuuucauaagacauuguguuuuguuugaaacuccaauuugaaauaagaguauggaaaccacuaaguugccugguuuuuauaaauggguccauccauagugcuaugcaguucagcugacauuuaauucauuucagaccuugaugagacaaauacagugacagcuacuaugugcaaggcacuguacuugcuauuugucaguucuuuuuuccccaaaaccugccuguauucuugcacagaucagucugaucauacuuacaguauucucccaguaacaaccaaauaguaugaugauaccaaagcuuguuuggucuuaagauguuugaaacaguguaacagucacccuaguccuaaguauguaacuucauuuugaugggcuuaaauuccuguauuuguucucauuauuccagagcuaguuuaauacauuacuuuuucuuccugauuuaauauguugauuacuaagcagaaaacugcauacaucacacuccuuuauuuauuuuuauaucugcucucacagcuagacuuugauagccugauuaugauuauaucccauuuuaucuuuuagcaauucuugucuaauacauaauuuuaacuguguugcguugauaguagcuguguucaugguuaaauaaccauggauuucuagcaguuugcagaguaauuacauggaauuuauuggaaagcuucuuuauuugagauaaauuuugguaucaggccuauaauuuauguuuccuugcuuuccucccugcuuuuucuaugggacuuuucacuguuuagucuaaauuuuaagagcacucauaaaaauagcugugacccgucuuuuuuauucuguguaugcugcuuccuuguauuucacaagucaaagguuuucuaaaaauuacagcuacagcauaccauagccauaauguaauguacaauucauuugacuuagucagcaagaucaguagaacaguaacacuuuuuuuggcaucugcuaguugaauaugaguguacaucuaugucugcuuuauguccuuguuacugaagauccugucaucaucacugagauccuuuagagauaccauaaauggguccagacccagcaauuuggguuaauacuauuuuccuucauugugaaauaagaauuagggcaggaaguuaagaaggaggcuuuagcuuggugucagaggaauauaugguaaaaaugguauacuguuagucauuacucuucaucaccugaacgauuaaucuuacuaggccccccagaggucaggagaagugaaauaagauggaaauagucaaaugacccauuaauuauaaggagcuugguagcuuuuagcagagaaucaggauucuaaaaagcgguacugaaauccucaaauugagcacaaggacuggaauugaggcaaaucucacucuuuuaagagcagaaaaaggagcaaaguaacugagaaaaagggucucugaaaggugagguuccagaacaaguaaaaggccagucugaggguccacaggcacagaacuuggguaguuaggcagcuacaaggagaauauuuucaucuugagaacaaaggaggugcccaugauucugggcuagaaaagacacuguccaugcugcuaugaaagggccagguggagacuugaaaagaugcucaggcuagaccuggaagaagaaacuggaacugacaggggagugacaacaaguacagcacauguaaauuuguaccaggauaauuacugccuaaauaauguguuuugacuucugcaguacuguauuguuagggagcuuucuaguaagaaccuuuggacaauggauguucauuuaauaccgugaauauugugccucuccuaucacucuuuuaauuuuucuuauuaaaaauaccuacucaaaugaaguuuucuuuaugccguuuacucagaugacaucuaucaagaaggagcuuuuaaaaaguuaauuacugugaauacacugcugugcuagagagucuacucauuuuucucacuuuucuuuuuguuuuccucccccacccccugcucccaccaccacucugaauugggguucuugauuauuuagaaaagaucccuuaaaucaaaguuuccucuuuuccauacuuuccauuuugauuguuaauacacccccgcccucccaaaaaaaauuaccugucuuccaacagauuaagacuuuaggucuuugucagacuaacaguuucagguagauguccccuuaauccuccaaagccuaccugggccuuccacagccaugaugccuuccccuggcugcccugucccucuagggagaaguauccaaaaagccacucagcaugugaugccuuguauuaucacagauguguguguauuccugaaagugccuccuaguucauggcauacagagcugccuuuacaccuagcauugugauggugcuccuccugggcuuguccucagguuccuaaugcuuucauuguuuaucauugucuccauuccuuccucccacucucugcaguugauuuuguacucucugugaucugcguucuucuguaucuugucuguuugcccaagguagccuucuuuaagacagggauaaugucuucccuacugccuguucccuauuacccccagcaagagauugcaguaaacagugcagguggcagagggcagguggaaugacugacagcauguacacucucuaguaccgaagcaccaauaggaacgagacaguggaaaacuaugagaggcagggcagggcagugcagagcgagaaauucagacucuggaguucaguuuuugcagcugaaucccggcuuuccaacuucugucuagugugacuugagcaagcaauuuaaccucccuacaagucucauuuucuucaucuguagaauggggauaauauuagagccucccucacaauaggguuguucugaagauuaauaaaaaacaauccauacaaaaaguccuuaucauagugccuggcacaauacauguccguucucauuagaaguaggauggugaguacuaaaagaguagguuuuagauguucucaccacaaaaaaaugauaaguauguaagguaacaaauacgcuaauuagcuugauuuagccauuccacaauaucuagauauauaaaaacaucauguuauaggcccuaaauauaguuuuaauuuucauuuaaaaaaucaaaucaaauaaaaauaagugcuacuugcuuggcauauuggaaaaaaaaguaggacagugagacaacacagugagacaacgucagucacaaugagcugaccuaaaguaggggucagcugggggaagaauagcacaaaucacauuggaaugaaagauaugacuacauaauguuuauugcgaucuauuuuaaggcuuuucauggaucuuuucagcuaugcacaugguuagucauaaugauugucauuuuaggucagaguuucucagccuuagcauuguugacauuuugguuaauucuuuguuguaggggcuguccuguacacuguaggguguuuagcagcaucccugaucucuaccuacuaaaugccaggagcaacacaguaccuccagcucaguugugacaacuacugaaugucuccagacaacuacugaaugucuccagacauugcagagaaauugagucugguugagaagucacuguuuuagggcauaauuuuuggguagacuguuagauucuuuguguucguugucucuggccuguauaacucuucuuaauuaucugcuacucaaauguauuugggaucagccacugucuuccauuucucuuuugcucacagaucuacuccacagcucuucucccuuccuggaagagaaugaugcugugaauguccaauauccaaugaaaugccagcauaucaaaauggaugcuaauaguugaccuucccaaagccucacugaugcucugcucaucuuacuccugcucuucauuuuuuggaugugaauguguacuuugucugcuggguuuagauacucauagacuuggucuacuuaggcagcgguccccaaccuuuuuggcaccagggaccaguuuugucaaagacaguuuuuccauggacaugggagagggugguggugguggaugguuuugggaugaaacugucccacucggaucaucaggcauuagauucucauaaggagcaugcaaccuagaucccucaccugcacaguucacaauaggguucacacuccuaugagaaccuaaugcugcugcugaucuaacaggaggcagaguucaggcaguaaugcugccucaucccgcugcucaccuccugcuaugugacccgguaauaggccucaaacugguacuggucuucggcccugggguuggggacuccuguacguggggacucaaagucuggguggguugacuggguuaguacacuguauauacuauuccugggcuugguuuccauagucaaaaaugucaaguagacuauuaaggauauuuuauaauuuuuuugacucuucagaagaaaauacaaagcagcagauugaaagauacccuaguugucugagaaauaggucauuugggguuuucauauuguuggauaauuaauuuuucagucuauuuuguguacuuuuaacucuuuaaauuucaauuauggauuuuuagauuaaauuaguauuccuaaauauuugacacauauuucaaaauguguguauuaaaacguauacuaggaacagucuuccucuuaccacaucguucaucuccccaacuguaaccacugauacuaguuucucuuauguacuuguagaguuucuuuaugaguacauaagcaaacauaaauaaagauucuuaugcucuccccuuuuuacacaaaaguagcuuacaaacacuguuccucagcaucuuguuuuuugcagccaaacauuucuuggagaucuuuccauuggaucaguguucuuaagcaggagcaggaaaagggaauaaaaauaaacaugguugcuaaauacaucuuuacaacuucaugcuaaagaaauuaaacuuuguaggaucuauuuuuaauggaauuaauauguaggagguauggaagacauauacuuuugcuguuuugaaauuauuaagauagauuguaacaguaagauuauuugacuuauaacaacagcuugaguguuguauaucuaucuuuauaaugucuguguagagcacaugcauuuauuuucuuaguugaaaaacugaggcccaggcagauuaauacuaugcaaggccaucauuaugguggcccuggaacugguacuagagugugagacuuggcuuauaaagagaaggaaacaagcauauugaaggucuacucugugccacuagaucucacuuaauacuuauagcaacuguaugagcuaaguauuauuauucucauuuugcagauggaggagaaaccaaaaaacuaaaauuuacagagguuaaauaauuuuccaaacaguacagguaacagaccagaauaaaaauucacuggcugcgaagucuguguucuuucuaccuaacaaccaggcuacaugccggaaaccccagacaaaaaauguugaccucagaagaguuuccucuuaucccauaccauguuuuugguguucauuuguucauucccaugcuuucugcuccacccacuuggcucccugaccccuucuacuguucuccucuuugcucacucugcuccucugcccacucaccagcuucuuugcuauuccucaaacagaacacggcauggugugcuuuugugcucgcugucuccccaggaaccacuggauucccccucaccucauuaguaccaucuggcauacuauauuuuauguauuuauugauuacugucucuccuacuagaauguaaacuacaugcagguaaugguguguguguaugugcgcacacacgcaucucauucaaugauuagucaaucauuggucuauuuuguuuaauacuauauuucugguagggaacaguaccugguacuuaauugguauucaauaaauauuugaacaaauaccucuucuauuuuugaaauagguaccauauuugaaagcauggguauaacuaagcaauagacauauaguaggcccuccucucuauagucuaggaauaacagcuaguugaacaauuuuuauaugccauguaccguguuaguccugcaaacagucauaggaggcagguauuaccgucuucuuauuuuacaaauaagaacugaggcucaaaaaaguuaauuugccacagguccuggugaguaauuggcagagccagaaugccaguguaguuuuuacuccaaauccuguuucucaccccauuacauacauccacacuuccuaucucauauauuauaucucaugagccauccucuccagugaauuugugugcuguaauauucugccugucaaagaucccaaaucaccaccacuagcaauucaguguugugucacaguauuuccuauagguucauggcuacuuugagccuugaucuugagacauuagcaaauauucucuuagucauuauaauaauauagcaaguuucgucauuuggcauaaauucauaauuauuuuuggaugguuuaaaaaauugugacuuugccaguaauaacaucucauguuccccagaggugguggguuugucauaaauaccauuuccauagaacauuucaaggaaccuaaaguucuuggaaaauauuuuuaacaggcagccauuucucugacagacuucaagggcauaauaauaaauauauauauauauauccuuagaaauauguguguauguauuuuaucuuauuaagaauauuuauauguuuuuuuauugcucacaauccauuuauauuucaaugauccuuuuguauuuuagcagauuaaagaauccaggaaugguucuuuagaaaaucauuccaauguagcuguuaaauuuuguuuuuaaccuccauuagucccuuuuuucucuucccaggucacagguuauuuucacuuagauauugcacgugggcauuuuggaggauuuaauaugauuccuucucuuaaccucuacucuucguugggcugcuuuucuuuccuuuauucucuccuuuauucucuccuuuguagaaagcauguauccuuuuccagaacuuauucugagcaaaaaguuaaaacuuuuuuuaagccuguguuuuuuuuuuuaaaggcuuuccuuuuuuauguggcuuucuuaccuuaauuguuguucaguucaccacauuuaauaaaaagccaaagcaggggccagucacguaccagaauggauaaguucacugguuuucaccuccuuguagucuggcugccuacacagaggcaguggcuaaagugguaugcuugggaaaccaaacguuuccuaacuuguuagugggaaauucaaacuucagaaauuuagaaaccacaacaacagaugccuauguuuuacugugacuacugaagucacaguuugccauagaaacaggauggauagcagccugaagaguauaaaaugugaaacauuuugauccuuagaggacuuuuuuggguccucgauuuuagcugucauaaaucaguaaacaaggagcaaggaaaauagggaaauuuaauacauuuaagaguacuuagagguucaggcaguuagaggaugaggguuaauguguggcuuggcuuccugcugaguaaacaauuaaaucaugagccacagugagcauccuacuucuaccuuuacccacucuuccuaguuccugaggaugauugguuuauaucuuuuccaugauuuuugcaaagugagaguuugggccauaugccaucucuaauuacagacagguggaaaaguuuuauucuguaaucugcuggaacaugaaugaccauuuuucuuguggucuguguuuugcuuguccucuugcaugcuuuguacaaauuaaaauuauuuugguuaucugagccuuguuuaauuuucccuugacuguaaguccagagcauuuggguuauguuuuccuuuucagcaacuucugaauacugagaagacagaaaaugcauaaacagucugaucauacuuccuuuccuguaaguuggguucuuuuaagaugaacauguucuagaggauauuaagcuugcauagcaaggaguaauuccaucaaaauaugacaguggucaacagcauaucugcuagaggugagagcaaugacuguaccccacuucucuuggcccugggucugcugcuuauacugucccugagcaggaguuucacccauuuaguuuaucuaugugagaaauguucuguuuguggcaguuaaagaaauggcuauaguauaccucauguaugugcuauuugaauaccauccauuuuugcccugaccauaucuuaccuugugauuugaauuuuaagagaaggcaaacuaucucagguuuuaguagcugaaaaaaagguuuuugaaaaaagcucuggcuucacuauucaucgcuuuuuaaaguuuacuaauucacagcuaaaaacaaagaaagcagaaccccagguauuaaacaauugaaaagccacauaucugauggacaggaaauguuggaccaaaaucugcuagugacuuaacuaucugaccuuaccucaucugcuugucaccuuagcugcaacaugggaagagcagugcaauuuugucucuaaggucuacaaagccuuuggcaaucucaaaucucaguuccacaaaauaaauacucccaacaaucuuuagaguccuuuccucccuucuuuccuauauaacacuguauacaaauucacaugucaagagauuuuauggcucaucaagucucaaugguucaaaagaauggaaaaccguaauuggaauuccaugggauucagauuuauuugagucuguuguaguucacaaguuguaaguaugcuguaaaagcaaauaaguacuuaaaauguuauacuaaauucaaaguacaauuaaacugaaaaauuaacaccuaggcaaaaaguauuuagacuguuaauuucaaaagagacucuuuauuguuuguggcuaggaucugauauaagccauuuagcccagguuguaaagauuugucuuacagauuuguuuuuugugggugcaugguaaaacagggagauuccaaacuagcuuuuaagccuuuugcagucaccagcucucuucgguccuuuaccugcucaggaaguuguuucuuacuucagaugaguaagacauuuuuaggaaaguucuuguggguuucucacaggagggacugccuuguagcagggaaaucaagguaaaggguaaccucuccuuacagaguggcuaagguuaggcacgcuagagacagaucuucaacaagcuuaauccuuuacuccacuucacagcugggugucugagaacaggaauucuucaugacugcauccuacaaaggaccuccucuuuggccugagacagcccccuauaugucagcccagcagcaccagaugaugaaggagcaucaucccuauggauagacuagcauaaccagaagaguaacaguagcugcuauagguuuggcacugugccaacugcuucaucacguuuaagcuucagguuaagaagugauguuacuuuaagcugccuuccuuucugcauaaguccagguuguucugaaggccaaauaauggguuuuuaaacuuacaguuugggugcucugaucuuggcacaagccuuauuugucuuuuaaccucagguucuccuuucauaauagacuucugaagaauaagucugccaucuuuuuuggaaugcugcauucagucaucuccauuuacauuucaguucccaucuuuuccaugaauguuucuuaacuugucuaacccuggcugauuuuccuuuucuaaguccccacagcccuuacagcuuuauuaccuaaauauucuacauuauuuuguacugcuuucuaauuuguuuuaguauauuacuuuugccguuaagccaacuguaagcuccuuaaaggaauaauaccucuguaucccucauauggguugaacucugugcauacuugaccaaaugauagagagguaaaaagaaccacuuccuaggggaguauaaccaucccuuaggcugagugguaccuaaaguucucagaaugacuuguuauuagaauggaagaaggacaaguagaguuuuguuccucuuguucuugucacuucuggaaggagaaccauuuagugaagagaagaauucacuuggagacaaauuuaauuaaaguccagauggggaaaauuggccagagaaucuuaacuuugccugugauucuuugcaucuguguucagccuaaugaauuuuauugaacuguaaaaagaauuuuauggggcagaauuuggggggagauuaguggagccccaaaucacuuggcaaaguuacucucacuuuuauuugaaagccucaagaauaauaugcgacuucaaacauaauguauuuauuuuaauaauaugaguguuugaaaaguagauaauuuuccuuuuagcagcaguggauucauuuucacaaaauuccacagaguaauucacuucuucugccauucccaauuaacagacuaacaaguuaagacuaagggacuuccacaauaucucacugaauggguguuugucuucagcaagaaaccagcaacuuucucauguucucucuaggcuccuggaccaggcaacuccuuccuuuucuucaaauuuaacaggcagacacuuaagucuugcgagcccaaaugugauguuuuacauuccacuuaugaucucugcucagagauuuguuuuuguuuugauucacauaaaaaagcauuuuaaaaagaaagagaaaaacauauuucaccuuuaaacuuuuguuccaggacuggugggccaugagacacaauaaaucuggcagauuugcuucugucagggcagcccaucuuagaggacugaccucagccuugaggcugcuuuagauacagugauuuggagcucucacaggcccaagugcuacagcuguguucaucuuuucuccauuuacauguggacucuuucccucaaauuacccucauuuucuuuagcuaauuugucucuguagugauauaaucaguagcuuuuauuuuuauauugucucuucucuacuugaucagaguucccaugaggguuauugcucauuauucaaucuuuauugaguacugagaaauacuugggguggaugacauuguucccuuuuuguaauuuguagaaaccaagggaacaggaggcucacccaguaaauggauggcagagcuaagaagaguagaacucugauuuauccacccauuauucuuacucuuuuagucucaccguugagacacuaacauuuaucccugucaauucagugucacuauucagcaagguuggccauugacuauauucuguugaaguuuuuauaagcauucucccacauuguuuaucuuuacuuaguuuuuauguguagcugaucucuccuaccuucauugcauuaccagucaauuaaaauagagcagggaugggaccauaauugaaguuguuguccaagagcugcuagugaucuuaguccuugucauuaaugugguaccaguccaugcuaguagcuauagcuggguuagugacaugguaugguguguggugaacuuaguugcugggccuguuuucaugccuugugcuuagcucaguaaauguuugcuacugcugaggagaauuauaagcccuaggcuagcuucacagguugacauuggaguaacuuugaaauuaaagaaaaaucacucuucuguaaaaucugggagauacacugguuuacccacagaaacuuuggaaugaaguacaugcuugggaaaaggcagucugcugcauggcaaagauaagccauuugugccccguaagugcaucuuccaggccuucaccugaggcacagagauuagagaaauucagaggaguccacccuucauuaaccacugcacuguguucuuccauauuuugcuugaaggccauuccaugcccccgggugacucaccugauacuccuucaccagguauacaaagucucauuuuauuggggagggaauuaaacugagguagaugaagaugggcagaaaagcaucugacuuagucugccuauauaacauacacugccauacaaagcagauuucacugccuugacuuaagcugagccuaacuugguuucuaguuaaguucacugccuugacuuaaccugagccuaacugguuucuguaagucacuuccauaugguugcuuuaaguaguggcugagauuuguuuucagcuccuaaacaaaaucuagaagaaggggcccuccacagcccacuguuugcagaaacacuuuuuuuuuguaucaaauaagcagcuucuagguuguaauuuguucauauauuuauccaacaccuuuucugucccagcaacacaccuacuaauuguaccucgguacuuuccuaggcacuggagguaaagcugguuguaaaacugacccugaaggaguuuauaguccaagagacagauaauaagcaaauaaaucauuaaugaguaauuuaaugucacaucacagugcacaguuugaaggaaaauaaagcaggguaaguaccaccaggagcuuguagccuucauaggugacuuccucugcaguuuugggggagguuguuuugaaggcauugagucacuuugaauuuugaaagggauccugcuagcugcggacgucugaggagugcaaaaugcuuagcuggaagauacuaauagaaggucauuugucaaguuagugguucagacccaaaugucuuugaccacagaguacacagucuuuccagggcaccucucaccuuccaaguagagagugggauuugccagccggaggaccuuuaaauacacuuauuuuuuauuuucucuuuccucccuuuaucaccucccuucuguuguuguagccugauuaaauuguauugauuuucacaaugcuuccuuauccuuugcuuuuuuauugcuuauacuuaagaacuuugaaccuuucuacuuucuuuuuuuaauggauuuuauaucuaaauuaacaccuacaguacugaggcuuuuucuggggcuucuguucuccucucuuccuagcacuaauuaaggaaaaacuacuggugagcuguagcccaagaaugcagggggcccuggcccuaccucugcauagcugugucucuggggcaagucacacuguggacaucaguuucuucuguaaagugaggcauuuggaucagaugaccuccauugccccuuccagcuguaaaauucuguggauauucugugccaggacugugugugugugugugugugugugugugugugugugugugugugugugugugugacuguggggccugggguaucccauuuuccauauagucaaguaccuuaucaagguacuucucaaauucauaguugaauguuugcuguucugauguaauguaugcuuucuuuugcugauaauaacuccuuuaggcuagaauaaguaguuaucauaaacagacacaaggaguugagguaugucugcauccugucugucccaaucauacacuuaccuaucuacuccucuacuuaccucccuacugcuccccugccugcccccacaaacacaucauuccccaagcuuguuuaaaaaaaauucuauacuuaacaauuuaucauauuuuggagccaguagagcauagaaaugugaggacggucagacuggaaaaagaauacugcuaauguguucucguucuugggcucagaauuaaaacugcugcuguccuaucuuaaucugcuaaagcaucucagagaacaagcaugaagagggaguguuucucauaucugaaaaagaaaccagggacuuuccuugguaagccuucccauuuuuguuugcccagcuuucccaggcagagacgauguuagugcagaugaaggucaaggagaaucucaagucuuuuuuuuuuuuuaaaaaaaggagggaugugcaaaggcugauaaguguuggugauaaucugcuaggaauuaguguaccuaacaaaaugacucaaaacaugaauguccuaccucauuuuaaguagaaaaugaccagccauaggagguucuaaaagucauugcagcacacuuuaagcauaagugacuggguugguggcuagaaaauguuguggugaugacagcagcaaccacagaaauauugcuuugaagguuugugaugcuggcugcauaugcagugucucuucaucuuuaaauccuuauuuaaauauaauuuacaaaaacuaaacaaucaguuuaaauugaagcugaauucauggucaaauacaaauuaaauggaccuuaaaaucguuuaaaauuaauauguccaacagauaagguaggguguauuagauuuuucaaagaugacaggcucugugaacaacagauggggccauuucaguuccugaagcagguugagaccaauauugccuuacauccacaauauccagucuuuuauaaacaguucucuucuugccccucuuccuuuuuccuuuaaauaggaggggcuguauguuuuuuuucuauucaccuuguaaaauguucacuuugcccugaagcacuagacauggacagaacaugaccuaagcagaauuauuggaaucuuauucuuccuccuacauuuucaguuuuuuuucuuaaaucucaaaauccauuuauuaccaaaggcacuuuuuuggaggggaaauuacagcagagaacccuuaaacaaaauuuacagccuuuugagaaggcaaauuaaugggaacugcaagagaaccggaaaauuaagucaaggcuugauuuguguuuucauacuggcuguuacuauagucuccaucacagcauuaggaaaauagcacaaaaauaccagggcuuaacaguuaagguuaaucaccacaaaagugcaaaugaacuuacuaagcauaaaauuauuaugugcuuuauuuggaaguguagaaauucacauucauucuaucaaaaacauuuucccaucauacagauugucccaaggacuaagaaauugcucauccaaagagcccagugugagauaggguauccaugauaagucauacuuagcuuucaguuuuaaaagaggucuuaugugauuguucuuugaaccaugcuuuaaaguuaauaaaugggaaaaaguguggaauauuaaagaguguuauuuuuaaauuuuaaaaaaucgaugcuugccugcuuuaaaaaaauaaaagacacugggaaacacagcuguuagaauuuugauggaaguuaugauuuucaacaguugaguuguaguuuaugguacagaugguacucuggguauaccugaaacaauaauugaugguuucuguuugucucuuccucuguuagauucagaagagcagaauaucuuuuuuccagagcaggaauuuuucaguuuccaauuaccgcuuauaucagauaaacaacucuuccauugcauauucuguacuucuccacagugacauggguguuggccccgcucuucucauuauggugggcuucccuagguuugaaauaauaguuuguggaaaauccuacuucucaguacuaaccugcaguuuauauagccuauccucaggccaaauaacauauaauuuuucuuuuaaaauaugaaaaccaaagucgugcauugcuccaaacaaaauuagcaaaaacaaaaaaacugcuaugaggcaaaaaugauaggcaccaaugucauauacuuuuaaaaaccauccaacagaaauuauuagaaauauacagauauaacccacauuuugaguauuuuuuaaaugcuguguuucaaugauaaaaucugggaucugacauuuucuucugacaauuaaauauaaaaacaugaguuuguaacacacacauacaccucagugguuauagugcucugcuccucuguuaaacuuuuacuguaccuccaaacaguuaucuuauauggucauuuuagugccaacuaaaaugccagcauuuuaaaaucucagaguaaauauaaauggcagccuaugaauucugaguuugaauuguauauacuuauaaaacauagagacuguuuuaaaagggacaauucugucacauaguuguuaaaguuuuauuuuacaauauauguuuagaccagauaaggauugaaugaugaaucaauuuuucaucuccuauuccaguguucuaaaguugacauaaccuuuuuauuuuuaauuccuacguugacuuuuaguuggaaaaaaugaaguaaaauauuauggagauuuuucugccaaguguucaguuaucauacuguaagaguucauugguagcaauagccucuucaggauuuagauguaacuaauuaugguuuaaaauguuacugauuaauacaguuacucuauaaguuuuaccuuuuaaauuggcauuuuuuacauaauauacuacuauccaaaauauuacucuagaaaugauagcuguaagugagguuugucauuuuuccaaugccuggacuugaagcagaaaguuagaacucaaaacuaugauaguuacuuccuuguacaaauugacauaugcuuuuacgacaaaauagcguuuguacgauuuuuugaagcuuaaaaagauuuuacuuuuuaaguuagauucgucuuaauuccaagauguauuccuaacaguguuuuucuagucguuuauauuaacauuuacaaaaagaggggaaaaccuggcacuaacaaauuuucgcauucugcucauguaagacaagcgaguuugaguccggaggagagauaggguugcugcaguacaauauagucucccccacccuuuccccaaagauuucucaauaugggcaggauucaauguguagcucacuuggaaagcguauguaauacagucaccucccaccucucaacauuuaaaauuaaaucucuaaucuguuuucuccuccagagaaaacuucuacuuucaaguuuugugugaguuggaaacgguuuugaaccuagaauucauuggaugcgcuuugcgaaaccugucugcaguuugugaugcugagacagcuuuaacagccacccacagacuugcuaccuggcugucugacagcagugccccuugguggagcgaaguugcucucccgggcuuaccugaacugccugcgccggggccgggcgggggccgggccggggccgcuguagugccgcgcugcgagccgacugugcgcgcuccgagagucgcccgaacaaug

SEQ ID NO: 18139 - RNA, 108483 nt, Homo sapiens
gcuggccgaggauuggccgcggugccuagggggcguggccggcgcgcgcgagagggagcgcgagggagcuggcugcgggccugccugccagcuagccggagccgcgggugagcgcggcgagcggcgacccuggugaggagcgcggcgcgggaggcacguuccuuagcuccgccgcggccguccuccgcggcucgaggacuccgcuuccuucccuccccuccccugcgcuccggccuggggucucggcgcggggagcggagggaagggacgaaggaggaguaggugaaagcggggugaggggcggaagggucccggcgcggggugaggcgagggcugccucuuguucucccgccgcugccgccgucuccuggucgggugccgcggccagaggcgcgcggggcugccgaggcacccgcacuaugcaggcagacugccggccgccgcgauggcgagccgggcgguggugagagccaggcgcugcccgcaguguccccaaguccgggccgcggccgccgcccccgccugggccgcgcucccccucucccgcucccucccucccugcuccaacuccuccuccuucuccaugccucuguuccuccugcucuuacuuguccugcuccugcugcucgaggacgcuggagcccagcaaggugaguggucccaggggagugagcggcgggggaaccuccgucggggcugcgggucucuuggccccugaacaaaucugcagacgcugcagggaggcgcggugcgcuuucgugcguggccggaccuggcuggguacucacgggguugaguugcaaaggcaaggucuugcccgucugucccccaaguuggcgcggcuuuacuuuuuggcaaggccauuuauuuuucugaaagggggacgugagacccugcuaugaaagccucguugauauuagguccuucuggggaaaauuuuggggaggaaaaagaaccuuuggagguaaugaccccuaaaguuaagcugcacggauggauggacacuguaggaaggcagguuaauuaaauagcaucuuaagccuauuaaagguaaguggugguaauuaugauccuuugugaaagagcccggguucugaagcgaauggaauaguuucugcuuaucucugagucuuggauucagaacauguucuuuacaauccaucauugaggcugguggucuagacugccuuggucaaacacugggucugacccaacgcuaugcuaauuugcccaagugaagcucuccacauuaaaaagguaagccuuuccagaaagugacaaaacuuuuuuuuuuuuccaccuacaauccuugaaaaaccuguuccagaaacaggcaaaacuguuuauuaaauacuuaucauaauggaaggagaaugcagggugauuucuuuuccccuuuaguacuguuuucccguaguguaccacacuuuuugaaucaguuuggcaucaguuuuugaaaagauauuuccauugcauuuuccauuuuauugcagugggaaggauaaggauuggauuguuacuuauugcuaggaagagaguuuuuuaaaaagaaaauuguucucugccuuuaagcccagcuuuauguugcucucaugguuuucagugaaguauggaaucauggccugucauuaagaagaugccgaaccuugacaggcauguggaaauauaaucucuguaacuauaaggaaaaaauguauuuggcaaacugaccccuuacaucuagacacguuucuauauagaguaacucaaaauuuagaugcuuagcauuuagguuuuaguuagaucgucuucuaaaauuacugaacaucaucaucauuuaauauauuaaagugugaaauccuucuuuccacuguagagauguauuucccuccugguaggggggaaaacaggcuuauauauggcuaacacuuagggcuuacuuuguggcuggaacaacuggacuaagugguuuggguuuauuaacuccuugaaucuucacuacaaucagcugagauaguuauuguuaucccaguucaaacguaaggacauugagacacaaagaauauaagguaccuugaugcaggagggcauauuacuccauaggcagaguacucugcuuugcuuguuucuggaucugauaguguuuguaucauguuauuaaaaaaaaucuuggaacaguauagaaucaguuacaugucuaccuuccaaaugagggauugccuuguuuuuagaaaaggccagucuaccgggcgcgguggcucacaccuguaauccgagcacuuugggaggcugaggcgggcagaucacgaggucaggagaucgagaccauccugaccaacauggugaaaccccgucucuccuaaaauacaaaaaauuagccgggcaugguggcacaugccuguagucccagguacucaggaggcugaggcaggggaaucgcuugaacccgggaggcggagguugcagcgaucgcgccacugcacuccagccuggcgacagagcgagacugucucaaaaaaaaaaaaaaaaaaagaaaaagaaauagccagucuaaucagacaagcaacauuacuucauuuuuuaagguuuaauauaauuuuuuuuuaccagaacauuuuaacaaauacauuucucuuuaacagugucaucuuauguaaacaucaacauaaauagaaaugauucugauaauuaaaagacuuuuuuuuuuuuuaguucuucuaaauugcuuggguaaauuuugcuaaaucauuuaauauuuaaucucuuuguaccucaguuuucuacaucauuaaggugagcaugcauaccuaucucauagcuuaauauaaaugaaaugauaguaugcaggaauuuugcaaagggaaaagcuuaaaauagcuauaaaugauuauuacuaaucucgaucuuacuaaguugauaaauuaagagcuaauuagguauacaucaucugaaaacucacaauuauuugagauuugaauuuucucauuuuuaaaaauuaaauuuuuuacucaaaggacccuaaagcagcccgugguggaauuccuuuuaagccagucuucccagucuaacagauguucuuuagggucuacugauauucccucacauaaccugaaaagaagucuguuuaaaacaccuuuagaauuuuuaaugggauuuguacauguuguaauguucagcuacaagguagaguuuuuacucuauaagaagucuuaagacuggaaggaaauaaacuguugacaguuguugucuuuuggugguaaaauugugggacauuucuuuauacuuuucuaaauuuucuguaauucgcauauagucagaauaaaaauuaaacugcaaaaaagguuucuuugauagauuuuuuuucuuuauuugacaacugaagguagaaaugcaucuaguauggagagguagaaaugugcuucagugucuuuuuucuuucugacaucauuuugaaauagcagaauauauuaccuucauuccaauuaaugucauacauagcuauuccucaauagauuuucuguucacaaugaccuuucuuuuuauuuggcuccgaauaaaauguaucauuaguuugaaaacuuaccgacuuuucacaacagauguauuuuaaccaguucuguuucacuuauaaauuuauaaauauauucuguuuaccucuauuuauuauguugauguuucacauauggcuuguauuuguguagaguucuaaguuggauaucaagaaguuggucuucgaaaucuuuuuuauugaagacuuuuuuucuguaaaauguaccucucaaaaaaauuaaauuggugaaacuuaugcugguagcauauuugcuauuguauuaaauuuauuggaaguugaugguuuacuaugauuuuaggucucugguuuccauuaugacuguaggaauuuggguuacuucauaucaggagcucagcuuccucauuuguauccuggaaggcuugccuacuuucuugguuagaauguaauuugaacaugguaaaauaucagggaauuaauucuuaaaaaccauuaagccugauuuguuugggccuauuaauauauaacauguugugaagauauuaguuuuucuuugcuaauuuaaucugugaaacaaaucagguucauucuuaaaaaggauguuucaguuauuugaacauauuuggaaccaauaugugaaaaaguuuauauucugucaaggaaugccuuuauuugcuugugaugcagggaaauauuuuugaacaauauuugugaguugccagaaaauaaaaacuuauuucucucugcaaauaaacauuuguaauuauuuuucacauugacauuagguuaauuuagaaauuuccauugucuuuucuuugucugauaaaacauuggggcucuuauccaguuuuguucagaagcaaauaaaucaaagcauccuuuucugcuauauuucuaauuaauuuuacaaaaugaaaauuagaagcagcacacaauccacacgugugaaugaucagauugaaacagcacauuuuugaaacuuguaaaugaaaaauugauucuaagauugcagguaaauuauagguagauuucucaguguuagaaacaaaaagaacauauuauuuucccuggggauaguugauaauuccauuugaacaucugagccucauuuuaaagacaaacauguaaaaauaucuuaaaaugguggaauuggcauaaguaaaauaccaguaguagaauuaaaaugacaaauuaauuuccaaaaguuaauagaucauguaugugggaaagggcuagauuuacauaggaguagaauuuaaauuuaggacuacacuuagcaaagugacacugggaagugaagcucagguaguaauguuggacauuaauugaaugcauacaaguagacaguuucugcuuccacuucuugauauauuuggaaggauauggaaugaugacccaacaguagaaggaugaggaaaagcuucauaaagauagugauauuugcuaagugugauuguugaaauaugaagugagacaauuuggcaauuuuucugauguggcuccuggauucgguuuucuuuauaacaaccuuacggccauaggacuuuguauuuauuuuuaaauauuguauggauaacaaugauuauuacucaaaacuaaaaacguagaugauuauccacauuucugucuucuaauccaucgacuuauaauuuuuaacuuuccuuucuauuacauauucacauaccugcauaaucuuuuguaguuguaauuuuaauaguguguucauguaaaauuaacuuauaggcuaauuuagcacacauaagcauaccuacaaaauacaguaaaacaaaaauuucaaaaugcaaaauuuuaucauaagacauucaguauuuauaaaguaauuacuguauuguucagagcuguuauuguauuuaauugaauucuucauucuggagaaaaaucuuugagaaaguauuucaguucaaaauguuaguuuagaaacaaauaucaggcuaauuuuucaguucauuauuuggguuaaauuaguacaaccuaugaggacagaaaauacagauauucaaauaaacuaguaucuaaugagugccagugcaguacccacugaagcugaugagauacucaugauuuccaagggcuacuaaaacaucauucaccagcugaacgugcacccugauggguguguaauugaaagaaaaacuuugauuugcugcuugaauuaugggagaaucccaagaugcacguucccucaacugcuuuuuaaggagaguggcccagaauucccugcaaggcuuuuguugaguagggugugugcaaccuugccuucaaaacugaauugccugggaucaaagagaagguauuggcacucuuuaucauucucucauuaagaacuaucaguaugaagggguaccaacugugaacucucaagagagugugcauguaccucaguauaguccugagacauucagagaagaguaaaacauuguuauugucuucagagaaccuacagucuauuugagaaaguaauucaaguuggaauauauauaauaauaaccaaggaaggauaucagaagguuauguaaggcagagagaacucaccacuccuggagaagcaggagacgccuacuauaauaauaaucaaggaagguuauaagaagguuguauaaggcagaaaaagcucacaacuccuggagaaguaggagacgccucacugauaaagugguuuuagauugguaagcuuugaaguuugguagguuucuuguccacaaggaacagcagauauuugaagaguaagaucauaagauuauaaccuggggagucaggaaagugggagugugaaagcccacccuuuuagaaugaguagcaaaacucauucuggucaugcuccacuguuugcuucuugaacucaugcccugugucugcccaguuauuggaaaaacguugguugguuacugugggccaggcaugguaccacaugcuggggcauuuuccucuuggagcuguguuaaugacuuccauaguguugccagcagccccuuuaucaucuguaagauaccguccaaacuccuuugcguaucauguaaguaauuuuuuucacagucuggucccucccuuucacucugacuuaaucuaaugccagcauuucucacacuguauaguucagauaugagacugagcuaauuuuauucuucuaagauauaauuucaugccauuuugccuuguucccuauacuaaccucuucauauaugcaguuuccucuacuugaaaugcucuuacuuuccuugucuucucgguaaacucucgaucagccuucaaaacccuucuuggguaucaucccuuuaugaagaguucucgaacaguccccacacacucaucuccggauaauacauuccacacuguauucuaaguauuuauuccugccagcggagagaguuuuauucauuuucuuauuucuaauacuuaucauagugucugucauucaaauuaugugaauuaagaaccccauuucuagaguuaaucugcuacccugagcacauuauuugguucaucccuuggcaccggcaugcacuucaugcuguuguccuuugccuaauccccguaaauuaguggucaguucaggagccgggaacagagccaugucuugacccuuacuaccuguuugcucagagccuaacagucuucccagccuuucccagucccaccucuucccaggaggaagacuccuuugcugcacacccuugacuaugagaggaauccuucaagcugaaauucugaaaauagacaugccuacuucuuagaaagcucugcuccccucagaugggucauccuuaacaaccgugacagccuaaaucagugccagcaauuugggcacacuuucuccuuugcaugcuuucagcuucugacuucaauaggcaucuccaauauuauaaaagucccccuaguuuuuguucucguaguugccugucuccuuuuucuugccaguggauguugcuggggagcauucagguagcuucacuaaucugguguaauagaaaaguaaugagaaauggaggcuggaacguauuguggaggacuucccauugaggggcagacugaggaguuuguaucugcgauguuaggccugacauuagccucaggugcuuccucuuucaccugguucauuugucugucacuagguuugguuaucucuucucaacucaggcaccccaaauccaucaucucaacaaugcucuuuccgugaucuuggacaguucccaaacuugggcccaugugauaauccccauucucugcuuucucugguucuggauagcucauaguuacaagauuaagucauguggucaucgugauuagaucugccacaaaugaggucuggcuaaucaagucccaaguggggauuacugcuuagcagacuaucucacuuuguaaagcugauuuguacagccgaacuccugcccugcuccuaauccuugcacaguaugacuuccuccugacugaaaccuuguccucuuccucuuuaucagagcacugcuacauuggggaaugugaauuuuguuuuggcaugcuuuacacuuugauggcacuuuuacuuuauaucuggaaacaugcucaaaaugccacuggcuuuuacauaucucuuuuuucauugcuuugugguaccuuguaucucugcuuuuuucagugacgagcuuucuaaaugguaaucuacauuugugcuguauauuuucuuagugacuggcacacagcagauauuuguuaaauuguuaauuuauuuuuuaacccuugcaauaaaaaagcaaggguuuuguuucugcuuuacugaaacugucauuuacacugucagauuuuuguuuguuuugguuuuuguuuuaguuugaaaaaccaagcagcuuugccuaucuuuauuauugguuucuuuuuuuuuuuuuucuuacuacaguggucuuugaaaaucuggaggcuuuggacuuggacauaccuggauuuaaauaauagccuuguugaacuugacauccaguuacuacucuaaauauuuuaaaauauguaacucaucuuucuuuuuagacuguaacgagggcugggauugaaucuggguagcaaguaaauuuuuguucaaugaaugaaucaauaugucaaagaaaauuuuguuucauuuuacucugcaguuaaaauuuccauuuuuauauguuuccguuccacuaagacucacuuuuccaucccucuucccuuuauccccaauuauuguuccacccccagcucagugagaggagucagagcaugcaauagaggaauguggcagaaaggcaugacugucuccagcccacccaaaucuuaaugugaguucugugcucuccuuuuugaccuuugcucugccucuucagccuucugccuguuggugugcuucaguguuuuuugauccccaccaucucagaucauuuuaucucuucuuuccugauauaccuuuguuucugucuacucuuggcauccuaaaagccagcuuuauaggucuggaugugagguggacauucuuuugcaugcauggaggaagaguguuuuaguuaggacuuuugagguuauagagaacagaaauccauaucugauuaagguagaaggagaaacuauugggaggauugagaggggaaggcaggaaugcagcuagacuucaggaaccaaggacucagcuuaguucuucccucuuguuucagucuggcuuucucuuuguggaaggaaucauggcugcuggcaaucccgaaggcuuacgguuuuaacacggagaaauucuguauuuucccuauuguacaagguccaggaaagggugaguuggcccucacauugacccagugugauucaguacccacccuuggaccagucaaauaaccagggggcaugaggucauauuaaaacuguugggaaacugcagagcaccuuccagagaaggauaaggcaggguacuagauaaacagaggcauccucuucuaggagaaagaguguuacauuuauaaagagaccacuguauuuuaaagaaguucuuacugaaccuuuacauuuaucuugggagauggguggugguauccucauccgugagguaguugcauccucaccaguauacugguuaggguauguaagcuuguggcaguuaaguguccaggaucuugaaaacuggcaugucuagaauuugaaucuaagucuguuggacuccaaagccuauguacuuucuaauguguuaguugucuaccauaacauuaguuuaggcuuauuucucauucaacagcaugugcuaagagccuuguauguuuuauuucuguguguaugcuuauaaaggugaguagaaugcauugccuuucuaaccaaauuuuauagguugguaugguaaccugacauaaauaugcauaauuaagcauauuaaguacagaaagauauuauuauggaaauagggagaaacaccaggagcuucagaaagguuucacaaagaaaauaacauugaguagguauuugcuagguggauaaaaggaggagggacguuauucuuggcagaguggaauguuaagugcaguggcacagaggugagagcguggagcauguggggagucaccuauaguucaggacuguggaacaaagagguugugggaaaagugaagagaugagaccagaaagggaaucaggggccagauuaugauagccuuuguauccuggcugaagcauuugaacuucguuguaucaucaguggaaaacaguuaaaggauuucuaaauaagggaccuacaugacccaguuaguauuuaagaaacucuggcugaaguguggacaguggauuagagggagaaaagauagaaaguggggaaaccuauuagagaacuuugcaagggccugcacuuguucagagggacuaaauuuagaacugcuaaggagauaaaaaguauaaaauauaaugauuaguuaaauuugagagagccaagucaguuuaauauugagauuuuucuuucuggaaucuucuuccucuuccugcauuccacuucucucauucaccaggauuucuaccuagcuaacugcuugcuugcuugcuugcuuuuuucuuucuuucucucucucucucucucccucccucucccucucuccuucucccucucccucugucacacaugcacacacacacacacauucucacacucacacugaagcacucauuacuucccuguaguacucaucaucccuggaaugacucucuguguuugucuuacucccuauauuguaaacucuguaaggacaggggucuugucugacauuuuuacuguuguuccuaauaccuaguagcacacugcuggacauguggagguuguucauugaaugcguaggacauguggaguuucaaaugaaguggaacuucugagcaaaagugcuuaguauguauauagauaagauugaagacuuuggagcuuucuccauuuagugacaacugaagucaaggaguagauugcccacauagaauacagaguggggaaagaacucugaagaauagcaacaucaacagcugguaguaacaagguuacauacaguuaaggucugcgagaugcaguuggaggguuaaaggaauuaagacaugggaggagagauuuaagaaggagggaggggagauaugaaguaagggagaaggaagcaagagaaggaagugccagcaaugccagaugcuguagaagguaacaaaagauaaggauggaaaauucuccauuggcuuuuggcagcucagaaacugacugcuuuagugaagaguuucauuggauauguagaucuguguguuuccuagggcagcuguaacaaaguaccacaagcuuaacugacuuaaauuuauugucucacaguuauggaggcuagaauucugacagcagggugugcagagggccaugcucuuuccuaagacucuaagguaggauccuuaucucuuucuagcuuuuuggugauugcaacucuuagcauugcuuggcuuuuaauauaucacuccagucucugccucugugguuacaugugguucucccugcaucucugucuaaacuuuccuccucuuagaaaacaccaguuguuggauuagggcccacccuaacuccagaaugacuucauuuuaacuugauuacauuugcaaaauccaguuuccagauaaggucacauuuguagguaccaaaaauuaggacuugaacaugugucuuuuugagggacacaauucaacccgcaacagucuugaacgugaauugcagugcauugacauuagaaaaggaggcaaagaagacaucaaguauaggcaacuaaagaaaucuauguacaagaaggaaaaagugagaaaaaggugguagaugggggguggugaggggacaccauguagaaggagguuuuguguguuuuuaguuguuacccuuaguguuuuaaagcuuguaaaacugcagauccaaggccccacugaagaacuacaauuacagguuauaauuugcaaaaaaggcaaaaucaguugucuugcaaauauaagauaaacacaccaaauauuuuguucaacucauucauuaaugagggaaucaguaaaauguuaaaacuguccauagaguauuugagaagcuagguguuuauaggcaauguuaggauaugauagcugcauuagauggccaaaacugauuaauggccaacaaagccuuaaacuuuuaccuauagguuauuuuuucaacuauagaaaaauuaugugcaucuuuaccaaacaaucuguaaguuaacauguaaccaagacugcaaccuuuaaucagcauuaaauagcaggugguaauuauuuugcccuauaacuuugaguggcuuuugcuuuuuaugacauuuaaaggaugugcugcacacuuuuuuuuuacccuauuuccaaguuucaggucaucuuucugacauacuuguuagaauccagggagguggaaauaggagccugagaaccuuuaauuagccuguaagugauucuaacauugacuugacuuugaguaccaccaaauaagagaaaacugagaggcuuugagugcccaucugaggcuggaacccauuacuaucugaugacacucaucuccuggguuuugugaguuuuuucucuuucuauagugcucaacucuuugacaaagagaaauuauuuaaugaucuaggguggagcuuuugccaggcagauauaugcucaagaagaauacaguggcuagaaagcgaagauaucagaaagaguguaguuaauguauuggacgugaggcccagacuagguagagaaagaagugaggccaggaucagcuuaacagauggagagagaagagagaaauccaguucacagaaaguaugcaguggguguaagagagcugagaggucaggagacuguaaccagaagagcgagauguuaaaguuuuuaagauuucagaguugggaguaguuuccaauaauggcaaaaauaaaguccagguugugguccugagagugaguuacugaacugcaguagaggucauuggguugauuagugagcauuacuuucucauaaauuuauacuuucuacaagacacuagaagcuuuaaagcaugcuauaaauuuaaauuuccuaaaauaaugugccauuguucucuuaacuuucgccagauuguagccaaguguacugggucaauaaacaaugggcaaaagcuguucugaucuuuuaugacaauaauaguacucacaaauauuuauugagcacauuguuauggcuuaggaccuugacaccaguuguuuucguaugguaugucguuuaaaucuuaaccuugguagcuugaauuguuaauauucccauuuuaccccuggcaaaacugugauuuagcagcaauaaguaaccuuuucaaggucauagugagugguagauaggacauuuaaauugauuguaugacuccaguguguauaaccauugcauucuagguagaguaugugcaugguggaguugaagaggauuuauauauagcucacauuccuucauguuauucaguuuuguagauuaucacacaugcagagaugaguuugagcuuaaaaagaaugaagcugggggcaaugucuuuuuaaaaaaauggucacauugacccucuuuggacucugaaugcaugugcaucuuaugcaguauuuuaaaaauuaaauaaaugagcuaucaagccacaaaaaaccauggaggaaauuuaaauacauucuacuaaaugaaagcagccaauccgaaaaggcuaccaacuaugugauuccaacuguuugaugcucuggaaaaggcaaaacuagggagacccgaaaaagaucagugguuaccaggguuuugggggagguagagaugagcagguggaacaugggauuuuuagggcagugaaacuacucugugugauacuauagugguggguacaugucauauauuuguccagaccuauagaauguacaccaggagugaacccuaauaugaacuguggacucagggugauaacaaugugucaguguagguucaucaauuguaacaaauguaucaguuuagucaggaauguuaauaaugaaggaggcuaugcaaguguaggggcaagggauauaugacaaauaucuguucuuucuauucaguuuuauuaugaaccuaaaacugcuuuaaaaagugaaauauauuuuaaauacuaaauuuauguuauauauguuuuaccacaauuuaaaaacuguagggauggagaaagauauaccuugugaacacuaaagaagacuggagucacuguauuaauuucagacaaaacuucagaacaaggaaaauuaccagggcuaaagaggacauuaaaaaauuaagugaaauuagaguaguauuugaauuaucugagauuuguagugaugcaacuuaacaaaccucacaauuacaagguugauauaguacuucuggucuaaaaauucacaguaccaaauaauaaaaacuuuauuguaaccaaaugaaaucagauacguuaguuaacaguugcaacuuacucuucugaacacuuuucuguuucguaaaagcuccaugcuuucucauuuuaagaucucgcagauauauuaugugaccaaagugacaguuauuuagagcaaguauagucagacucaccaguucaccaaaaaaaaccuugaaaacucacuggaaaaguuuaaaccuuugcucuccauuuuuggcauauuugugcaaguguauccugcauuugcuguuaaaggaaauaauuuuggaaaucacaauguucauauuauuaaaauucaguaaugcauauauaagaauauaauuaauacaauuuaucaguagugauauggcuaaaaucuggggguggcuggaaagucauauggaaucagcaucacaagcacauacuuaaacaaaaaacacacuugauuuggaguuuaauuagaguagccuaaaaaagcaugcauucuuuguugcaauaauucauuaucauuuaaauacguuuaauuuucuuucucuuuuuucuagggauaaguaguaaaaaaaaaaaaaaaaggggggggguuuuccuguaauaauaucaaaauuuguaucuggcuuaacacaucugaccuuacacucuucagaggaagugaacacauguucuaugaguaauucccuagauaaaugugcagccaaagaaucauuaagaucaaauuccaguguuuauucuuagcugaaauaaaauuaaaauucaaaaauuagguuaacaggcuucuacccuuuuugaucaguuauagucugguggagaacaugucgaggaggaagaugaaaaagagaaccugucagugauagugcugauggaguuuggagaaggagaaaguuagugaaguuggaguuggugagaauguauggauuggugcucugaauguuguuuuuuccaagaguaguuuuacucuuuuugucaauucugccuuaugagcaggaauaauaguaggugguguagccuggucacagaucauuauucuucccaguguacaaagcuacucagaauuaauagcagucacagaugauuacuguuagcuccuuucccuccuaauguuaagagcuccugacccagaaaaaauauauaucauuugaggucuguagacuaauaaaaagcauuucuuuauguuaaagaaaaauaaaacauuccuuuuacuuuuuuuaaaaauuggaaagucggaacauaaaacucuuuaguauaacugcugaucuuugggggaaaaccagucucuuagugaauagaacagcauuacccuuugggccaaauggaacccagccaagagcuaaaccagaucuuuuuucugagauuuucuagcuuuaacucuaagucagcacuuaaccucagcacuauucacuuuuaagguugaucauucuuuguucugagggaccuccugugcaugauaagauguuuuagcagcuuuucuggccuuuaccuacuagaugccaauaacaccccucccccuccaguugugacaaccaaaauugucucaagacacugccaaaugggagguaaaauugcuucugugggguccucuucuccucugcccugcaacccaccuuuugagaaucacugcucuaaguguauuacauaauugguugaucaagaauguuuucccaauuuuaguucuacuuuuaaauauuuugucguauuuuaaguaucuugguggaauaggcuuuacuuuuaagaacuguaaaaauaaacuggaaacacauuucuaauuuaggggugaaaaugagaacgaggucuuuccuugauuugcaaauucaauguuaagaccuuugcauaccuagcacaguguuuuucagauugcaguuggggacacauuagggggucaugaaauacuuuagugggucaugagcgugcaugcgagaguguauagggucacgauguaaacgguauuucuuuuggaauaagcaaaaaaaauauguauaugucuagccuucccuuuugaacuggaguauucugaacauauauuucauagcaguaggugcuuaguuaagcuauuuauccagucagguuaaacuugucaaauauuuuuugagauacaaagcauucaaauuuguucauugcuguagauuggagaccuguuguuaacuuuaguuucuggugcauaucaucuugcuugcaagaggaggaagcucugaacuccaucacauauuuuagaacauucuuggcacguuacuuguggacuguuccugcccucccccuacacaagguuaugaaaaaagacaacucuguaauuauuuucuucaucagcaugcaugcaaaaguccuguuuuucaucaguuaguauuucuuuuguuaacuuuuguagaaauuauccuucauguuggaaagggcaguaaauguucguguauuuauugagaaucaaacaugagcauaagacaccuaaaaauuacuccuaacacucugcguguacucuuuguaaaaaucauuuuuaaaugacaaccguaaguugaauaauagccuacagggaauaccuuaagugugacaaucugccacuacaaagucguagauucagcuguuaauagaaaauacuugaguuucugaaauucaucuacacuuucaaucaccuuaaaagcugccuuuguuuucuauuuacuaaagaacgugcauuuauauuuugaguuacuuuguuuauucagugguuauuuuaugaagauugaaccaccuacaggaagaauguuuucaucuuuucaguaguaagggcauuucagacuaguuuuauaauguuaggaacucugucuuagggugguaguuuuuuccucugaggaaaaauguuagugauuguuuaagaguuauuuaucuuacaauucauuuauuuucacaguagauuuuuuuauaucccuauguuuuuaauuuagcugauauccagcagagauauucaagguauuuucaugccaguuucaggggaaauuugugguuuuuuuuuuuuauggacuguguaacauccuacauuuuauauuugcaaaagaccaguggauauauugcacagaaauccacguuuauuacauucugcccuuauauauuuuuguguuacugaguugcuaugccuaguucuuguguaugaaaugaaagcaaguauagaagauagcuaaaauuuaauguugauuaaaaacuaagcuuugugugagagauacuuguucagaaagccagauuucuaguacugaccuuuaaaaguagacuaaggagcaauacuaauauggauucaacaauaaaauuucuuuaucagccaaggauacgauuuuuaaguauuaucauaagaauuuagguacaaaguuguuccaucauuaaaguuagcuuugagacuaauuugaaauuacuuuuucauagauuaauguacaguuuccuuauucaauuaauaaacauuuauuuagcauccaccacuuacuaaaaacuacaugaaauucuuauucauaggcuuuugaaaguuuucaucuuuucuagcaaauauuagcacuacauuuguucuuaaaaauaaucaacauaguagaaaguucuauuacagcccucuguguccauauugaguuuagaacucagcagugucacuuuuaauauaguuuuuguguaagugcuguacuguuccaaaaggugauuuguaaauaacuguuuugaaggacaaaaugcuguuauuuuaaaagcauauauucaucauccuacuagaaagagauuuauuugaaucuuauuguuauggaaugcugaacaguacaguuggagcagcugcugaaacuccuaaaugaacauuaauuuuuccuucugggugcucaguaaaaacaaaauacaaacuuuaugauaaagaaugcaaauauuucauuuuuacaaacauguuguuaacuaaguuucuguauuuagcugcugaauaaauuucuggagcaaauaaugcugcugccaauauauaaaggucauuuuuucaaaucuuuaauuuuacuucuccuuauucuauagggaaaaaauaaggugugcgggaggaacuacuaaaaaguuaaauuucaguaaauauagaauuaaacuucauuaaauauugcuuuaauaauuucaagaaggagugccuuguagucuguaauagucaguaaucugcauaaucuuucguacauaguguuuuuagaaauauucagcuucucgacauuuaugcagccaacaaacauaugaaaaaaaugcucaucaucacuggucauuagagaaugcagaucaaaaccacaaugagauacuaucucauggccaguuagaaugguaaucauuaaaaagucaggaaacaacagaugcuggagaggauguggagaaauaggaaugcuguuacacuguuggugggaguguaaauuaguucaaccauuguggaagacaguguggcgauuccucaaggaucuagaacuagaaauaccauuugacccagccaucccauuacugggcauauacccaaaggaucauaaaucaugcuacuauaaaaacacaugcacacauauguuuauugcggcacuauucacaauagcaaagacuuggaacuaacccaaguguucaucaguaauagacuggauaaagaaaauguggcacauauacaccauggaauacuaugcagccauaaaaaaggaugaguucauguccuuugcagggacauggaugaagcuggaaaccaucauucucagcaaauuaccacaaggacagaaaaccaaacaccacauguucucacucauaaguggggguugaacaaugagaacacacguacacagggaagggaguaucacacacuggggccugucagaggcugggaggcuggggaagggauagcauuaggagaaauaccuaauguagaugauggguugaugggcacagcaaaccaacauggcacauguauaucuguguaaccugcgcauugugcacauguaccccagaacuuguauaauuuuuaaaaaguuaaaaaaaaaagagcuuccauucagcuucucacagauauuuugguucaugauuuguaaauagaugaagcugaccacauuucuauauuuuacauucacuuuuugaacaauuaaguugcucuucuuuugaagauuggauuuauuauaacauguauauguauauuuaaugacuacuaauuuauauuuacuuuuauuuguucagaauugaaaucuccuugaacuuauaaauuauauaaguaaccauugauuauuuugaccuaacuugucuucucuugccuccugugaauagauauacuaagaacaaugucaggucuugugauuuguuaaaggauacaaaguuacagcuagauaggaggaaucuaccacugcaggauggcuauaguuaacaaaauuauguaguuucagguaacacaagugauaaauguuugagaugaugcauuugcuaauugcccugaucugaucacuauacaucauauguaucagaacaucacugugaaccccaugaguauguacaauuauuuguccauuaaaaaaaauaaaauagaaaguaugggugguauaaaauauuugaugucgugcauauuuuuaaaucuucacaaaaaaaucauuauagaggaaguaaaauaugugagaauaauuuaucauucuuuucacuuuuuuuaaaggugauggauguggacacacuguacuaggcccugagaguggaacccuuacauccauaaacuacccacagaccuaucccaacagcacuguuugugaaugggagauccguguaaagaugggagagagaguucgcaucaaauuuggugacuuugacauugaagauucugauucuugucacuuuaauuacuugagaauuuauaauggaauuggagucagcagaacugaaauagguaggacuuuuuuuuguaaauguacauguaaauacaucauugucucaaugauguauuuuuuugauauuaacauuaaauaaccaugcaguguaaggugcuaugugggaaauuauugaauauguguaaaaauuuugaauuugaaucuuuugggaagagaagauucuugucuguuuacuuuauuuacuuuucuaauaagcacauauugguacccuugcccaagaugccacuguacuacuaagaaggaggaaguuaauucucuguuuuuuuuuuuuuguuuuuuuuuuugagacagagucuugcuuuuguagcccaggcuggagggcaauggcgcaauuuuggcucacugcaaccuccgccuccuggguucaagcuauccuccugccucggccucccaaguaccugauuacaggcgcucgccaccauagccggcuaauuuuuuuuugauuuuuaguagagacgguuucaccaugguggccaggcuguuggccaggcuggucucaaacuccagccucaggugauccacccaccucagccucccaaagugcugggauuacaggcguaaaccacugcacccagccaauuaucucauuuuuaaaaauguuuuccuuucauaguuuuauuugcaauugaagaauacaaguauaauuaaugcuuaggagacaguauagcauggugauuaaaaacaaggguuuuggauccaaacuuccugggauuaaagcauaacucucaucagcuugcugugugacuuuggccagauuaccugaccucuccauuuuuucucuuguaaaaaauacagggaaugaacuaguauguguaacgugcuuagaaaaguaaacagcaccuaagauauaauauaugcuuaguaaaugguaguggccauuguuguuguucuugauuaagagcagugguucucaauuauagcugcauauuagagccaccuaaguaguaaacaauaccauaaacccaguuaccauccuagaccaguugaaucagaauugauuagguggaacccaggccucaguaucuuaaacgcuuccugggaaaaucucuugcagucacguuuaaaaaccuuugauuuaggcaucaguaccuuucuuaagcaagaaagguggaaaaauuuguaaggcuuuuuaggugaacuaacauuauaaaauuaggaauucucugugaguuuauuuagaaacauuuuuugguuccaguguguaaaauauccuucagaacuauaauaggaauccaauauacuguucuuuaaauaccauacuauguucauccucuggcuuccucuccaucucuagugaaauccuucaucucuucuuuacuuuuuuggccucuuaucuaccagaggaaaaauuccugcccuaucucccaggcugcugauugauaaacuuuggugcuucucagucacuucuugauuaaccuggugguuugagcaccacgugcguauugcaugaauauaugguguugaacaaaguuuuaggaacacaaaucgccugaggauguagaaaaacuuacugugauauuaacacuaauagaagauaacuggauaguagaugucuccugcagaugcaguagggagcagacaguaccaccugagcauucuuuaagcaacagugaggaaaagugaaccacaguuuggucaccccucuaacacuuuacaggagauaagggagauagagaaauacauucuacugaguguaaggacuaaauuaaggauaugagaaauucuguagaacaaacgaccuaguuucuucaacauauacauagcauuuuaaaaaaauaggaggagggggaagguaacuguucuacauugugacauaucuuccuaaaauaauauguagacuuugcuuggaucuugauucaagcuaaccacugaaagaaauuauuuuuaagauuaucagaccgaggugggcggaucacgaggucaggugaucgagaccauccuggcuaacauggugaaacccugccucuacugaaaauacaaaaaaaugagccgggcgugguggcgggcgccuguagucccagcuacuugggaggcugagggaggagaauggcgugaacccgggagacggagcuugcagugagccgagaucgagccacugcacuccagccugggugacagagcaagacuccgucucaaaaaaagaaaaaaagauuaucagagaaauuugaagcauugggcauucagugaugguaaagaaugacuguuuuagauguaauaauguuaaaauuauuuuuaaguucuaauuuguuagagacauucucaaguucaaaugucuaggauuuauguuuaaguauuucagaaauagggagaaggauaggagaaacaagggcacauuagugaagcugaguaaugggcagaugggaauuguuacacccucuucuuucuacuuuuguguaauuuugaaaauuccuauaaagaaaagugguuauguuaaaauaaaacaagagaauuauauauuuagauaauacauaguggcacuguugguagaguggaagaguggcguggggaagauucugagcacagguuucaaauugcucgcugaauucuagucaaagcuccaggaguuacuuguugagaguccuuuuucuacaaaguguugaaccugcccagacuucauagucacuuucuguacggucugaagauuaaaagaaguaauacuuugcaguguuugguguguaauagguauuuaauaaaucucagcuuucccuuauuuccauugcuuuuuccuauucuccucaugggugaauggaaagcugcagaaaggucaaggggccugagugaugaugguuccuguugggcuucaguuuguacccacccuucccccaucacaccuaccguauacccacugguccuccauuugguagcagccuaugguuagugguagaaaaguuucuuaacguauugcagagaaauaaagauaauucaagaauagucguuuaacauucugguuaagauaggucugcagagaauuacaggauagaaacaaauacauugugggcaucaggauuucagggauaaugucacugaaucuuuuuuuuucccccuauaucauguuuucucagugccccuuuagaaaacaagcauuaaaggagaagagaguucauuggucucucuguguuucugauguucacauuugaaguauaugggcuaaugauuucgugggaugugugucugaugcuuccucauuauuagauuccagugacagacuuuuggcaagaauaccacagaugcgcuguucucaguguaucauaucauggcacaugagauugauuugucccauuucuggugcuauuaacuuugauauuuuggcuaaggugaugucucucaguuuucuacacuguaacuaugcugcucuucauaaccaauacaugucugauugggagacucuuugaaauguuggaaauauccuguuacucaucaaacuuauacccacuagauuugggacauauuaaucuuguaugaaucaauuauuauuuucuaauuucauuauuccuucuguauuuauuagguuuuuuuuucauacuaaaaacaggaucuuucccuucucucccauuuguuuguuuauaucagugugaagucaauggauuccuguguuaggccaucacuuaucacccuuuccugucauuauuuuggugcucagauugucccaaaucuccagugggagccucuucacgcuagcuccuauguccuuuggugauguccucaucauuauuugaguaccucuuuauauucuggcacaggauauucuagguuuaucuugugauugcccugcuccagcccuggaaucagccauuucuucagggaacccugguucuuuuuaguggagaaugguauuagaaaucaaugucugguugcuagguuuagaccaaugagcuaccauaugccuaucaacaaauagauuuaguaaauagacauuuguauauacauauguauauacauguaccuguuauaucuuuuuauauuuaucugccuguauuaaagagcaugaguuuaugcugauaccuuuaauacuaaugcaacauuauaggguucauucuauccuuuuccuauuuuucuuucuaacucacuucucugacagugagaaaucuugcucccauuaccuguaauguauuuacuuguucagugcuauaaccagaaaauaguuuuagaauugcuaacccaugacucgaacugaaagaagccugcuaccuagaauucguaccugaggacuuagagucuaaauacuacauuaaaaaauucuuuaggcugguucuuacuccaccaccaccugcccuucaaugugguuauguuacucauuugaaauaugguuugguucauuucuuucuguucaucuuccauuauagguuuuuucuuuauccuuguugguuuucuuucucuuuuguugaauauguuaaacauuaacaugauucucaaaguuaaaacuguacaaaaagguagauaagugacauuccuccccuuuacagugcauuucuucuuuccuuuuaaccccaucuccacucacucccuguagcuaaccaauugcauuaguguuuguuuuaucuuuuccguacuucuuuauacaaaugacauuuauauuuucuguuuucuccuuucuuauacgaacuuuaacauucuuucaauauucuuuuguacuuugcuuucucccuaccuaucaguguuuucuggaaaucacugugcaucauuuuguaggauaguccucauucuuuuuauagcaguauagaacuccaucauguggauguaucauaguuuauuuaaucacucuuuuaugaaugguuguauugguugcuuucaauauuuuacaguuacaaacuauuuuuguauucuuagaggugucuuugguguagauuccugaagugauugcugagucaaaagguaaauuauauacuuuguuagacauugcuaaauuggaaguuauaccaguuugcauuuccauagcauaaaaaugcuuguuuuccacagccuucccaacaaaguguguugucauaucuuuuaaguuuugccaauugauaaugauaaauagugcucaguauaguuguaauuugcauuucucuuacuaugagugaaauugaacuguuuuuucccauauguugacggccuuuuuuuuuuuuuuuuuuuuuuuuuuuuuuacuuuuuaucucuuccugucuuuugcccguuuuucugucaaguuuuuuuuuauuuuuaaagacaggucuuucuauauugcucaggcuggccucaaaccccugggcucaagcaaucaucucaccucagcccccugaguagcugggacgacaggcacacaccauuugcccaucugucaaguuuuauuggucuuuguuucucucagguuuuaggacuucucauuaucuuuuagggauauuagucuauaaacauaauagugguauaugcuacaaauaauuucuccuaauuugucaguugucuuuugacuuuguuuauguuacuuuuuuucaaccaugcaaacuuuuaaaaauguauuuauaguuagauucauuagucuuuuuuuaaauugcaucuagauucuaaguccuaguuagaaagcuucuuccuauaucccaacuaaagauaaauuuacccauuuuuuucauagugggauuauaugauuucauuuuuuauauuuagaucccugguacaucgggguuuuuuucuuuuguauggcaugaaguauagaucucauuguguuuuccauaugacuaaccacuugccccaucaccaugcauuuaaaaguuuaucuuugucccagugguuugaaauacugccuuuaucauauacugcaguucuguaugugcuugggucuauuucuggacuuuggguugcacuccacagauguaucuauccacauaccagaaugugacuguuuuguaaaggcuuucagaggcuuuacgguauguguuaaugccugauagggcuuagucuccuuucagaaacguucauuuuuaguguuuuccugggucuuccuuccuguuuguuuauccaugugaaguuuaguaucagcuuaucuaacuccacaaaaaagcucguugguguuuuuauugacauuauacuguuuauaaauuaacuuuaugauguugaguuaucuuaaguucaaaaccaagagcucuuuuuuuuucuccuuucuucacaucuacuuuuguugucuuuaaggauuguuuuaaacucuuucucauguaggguuuacacauuuuuuguuaaacuuaauccuuaacaucuuaucugcuuuguugcaauggagauggagguguuuuuguuuugcuguuauauccuguaacggguuccuaauuaugugagauuguauuucuguauguugauuuuuuucugcuauuuuacugaguuuuuaaaauuauuucaguuaguuuuaucauucacuuucuagggauuuucagauacacaaucacaucugcagauagagauaguucuacuuccuuuuuuuccauuucuuaugccuaugguugauucuuuuaucuaauuguauuggcuaacaccuccaguccaggacuacguuaaacaguaguggagagagugagcauccuuuccggguuccuuaucuuaguggaaauuuaaagugucugagcucagguugccguaacaaaaucuauagaccgaguggcuuaaaaaaacagcaguuuacuuucucagaguuuuggaggcuagaagucccacaucaagaugccaagcaauucaguuucuggugagggcucucuuccuggcuuguagauggccaccuucuuccuguguccucacaugacgagguuggagggaugaggagagagaaacagcagguucucuuaugucucuucuuauaaguacacuaauccuguuggaucagcgccccaccuuaggaaaacuaaaaccauuuaauuuuaauuaccucucuaaagagccuaacuccaacucuagucauauuaagaguugggacuucaacagcaauuaauuuuggggggcguaccaguaucugguccauaauaggaaguauccacugauuuccauuaaguguuguuaucaagaaagacuauugaauuuuguugaaaagcuuuuuuagcaucuauggagguaaugauaugguuuuucuaccuaaaucuauugguauaguguauuauauuaauggguucccuaauauugaaauaacugugcauuguuggaauaaguaucucuugguuaugaugugacauucuuuuaauguggcauuggauuauguuuccuaauauuuuauuaguauuuuugcauaaauauuggugugauauuaauuuguaauuuacuuugcauuuucuuuaucaggcuuagguauugauacuauacauacaaauaaaaagaaauaugaaguuuuccuuucuuuuuaguucucuggaaaaauuuacagagaauuugaacaaucuaguuuuugaagguuucacucugugaagcuauuuuagccuggugcguuuuugauaggaugcuuccuuaaugacguucucuguuucuucucaggaaauuggucuguuugagcuuucuaccucuaauggguccaauuguaauaaacgguacuugccugguaaauuacccauucaccuaggugaucuaauauauuggccaugaugucuguaaaauagaaucuuacaguuauuaacaugguuauuucaguguuuuuccaauaguuauuuaccuccugucauuucuuauuuuacauauuuaugcuucccacccucuuuuuucauuaaauuagcuaggggcaugccuauucuguuaaauuuuuccaaaaaaugaaucuugauuuauuagaacuauuguuuuucuguugucuacauuauuaaucucuauuuucaugauuuaaaauuuuuuuuuuacuuuguuaacugcuaguuuuagcuaggcauuuaauucacuuuuucuuucauuuuuauugauaaaaauaucuaagccuaugaauuuuacuuugaucacauccuuaagaaugauaucacugauuaauaugggucaauuauaucauuuuuuaggaauuuuuaaacuuugguuuauguuuuucuuuuacccaauaauuguuuaacagguuuauuucuaauuggaaggaccuuucuuuguuauugcuaauaauguauaauucuauugcauuauagucagagagcauuguaaaauuucuacuuuauaagcuaauguaugaccaguuuuuuugugaauauucuauauauacuugagaagguuuacucucuacuguaaaaaguuugauaugcauuuaaaaaucugucuuuauuuugcuguuucugucuucuauauacuuauuuuaucuguuugaucuccuauuuggugugguucuuucucuuucuuugcugucuccuggagguuuugcuuuuauaaaguugcugugcugugucgacuagauauucauaauucuaauaucuccauuuuaaauuaugacuucucacauuuaaagguuuccuacccaucauauauuacuuuuuaguuugaauucuccuuuguuugacaccaguaucacacacauacccuccuauuaauuccuuauuguuuucauuauccugcugugucugucugugcccaucacuuuauuuuuagccuuucugaaucacuuuguuuugggugucuuucuugaauauugcauauuuuugggucuuuaugagccaaauugcaaauauuuuuaaugucuaaguuaaauccauucgcauuuauuuauaacugauacauuuuaacucuuccauaucuuucaaaguuauguauauuauauuuguuguguucauuuuuucuacauuguuuucuguccuucugguuuuuuuuaagugucuuuucguguuugguaagguuuauaguuuuguucuaggugcugcuuuucaauuuauacuuuuuaaaaugccuguggucccuauugucuuaaucauuuacuauccgauuuguccauuuuuaaugguauucuuuauuuucuaccuauugccuauaaaacauucaaugaacuagacuucuuuccccuuccuucuguacccaguuuccucaguuuuauucuguuuaguguggcuacgacagaauaacugaagcuggauguuuuauaaagaaaagagguuuauuugguucauaauucugguggcuggaaagugcaagaguggacagcucaucugauaaagguuuugugcugcuucaacucauggaggaaacuggaagggaaaggggcuugugcagagagagaggggaccgaggaggcugacuugcuuuauaacaacccacugucaugguaacuaauccaguccuguuagagugagaacucacucccgugagauggcauuaaucaauuuauaagagaucuggccccaugacccaaacaacucccauuaggccccacuuuccaauacugucaugcuggcaguuaaacuucaacaugaagacuauacuuucagagaucacuucuguaguuuauuauuagaaaguuucucugaauguguagaacacuggaaaaaaugaucuaagacuacugugaauaugucugugcacacaaacuagaaagucuagaggaaauggauaaauuccuagaaacacacaaucccacaaauuugaaucaggaagaaacagaaauccugaauggaccaaguaauaaguagugagauugaaucaguaauaaaaaaucucccaaugacaacaacaacaacaacgaaugcccaggaccagauggauucacagcugaauuuuaccagacauggaaagaagaacugaugccaauucuacugaaacuauucuaaaagauggagaaagagggaauccucccuaauucuuucuaugaacccgguaucacccuaauaccaaagccaggaaaagacacaacaaacaaggaaaacugcagaccaauauuccuaaugaacauaggugcaaaaauccucaacaaaauucuagcaaaccagauucagcaguauaucaacaagauaauucagcaucaaguggguuucauaccaggaaugcaaggaugauuugacauaugcaaaucaacaaaugugauucaccacauaaauauaauuaaaaacaaaaaaaaaucauuucaguagaugaagaaaaagcauuugauaaaauugagcaucccuucaugauaaaacuccucaacaaacuaggcacagaaagaacauaccuuaaaauaauaaaagccauauaugacaaacucacagccaacauacugaaugaggaaaaacugaaagcauucuuccuaagaacuggaacaagacaagaaugcccacuucugccacuuuuauucaacguaguacuggaaguucuagcuagaacagucaggcaagagaagaaauaaagggcaucuaaguuagaaaagagaaaucaagcuaucucuguuugcugaugaugugaucuuauaccuugaaaauucuaaagacuccuccaaaaucuccuagauuggauaaaugaaucuguaaagugucagguuacaaaaucaccauacacacaucaguacuacugcuauauaccaauaaugaccaagcagaaucaaaucaagaacucagucccauuuacaauuguugcaaaaaaaggaaaaaaaaaaacccuaggaauauacuuaaccaaagaggugaaagaucucuacacauagaacugcaaaacacugaugaaagaaaccauagaugauacaaacaaauagaaaaccuccuauguucaugaauuaaaagaaucaauauugugaaaaugaccauacugcccaaaacaaucuacagauucaguagaguuccuaucaaaauaccaccaaugccugccuaccuuucuuucuuucuuucuuucuuucuuucuuucuuucuuucuuucuuucuuucuuucuuucuuucuuucuuucuuuuucuuucuuuucuuuuccuuuuucuuucuuuuuuucucucucuuuuucuuucucuauuucucucucucucucucucucucuuucucuaucucuucuuccuuccauuucccuuucccuuucccuuuccuuuccaucuuacucugucacccagucuggagugcaguugugcaaucuuggcuuacuucagccucagccuccugccuuagccucccaagcagcuggaacuacaggugugugccaucauauccugccaaaaacaccauuuuucucagaauuagaaaagaaaauccuaaauucaaauaaaaccaaaaauccugaauagcaaaagcaguccugagcaaacaaaagaaaucugggggcaucacauuagcuaucuuuaaguuauacugcaaggcuacaguaaucaacacaguaugacaacugguauaaaaauagacacauauaccaaugaaacagaauagagaacccagauauaaagccaaauaacuacaaccaacugaucuuugacaaagcagacugaaacauacaaugggggaaaggacacccuauucauucaguggugcuggaaaauuggauagccauacacagaagaaugaaacugguucccuaucucucaccgucuacaaaaauuuacucaagauggauuaaagacuuaacccuuuccccauuugcucugagaauacucaccaguggcacuugcggcugcaucauuuaccccaaaguaaauuugccacaaaauagcacccuaugauuauuauuuuugcauugcucuaguauaucaacuuuggaaacaaaagacauuauccuauuuauagcacuccauuuuuaguagcgguauuuccacuuacaaaauaaaaucucagccacugaaaaugucaaaucuuagaaaacagcauuccuacacaugaugcuaacauuguucaugaaaaguuguuggccaaggauuaguuucaugaauucaguuuuucugaaauagauuauucugaugauucagacaauucuaauguuaguucuguuuagaaauaacuccaagaacaguuuuuauauuuuauuuucacauugacuaucagucagauuugcuucagccucaaagaacguguuuauguaaaauuaaaugagcgcuggcagcaagccacaccuuuuuuugaaaacaggaaaagggucaaauguaagaccugaaaccauaacaauuuuagaagaagcccuaggaaaaauucuggauauuggcguaggcagagaauuuauuaguaagagacagagcaaaugcaacaaaaauaaauaaaugggacucaaacugaaaagcuuuguacagcaaaagagauaaucugcagaguaaacagagaaccuacagaaugggagaaaauauuuguaaacuauacaucugacaaaggacuaauguccguaaucuacaaggaacugaaauuagcaagaaaauaaauaaucccuuaaaaaguagacaaacaacaugaacagacauuucucaaaagaagauacacaaaagacuaacaaacauaugaaaaaugcucaacaucacuagucaucacagaaaugcaaauuaaaacugcaguaagauaccacuuugcccuagucagaauggccauuaagaagucaaaaaacaauagauguuggcgcagacagggaacacuuauacacuguuggugagaauguaaauuaguucaaccucuguggaaaacaguauggaaauuuaucaaagaacuaacagaucuaccauucaguucagcagucucacuacugauaucugcccaaaggaaaauaugucauuauaucaaaaagauaccugcacuaguauguuuaucauaguagaauucaccauggaaaagauacggaaucaaccuaagaguccaucaaaccaaugaguggauaaagaaaauguuauauauauaugauguaaacauauagacacaguggaauacuacucacccuuaaaaagaaugaaauaaugucuucgcagcuccuuggauagaacuggggaucauuauccuaaguaaaguaacucaggaacagaaaaccaaguaccauauguucucacaaggggggacuaaccuuguggauaaauaacagcauacagaaugcuguaauggacaucggagacucagaaagggggagggugguaagggauuaaaaaaucaccuguuggguacacuguacacuauuugggugauggguacacuaaaagcucagauuucaccacuauaaaauuuaucuguguaacaaaaacuacuuguaccccuaaagcuauugaaaauuaaaaaaauauauaaauaaauuucaacaugagauuucauggggacaaaccauguccaaaucauagcacucucagaauauacauucauaacacacagcauguaucauaucuucuuauucuucaaccccaucucuaacuuuucuagaucuauaauuaaauauaauaaaugaucacugucuuuuuccucaaguccucccacuagucuauuguuuggaugaaguucaucuuugaauagguugauuccuuaagaagggcuuauguugcagauuuugcauguuuaaaacugcuuacuuuguaaauuuuuuauggccuuuaggcuucagggggcugcuugauaguauuuaaaucuuggauucaaauguuauuucuggucgggcacgguggcucacgccuguaaucccagaacuuugggaggcugaggugggcagaucacaaggucaggagaucgagaccauccuggcuaacaaggugaaaccccgucucuacugaaaauacaaaaaaaguagccgggcgcgguggcaggcaccuguagucccagcuaugcaggaggcugaggcaggagaauggcaugaaccugggaggcggagcuugcagugaaccaagauugugccacugcacuccagccugggugacagagcgagacuccgucucaaaaaaaaaaaaacaaaaaacaacaaaaacaaauguuauuucuuugaguuaaaaaaaaugcuuuuccaugauucccuuacuucauauuguuuuuugagaagucugaugacaauugaacucuccugccauuauaagguauuugguuuuuguacagugaccaugaggauuuuuuucuuuaccuuuaaagucuauuaguuuucuaaggauauguguugaaguugaucauuacagguuuucacugguacccaguggacccuuucaguauguaaauucaagucuuccuuuauuucuagaaaauugaauuggauuauaguuuuaauacuucuuauuuaaugauuuuuuaagugacaugaaaauuguacauauuuuauaaaauaccuaggaauccaacuuacaagggcugugaaggaccucuucaaggagaacuacaaaccacugcucaaugaaauaaaagaggacacaaauggaagaacauuccaugcucauggauaggaagaaucaauaucgugaaaauggcuauacugcccaagguaauuuauagauucaaugccauccccaucaagcuaccaaugacuuucuucacagaauuggaaaaaacuacuuuaaaguucauauggaaccaaaaaagagcuggcauugccaagucaauccuaagccaaaagaacaaagcgggaggcaucaggcuaccugacuucaaacuauacuacaaggcuacaguaaccaaaacagcaugguacugggaccaaaacagagauauagaccaauggaacagaacagagcccucagaaauaauaccacacaucuacaaccaucugaucuuugacaaaccugacaaaaacaagaaauggggaaaggauucccuauuuaauaaaugguucugggaaaacuggcuagccauauguaaaaagcugaaacuggaucccuuccuuacaccuuaugcaaaaacuaauucaagauggauuaaagacuuaaauguuagaccuaaaaccauaaaaacccuagaagaaaaccuaggcaguaccauucaggacauaggcaugggcaaggacuucaugucugaaacaccaaaagcaauggcaacaaaagccaaaauugacaaaugggaucuaauuaaacuaaagagcuucugcacagcaaaagaaacuaccaucagagugaacaggcaaccuacagaaugggagaaaauuuuugcaaucuacucaucagacaaagggcuaauauugagaaucuacaaagaacucaaacaaauuuacaagaaaaaaacaaccccaucaacaagugggcaaaugauaugaacagacacuucucaaaagaagacauuuaugcagccaaaagacacaugaaaaaaugcucaucaucacuggccaucagagaaaugcaaaucaaaaccacaaugagauaccaucucacaccaguuagaauggugaucauuaaaaagucaggaaauaacaggugcuggagagguuguggagaaauaggaacacuuuuacacuguuggugggaguguaaacuaguucaaccauuguggaagacaguguggcgauuccucagggaucuagaacuagaaauaccauuugacccagccaucccauuacuggguauauacccaaaggauuauaaaucaugcugcuauaaagacacaugcacacgucuguuuauugcggcacuauucacaauagcaaagacuuggaaccaacccagauguccaucaaugauagacuggauuaagaaaauguggcacauauacaccauggaauacuaugcagccauaaaaaaugaugaguucauguccuuuguaaggacauggaugaagcuggaaaccaucauucucagcaaacuaucacaaggacaaaaaaccgaacaccgcauguucucacucauaggugggaauugaacaaugagaacaguuggacacaggaaggggaacaucacacaccggugccugucaugggguggggggagggaggagggauagcauuaggagauauaccuaauguaaaugacgaguuaaugggugcagcacaccagcgugucacauguauacauaugucaccugcacguugugcacauguacccuagaacuuaaaguauaauacaaaauauauauauaaaaaaagaaaauuguauauaugcuguacauuauguuuucauauguguauacauuguagaaugggucaaucagacuaauaaaugcauuaccucacguacuuaacguuuuuguggugagaacacuuaaaaaaucucuuagcaauuuuuaacuauacaauacacuguuauacaguguuucuuuuuaacuuaucacuccuauguaacugaaauuuuugugucccuugaccaacaucucuccagcucaucccuccaacucccccuucaacccguucuacucucugcuucugugaguuugucuuuuuuagauucuacaugugagugggaucauguaguauuugucuuucuaugccuugcuuauuucgcuuaacaucauauccuccaguuucauccauguuguuagaaaugucaggguuucuuuuuuuuuuaauacaggcugaauaguacucuguuguguucauauaccacauuuccuuuauccauucaucuacugauggacauuuagauugauuccauaucuuggcuauugugaauaaugcagcagugaacaugggaguguagguaucuuuucaacauacugauuucauuuucuuuggauauguauacccaguaguaaaauuacuggaucauaugguaguuuuauuuuuaauuuuuugaggaacuuccauacugguuuucauaacagcuauacuaauuuagauucccaccaauaguguagaaguguaccauuuucuccacauucuugucaacacuuuugucuuuuugauaguagccauucuaggaagcaugaggugauaucucauugugguuuuauuuucauuuccuugguguuuaacggugcagaacauuuuuucuuuuuuuauuauuauuuaaguucuaggauacgugugcacagugugcagguuuuuuacauauguaugcaugagccauguugguaugcugcacccauuaacucgucauuuacauuagguauaucuccuaaugcuuucucuccccccuccacccaccccacaacaggccccagagugugauguuccccugccuguguccaaguguucucauuguucaauucccaccuaugagugagaacaugcgcuguuugguuuuuuguucuugcgauaguuugcugagaaugaugguuuccagcuucauccaugucccuacaaaggacaugaacucaucuuuuuuuaugguugcauaguauuccaugguguauaugugccacauuuucuuaaucuagucuaucauugauggacauuuggguugguuccaagucuuugcuauugugaauagugccacaauaaacauacaugcgcaugugccuuuacagcaacaugauuuauaauccuuuggguauauacccaguaaugggauggcuggaucaaaugguauuuuaaguucuagauacuugaggaauugccacacugucuucuacaaugguuuaacaaguuuacagucccaccaacaauuuaaaaguguuccuauuucuccacaaccucuccagcaccuguuauuuccugacuuuuuaauaaucaccauucuaacuggugugaggugguaucucauugugguuuugauuugcauuucucugauggccagugaugaugagcauuuuuuucugugucuuuuggcugcauaaaugucuucuuuugagaagugucuguucauaucguucgcccacuuguugaugggguuguuuuuuucuuguaaauuuguuugaguucuuuguagauucucaauauuagcccuuugucagaugaguagauugcaaaaauuuucucccauccuguagguugccuguucacucugaugguaguuucuuuugcugugcagaagcucuuuaguuuaauuagaucccauuugucaauuuuggcuuuuguugccauugcuuuugguguuuuagacaugaaguccaugccuauguccugaaugguauugccuagguuuucuucuaggguuuuuaugguguuaggucuaacauuuaagucuuuaauccaucuugaguuaauuuuuguauaagguguaaggaagggauccaguuucagcuuucuacauauggcuagccaguuuucccagcaccauuuauuaaauagggaauccuuuccccauuucuuguuuuugucagguuugucaaagaucagaugguuguaaauguaugguauuauuucugagggcucuguucuguuccauuggucuauaucucuguuuuggucccaguaccaugcuguuuugguuacuguagccuuguaguauaguuugaagucaaguagcuugaugccucccgcuuuguucuuuuggcuuaggauugucuuggcaaugcagcuuuuuuuugguuccauaugaacuuuaaaguaguuuuuuccaauucugugaagaaagucauugguagcuugauggggauggcauugaaucuauaaauuaccuugggcaguauggccauuuucaugauauugauucuuccucuccaugagccuggaauguucuuccaauuguugaccucuuuuguugagcagugguuuguaguucucuuugaagagguccuucacaucccuuguaaguuggauuccuaguuauuuuauucucuuugaagcaguugugaaugggaguucacucaugauuuggcucucuguuugucuguuauugguauauaagaaugccugugauuuuuguacauugauuuuguauccugagacuuugcugaaguugcuuaucagcuuaagaagauuuugggcguagaugaugggguuuucuaaauauacaaucaugucaucugcaaacagggacaauuugacuuccucuuuuccuaacugaauacccuuuauuucuuucuccugccugauugcccuggccagaacuuccaauacuauaugaaauaggaguagugagagagggcaucccuguuuugcaccaguuuucaaagggaaugcuuccaguuuuugcccauucagugugauauuggcuguggguuugucauaaauaacucuuauuauuuugagacacgucucaucaauacaugauuuauugagaguuuuuaggauaaaaggcuguugaauuuugucaaaccccuuuucugcaucuauugagauaaucaaugugguuuuuguaugugguucuguuuauaugcuggauuacguuuauggauuugcauauguucaaccagccuugcaucccagagaugaagcccacuugaucgugguggauaaacuuuuugaugugcugcuggauucgguuugccaguauuuuauugaggauuuuugcaucgauguucaucagggauauuggucuaaaauucucuuuuuuuguugugucucugccaggcuuugguaucaggaugaugcuggccucauaaaaagaguuagggaggauucccucuuuuucuauugauuggaauacuuucagaaagaaugguaccagcuccuccuuguaccucugguagaauuuggcugugaaucugucugguccuggacuuuuuuugguugguaggcuauuauugccucaauuucagagccuguuauuggucuguucagggauucaacuucuuccugguuuagucuugggagggugugcauguccaggaacuuauccauuucuucuagauuuucuuguuuauuugcguagagguguuuguaguauucucugaugguaguuuguaucucugugggaucgguggugauauccccuuuaucauuuuuuauugcgucuauuugauucuucucucuuuucuuuauuagucuugcuagcaaucuaucaauuuuguugaucuuuucaaaaaaccaucuccuggauucauugauuuuuugaagguuuuuuugugucccuaucuccuucaguucuucucugaucuuaguuauuucuugccuucugcuagcuuuugaauguguuugcucuugcuucucuaguucuuuuaauugugauguuaggguguccauuuuagaucuuuccugcuuucucuugugggcauuuagugcuuaaauuucccucuacacacugcuuuaaaugugucccagagauucugguauguugugucuuuguucucguugguuucaaagaacauauuuauuucugccuucauuucguuauguacccaguagucauucaggagcagguuguucaguuuccacguuguugagcgguuuugagugaguuucuuaauccugaguucuaguuugauugcacuguggucugagagacaguuuguuaugauuucuguucuuuuacauuugcugaggaguacuuuacuuccaacuauguggucaauuuuggaauaagugcaauguggugcugagaagaacguauauuguguugauuugggguggagaguucuguagauguguguuaggucugcuuggugcagagcuaaguucaauuccuggauaucccuguuaacuuucuuucucauugaucugucuaaugcugacagugggguguuaaaagucucccauuauuauugugugggagucuaagucuccuuguagaucucuaaggacuugcuuuaugaaucuggguucuccuguauuggcugcauauauauuuaggauaguuagcucuucuuguugaauugaucccuuuaccauuauguaauggccuucuuugucucuuuuaaucuuuguugguuuaaagucuguuuuaucagagacuaggauugcaaccccugccuuuuuguguuuuccauuugcuugguagaucuuccuccaucuccuuauuuugagccuaugugugucucugcaugugagaugggucuccugaauacagcacacugaugagucucgacucuuuauccaauuugccagucuaugucuuuuaauuggagcauuuagcccauuuacauuuaagguuaauauuguuaugugugaauuugauccugucauugugauguuagcugguuauuuugcuuguuaguugaugcaguuucuuccaagcauugauggucuuuacaauuugucauguuuuugcaguggcugguauugguuguuccuuuccauguuuagugcuuccuuuaggagcucuuuuagggcaggccugguggugacaaaaucugucagcguuugcuugucuguaaaguauuuuauuucuccuucacuuaugaagcuuaguuuggcuggauaugaaauuccggguugaaaauucuuuccuuuaagaauguugaauauuggccccuacugucuucuggcuuguagaguuucuccugaaagaucugcuguuagucugaugggcuucccuucguggguaacccaaccuuucucucuggcugcucucaucauuuuuuccuucauuucaacuuuggugaaucugacaauuaugugucaugaaguugcucuucucgaggaguaucuuuguggcauucucuguauuuccugaauuugaguguuggccugccuugcuagguuggggaaguucuccuggauaauauccugcagaguguuuuccaacuugguuccauucuccccaucacuuucagguacaccaaucagacguagauuuggucuuuucaccuagucccauauuucuuggaggcuuuguucauuucuuuuuagucuuuuuucuccaaauuucucuucuggcuucauuucauucauuugaucuucuaucaccgauacccuuucuuccaguugauugaauuaucuacugaagcuugugcauucgucacguaguucucaugccaugguuuucagcucuaucaggucauuuaaggacuucucuacacugguuauucuaguuagccauucgucuaaucuuuucucaagguuuuuagcuucuuuguguuguguucaaacuucuuccuuuagcucagagaaguuugauggucugaagccuucuucucucaacucgucaaagucauucuccguccagcuuuguuccguugcuggcgaggagcugcguuccuuuguggggggagaggugcucugauuuuuagaauuuucagauuuucugcucuguuuuuuccccaucuuugugguuuuaucuaccuuuggucuuugauguuggugacauacagaugggguuuugguguggauguccuuucuguuuguuaauuuuccuuuuaacagucauagcccucagcugaggucuguuggaguuuucuggagguccacuccagacccuguuugccuggguaucagcaguggaggcugcagaacagugaauauugcugaacagcaaauguugcugccugaucauuccucuggaagcuucgucucagaggcguacccggccaugugagguaucagucugccccuacuggggggugccucccaguuaggcuacuugggggucagggacccacuugaggaggcagucugucuguucucagaucucagacuccaugcugggagaaccacuacucucuucaaagcugucagacagggacauuuaagucuguagagguuuuugcugacuuuuguuuggcuaugcccugcccccagagguggagucuacagaggcaggcaggccuccuugagcugcguugggcuccacccaguucgagcuuccuggccgcuuuguuuaccuacucaacccucagcaauggugggcuccccucccccagccuccugcugccuugcaguucaaucccagacugcugugcuagcaaugagugagccuccguuggcguaggacccuccgagccaggcgugggauguaaucuccuggugugccguuugcuauaagaccauuggaaaagugcgguauuagggcagaagugacccgauuuuccaggugccaucugucaccccuucccuuggcuaggaaagggaauuccccgaccccacgcgcuucccaggugaagcgaugccaguaccucaguuggaaaugcagaaaucacccaucuucugcgucgcucacacugggagcuauagacuggagcuguuccuauucggccaucuuggaacggaggacccagaacauuuuuucauauaucuguuggcuauuuguauaauaggggaggggauuguuuucauaaacuuuuucugaaaaaugccuacuuaggucuuuuuucauuuuuaaaguuacuuguuuucuugcuuuugaguuguuugaccucauauguuuuugguauuaaccccuuaccagauacaugguuugcagguauuuucucuuucugugucucuucacucuguugauuguuuucuuugcuaugcgaaagcauuuuagugugagguaauccuauaugccuauuuuuuaauguuaauauuuguuccauugcuuuguguauuuauuuuuaauacuuaugagaggugacagcgugcuggcagcccucgcaggccucgcucgcucucggcaccuccucugccugggcucccacuuuggcagcacuugaggagcccuucagccugcugcugcacugugggagccccuuccugggcuggccaaggccggagccggcucccucagcuugcggguagguguggagggagaggcgcaggcgggaacuggggcugcacacggcgcuugcgggccagugcgaguucugggugugugugggcucggcaggccccacacucggaguggccagcuggcccugccagccccaggcagugaggugcuuagcaccugggccagcagcugcugugacuuuucgcugggccuuagcugccuccccguggggcagggcucgggaccugcagcccgccaugccugagccugccccccaccgugggcugcugcguggcccaagccuccccgacgagcaccgcccccugcuccauggcacccagucccauugaccacccaagggcugaggagugcgggcgcacggcgcgggacuggcaggcagcuccaccugcagccccggugcgggauccacugggugcagccagcugggcuccugagucugguggggacuuggagaaccuuuaugucuagcuaagggauuguaaauacaccagucggcacucuguaucuagcucaagguuuguaaagacaccaaucagcacccuguguguggcucaggguuugugaaugcaccaaucgacuguaucuagcuacucuaguggggacguggagaaccuuuaugucuagcuaagggauuguaaauacaccaaucggcacuguguaucuagcucaagguuuguaaacacaccaaucagcacccugcgucuagcucaggguuugugaaugcaccaaucgacacucugugucuagcuaaucucguggggauguggagaacuuuugugucuagcucagggauuguaaacgcaccaaucagcacccugucauaacggaccaauaagcucucuguaaaauggaccagucggcucucuguaaaauggacuaaucagcagaauguggguugggccagauaagagaauaaaagcaggcugccggagccagcaguggcgagccagcaguggcaacccagcuuggguccccuuacacacuguggaagcuuuguucuuucgcucuuugcaauaaaucuugcuacugcucacucuuuggguccacacugccuuuaugagcuguaacacucaccgcaaaggucugcagcuucacuccugaagccagcgagaccacgaacccaccaggaggaaugaacaacuccagacgugccgccuuaagagcuguaacacucaccacgaaggucugcagcuucacuccugagccagugagaccacgaacccaccagaaggaagaaacuccaaacacauccgaacaucagaaagaacaaacuccggacaugccaccuuuaagaaccguaacacucacugcgagggucugcggcuucguucuugaagucagugagaccaagaacccaccaauucuggacacacuuauaugucaguugaaucuucuuugccauuuauauccccuuucauuucagccacauucucacugauccuuuuuacuuuuuaaauauucuuuuuagucuguuuuuuuucuucuuuucaacauuccuuauguuuucguuagaaucuguaauuccuugugcacuuuauaaugucuuaauucuucauuuuugguauacuuuugucuuuuucuuauauuucuuuccugaggucaaccaacucucauuucuuucugcuuuuuuuguccauuucugccccuaguuucugaauuuaugcuucaagauguuuuaucauaucccaaauguaugaggacauuuaauuaacuuuggaguguugugcuguaguuuccuucugucacuguuuuuauagggggagaggguuuucauaaacuaaauuuuagggauucccauuuuuuguuuucuuuuuauacuguguauuuuuaaguagauuaacauuguaccucuguauuucuguggauagggcuggcaguuugcagugguuuauaagcuuuguagcucauaauaggccccuuuguuaauauaguuuuuucuuuuuuuucuucugagagagaccauaguucgggagagauugcauauauauuuguuguuuuguuuuguucuuucaguauccuaaauguuuccucugagguuuugaggcagauuauugaggaauugacaacuguccauuucucagcauuuaacuggagggaacuuacucuccugugagauccugcccccauccaagaauuccuguuugugagccuuuuaagugaauauuaaaagguuuugacaucuccuaaguagugaagaguauauuuuuucagaaaagcuuuaaagaaauuucuugauauucuaugaaugucucaucugugaugcuuggcaccacaucugguuuugcugaagucuucacauuauuaugacucauugcuuuuuguauuagcauacuuggcaugagaaacugccagcuauacugaaauaaucugucaacuuaguaagagcuaggaccuugaaucacuaccuuuucaagauguuuuauuaagaaauagaaugugaagcucucuuuacagaguuggcuuguuuuccaaaagauaacucuuaaaguccuuugcuaaaguagaaguuucauaagagagaaggaaagcccacuuggaaaauuucgauggggaauuuugauauuaccuuaugaauauuucagcccaucugaaugcuauaaauuuuucuaucaagaccguuugguuaccauuguagauagugguaaaaaccuauaugcucuuuugucugagcuacaguucugaaaggauuuuagaggagggaacuaugcuuacagucaaagaaaugcauaguuuuaaaacuacauuuuuuuccugacuuuugaauucauaaaaaauauuaaaauuuuaauguuauguuugugugagugugguaaaacugacacuuuuuuauguugaagauguacguaaguacacauuucuauacguagaagaggaauugcugggucacuggguugcauauguucagcuuuagcaguuauugccaaauguuuuuguggcuguacuauuuuauacccaccaccaguguauaagaguucuaguuaccauucucugcuuuucuccauguuaacuguucugguguguguguacugauggcauguuauacauaguuugcuuuguauuuccuugauagcugaugauacugugcucuuuucauacauuuauuauccauuuaaauaucuuuguuuauaaaaaaucuguuuacauuuucaugcauauucucuauugggagaucuuuuucuuauucauuuguuggaguucuguauauauucggguaauggguucuuuuuagauguaguaaauguaucuucuccauugcuaugggcugccauuuuacucccuuacugguaucuuaugauaaauaaacguuaauuuuauguaguuugcguuuacuaauuauuuuaugguuaguacuuuuuguauucuguuuaagaaauuuuugcccaguucuaggucgugaagcucuucucaaaguuuuccacuuaaagccuuauuggauuuguuucuaauauuauccucaauccauccagaauugauuuuuaucuguguugugugagguaggagucaaagugucaagguacauuuuucccuugcagcguuuauucacuuuaaaaugugcagauaucagaucugcugcuuaagaagaauaacaccaaaauagccacuuuucuaaaaucaagauguacaaugacuaugauauguuguagaaaaacauaauuuaaaauacuuuucuaaaaccacuauauuuuagaaggagaggcaaauucauuuuuaguaauauuguuaaaucccuuuuaaaccuaguaaauaucuguuaugucccauuuuaaauauauacccaauagucuaauuguucaaaaagaaauuagagcuauaccuuccuaucauuaucuucugcaggcaagucuuugcugaagcagcuaaaaguaaggcuaaauccagccaaaaggacagcuuauucacaguauaagagaaaugauuaugggaagacauuuuagacauucaaaaagagaacacucaaccacuccaagcaggggguuaauuuguacaucuccaccucacucuggcccaccaagcauaagacaaugguccucaaagccagacuuuuuaaagaaacuacugaugggaguuauuuaaugauagcaucuaugguaaacauuguucaggagcuaucauggccucuucuguaccuuagaggauucaacuguacauuugauuugucccacuacacuaagcuuucugagggcaucacugccucucauuccauuacugaauccccaguuccugccuggcuuagugccuggauauucagaguuucaguaaaugaguuccuuugagaauuccaaauuuuguuuuugagacuagagaugcucuauacuaguuaaaaaaagaaaaaaaaaaccuguucguaaauaaguuuguaaauuaggacugaggcucuuuaagcaagcuucauuucccuccacugaaagugggcagagcugaugugcuuuuguucuagcaaguaacucucuacccucugguucauccuucuaaguugcagauuccuaaggagagcauuguuccguggcacaccucaggaaguugaaugagcuuccauuuaauugagaacauaaauaagauuucucaaguuucguaacaauauuaauuauacuucugguuuaucagagucagaugcacuaucuccccucuuuugaauacagaauguuuccauuuaacaccuucuagagcuuaauuuauugcuguuauucaucuacugugguugauguggacaucagaagaggcauggugaccauaaggucucuauacucuguacaaguggcuacaagcucacugccaacagggucuagacagaugaaauaaaggagugaaauggccuaggcauaugaagaauaacagcauagccaugaugauaaaugauagcugagcuucaggacugguggcauuguggagugauagggcuguggcaaacuggagugugacuuucuuuuucaaaggggacagcugcuacuuaaggacaaccacuuagaaaacuggccuagauuuccuuuuuuuccuugugauuuuucaagagaaguuggaaauucagaauuuauguuaaguuuccagauuuugagaacuuuaacaccuaauuuaaacauuuuugaaggagaguauagcccagagcuguacagaccaagaggccugugggcuaauuuggguccugagccaucaauucuaacuucgccuccauaccucuaucaaauucaauuauccaaaagcacaauauucuuggacuguacacuaaauuccugguuguauucuguuuuacuuugcuucuuaauaaauuaucacaagccuacaacuuaaaacagcgcaguuuuaucaucucacuucccauggaucugaagucuaggcauugcauggcaugacugaauucucugcuuggggucccaccaggcugaaauuaagguguuagcugggaauacguuucucaucuggggcucacaguucucuuccaaguguacuaguuguugguagaauucaguucauugcaguuguaaaacugagguccccauuuucuugguaacuguuggccagggacugcuuuaacuuucuagaggugacuugcaauggcccugauaggcaaguugcuacauagauguuugcauucuuccaggccaccuggcaugugucucucuuauuuccaauucugcaaccugagaaaacaaugugcuuuuaaugggccuaccugauuaguucaggcuuacccagaaaaaucuccguuuugccauauauguaacauaaaagaaguuaaaaaugaaacugacagggaauccugguaagaaauacccuagaaggcugggugcgguggcucacgccuguaaucccaucacuuugggaggccgagguggguggaucaccacaggucaggaguucuagaccagccuggcaaauacggugaaacccugucucuaauaaaaauacaaaaauuagccuggcguguuggugugcgccuguaaucccagcuacuugggaggcugagacaggagaauugcuugaacgugggaggcagagguugcagugagccaagaucacgccacuguacuccagccugggugacagagcgagacuccuuuaaaaaaaaaaaaaaaaagaaauauccuagaagcauuaaaagaucacauacuagaggaaauuuuacaaguaaacacacauuggaaaaguuaaucaagaaaauaacaaguuaccagucucuugaucaccaauacugcuggggagaaggggaauaaauugguacagccuuuuuguuuaauuagauuccauuugucaguuuuggcuuuuguugccauuguuuuugguguuuuagucaugcagucuuggcccaugccuauguccugaaugguauugccuagguuuucuagguuuuuuaugguuuuaggucuuacguuuaagucuuuaauccaucuugaguuaauuuuuguauaagguguaaggaaggggcccaguuucaguuuucugcauauggcuagcuggccaguuuucccaacagcauuuauuaaauagggaacccuuuccccguugcuuguuuuuguuagguuugucaaagaucaaaugguuguaguuguguaguguuauuucugaagccucuguucuguuccauuggucuacauaccuguuuugguaccaguaccgugcuguuuggguuacuguagccuuguauaguuugaagucagguagcgugaugccuccagcuuuguucuuuuugcuuaggaaugucuuggcuacauggauucuuuuuugguuccauaugaaauuuaaaguaguuuuuucuaauucugugaagaaagucaaugguagcuugauggggauagcauugaaucuauacauuugggcauuauggccauuuuccugauauugauucuuccuauccacgagcauggaauguuuuuccauuuguauccgcucuuauuuccuugagcagugcuuuguaguucuccuugaagagguccuucacaucccuuguaaguuguauuccuagguauuuuauucucuuuguagcaauugugaaugggaguucucucaugauuuggcucucugucuguuauugguguauaggaaugcuugugauuuuuucacguugauuuuguauccugagacuuugcugaaguugucuaucagcuuaaggagauuuugggcugagacaaugggguuuucuaaauauacagucaugucaucugcaaacaaagacaauuuuacuuccucacuuccuguuugaauacccuuuauuucuuucucuugccugauuucccugaccagaacuuccaguacuauguuaauaggaguggugagagagggcauccuugucuugugcagguuuucaaagggaaugcuuccaguuuuugcccauucaguaugauauuggcuguggguuugucauaaauaguucuuauuauuuugagguaugcugauuuugaacuuuuuaaagcaauuuuauuccuaaguuuuuuaacuuuuuugaugcuauuauggauggaguuuuaaaaauuucauuucagauugcacuagcauauauggaaaugcaguugauuuuuguauauggauccugugacuuagcuaaguuucuuuacuaguucuagagagguuuuguuuuguuuuauuugucaauuccuuagaauucacuacucauaagauaaaguaucauccuugaaaaugauauccuuggagguccacauuacucuuauucaagugauguugccauagcuuaaaacauuuuuggaaguccuuauucaggcuuucuuacacaaguuaccaagcacauaagaaaaucaguuuuuauuauuuauuagugugugucuugcuuuaauuuuucuucuucuuucuuuuuaucuuaguaucuuagaucuguacugaggauauguuauuuuuuauauaucugauagaccaagcuuguccaaccuguggccugcaggccacaugcggcccaggacagcuuugaaugcggcccaacagaaauuuauaaacuuucuuaaaacaugagauuuuuuugugauuuauuuauguuuguuuguuuauugguugauugaucgugcccaaaagcugucauuaguguuaaugcauuuuauguguggcccaagacaauucuuuuuccacuguggcccagggagaccaaaagaugaggcaccucugugauagacauuaaaggaugaaauuuaggcacacaguuuuauauaugcaucugacauucaaggaaaaagcuguggauggaagguuaagcuugugaguugucagaucauaguuaaagccaugggaucagauaugaucaccuaaagagauuaacuagaaauccaacaacccucagaaguaaaauugaguagguccaaaaaaaggcuugagggaugaccugaggcuggaaucuaagggguuugagggaagcacuuuaagaauacuacuaauuaaucaucaauucauuugugagccaccugccuggaugaaauauuuuguuaauuuuuuuuuuagucccucauuauuguuuugaaagaguauacaugucuuucacaggaaauuaaucucuauaaguucagugaugcauguacugcuuuuccuuuugaaucauuugaauagacauuacuugucauuuuuuuccuccagagcaauaugauugguaaucauuaaacauuuuagucauuauuccauacuaauuuaacagccagcuugguauauuauucugcuucuguuaucuacauugcaaauauuauugacuucaugagagucaucccaaauaaucugcuuuucuuucauuccuaggcaaauacuguggucugggguugcaaaugaaccauucaauugaaucaaaaggcaaugaaaucacauugcuguucaugaguggaauccauguuucuggacgcggauuuuuggccucauacucuguuauagauaaacaagguaauuuucaccuuuugcaaugguuccuacaguuuguaauuucuaacaacaaaaauaaaaugcuuuuuuuaaguaccuguuuucugaaauuggaauagagcagaaagacugaacaauuaauagcacauauauaaauuugacaaauaaggugaguucaguuucaaaguuccaaaaauaaaaguacauaaacguuacuucccuuuccuuaguaaaggaaauacugcugaaaugcugauuuuuuuuauuuuuauaagauuggaacacgagcuauaauaacuuuuuuuuuuuuuugagacagaguuuugcucuuguugcccaggcuggagugcaguggugugaucucggcucaccgcaaucuccaccucccggguucaagcaauucuccugucccagccuccugaguagcugggauuacaggcaugcgccaccaugcccagcuaauuuuguauuuuuaguagagaugggguuucuacauguuggccaggcuggucucgaacuccugaccccaggugauccgccuggcucggccucccaaagugcugggauuacaggugugagcuacugcacccggccuauaauaacauuuuuaaaauuuauaaauuauugaaauguuuuauaucaauuuaaaacauuauuauucacaguuuaccacuucauagugcuguguuaaagaccauacuaccauuauuuucaaagaauaagaucucacauccccaggaguaccugaggagugcugagacagcaugaaauaaacaugggauauuucuaaauugcuaauguuuaggaggaaaaugugguguaaagggggaaaauuaaaaacaagguuauucagaugcuggugagguuguggagaaaaagaaaccguauacacuguuugugggaguguaagucaguucagccauuguggaagacaguguggcaauuccucaaagaccuaaagacagaaauaccauucaacccagcaauccuauuacuggauauauacccaaaggaauauaaauuauucugucauaaagacauaagcauguguauguucauugcaccgcuauucaauagcaaagacuuagaaucaccuuaaaugcccaucagugauagacuggauaaagaaaguuuuggacauguauaccauggaauacuaugcagccaugaaaaagaaugagauguucuuugcagggacauggauggagcuggaagcccuuaucuuuagcaaacuaauuaaugcaggaacagaaaaccaaauacugcauguuuucacauauaaauaggagcuaaauuaugaaaacacauggacauauagaggggaacaacacacacuggggcuuuugggagggugggaggugggagaggaucaggaaaaauaacuaauggauaccaggcuuaauaccuggaugauaaaauaaucuguaaaacaagcccccaugacgcaagcuuacuuauggaacaaaccugcacauguaccccaaacuuaaaaguuuaaaaacaaaagauuaucaaauagaauaaaauccaaaauuuaccugaaucucuaagauaaaaugcaagaccugcaugaacucucucacguguuuuagcugcugugggauguguucauuucccccugcuauauagggguaccaugaugagaaaguuuaauaaguguugcuaguacaagaauauaucaaaacaaucauuuaaauuuuuaacaguugauuauuuugauauucagcauugaauuaaguuaccauuuaaaaguuuaaauuggcuuuuacuucauauuguauaaaugaggagauucucaagaaccuccuaguugugagaaugcugggcacugggaauuauaggggaaagcaagcgauuccuccucagcuauggugggcuugagauaaacacgauaugucuuauugaaaguuucauauagaaagugauagaggagagagcuguucuguguggaggaaccugccuuuccuuaguuuauaagcaguagggcaagaugugaaggcuaacaaaaucuuucauaguaaaugagaaggaaaauucauuuggaugaaauaauagaaaagaacuagaaacauuaugccaaaugaacaauuaauauuuucgacagaaccaggaaaacuuagucagugugauguuauggaaaggacucuugguaucccugccucugccacgugcuagcuggcuaaccucuggccagucauuucaccacugugaguuguaucuuugaauggauucguugugaggacugaaucuaauaaaaacauguguacuguuuguaggcucaugacauagcagacacauacaauguuaguuuccccccuucuaccacuguacacaugcauacacguguuccccaccccuaccaccaaaagaguaauguagagaacacaagugagaugauaauggauuaccguccuuuaaguuuuacuuauugaaagucuuggguugauaggugagaggauagaaaauaaaguuaauuugcuucuuauuuucauuaaguuucuuaauaucagguuaaauuauuuauuuugauucauauuuuugcuuuucucuguuauuuaucaaguugaagguuucuggaaaauaaguauccuguuuuuuuaaaaaaagguucucauauuagauauuuaaauuaugaggcuuuuuggcccacagaaaccuuaauguccugcaugaaauuuacuuaagaauuggcuaugaccucagauaaaagaaucaguauguuguguagcuuacaaaccuguaccaaauuucaaauggcuauauucuauuuuagaugaaucuuagcuuccaaagauuuuugaaacaaccaccuuaaucaggaauuucuugauacuaaaacuuuccaaagucauaaucaucuugggaaaucucauuuaacagcuccuaaaaucuuauuauuuuuugccugucuuuaucccauccaucaagcauuuguuuuaucugaacuagaaugaauugccugaacuauauucaagacaacacugguugaauuucuuauuacuucuucuuggguggcuuuuugaugacaauuucuuauaaugacucauuaauuugaagguugcuuggcuuugguugagguccucaguauauuuuuauccaggaaacuuaacugccacaaugaauuccauaaauauuuucaaggaaccuagcuacaugucccuagccuagaagucuaguugaagauuuagaguauuugggaaugaaaagauugugaaaaauauugcuucaucagcuacuucauuuguuaggcucucaagaugacuuguguuauagcauggguuguugauagagucaucauuuugcaugagauagacuaauucucauuaccuugugcaagagcccauuauaaaaaucuauuccuuuugauuccuuauuuccugcccuauacuuggcaccaaggaaacagcaguagauaagacacaaucacaccuucauggaacuugcaguauaggguuggaaaaagauauuaaacgauuacuucauugcaacuaugaaauaaaguauggugaaagaaucaccaaaugauaggggccagagguguguggggaguggaagauugauaaaaagcagaguuuuccugaggaagucacuuuuaagcugagaagugaaggauuggaguuuccaggcagacaaggaaggaaaaacauucuacagaagggaacagcaggugcaaaaaccugaugguagagaagagcucugggagaacuggaaaagaaagcagaguagcugaaguagauuggguugggggagaguaggcuucauuauucugaaccuuacagaaaauguaaggguuggagcuuuuuccuaagagugcauggaagcuguuaaggaagauguuaagaacagagaaguggugugacuggauuuauguuuuuguuuaugcagucuucccugcucugugaagagcgggucaaauaaaaguaagaauaaauguagagaggcccguuaagaggcuguccgaggaggcaaagcagagaugauugaauuaagaggucucguuauaaauguaacuagaauuaugccaguuuguaaagacuguagagucagacauaucuucuauagggaacauuucgaugaauuagaguuuaucuugguggaauuuaagcucuaggaagagucuuugagcauuaggaagcccucuuggguaaagcucugagcuacaguaaugcccggguuguaucuugggcucucuaccuggaguccucuuccacuuucauuucuaguuuucauuaaauuuuuaauaaagcuuuuuccccccucugcuauuuuuaaugaucuuugagcaauaguuuucagcuuuuuucauuaccaguuaucucuuuccauuuucaccuauaaaccucauuuuugaaagauagugaaaggaaaaguucccauuuccucaagcaauuugauauauagaaauaugaaucaagacuuccaacaacuaugagaggacuaauaauuucuacucuaaaguagcauaaucucaacaaauuucaacuguuccacagaagcagccacuaaauacuuccuuauacaaacaaccacaucuauaguccucauaauagguauucucucuaacagucuauucgccacacagugaacuauaauaaauacuguuaaucaguuuucaucuaccacggccagacuuucugaaaauuugaacguguauguggaccuuugugguaucuuggacuuuuauacuggcaaccccuguuuagaagcucuauagaaacuccugaguuacugcugguguuacugagugaggcagaaccuaccacaguaagguccagacucagguaacuuggaucuuuuaauuuaguauaauaaugaauguggccaggugcggugguucacacuuguaaucccagcacuuugggaggccgaagcgggugggucaucugaggucaguaguucgagacaagccuggccaacaugaugaaaaccugucuuuacuaaaaauauaaaaaauuagccgggcgugguggugggugccuguaaucccagcuacucagggggcugaggcaggagaaucguuuguuuguacccgggaggcgaagguugcagugagccaagacugcauuacugcacuccaaccugggcaacaagaaugaaacucuaucccaaaauaauaauaauaauaauaauaauaauaaaugcuacugacauuuuauucugaaaaguagauuuaaaaacagugguugucauuggaauugaaaaauaaaaugaauuuuauagaugaucuaaauuucuguuuuugaaucuguucaacaaugaccaguuucuaggaggaacuggacauuuguagaaugguucugggugacgaauuuuuuaaguuguaguuauaaaacagugaacucaaaagaaauauauacauuugcauugaaagcuucaaguccuucaagacagcauuuauucauauguaccauaauuggggugugugugugugugugugugugugugugcaugcaugauuggaaaguggugauccugguauucuuuuuggagaacaugaaauugucacuuaaaacauaauacugaaucuuacuacuuuagauuucaccaacucgaaauuuuguagugcucagucuauaaaguuugccuuuauuuuggacgggagaaauaguaaauaguuuaaaauuucaugugaaauaauguagauauuaauauaguuccuaaucggaacucauaaacacauguucauucauugucugccaccccuuagaaucugaugacagugcacuuaagacuuguaaacagcugagccuggaaaauauucccauuuaacaagauuaucauugcuauaugauggauuauuuuuagaauuaacaccaauaguauaaaaaauauuugcugcauuuuuuaaccacaucauuuuugcaaauauuugccauuuuuucauucuuacaucagauuauaugaguuugcaaaugaaacguagggcugacuagauaauuccuuucuagcagaguccaaauuucuguaaccgguuauuuuuuuccugcauggaauguuuucggcuuugaaaauagagugugaauuccuuagauuguuugccuucuuaaccguacaguaauuuuauagaaucuguuuuguuuccaguacuacaauuggcuagguuccuauuuguuauuuuuauauuggguuccaaauuuugguuccuguaucuggcaaacauuuuaaaacucugauacuauuaaacuuaguaagauuuuauuaaugaaguuucaguuuacauuccuaucuuuagauaugcuuuuauuuccauacaaaugaguauguauaauguuuguauguauaauauaauuaacacgcagaagaauauuuguaguuuggugucaguuuguagaacaaaggugcugacgaacaaaguguuaccaauuuugcagagaaagagaauuuaaacacuuaaucuguuaagaugguguuaaccugaagaggcaauucacauuacaggauagaguuuauuccaagcuguuagauaaaccugaagagcaucuuaaugauuuuaauguuuucuauguuuuuaauuuuuuuggcauauuaggagugcugagaagagacuacauacguguuugugcuguccugugcuguacaguggcucuauccuucacuguugauaaauacuaauguauuuauuagcuuccuagauacuguguaggucacaaaauaauuaugcuauauuuuaauguuuuguauucauuuuuuaguguauggagauuuagauaaggaguuugauuugauccaguuaaccauguguagcuuauagcguguuugacuacauaguuuauugcuuaggcaacugagcuaugcuuuauaucauccauaggaaagcauuaauuauuuucaucugagaaaauuuuuucugggcuucuacuguggacucugcuuucauagaugacauuguuauauucuuaagagaaacauaagguuuaguguccacucucaguauguaaaaggagagaagagguaaaauaccuaguauagugucugguacuuaguaaauguuaauuggcucugaaucacuauaaauuauguuguacuauacuauauauguaaauuucucuuaacagaauugcagaugcuaaaaaaucaaugccagauuccuauaauaggagcaaggaauuagucuuaggaccacacaauaauauugucaggagaauuuagcagaagaccaggcuuauccuacauccuuuagcacuugaacagaguagcuguucauauaucuacgaugcaaggcuauugacaagaugagaacuaugaaagcaagaccacauauuguuuaaggcucugggaaauugguuauuuaaauaauuuuagaucacauaagagagaagaaugaauagguguacauuuucuuguuucggccuauauuuucuuauuucuaguaaauaauacaguaacuuuggaacaguacuucugugcuuucuuuuuugagauggagucuugcucuggcacccgggcuguaguacaguggcacgaucucagcucacugcagccuccgccucucggguucaagcgauucuccugccucagccucccaaguagcugggacuacaggcacacgccaccaugcccggcuaauuuuuuguauuuuuuuugguagagacgggguuucacuguguuagccaggauggucucgaucuccugaccucgugaucugccugccucggccucccaaagugcugggauuacaggcaugagccaccgugccuggccacuuucuugaguuagaauaaauauaggcacuugaguucaacugugcaaaaauguuuacagcaaauauaguugucauuauaccaacuuauugugguaagugauggcuacugacacuacugagggucuuuuucaauucauucaagaacacaaaacaguauugaaggaaaaucuaaauaaauauauuuugcaacccuacaaucucagaaauagccaacacugucaaucaaaaauauuucuaugauaguaaccaaugugcugauauuuuuugauucauuuguuaacauaaaauauauuuucaugguauuauauaugggucaacauaagauuucaaguuuaaauauuucaugcaacaguuacaaaguucucuagccuuugcaguuauuaugucuugaaaauguuuuuaauuguacuuuauuuuuuuuaaauguauauaucaguuauggcagauaauauagcuaacuaaguuugcaacugucuuaggaaaucugauguugguguuuucagaaaaccugacguuccucaggcuguuauugauuauuggcuugccuucacauuuguauucucuccugcucuuucucacaaucacauuauccugccuucagagccccaucugagaucugccugcucuggacagcccucuaggauuagggaaggcagguaauggggaaggauagaaacucuuuuuauagauacuaugguuacacuuccuuuggguuaaacucuacugugaagacuaguguauauucaacacugaagaugcucuuuugggggcuauacagaaaaagagggaaugccaguuugcuucagcagaaucccugagggcauucuguuuacuacugccaucgcuguuaucuacaacacccaaaugaaguguaccauaugugugauacuucgugcaguaauguguuacagucauuuguauguauuguuugauuaaaauuaccagaauaaaauucuaugcagaggcugucaguuuaaaacguagcaaauaacaggcaugggggcucacauaugucuucucaacaguuugggagguugacgugggaggauugcuugaggcugggaguuccagaccagaaagguagugagacccccaucuuuaccaacaauuuaaaaaauuaguugggugugguggcacaugccuguaguuuuagcuacuugggaggcugagguggaggauugcuugagaccaggaacuugaggcugcagugagcuaggaucaugccacugcacucuagccucggugacagagcaaggaaaaagaaauguaaauuauauacugccccguacuuugaacauaucacugauuuuucuaguauuauaggacauauuaaaguggauccagcaagauaaguguuuucucaguauuuauuauaaucuaagcacuucacauguaauaaguucaucuuuuaaguugcucaguccagaaauuuuaguguaucuuugacuccucucuuuuucucaagcuucauauucagcugccaauucuucgaauauauauguacauguaccagaaucugacuacaucuuaacagcucuacuacuaccacucuauuucagguuccaacuuuuaccucaauuacggcaauaaauuucuuaccuuuguuuuugcuguuuucccccuucaaucuacucugaauucaguggucaguaugaucuuauuaaagugaaaguuucaucucacucuaccaacuauccuuaucuccaagaugcucuagcauucagcuucccauuacucaucugacuucaucuuuuacuugucuacuguggccucaaacaugcugagcacauuuccuaacagggccuuugauucccgcugccuguucucagauucaaauaccuaacaccucacucccucaccgauuuuaagaguuuuacuuaaaugucaucuucacagugaugccugaucugaccacuguacuuaaaauuguaacucccuaacuuuuuaaaacuuccuuguucucauuauuuuucuaaaguacaauacacauucuaacacaguauuuuuuucuuacuaacauugucuuuuaccucccccaccccacccagagguauacucccuauacgaaggaauuuuuaucugguuguucuuuguuuuaucucuggugccuagaaugacaucuggucauaacacaugcuuauuaaauauaugcugaaugaauaaaugaacgaacugccagcccuggcucuuuuacuaggcuuuauuucacccaucaauacagauaugcuacauaugaaaggacacuguuauucuaugauaguuucuuuuuauuuuauaacagucuuauuaaguuauaauucacacaccauacaauucccuuauuuaaaauauacaauucagggggguuggccaaggugaccaacuaaaaacagcuagugugugccgccuucauggaaagaaauagaaggggcaaguaaauacagcacuucaacuggaacacccagguacacaaacggauucaucaagaaaacaacucgacugcauuccagccugggcaacagagcaagacucugagaaagaaagaggaagaaagaaagaaugagagagagagagaaggaaagaaggaaagaaagaaggaaggaaggaaggaaggaaggaagaaagaaaggaaagaaagaaagaaagaaagaaagaaggaaggaaggaaggaaagaaagaaaaagaaagaaagaaagaagggagcacaggguuggggguaaggucacagaucaacaggaucccaaggcucccucucccucucccucucccucucccgacggucucccucucaugcggagccgaagcuggacuguacugcugccaucucggcucacugcaaccucccugccugauacuccugccucagucugccgaaugccugcgauugcaggcacgcgccgccacgccugacugguuuugguggagacgggguuucgcuguguuggccgggccggucuccagccccuaaccgcgagugauccgccaaccucagccucccgaggugccgggauugcagacggagucucguucacucagugcucaauggugcccaggcuggagugcaguggcgugaucuuggcucgcuacaaccuacaccucccagccgccugccuuggccucccaaagugccgagauugcagccucugcccagccgccaccccgucugggaagugaagagugucucugccuggccgcccaucgucugggaugugaggagccccucugccuggcugcccagucuggaaagugaggagcgucuccgcccggccgccaucccaucuaggaagugaggagcgccucuucccagcugccaucacaucuaggaagugaggagcgucucugcccggccgcccaucgucugagauguggggagcgccucugccccgccgccccaucugggaugugaggagcgccucugcccggccgagaccccgucugggaggugaggagcgucucugcccggccgccccgucugagaagugaggagacccucugccuggcaaccgccccgucugagaagugaggagccccuccgcccggcagcugccccgucugagaagugaggagccucuccgcccggcagccaccccaucugggaagugaggagcgucuccgcccggcagccaccccguccgggagggagguggggggggucagccccccgcccgaccagccgccccauccgggagggaggugggggguucagcccccggccuggccagccgugccguccgggagggaggugggggggucagccccccgcccggccagccgccccguccgggaggugaggggcgccucugcccggccgccccuacugggaagugaggagccccucagcccggccagccaccccauccgggagggagaugggggggucagcacccccacccggccagccgccccauccgggagggaggugggggggucagccccccgcauggccagccgccccguccgggagggaggugggggggucagcccuccgcccggccagccgccccgucugggaggugaggggcgccucugcccggccgccccuacugggaagugaggagccccucugcccggccagccgccccguccgggagggaggugggggggucagccccccgcccggccagccgccccguccgggagggaggugggggggucagcccuccgcccggccagccgccccgucugggaggugaggggcgccucugcccggccgccccuacugggaagugaggagccccucugcccggccagcugccccauccgggagggaggugggggggucggccccccgcccggccagccgccccguccgggagggaggugggggggucagccccccgcccggccagccgccccguccgggaggugggggugucagccccccugcccggccagccaccccguccgggaggugaggggcgccucugcccggccgccccuacugggaagugaggagccccucugcccggccagccgccccguccgggagggaggugggggugucggccccccgcccggccagccgccccguccgggagggaggugggggggucggcccccugcccggccagccaccccguccgggagggaggugggggugucggccccccgcccggccagccgccccguccgggagggaggugggggggucggcccccugcccggccagccaccccgucugggagggaggugggggugucggccccccgcccggccagccgccccguccgggagggagauggggggggucagcccccccgcccggccagccgccccguccgggaggugaggggcgccucugcccggccgccccuacugggaagugaggagccccucugcccggccagccgccccguccgggagggaggugggggggucagccccccgcccggccagccgcccccuccgggagggaggugggggugucggccccccgcccggccagccgccccguccgggagggaggugggggggucggcccccugcccggccagccaccccguccgggagggaggugggggugucggccccccgcccggccagccaccccguccgggagggagaugggggggucagcccccccgcccggccagccgccccguccgggaggugaugggcgccucugcccggccgccccuacugggaagugaggagccccucugcccggccagccgccccgucugggaggugugcccaacagcucauugagaacgggccaggaugacaauggcggcuuuguggaauagaaaggcgggaaagguggggaaaagauugagaaaucggaugguugcggugucuguguagaaagaaguagacaugagagacuuuucauuuuguucuggaucucaaauuucauaacgcaugggcccuuuucaccaaaaaauaauuuccauggguuccaauugaguagcauuaacuguggaacuaacguuccauguuauacaaauuucauccacagacuuccaccucuggcaauuacuaacugguaccagaucuacccuccucugccacuguaaacaaucagaaaacugagcaaaauauuggaggcaaccauuuucaggcaagggacaacaggcagugcagaaccagagcaccugccggcagggaagcagcugguaaauauguggauacauacaaaacagcagcuuuucuuuuguccucuuaauuuccuuaagaugcaaguggcuauuuaaaauaauaauauugcaaggugagguuuacauacacacacacauacacacacacacaggaggacugauuuauuacuauaaaauggugaaaucuauacauaaguucaaaagaauuuagauucuccucaaugugaauaaacaaaaauuuaaaaaucuuaaaaaaaaaaaaaaagaaagaaaggaaggaagaaagaaagaaagaaagaaaaauucaucuccuccccucauauaagcaccaaauaauuauaguagcauauggaguggccaggcgugguggcucacgcuauaaucccagcaguuugggaggccaagguaggugaaucaccugaggucaggagcuugagaccagccuggccaacauggugaaacccugucucuacuaaaaauacaaaaauuagccaggcaugguggcacgugccuguagucccagcuacucgggaggcuaagacgagagaaucgcuugaauccgggaggcagaaguugcagugagccgagauugcaccauugcacucaaggcugggcaacaaaaaagaaacucugucucaaaaaaaaaaaaagaagaaaaaaaaauagcauacggagugagaggauggauaagugaaccuggcacauauuuggugcucaauagauguuuacugagugaagaauaauuaaauggcaagaaaauaguuaucuuagaagaacaaaugagaagggaaucauuucuggcuggggacacccaggaguugacauuugaauuugaccuugaacaguggguaggaugcuuuuggugaugagaaacccauucuagguaagggaggaaugccaggaaagaguagggacuuaagaaugugcgaguaugccgggcgcgguggcuccugccuguaaucccagcacuuugggaaguugaggcggacagaucaucugaguucaggaguucgagaccagccugaccaacauggugaaaccccaucucuccuaaaaauacaaaauuacccaggugugguggcacaugccuguaaucccagcuaccugggaggcugaggcaggagaaucgccugaaccugggaggcagagguugcagugagccaagauagggccauugcacucuagccuggaugacagagcaaaacucugucucaaaaaaauaaaaaaaaaaaagaaugugcaaguuuauagcagaagggcugguggccuauugggauggaaaauuuaaagacaagcaguaggaaucaguugggauuaugacaggcagcuuuggguuugaaaaaggaaguuccagaugucaaagcaguucagacugaggggaggcuuuuaacuuuuuaggauaacaucuauaaguuucaauauauggaaaagauaucugcacucccaucuuuaucgcagcacuauucacaauagcuaaaauauagaaucaaucuaaguauccaucaauggaugagugaauaaagaaaaggugauguauacacaauggaauauuauucagcaaugaaaaagaaugagauccugucauuugcagcaacaggcauggaacuggaagucacuguguugugaaauaagccaagcauggauaagcaaauaucacauguucucacucauauuugggagcuaaaaacguaaaucucaugaaguuagagaauagacuggugguuacuggaggcugaaaggggaggagguggggggaugaagagagguugauuaauggguacaaauauacaguuugauagaagaaauaagaccugguguuugauagaucaguaaggugacuaugguuuacaauaaucuguuguauauuuugaaauagcuagaagggaauaaagcaaauguuuuagcauaaagaaaaguauucaaggugaugaauaucccaauuacacugauuugaucuuugugaauucuaugaauguauuaaguuaucauauguacuccccaaaauagguacaucuauuauguaucaauaaaaaaauuuaaaacaaaaaaaaaaaaaaaaaagaaaacaacucuacucacagagaauggaaaaaagcaaagcaggacaaccacccacucaggaacgacacagggccagaggagccucccccacccagggaaguggugcuggaaaauccgaggugacuggggaccagagcaggccccuaguuuacuggaguagucauggaaaaguggccagacuguuucuuacaugggucuccacucccauaucuccucacugggcaaguccuccaggcuuggguuuccagccucccuucacugggacuuuggagccaguagcagcucugcagcaaccugggacagagcucccacugggagggugguguuuccaucuuuucugccuugcagcccucaccuuugcuguuuccaggcucuggagaguccaugggacugaagccuggucugaaccccaagcacaguacccaucucaccaaaaaguggucagacgguucuccauguagauccugguccucacuucuccucacuggacagggcugccugaccugggacuccagcacaaccacuguacccccaccugaccacuucaauuagaggcagcccagcaguuaaaggaacacccacacagagagaugagaaagaacuaacacaagaacuucagcaauucaaauggccagagugucuuauguccuccuaacgauugcacuaguucaccaaugaggguucuuaaccaggcugaguuggcugaaaugacagaaauagaauucagaauaugcacaggaaugaagagcaucgagauucaggagaauggcaaaacccaauucaaggaaacuaagaauuaacaauaaaacaauacaggagcuggcagauaaaauagccagugcaaaaaagaaucuaacugaccugauagagcugaaaaacacacuacaagaauuucacaacccaauugcaaguauuaacagcagaauagaccacgcugaggaaagaaucuuggaacuugaagacuggcucucugaaauaagagagucagacaaaaguaaagaaaaaaagaaugaaaaggaaugaauaaaaccucuaagaaauaagggauuauauaaagaagccaaaucugcaaaucacugauaucccugaauuggauggggagaaagcaaacaacuuggaaaacauauuucaggauaucaucuaugaaaauuuccccagccucgcuagagaggccaacagucaaaauucaggaaauacagagaaccccugcaagauucuacacaagaucuccccaagacacauaaucaucagauuuuccaaugucuaaauaaaagaauguuaaaggcagcuagagagaaagggcagaucaccaacaaagggaaccccaucaggcuagcaacagaccucucagcugaaacccugcaaacuggaagagauuggggaccuauauuugacauucuuaaaggaaaaaaaucuucaagaauuucauaaccagccaaacuaagcuuccuuagcaaaggagaaauaagauucuugucagauaagcaaaugcuaagcgaguucauuaccaccagacccaccuuucaagacaucuugaagcuagcacuaaauauggaaaagaaaaaccauuaaaacaccacuaggaaaauacacucaaguacacacaccagugacacuauaaaggaaccacacaaacaagccagcauaauaaucagcuaacaacacaaugacaggaucauaugcacacauaucaauacuacccuugaauguaaauagccuaaaugcccuauuuaaaaaggcauagaguggcaugcugaauaaaaaagcaagacccaaugauacgccgucuucaggaacccaucucacaugcaaugacauccauaggcucaaaauaaagggauggaggaaaaucuaacaagcaaauggaaaucagaaaaaugcaggcauugcaacccuaauuucagacaaaacagacuuuaaacgaacaaagcucaaaaaagacaagggcauuacauaauguaaagcauucaguucaacaagaauaccuaacuauucuaaauauauaugcacucaacacaggagcacccagauucauaaagcaaguucuuagaaaccuaaaaagagacuuaggcucccacacaauaauagugggagacuuuaacacuccacugacaguauuagacagaucaucuaagcagaaaauuaacaaagauauucaggaccuaaacucaacacuggaccaaauguaucuaauagaccucuacagaacuguccauccaaagacaauagaaaauacauucuucugauugccacaugacacauacucuaaaaaugaccacauaaucggacauaaagcaaucagcagaugcaaaagaaccaaaaccauaccagacacacucucagaccacagugcaauaaaaauagaaaucaaaacuaaaaaaaauggcucaaaaccaugcaauuacauggaaaugcuccagaauaacuuuggaguaaauaaugaaauuaaggcaaaaaucaagaaguucuuugaaacuaaaugagaacaaagauacaacauuccagaaucuccgggaugcagcuaaggcauuguuacaagagaaauuuauagcacuaaaugcccacaucaaaaaguuagaucucaaauuaaccuaacaucacaacuaaaagaacuagaaaaguaagagcaaaccaaccuuaaagcuagcagaauauguauaaucaaaaucagagcucaaccugaaggacagugagacgcagaaaaacauucaaaaggucaacaaaucaaggaguugguuuuuugaaaaaaauuaaugauaggccacuagcuagauuaauaaagaagagagaagggccaagagcgguagcucaugccugaaaucccagcacuuuggaggccaagguggguggaucacuugaggucaggaguugguaaugagccuggcugacaugaugaaaccucgucucuacuaaaaauaccaaaaaaaaaaaaaaaauuagcucagcaugguggcaugugccuguaaucccagcuacccgggaggcggagguugcagugagccaagaucacaccacugcacugcacuccagccugggcaacagagcaagacuccaucucaaaaaaaaaaaaaaauuacuagcauuucuguacaccaaaaacagucaagccaagagccuaaucaagaacacaaucccauucacaauugccacaaaaagaauaaaauaccuaggaaugcagcuaacuggggaggugaaugaucucuacaacaggaauuacaaaacacagcucaaagaaaucagagaugacacaaacaaguggaaaaacaugccaugcucaugaauuggaggagucauuaucauaaaaauggccauucuguccaaagugauuuacagauucaaugaaauuguuaucaaacuuccaaugacauucuucacagaacuagaaaaaacuacuuuagaauucauauggaaacaaaaaggagcccaaauagccaaggcaaucuuaaacaaaaagaaaaaagcugcaggagucauauuaccugacuucaaacuguacugcagggcuacaguaaccaaaacagcaugguacugguacagaaauaggugcguagaccaauagaacagaguagagagcacagaaauaaggccacauaucugcaaccaccugaucuucgacaaagcuaacaaaaauaaacaauguagaaaggacugccuauuuaauaaauggugcugggauaacuggcuagccauaugcagaagauugaagcuggaccccuuccuuauaucauauccaaaaaucaacucaagauagauuaaacacuuaaauguaaaucucaaaacuauaaaaacccuggaagacaauguaggcaauagcauucugucauaggaacugucaaagauuucaugaugaagacaccaaaaacaaucacagcaaaagcaaacauugacaaauaggaucuaauuaaaauuaagagcuucuguacagcaaaagaaacuaucaacagaguaaacagacaaccuacagaauggggagaaaauauuugcaaaguguggaucuggcaaaggucugauauccaacaucaauaaggaacuuaaacaaguuuacaagaaaaaagaaacauuaaaaagcagguaaagaacaugagcagacacuuuuccaaagaagacacauauguggccaauaagcauaagaaaaaaagcucaauaucaucgaucuuuagagaaauacaaaucaaaaccauaaugagauaccaucucauaccagucagaauggcuauuauuaaaaaguaaaaaaauaacaugcuaaugagguuauggagaaaagggaacacuuaaacgcuguuggugggaguguaaguucaaccauuguggaaaccaguggugauugcucagagugcuaaaagcagggccaccauuugaccuaguaaccccauuacuggguauauacccagaggaauauaaauugcacucauauuguucauugcagcaguauuuacaauagcaaagacauggagucaaccuaaauguccauuaaugguagacuggauaaagaaaaugugguacauauacacuauggaauacuaugcagucauaaaaaagaaugagauuaugcccuuugcagggacauggauggaacuggaggccauuaaccucacaggaagagaaaaccaaauaccacauguucuuacuuuuaaguggcaguuaaauguagcacauggacacauaaaggggaacaauugacacugaggccuacuggagggugggaggagggagaggaacagaaacaauaacugugggaugcuaacuaggcuuaguaccuagaugacaaaagauacagcaaacccccaugacacaaguuuaccuauauaacaauccugcgcauauacccuugaaccuaaaauaaaguuaaaaggaaaacuaccuguuggguacuauguucacucucuuggugguggggucuguaccccaaaccucagcaccaugcaguauaccuauguaacaaaccuacacauguaccccguaucuaaaauaaaaguugaaauuaaauaauaaaauaucuguauauacaauucauugauuuuucaguguauuuagaguuguacaguuaucaccauagucaauuuuagaacauauuuaucaccccaaaggaaauuccuuaguuaguagcaguuauuccccauuucucuccucuuaacccccuacaauccuaggaaaccacgaaucuacuuuuuauugcuauagauuugccuauucgaaacauuucauauaaauguaucacauaguauguggucuuuugugacuagcuucuuucacuuagcauauuuucaaaguuuaucaauguuguagcaugaaucaguacuucauuucuuuuuauggccaaauaauauuccauuguauguauauacaccccauuuuguuuaucuauccauucaucaguugaugaacuuuuguguacaaauguugguggggacauagguuuuuaauucucuugggcauauaccuaggagugagauuucugggucauaugcuaacucuuuguuuaauauuuuaaggaacugccaaaccauuuuccaaaacaguugcaccauuuuacaauuuuacuaguacugcauaaagacuccaguuucuccacauuuuugccagugcuuguuaugucuuuuuuauuuucgccauccuagugaguguaugguggugucucacugugauuuuaauuugcauuucccugauggcuaaugaugcugagcaucuuuuuaugugccuguuggccauuuguauaucuucuuuggagaaaugucuguucauauccauugucuguuuuuaaauugguuccuuugucuuuuuaaugccacauaauaauauucuuuauucuggauauuagauacaucuguuuucauugauauaucauuugugaauguuuucucccauucugugugccaucuuucucuuucuuaaugguguccugugaaguacaaaaguuuuuaaucuugaugaacuuccauuuauuuuuauuuguuuucuugugcuuuugguguuuuaucuaagaaaucacugcuuaauccagaguugugauauucucauauauuuuuuucuaaaaguuuuauaguuucagcucuugaguuuagauccacuuuauuuuguauguaguuugagguacggguccaauucauuuguuuguuugguggauauccaguugucucagcaucauuugucuaaaagauaauucuuccccccauugaauugucuaggcacccuugcugaaacucaguugacuauaaauuugaggguuuauuucuagauuuucaauucuguuccuuugauuaugaugacuuauacauugcuaucagaaaucucuggggcagauggauuuuucuggagcuaggcuguguucuuauuagcugggagcauuguaguaaugacaauuuucuggaaggcuguuuacuugggaaaagcuuuuaagaaagacauuuuaaagcuucuuaauugccugcuuuauuugauguuguuuucuuuguagaguuguaaaggucaaaguguguacuuaaggcuuucuuuaucuucagucuucuuggcucuccuuguagcuguccauuuugaauucuuauuuuucuccuugagagcucuuugaacuuccauggaauuugagagcaacuuuagugaguugcacauuugcauggcauaguuuuggagucucagcacugcaugcacuuacaaccaaagcccuguucugaucaaauaauccauaguugaccagauuucuggcauguggcuggaagauaauggggccagcuggcagucuucuugugguuuaagugccauauuggaccacacaguaccuuucaucccaggcuauuaaucuuagaaauucaacuucuaaucuuagaagucggaaauuuuuuugguggagcagaaaguggaaaauugauucuuguugaugcugggcaaagauugacaggaauaacuagagaacugguaauucaauuugccugcucuucugguuggucaacugggugguagugagccccuauuuaggcaucuauccuauuaaauuccuaaagcacagauuuagcuuaacugucauucaaaugccugugguuuauaacuauuaauuuauacacuugccuugaaaauaccccuuucuuacugguacaacacaguuauuaagcucuaguucaagacacauuuuaguugaauaguaaacacaaaauuucuucagaauuauggaauaaaaugaucgauuaucauaugcuugcugugguaaccauuaauuuaacaaauauuuauauacuguucagugugcuaggagcuaucuccaucaaggguauauuggcuacccuugacacaguucuuuaaucaagcguuuauauguaaaaucacuuacuuuugugauugccuuggggucuucuuccagguuuucuucccugcagguuaguaaauaacuggacuuagccaaacaugcuaaugaucagaaacuuuuauucauccauugauucaauaaauaagucuccuguauaccauaugcuguuauugcuacuggaaauacaaaggugaggacaaacagccucaggcucuguccggggacuaggcuuuauagagugauuuugcuuauaacucuauaauuacaccaacaagucaggcuuacauauuaacauaacacauuacguuugacaacacagaauagucaucuguuuauuaaaacaaacaaaacuuaagugccuacugugugcuaaaggaauuugacuugugaagcugagggacagcuucugugaggaaguggcagugaagcugagcucuuagagaggaaucagcuaagcuaaguaguagugggaaagccuuacaagucgagagagcagcuugugccaggggaccaaaacaagacuggagcggcgagaagccaaggcagguacacacaagacugcagaguaagacaaggccagcacuucaagacucuguaggcuguguugaaggcuuugcugucuaaccuaagagaaggaagccacugaaaugguguguuuuguuuuguuuuuuuugcuuuuuuuuuaaccaaagccacuuuuuacauagccuaugaacuuggucuuaauuagaggcagauuaguucuugcucagcuguauugguuucuaggcagaaaauguuaaauuuuagaaguuuuauuucuuuagagcaaugcuacugcagcuuccgugugcuuaagaaauuacugagaggacuuguuaaaacagauuuuugggcaccaccgccagagauucuguaagucuggauggaguucaagaauuugaauuucuacuaaauuuccagaaggugcugaugcaccaguccugucucuggaccagauuuuaauuagcaguuauuaauaguuagagccauaaaauuaacucucuuugucauuauuuuccuuaugugcaaacagcaaagggucauuuuuaguuauauaauaaccaagaaauauuucuguguguggguagcuguauuuuacagaaaccacuuuaaagcuauaaauuuuacuuaucuaugcauguucuaaauauauauauauauauauauauauauauauauauauaaauacacauauacauauauguguguauaugguaugugacuuccugaggugauguaguaaacaguauugaggggacauugcuccaaaaaucaagaaacuuaauaucagaaagaaauugugauuaacaaaaguuggcaaaguuuuuaguaccacuuugacagugccauugagauuuuugaaaauuagaguaguacaguuugggauucugagacacuuggaguuucagcaagguaauccuguauauuaauggaaucaguuuuuuauuuuuguuuuucuagaucuaauuacuuguuuggacacugcauccaauuuuuuggaaccugaguucagguaugauuauauuugugacuuuuuuuuuuuuuuuugcuuaaauguuacuuuucauucacuucuucauuuucauucuguauacucuuaggguuaauguauauugugugauacauaucauuguuccgagacuucaauaaauuagagcuuacuuaaagcauaaagccauuuaguugcauguuuacauuuugcuuuuauuguagcauuuagaucugcaaaaugaaaguaucauuuuaauaugcuuugaaaguagaacuaguugcuuuucaaaaucuagcaaaacuccuaguaaaaguugaaaagguauuuaucuuuuuucaaaaaauugaaagagcaugguuuuggcuguuauagaauucugcaguguuguuacucaaguaccauuucuacuauuucucuucuuuaugccuuugucucuugccuagacaacuucuaaucgaguuccuauuucuguuugcuggcugccauucacacugcugccaaguuguuuccaaaauacauaucugaucauuucccugcauaaaaaucuugagaaacuacuuauuaugauaaaaaacaguuguccagauuuccuuaaccuggucuucucguucuuucacaagcaguccucaggccauuuuuccagucucaucuuauguucuccauauugaaaugacucuugaguuauuuacagugcucugagcucacagagcuuuuaccaggaaccacuugccuccucugcuuggcagaucauucucaucuuucaagagccaucuuacuaacuuuuccgaacuuacuaccacuuccccccaagaaccuuaauuuugucuucaagaaugguucugugugggaagggugcccucuucagcauuugagggggacguuagcugggguaacccuagcaucaguguaugguagacagcccuggcagagggucagcugcgcucgcgccacucuccagcuccaugaucugccacaacaaauccaagcucccauuaucccuguccggggcugcuguacuauugccuaauggugucccagccuccacucaugauuccuugcuaucucuuuucuucccaggagccagaauaaucuuuuuuaaaaauacuaaucagauuauguauguaagcugccaaaauccuuuacuggcuuccuauuuuuacuuagaaauauauuccauacucuucaccauagcccacaaggcuccugcauuaccugcccgucuguccagucuucucucuaacuaaccuuaguuuugcucucuggcaccuacuugcacugccguccccacuuccggacacacacuaggccauccugccucaugcugugcucaucccucugacuaaugugcauuucccaccacuuguucuagugacaccccuuagcucacugcugaggcuucacuuccuaagagccccauccugccacccccauucccugacugggggcgguacagaguccugcauaagagcauggacuccagaccccauuugcuaccugcuaacugugugaaugggcauacaguuccuuaauuucccuguuuccuaaaaugaggacaacacuagcaucuccuccauagaguucuuauauggauuaccuaaagcacuuagggugcuaccuggcaauucauuaaguuuacugaauuauuguguuacuuguauuaaguuagauuucuugcgguuauuucagcaugacuucauagcagaaucaaaaucaauuauuuguguaaguauugguuuaaugucuucuaccacuggaauauaaacucagugaggacaggggcaauauuugucuguuugacuuuuguaaacccaguaccuaguacugcccuacacucaacagacagcauaauagacacucaaauaaauguguuggguggauggguagcagcgugaaugaaugcaccucuuuuaauacagcuuaaauuggaucaauagaggguugguaaaauguauuauggcauauccacagaauagaauaucauuuagcucuuaaauuugaugaguagguuuuauaguagaaacaugucuaccauucauuaugaaauaaaauaaucaaggcaguauguaauaagacaaaaaaauguuucaaaugugugaguaaagacauauuauauauauauggauggaagaaagucugaaagggcuuuuuagaacuggugguccuggccgggcacagucauucacaccugaaaucccagcaguuugggaggccgaggugggcggaucaccugaggucaggaguuugagaccagccuggccaacauggugaaaccccaucucuacuaaaaauacaaaaauuagccagguguggugguaugcaccuguaaucccagcuacucgggaggcugagccaggaaaaucucugagacccaggagacagauguugcagugagccaagaaggugccauugcacuccagccugggcgacaagagugaaacuccgugucaaaaaaaagaaguggugggucuuugaggguagugaaauuaugguauucaccuugaacugaaaaaugugucugugauauuuuugggggguugcuuuuuucccuguaaaauacagcauuauguaaccuuuugcuuguuuucauuucucaguaaguacugcccagcugguugucugcuuccuuuugcugagauaucuggaacaauuccucauggauauagagauguaagccagauauaaacuuauuugaaaauugugauauaacucuauuuuuuuagaacuccagaguaguuagagguguguuaaucauauauccuuaucuuuugccuuuuuaagacauuuuuuaaucauauguguuuuauucuuuuucuucugcuaaaacuguuguguuacaguaccaauaaucuauuuuuguuuaugaaguuuaugaagaaacugccuagauuaacugauuucucaggaaguagagugucuuguuuaugaauuauuaagagaaaauuaaaaaugaaucuuuucuuuucccuuccuuaaguccucgccauugugcauggcuggugugcaugcaggaguagugucaaacacguugggcggccaaaucaguguuguaauuaguaaagguauccccuauuaugaaaguucuuuggcuaacaacgucacaucugugguguaaguauauaugcaauuuaaaaaauauaugcuauauauaauuagcauucuggguagcacugggcuaagaacuagcuagaucucagcaguaucacuguuaaugguguucaugaaagaacauuuaggcaguaagcacucacauuagugugcucagugucuguuuuuuuguuuuguuuuguuugagacagaguuucgcucucauugcccaggcuggagugcaguggcgugaucucggcucacugcaaccucuguauucugguuucaagcgauucuccggucucagccucccaaguagcugggauuacagguguguggcaccacgccuggcuaacuuuuguauuuuuaguagaggcgggguuucaccauguuggccaggcugcucucgaacuccugaccucgugauccacccgccucggccaccgaaagugcugggauuacaggcgugacccaccgugcccagccagugucugcauauuuugaagaguacaggugguguuguacuacuuuagcuuauuguucuucaaaaauguagucauuuggaagaguaauguguuucuucugucuuuucuaaguguuaaaaaaaagucuacauaagagucuagaaguuuguugccaaauccuuauuuauuuuacagauugaaaggcuuaacuacuguguuccuuauagcacauggggauucaagauaauugaaauacuuuaaauauaaauuuaaguuugacauaaaguguuacaucauaagcauuauugugaaucuuccuuucauucuaagagaauauuuugaagauguauuuucaugguaacuauaguguucuacuguuuuauaaaacguaggguaggcaucaaaagcaagagaaauugaaacauuaaauagaaaugcaguguuagcaaucuguuuuuauaaaucuugucucuuagaucugcucagucuuucagacaacacuaagccuaauugaaaccagcuuuucuucagagguccuaggccaauuuucauucagaagacacaagcaucauccauauccagauugguauacaacaggauucagcagauuuguucuguaaagauccagcuaauaaauauuuuaggcuuuacaggccacaugucgcugcagcuuauucuuuuuuuguuuuauuuauagcucuuuauucuuaacucacggcccauacaaaacaggccaugcaugggcagucauuugcccaucccugguauagauucaacuaccuucccuucuuuuuuuuuuuuuuuuucuagauuauuuuaugcagacccuuucauuccuuuaccauguuauaccuuuagaaagauuuaguguuugugaauucucucuuucauacuuuaaaaaagaaaacagggauaaauugcauccucuuguaaugguuuguauguuggacuaaaggcaggaguguacacugaaacuucuuccaugagauguugauuucuccuaaaaaaaaaaaaaaaaagaaaaagaaaucuauuaguacccaacuuuucucauguuuauccgaaaaaacuugagccucauucucugagaauuagaccuuuuaguguauuuucaucgaaagcauuugccacagaaaaguguuaagaauccauuuauuucaugaaauaaaguagugagagauugacaguaaacaaugaguaaauacauaugaaaaagaaguacauauuaaagauuacauagagaacuuuugcacaaucacauaugaaacugggugcuagauacuuguagagaaagcuguuuaugcugauuucagaaguuguccugcuuagaaaugagacuuuuuuccuaggaacaauauuaguugucuaauuuuuagccacacagucuucuugguucuuuuauuggguggggggaaccaaaucaaaagaaaauguuucacuaaauauggggcaucauguguuaugugaguaucaccaaaaaaaacccuucucucuuucaggggacacuuaucuacaagucuuuuuacauuuaagacaagugguaagccuuuuauggacuuuauaauuuuuuauuuauauaauauuuuuugaacacuguuaggcacugugucaguugcugauuuauuguacuuucucacguaguugucuuaauaacacuaugagguaagauaguuaucuaauaauauaaugaauagagcaaauugaaaguuuuauauuuauagagaaauggucauguaagcaaggaagguuccuuaagaaagaugacuuuugaacuugucugaagaaguaaucaauucguucaacagaaaauacuuacugagugccuucucuuuaugugccaggcauugcucugguucgagugauagaguaaagugaacaaacuccugccuuccuggagcuuacauucuaguagugagagauugaugauaagcaaugaauaaauuucuguuuauaauguacuguuuacaauaugauaaaagauguaggaaaauaaggaggacuggauugaaguugggaagggccuuccucccagggaagaccucagggagaaugcaacauaggccaaaaaccugaaggagguaaaggagugaguuacucaguuauuugggaagagugucccagggagaagauaauguaucuccauuaaacuaacagucaugcuuauaaaugagcauguuuguagguuuccuaaugauacacaaagacauaugcccaagaaacacuugccuaguuuugaaauuucucuguuacaguguauuauuaguguaguguauguuaauuaaagauggaauagaaaguuuucagugagcaggucuacaugcauuuugaaauuauaccuggaaaccaaauuuagucuuuucuuuguuucaggauguuauggaacacuggggauggagucuggugugaucgcggauccucaaauaacagcaucaucugugcuggaguggacugaccacacagggcaagagaacaguuggaaacccaaaaaagccaggcugaaaaaaccuggaccgccuugggcugcuuuugccacugaugaauaccagugguuacaaauagauuugaauaaggaaaagaaaauaacagguuaagagacaaaaauuuucuaaagcaauuuguaacacuuauuuuauuugaaaaacuaguaacaucuaagauuuucagagaaaauuaaggcauuaaaauuguaauuauaugguuuuauauuuucuucacugauguuaauauuacuagagacacauuuuaugaaacauggcagagaaaaggaguuauuuguguuggucaggguucucuaaaaggacacaacugauaggacagauguauauauaaaggggaguuuauuaagguguaucgacucacaugaucacaaagugaagucccacaguaggccaucugcaagcugaggagcaaggaagccauuccgagucccaaaaccucaaaaguagggaagccaacagugcagcuuuuagucuauggucaaagguccagaagucccaaagcuaagaacuuggagucugauguucaagggcaggaagcauccagcaugggagaaagauguaggcugggagacuuaagccaguuuagucuuuucacauuuucuucugccuguuuuuauucuggccgugcugaugcagauuaaauggugccgacccagauugagggugggucugcguguccuaguccacugacucaaauguuaaucuccucuagcaacacccucacagacacaccugggaacaauacuuuucauccuucaaucaaguugacacucaguauuaaccaucacaguauuuaauucguaauagcuuuuuguuuccauuguaaugagacucuuuuuuuaagguaguguuucaguaaaguggucuugagacaucuaaaauaacggucuccuacagucauuaagagaaauuuauguuaaaggaguccauuuuaaaugaugagaucauuaauuuuccacauguggagaguauaaauuuaauuuaggggaacuuagcaaauggucggaauaauugguugggauugguuuaauuuuguuaaaauauuuauuuuguuuugguacuguaaauaauaccaauaaucaucuuuaaucuguucauucccaggaagucaucuuacccaguagucaaaaucuauuuuacgacguuauaaacacaagacaccaaaacagaauaguucuuuacuuaauuaaugcccacccauaauccuuccucucucuccaagggaauaaggccaaggauuuaguaauuguuaugacaaaaacgugcacuuggauauggaaaugagccauaauuagaaauguucgagcugugcauuucaaguguuuauacuuugaugcugaacaaacuuagggaaucagaccaugugcauuaaugaaagcaacucuucauuccccaggcauuauaaccacuggauccaccaugguggagcacaauuacuaugugucugccuacagaauccuguacagugaugaugggcagaaauggacuguguacagagagccugguguggagcaagauaagguaaaaugauuaccaagguauuuuuaaaaaacauuuuuuaaaugggugguugccaagucacagagcucuccuguauaaaagagauguagaaguuuagaaugucuuauacuacccucuugugguuauuuuagguaguguuauuggccuuacucuacugacuuuagaaaauucucaguaguucuagguuccuuuuggugauuguaacggugaguacuuuucugauuuuugucauugcauuuuuaauugaauuguuuagacacuuuauuaagaaagucuaaaagggaccuuguaauuucuuauuuuuaugaagcuuuuuucaauucaccagaugauggagagccuuuguucccagauuucuacucuguaggcaagagguaaaaaaagaaaaaagcugaaaaccaacgugcauuaaauuauaggauauuagagaugaaaauucaucugaagaucaucucaccaacuuucaucuugggaaacuucuguuuuuucuuacaugaagaauugcucuagcaucuaauuauggaaucuuuguuuuaguuagcaacaauuuaugaagaugcuggaaugagccagaggaaaugauaagggguggggagcaggcagagaugggucuuauucagauguguaucccuuugaucuuuaaauggagaaguccuugugccuaaggaagauagaugucucccaucaguaccaaaacuauggggcugggcaugauggcucacuccuguaaucacagcacuuugggauugcuugagcucaggaguuugaaaccagccugggcaacauggcaacacgccaucuccacuaaaaauacagaaaauuagccaggcaugguggcgcaugccuguagucccaguuucuugggaggcugaggugggagaaucaccugaacccaggagguugaggcugcagugagcugugaucacuccacugcaauccagccugggcgacagagggagacucugucucaaaguggaaaaaaaagaacugaaacaaugaugacauuuuuucaaacuuuccuaugaguuugauuuugauuauauauuuuuguuuuuuaucauguaugauuugcuaaaaagucuucaauuacuacuuuucucaucucuuuguucaaaaaccuccaggggcucauuaucuuucauaugcaucuuaacuccucugcuuuuauucaaggccucuuucuucucuucuacuuggcgucacaugaacuucaucuuuggugagccucucccuguuaaagaaaauaacaauacugucuccauacauaucuucuaccucaugccccuaaacuugacuacucuuuacuccugccacauccauauucauuuguaucacauuuauuuugcuuguggaauauagcuaaauuuuuggaauguuaagaauuguucaggcuuauacuauaaaaacuucuaaacauuaaaugauauuucugaaaaagauucuauguugcauucauuuuugaaagguaauuucucuaaguguagaaaucuggguugaucagugguuuuuugguuuuuuuuuuuuuuugguuuuuccuuucaauaauugaaauacguugucugcuguuugcuggcuugcauuguuuuugacaagaauucugcuauuauuucuguuccucaauaugugauaugucuuuuuuucuguggcuccuuuuaagguuuucuuuuuaucauuuguuuuaagcaguuugauugauguggcuuuuuuauauuuuucuucuuuuuuuuuugcgugggguucuuugagguuuuuggaucuguagguuaugauuugcaucaaauuuagaaaauuguaguucuuuuuuuuucaaauauuucccuuccccaauucuaauuuuaugaauauuaugacccuugaagguaucuuaccauucaccaaugcuccguucuuuauuuuuuucagucuuuuucucuuuguauuuuaguuugaaaguuuucuguuuugucuucaaguucacuaaucuauucuucugaaaugucuaaucuguuaaucccauccaauguauuuuuaucucugauacuguauuuuuuaucucuagauguucaguuugggaguuuuaagaugucuccagugugucuuuacaugcucaugcuuuucucuaucucuggaacauggagcauauauaauagcucuuuuaauauccucaucugcuaauguuauccuaugucauauaugggucuuuuuauguugauugauauuauggaucauauuuuaccugcccgaauuuuuuuuauuggaugccagacauuguguuacauuguuuggugcugggguuuuuuguuauuaauauucccuuaaguauuuuugagcuuuauucuggaauguaguuaagcuacuggaaacaaugugauauuuucaaggcuugcuuuuaaacuucauuaggcaggaccuggacagccuucaguuuucuuauuuuucucccccacugagacaauacuguucuaaguacucacugcagcaucccauguauuaugagguuucucuguucuaccucuuggcaguguaaggaauucccagaucuacggagcugugagacuuguccugcugacucauuccaguguuucuuuuacuggccauaggucauuucuuuacaugcagcugaagauuuaagggauaacuccuuauauauucuagaagugucucucucucucucucucacucacucuaucuuuauagcucucuucucuccuaaucucugccuacaaauucuagcuaccuuauuggccucccacucucagcucugucucugcaacucagugagaccggcaggcucuguuagggaucucucucccugcacuguggccuggaaacucuucuauagacaguacuggggcaauaaauagcaggguucaccuuauuuguuucccuucuuuccgucauuauugcccaaggcagccuguuauccaguuucucagguacguauagggcugaacaauaagucuaauccguuacucuuauggucagaaaugcaaaucuucacauugaauuguaugaauuaacagucuuuucccgcucauguaaguccaucugcucccucaucaccuccaacccaaggguaauugguguauucauuuuaccccuuuucugagccugcacaugugcaugaguacgcagagacugcauuugguuuuguuuuuagaaaaugggauuuauauauauauauacaauuuguuuucauaauauaucacuuucuaacauuaugccauauuuaugugugguaaucaauaaaauuuaaguuucuugagggugggaacuguagcaaccauauccauuuucucuucaugacaccucacauacuucucuguacaugaggauucucaguaaaugcucauagguugacuauagcaaaucuuuuuuacucaguuuuuauaaaauugagacagcaauauagaggaauaucuuaaagauaguuuuuauguguuaaaguaaugauuuguuaucgucccuguuccacuaauauaguaagaaugaaaauaauugccuuucauuuuauuucagaguaauaucugaggaaaucacgggagcucacuaguauggaaguuauuguaacugcaaaacaaacuuuuuaggaaaugaaggauauuaacacaucuuucgagauuuauagucuaaugccaagugaauuagccaagaagaaauagagccacaauacuuggaaauagcuugauugagaaguuaaacauuuacuuaaucucaucuuagcugauuagaaaaaaaaucacuuugauuuuaggcaauauaugcuuauuaauggucuuuagaaacuaccuaguugaucugaccuagagaacaaacagggcucuuuuuagcuuauuggaguccauacuuaagucggaagacccagagucaaguugcugcccugucauugacuagcugugcaauccacuuacagauuccugugcccuccuauuucauaggguugucugaauuaguuacauuaaaauguuuuauaaauaauuaagugcugguccauuguaagauacuaucauuauuugcuugaaguaguuaagggaaugagacucaccuaaacucauauuuuuaccuagggauuauuuuuauaaugcauuuguugcuaguuaguuacaagcauuaaauuagucacaggccaggcgugguagcucacaccuguaauuccagcauuuugggggaggucuaggugugaguauacuugaggacaggaguuugagaccagccugaacagcauagcaagaccccuuucuacaaaaauaaaaaaucaccaggugcaguggcucauuccuguaaucucagcacuuugggaggcugaggcagguggaucccuugaggucaacaugguaaaacccugucucuacuaaaaaugcaaaaauuagccgggcguguuggugcacaccuguaaucccagcuacucaggaggcugaggcaggagaguugcuugaacuugggaggaagagguugcagugagccaagauugcgccacugcacacuagccugggcaacaaagcgagaccucuuuucuaaauaaauaaguaaauauugccacacauguuggcaugcgccucuguaguccuagcuacucaggaggcugaggugggaggaucuuuugagcccaggaguucuaggcuguauugugcuaugaucccgccaaugcauuccuuggaugacagagcaagacucuaucucuaaaaauaauuaauaauuuaagcauaaaauagcauuucaaagucacuucuaguuuaaauagcagcauggaacaaaaaccgggauaauaggagaacugucuuuaugcaguuuauccaguagguggagguauauaucuguuauauguuuguuaguauauguucaccuucagccuguugagagaaaaauuaugaaaaguacacaagcaaaauauuuccccuaagacuuggcaugaucaauuuuguuuuacuuuaaaaauaaaaauuaauauauuuaaauaguugguaauuccacaggacuagaguuacugauuuacuaauaggauaaauugucucacuggauuugaaaccuuuuacccaaaugccaaguuagcccucuuguuaaguucuuaaaucaucuuaaaaucauuucuauauuaaauauuuuuguuucauaaacuuuugauaaaaaugugcagcaucuuaauauuuuuccaaauuaugauuauuuucuuaaaaauugauccuuauuaucauacuuuccagauguaauuuaaggccuagagcaaagaacaaaaacauguuuaaguggagaaauuuagcccugaccucuauugauuugaaguaccaauuuuuuguuguuuuuuuaaagauauuucaaggaaacaaagauuaucaccaggaugugcguaauaacuuuuugccaccaauuauugcacguuuuauuagagugaauccuacccaauggcagcagaaaauugccaugaaaauggagcugcucggaugucaguuuauuccuaaagguaaagagacaguucguuuaagauauguuuuuacuggauugccaauuuaaaaugguuuugcuguucucagagagaguaauuaauaaugugagugucuuucugguuaaacucuaauuacaauaucuucuuaaagggauguuaaaaaaaaugguuacccuauuaaaaaguuaguuauaagaaugguuuccaaaauuauaaguggaagaagaaauagcaucauucauaagauaauguaaaugagaucacuuuccaaauuuaaucucaauccuaauaauuuuaaaucaggugucauguacuguaauauuuguuuaacauaagcaugaaagauuguaacaauacauuuaaagcaagaauaauuuaucucaauauuauacauuuuaauauacuguuuacuuuuguacgcccaaaggcuaccacagugccugacacaucguuggcccuccauaaauaacuauuaaaugaauugaauaaguacuguaucaaaauguggaugacuccuuuauagcuuuagcauucaacaucacuuuccaccccauuauucuucuuccuaagauuauuuucagaugauuuaauuauuuaaaaacugagaaauccuggcauauuugugccuuuauugcagaguauaauauuuauccuuccaauauauuucucucugagaguuaaaauuauucugcagaauuaaauacuuuaggaaauauugaagacauuuagcauuacuauuuuuaauuaugauuuuuaaaaacaaaauguuuaaauuuuucuaaaccauuuuucaaggucguccuccaaaacuuacucaaccuccaccuccucggaacagcaaugaccucaaaaacacuacagccccuccaaaaauagccaaagguaugccuguuuuuaaugugagaauuugauauuccuuggauuuauggugcaacuuuccaaaaauauauuaaaagcauuaucaaauaaguuuauguuaaucaaguugguacagauuaaaaaguaaagagcuuuugaaacuuuuuuaaaggucgugccccaaaauuuacgcaaccacuacaaccucgcaguagcaaugaauuuccugcacagacagaacaaacaacugccaguccugauaucagaaauacuaccguaacuccaaauguaaccaaagguaugcaaacauggaaaugaacgccuaguacauaguauuguuuuguucuuaacugaaguuuucacgggcauuuuuaaaccuucaguuuauuuucuuccaacuauaguuuuuaaguauagcaaaaaaaaaaauuuauuuucuuucauaggaaaagacugcauugaucuaaguuguagucucugcugccauguagaauugcucuuuaaauauuuagagaaggccacuguguugcaggccuccucuugugauuuauuguuccuuacagcuaaacauguugacucucaggcuuagaaauacaauauuuucuagaaauaacugaaaucauagcaggaaacaaacuuguuucccuugauaauauauuaauuugauggauagggaacuugauggcaaaaaggggaaaauaaaaacagaacuuuuaguagaaacuaguaauuguuaaaaaauacucauaguuaacauauucauaaaaaaaaacuuuggucucuuuuuaaguguuugcaauuauauuuuuuaagaucauaaauagaaauuuauuagaauuuacuuucaaguuuuguuaucagugauaaauaaggucucaaaauacauaaaacauaguagucuuacuaguuguugaaaaacaaaauuucaauugaauucaaaaaagugucagugucauaguagacuaaguaucagaguugucacauaaaaagcuuccuuguuuucaggaaagugcagagagagaaagccguucauccaaaguaauuugugccacauagaacuucagucauucucauuuuuugaaaguuugccuggauucagauaacuuucucugacuuuccccauguugguucuuucccaucuucugaaguauuuucacaaagaugaauuacuuucucaugcugcagguacagcuagagagaaucaaggguucucagaggcaggagaucucagcaucuuuuaacugcuuaccaguugucagaaggcauguacuaaggcagaaucccagaccacaugccuggauggagaucagucacugaaaaguguugcucaucuuaaaaucugauugcaucucagacccucaaggcuaaaaagaguccuuaaauaauuuccuuccagaauuaggaucccuguaugcccaaaaagaauaacaaagaaugaguuggucuucucagagaccuccugucucuuuuuuagggggaugguaguauauaaauuuauuuuuugaaccuaagaagauguuuuaaagccucugauuaaaucacacagcauccaucuaaacuugauuaucuucucuugucucacuaaucuuauggaaaaagcacauuuaccguugugaauucugagugcuuucuagucuaagucauuauuucuguuuauggacuucuccauuuuuacagccaggcugagagugauuucauggaaaagauuaugucauggucagauuugugccucuguaguuuccagguccucccucaguggggcccguggcaccagcuggcugaccuucugaaaggcugcaguagcucuucugucuguucucaacuguagcuauuuuacauauuccccuuauuuucaagcccuucacccagauaucuucacccacucucaguuaccgcuccaacuucacagagaaaguagggaguuuccuuccagugaaacucccuuuuuguggagccuacaaaccuaucuguauccucuguucacugcagugaaaagggggcuuccuuauguugcccaaggcugauuauaucaccugugcccugguuccccucgaucuaccucucagggacccaaucuuacugauuauccucucccccuccuguaucuucagccucuuucucucuuuuggauacaguuguuuuaaggaauaaagaagauggugcagguuagacucauugcaguguccggcucugagcccccaguaaauaucagcaggugcugcuauuaucaucuucauggcaaguaggggguugagcgacaaaggaagaaacuaauaucccaagugaccuuaggcagaucauuuucuauaucugggcccagaauuccuuaucucuggagugaaauuaggggauuaaaugaucccuaaaucucucccaguuccagcauuaugcuggcuucugaccuggucacacacacauuuccaauugacuuucuuaacaccacauuguuaccuucccauauauauauauaugaauguuuugccauuaugauguaacgucauuucaauugcuggauuauuuucucuuguaaggaggauaccaugauuuauucccucucauuuuugggcauuuggauuauuuccaauuuuucacucuuacgcagaaacagggagaacaucuuuaaggaugcaucuuuuuuuaguuucugagaauaaauucuaggaauggaauugccaauagauuuuuguacauauugcccaaaaaugccaaucagugagauagcaucaguuuauauuuccauuaaaaaauaacuguuuccugguagccuguucaucaauuaguuguuguuuuaaauauuugccacuuugauuagcaaaaguaguauuuuguuguuuuaacuuuuuuuguguugguuguuuaacuuguauuucuuugauuacuagugaaguuaacauauuuaaugguuacuuguauuuuuuaauguauuacuaguuaaucucugcugauuuuucucuuaaauguuuggauuuggcuuguaaugcccuacaauauaauaauuauuuaaaguaacucuucucauauguagaaaauauauuuucccaauuuuucauuugucuuucaauuuuauuuuagugauuuaaaaauuuaggaaaauuucacaucucuacacagauggaaugaauaguguaacaagcuuuuguguaucugcaaaagcuucuacaguuaccaccacaugcccagucuugacaaauaauguuuaugguauuuccgugagguagaaaaauguugaaagaugaugugguuaauuuucccuagugauuucugccuuugguguuaauauggcuuuuguuugucuguuuuugucuuuguaacuucagauguagcgcuggcugcaguucuugucccugugcuggucaugguccucacuacucucauucucauauuagugugugcuuggcacuggagaaacagguuaguacauaacuaguucaccugaguccaaaacuaccaaaugugaaguagaagcuaaauauagaagaugaaaauguuuaccuguuugagagugagaguuaagguaauuauuaaaaugaaaauuucaugcuucuccuuuauucccauuaaaaauaaauaaguucaauuccacaaucaguuacuaaguaccuuuuuuguaucaaguucugcauuauacacugggauauguacauuaauaugaacaauuucugacacaugauaguuacauuuacuuaaagaaugagacacaauuccuuucucugaaguguuuagcaggguugacuaacaaggaacuauaucaugugguuugaugaguuaugaaccaugagaauuaacugaaguuuuuucuucgggaaaggggacuccucaaguuuggcuugcuuugccuuaaaggaauuguaguuggcuagauagaggaagguagaugucuuuguuugggaugcuguaagaaaauaccauaaccugggugacauaaauaauagaauugauuucucacaguucuggaggcugagaaguccaagaucaaaacacugcagauacuaugacuagugagggccugccgucuggcucauucaucaacagugccuucuugcccgauccucucaugguggaagggauaaacacgcucucucaggccuuuccuguaagggcaccaaucccauucaugaggacucugccuucaugaccuaaucacuuaccaaagccccacuuucuaacggggguuaggauuucaacauaugaauuuuggagagaugcaaauauucagaccauagcacuagcaaauggcccaaccugagccaauuguuugagugaaggcacagagauauggaauguaggcaaaauagugagucaucgcauguacgcuuggcgugggagaguccugagaaauaaccauagagguucagucugggccuggaucaggaaaggcuuuucuggaagagagaaauuuagauuucauucuauagauggaaagucacuugagugucaagcaaagaggugauauugucagaugauuguacaaagaugguggcaguuuugaaggguagauugaagaggagagaggcugagagacuuagcaagaugaguuaggaaaccacugaggccaggcaggcacauaacacacugauucuaggaaagggagaagagauggaguggagauguuucccaguagcauugacaggauguaugacuaguugucuaguaaggaagaagugauacaggaggaaucugagguuucuggcuugugcaguuagaccaguagaggugucaugaguugagauaacacagcaggaaggacagguuugguggagaaugaaaaugacuucauuuguucagccaugcaacaaguauuugaauauuuggcuguuacccuaugucaaguauugagccaugugcuggggauuccagugaugaaccccaaagcuuacagauuaggaacggaugcaaugcaaaaaaaacucccagcuguaacaccagccauagaauauaugccaugggaggaagcuaguggaucccagcuucaugaacaggcugucuaagcagagacacagcaaauuaguaugagaacaauagggaaaggaaaggacuuuaggaaauuccaaagaggagagaguaugaugcauuuaaggaacuuagcaacaacagugauaguagugaugaggcccgcagcagcagaagcuaauuuuuauagaaaauugaaugcuaaucuuagucacuauucuacauaauuauuccaaauaccuguauuuucuauuuucaauuuuauuuuagugauuuaaaaauuuaggaaaguuucacaucucuacacagauggaaugcauaguguaacaagcuuuuguguaucugcaaaagcuucugcaguuaccaccacaugcccagucuugacaacaugcaccucuacgcaaauuauucuaaauaccugaauuaauuaauuuaauccucaaaacaaucuacgaagcaggcacuauaauaagccccguuuuacagaaggagaaaaugagacacaacauaaauaacuugccuaguuaugggcaaauaacuugccuaguuuaugggcauaaauaaccugccuaguuauugccuaguacaugggcagaggggaguuuuggaccagacuugagagaucgugcucuuacccacugcugcucugaacacauaauaaauaaaguauaacucacuguuauuaaagcacagggugugagggggaggacugaggagugccgcuguugagagggcagaagucagacagagccugaggucaguuugggaugguguugaaaggacccuguggacauccagacuccugaggcaauucgaccacacaccuggcguuaaggacacgaucugagcuggagaauugaaguuacuguuaggaacguaguugaaaucacugaugaguguggcuuuaugacaaggaguaaaggagcagauaccauuaauaugcuguggaaaauagggaggaugagaaugauaauaaaaacagcugcagcuuauugaauccagagcucauucuaagcacuuuauacguaaugaauaaguaaccagaagcuuugucacuuauguguauaaaauccuuuauaguacaaccuauggcuaauauugaugccauaaauuuguuguccuagcaauauagggcaucuaacuucuauuuagaaaagaugauuuauuuauuuuuuuauuucuaaaucaugugaugauuagagcauuuucagggagaaagguguuuaaucaguauuuuuuuuuauuucuuuuccauucaaguguuucauuaacaucuucaacacucauuaucuuuuccacaaauuuuuuauuaugcuguacuuugaaauaaugaaauaaguauaccuacgcuuuaaaaugaggaugcauuuaguaucaaaaauauagucuuauacuggagaauguuucccaguaggaaaagcacauggcuugggcuuuuuaugaaaaccacauuuguggugcucacuucggcagcacauauacuaacauuggaacgacacagagaagauuagcauggccccugugcaaggaugacacgcaaauucaugaagcguuccauauuuuuaauugaccacauaguugaaaguaaagcacucaucagcaaauguaacagaaaagaaauuauaacaaacugucucucagaccacaguucaaucaaacaagaacucaggauuaagaaacucacucaaaaccacucaacuacauggaaacugaacaaccugcuccugaaugacuacuggguacauaaugaaaugaaggcagaaauaaagauuuucuuugaaaccaaugagagcaaagacacaacauaccagaaucucugggacacauucaaagcaguguguagagggaaauuuauagcacuaaaugcccacaagagaaagcaggaaaguucuaaaauugacacccuaacaucacaauuaaaagaacuagagaagcaagagcaaacacauugaaaagcugcagaagucaagaaauaacuaagaucagagcagaacugaaggagauagagacaaaaaacccuucaaaaaaucagugaauccaggagcugguuuuuugaaaagaucaacaaaauugauagacugcuagcaagacuaauaaagaagaaaagagagaagaaucaaauagaugcaauaaaaaaugauaaaggggauaucaccaccgaucccacagaaauacaaacuaccaucagagaauacuacaaacaccucuaugcaaauaaacuagaaaaucuagaagaaauggauaaauuccuggacacauacacccucccaagacuaaaccaggaagaaguugaaucccugaauagaccaauaacaggcucugaaauugaggcaauaauuaauagccuaccaaccaaaaaaaguccaggaccagacggauucauagccgaauucuaccagagguacaaggaggagcugguaccauucuuucugaaaguauuccaaucaauagaaaaagagggaauccucccuaacucauuuuaugaggccagcaucauccugauaccaaagccuggcagagacacaacaaaaaaaagagaauuuuagaccaauaucccugaugaaaaucgaugcaaaaauccucaguaaaauacuggcaaaccgaauccagcagcacgucaaaaagcuuauccacugugaucaagugggcuucaucccugggaugccaggcugguucaacauaugcaaaucaauaaacguaauccagcauauaaacagaaccaaagacaaacacuacaugauuaucucaauaaaugcagaaaaggccuuugacaaaauucaacaacccuucaugcuaaaaacucucaauaaauuagguauugaugggacguaucccaaaauaauaagagcuauguaugacaaacccacagccaauaucauacugaaugggcaaaaacuggaagcauugccuuugaaaacuggcacaagacagggaugcccucucucaccacuccuauucaauauaguguuggaaguucuggccagggcagucaggcaagagaaagaaauaaaggguauucaauuaggaaaagaggaagucaaauuuucccuguuugcagaugacaugauuguauauuuagaaaaccccaucaucucagcccaaaaucuucuuaagcugauaagcaacuucagcaaagucucaggauacaaaaucaauguacaaaaaucacaagcauucuuauacaccaauaacagacagagagccaaaucaugagugaacucccauucacaauugcuucaaagagaauaaaauaccuaggaauccaacuuacaagggaugugaaggaccucuucaaagagaacuacaaaccacugcucaaugaaauaaaagaggacgcaaacaaauggaagaacauuccaugcucauggauaggaagaaucaauaucgugaaaauggccauacugcccaagguaauuuauagaucaaugccauccccaucaagcuaccaaugacuuucuucacaaaauuggaaaaaacuacuuuaaaguucauauagaaccaaaaaagagcccacauugccaagacaauccuaagccaaaagaacaaagcuggaggcaucacguuaccugacuucaaacuauacuacaaggcuacaguaaccaaaacagcaugauacugggaccaaaacagagauauagaccaauggaacagaacagagcccucagaaauaauaccacacaucuacaaccaucugaucuuugacaaaccugacaaaaacaagaacuggggaaaggauucccuauuuaauaaauggugcugggaaaacuggcuagccauauguagaaagcugaaacuggaucccuuccuuacaccuuauacaaaaauuaauucaagauggauuaaagacuuaaauguuagaccuaaaaccauaaaaacccuagaagaaaaccuaggcaauaccauucaggacacagacauggacuucaugucuaaaacaccaaaaacaauggcaacaaaagccagaauugacaaaugggaucuaauuaaacuaaacagcuucugcacagcaaaagaaacuaccaucaaagugagcaggcaaccuacagaaugggagaaaauuuuugcaaucuacucaucugacaaagggcuaauauccagaaucuacaaagaacucaaacaaauuuacaagaaaaaaaaacaaccccaucaacaagugggcgaaagauaugaacagacacuucucaaaagaagacauuuaugcagccaacaaacacaugaaaaaaugcucaucaucacuggccaucagagaaaugcaaaucaaaaccacaaugagauaccaucucacaccaguuagaauggugaucauuaaaaagucaggaaacaacaggugcuggagaggauguggagaaauaggaacauuuuuacacuguugguaggacuguaaccuaguucaaccauuguggaagacaguguggugauuccucagggaucuagaacuagaaauaccauuugacccagccaucccauuacuggguauauacccaaaggauuauaaaucaugcugcuauagagacacaugcacacguauguucauugcagcacuauucaaaauagcaaagacuuggaaccaacccaaauguccaugaaugauagauugaauuaagaaaauguggcacauauacaccauggaauacuaugcagccauaaaaaaugaugaguuccuguccuuuguagugacauggaugaagcuggaaaccaucauucucagcaaacugucccaaggacaaaaaaccaaacaccgcauguucucacucauaggugggaauugaacaaugagaacacuuggacacaggaaggggaauaucacauaccaaggccugucaugggguagggggagcaggcuuaccagugaauuuacucuguuugcuaacuucucuucuguauuuuuccagaaagaaaaaaacugaaggcaccuaugacuuaccuuacugggaccgggcagguaacucacguggucuuugcaucucauuucuaucagagggaugucgcuccccuacagggggcaguagugaaaaaagagucauucucuggcccaggugaacuccccgacacuguuagaacaauggcauuacucuucaguucucaccauuuuuacccuucugcaaagucucuuguaauuccuaaguaaugaaaugaaaaguacaaauuucuuaaaacaagcucuguucuuuuucuucuggaaaacuuguguaguuuguccuguguaucuguuucucaugaggagaccggcuuucuguggcccacgugaacacugaguaagaaacaaaagacuguggucuccaggacacaguguguguuuguccucugccaugguuauucaccaaguggaguccagcaguuuaggaaucgggaggucucccaugaugaguugucaucuucugaauugcugcaagugacaccaaaggggccccccuaccaguuucucacuucccagucucacuacuggaucagcucuuaggagccaggagaguucacugcuguggcuaggauagaaaagggcagcuagugccccaggguagaucuuggaaaauauuuuuugggaaaaauguaauuaaggccaccccuaaaauagauacuguaucuggcuguacuauacuaacagugauuugccugcauguguuugauagagauuucuaccauguacugcuuggugcuggauagucuaucacagcaaaaaaaaaaaaaaaaguuggauuauaaaggcaaguuuguagagauauuuguuauagaaauggcuuaaaugcaacaggauuuuucucuugauacuacuguuugagauacagguuuuuauuuaauggucucuuuggcuugccgucacaaugaagguugguggaaaggaaugaagcaguuucuuccugcaaaagcaguggaccaugaggaaaccccaguucgcuauagcagcagcgaaguuaaucaccugaguccaagagaagucaccacagugcugcaggcugacucugcagguaacuauguugcagccuucugguaccaggcagagggagaaacugcuuaggcuugcuauaaagugcuuugggauuuacaguucuuugaucccuuucauguuuaagaaaugaauuguuuccuaaagguagaaccacuuuuuuaaaaggugacucuucagagagucauuucuguaucuuggauauucugucuguaaaguugggacauugauuucuaaagacucugggcauuauguauguuaacugaggcuuguggggagacccgagauguugagaggagagcgggaaagacagaagaagccuuacaguguuuauccucuuagccuaguacauacuuauuuuaaacauuuccuaauauuugaaaaaaaucucugaaauuauuuuucaagauuaauauuuauuccaguaacugaauguuucuuuuccaaugaaauauucugaaaauaauucagaaaggaaauauucaguaaagaaauauguugucuguaaaucuaaagaacauaugugaaaauucuauaugcaaaauuacaugaaugagacuuucugguauauuauuacuaugagaaguacuagacaguauguuuaauuuuaauuuucaaaguucuuacagauuaaguauugauggcaacaaaaguauccuaaagaauguuugcuuuuaguauaaucugcagcugccacccuaaauuaugcaaucucuuuacuaguaaaaugacuuuucuguuguuuugugauauccacagaguaugcucagccacugguaggaggaauuguugguacacuucaucaaagaucuaccuuuaaaccagaagaaggaaaagaagcaggcuaugcagaccuagauccuuacaacucaccagggcaggaaguuuaucaugccuaugcugaaccacucccaauuacggggccugaguaugcaaccccaaucaucauggacaugucagggcaccccacaacuucaguuggucagcccuccacauccacuuucaaggcuacggggaaccaaccucccccacuagugggaacuuacaauacacuucucuccaggacugacagcugcuccucagcccaggcccaguaugauaccccgaaagcugggaagccaggucuaccugccccagacgaauugguguaccaggugccacagagcacacaagaaguaucaggagcaggaagggauggggaaugugauguuuuuaaagaaauccuuugaagaugaugcugcuuuuuacaaagcaucguuuuaaagcacauggccuuuuuuuuuuaauuauuagugguaguaauauauagaauguauuacauaacugucacugaagugguuggggaaaauguggugacugagguacaggaaacuacuaaucuugccaucuugcuuuaagguguuaugguggcacaguuacugcucgccuguuaaauuucaaauguccuguuugauacuacuguagaacacuauuuuuaauacagaaaaagcucccuauaaugcacuucagagaaauuaaaaaucacagaguauuuauuaccaaugcugcagguacauuaaugaacucgagauggcucuguaagccugacuggcaauaacgcacgguacuguucuugaaauaccuaauggcuugaaauucuagucuguuugugaaagauggguacuaucaugauuuccucuucuauuccuauauucuuuucuggauuuuuuuuaauaauuagugauauaagcauuguuuuuauugcagccauauccacuuauccaucuuaagaucuguagcugggauuuucugacuuguaaugagcagggggauugcuuuuucacuuugugacacucuuuagagcuuuaaugcuucacaguauauggccuggucucauccuugcguguuccacuugaggcccuuuggugucuugccccauucuuguguuuauaaaauguuugaguauuucugaugagugaugcuugccuuagucucaugaauucagaucccuucauguccuuuaaguaugcuccucaauguguaaacaggaacaacuuuaugauuugaaagcuuuaaaggagauucuucucccacccccaacuuuauuugcaaugggauuuuuccuaggagaguuaugaaaaguugaaggcuucuaagggaauacuguaaacaugacccacuuauauuuaucacagugaaaggcaaaauuauucacucagaaguaauauaaauuaccucuuuaaaaaguaaccagaauuuguccuuuuugguuuuauacauucacaaacauauacauuuuucuugagucucaagguauuuuauauuuuuagucagaaaaaauaauuuuucauuucaguuuuccauaaacuguuacacaaaauauaaaccuaacguguauuuuucaggacugcgugaucgugcacuuugugugguaagagguuugaguaguccuauaugucaccuagggaacagacauuauagcuuacuagcaaaugaauauucaugccuuguuuuugauaccuccuggcagcuuccaugucaccacuuguucauaccugcccagagcuaguuuuagacauggcaaaauagaaaucaucuguaauuuauuagcuaacaauguaaaaccaucuuuuaaagccuucagacugucaagacgacaugagcagcucaccauaugauaaaaauacauaaauuugacauucccucuuccauaaaccuuuguuuguagauuuaauguugaacaguacuuuuccauaaaguucuagucacuucuguuggccugagccaccagauuaugauguugccagaauucacucaauuugaauaaagaugaacaguauuuguuuucuuguuuccaugaauuauaucaguauucuaaaacaucgcuucagaaagagaacuguuuauuucugcaggcuuccuguccuuuugugguaugguuuuuuggccuuauuuucacuggcuuuuccuucuccaaacuuugaggcgugauuucauucauugaagaaucaauacauauuuuguuucaaaauguuugaaacaaaagacauagaugguagacuuuuauuaaaacauauauggauguggaaagcacauauauuaaugcagucaucccuuuucaggugggaagagagcaaaccaguugauuuuuuaauucauccuuaguacacagagaauauacuuuuccucaaguaauauaccuguuugaagcuuuaagagagauguuuuugguaacuauuucauuuucccaaagaaguuugcuauucuuguguuaauuguguauaccugauuguuuuuuccuggagguuuuuguuguuguuguuuaguuuuggguuuuuuuuuuuuuaagaggggcaaguguuuucugaaaugaugcauauuuuaagacucgauucauauugccacugugcuauccuugaacuaccaauaauuuuuauaaaauaucuaguuuuuacuacuuuuauauaaacuuuacuuuccagaugaagagcugagccugauucaaaugguuuuucugcuuuauacuucuuuuuaguucauugguuuuuauaguagagguuuucuauuuuuuuuuuuuuuuuuuuuacuacauuuauaugucugauacauauacggcuuuggagacaaucaaguaacaacugaaaaugugaaaguaaccauaucugacaaaauucccuugaauuuuuauccuuugcuugcaacauuuaagacucaaagucacugguauauuggauuaaguuuuuuccuguuaaugcaauuauagaaauacaucggagacacaacaaauguggccauuacagguuucauaaaauuacacugacuuggcuguuacuugaucuuaggaaacagcacaguuuaagauauugugaauucugacuuauacuuuauuaaaugcuguaaaucuaaauagauccuguuggaugugaugggucuaguccaguuuauuuaaguucauguuucacuguuugcacuuugcauugaacaauggguuuauucgcugauguaaacgguucgagugaagaauuaaugcaguaaguaugacaacacauacacacuugccucuccccaucuccagaagaggggagcagaguccgagcuuaucuaaauaugaauguggccacaaagcuguggaaggugacaaagcuuaaacaccuuugcccuggcucugcauugucaccuagagagcaagaggucuauagaaacaucaugucacaugaaacgauucucugcuuuuugguucugaacuugaagucccuaaacugcaaaaucuaagaguugggugguuauuaaaaugcuuuuaaagucaacuguggcaccaauucuaauguaauccaacuugugacuguuuuuuuuuguuuuguuuuguuuuuguguguguguguguggcacugggaaaaguggaaacaaacauguauugaaauacauauuggaaauaaaaaugguuugagcgucagugauauucucccagaauguacuuaucuuaccucggcauguacuguagucacucaguauuuguauauguugcuagaauuuagauuguaaaauagugaaauuuuaauguguucauuuguuuuuaauguauauaugucuugcucagauuauuugguuuaaauaaaacaaccuugagguuuguagcuuuuccuuauacuauaaaaugccagauucuucuauuuuaaccucacuaauuuauggccaauauugugcuuccagcaacauuugaaaaugacacuguuaguuuacuuugacuuuuucuaugaccagcgccauccuuuuuuuaaaaaaauaauuucaacuuuuauuuuagauucuaaggguacaugugcagagugcagguuguuacauggguauauugugugauacugagguuugugguaugaaugaucccaucauccagguugugagcauaguacccaauacauagucuuucagcccuugcccuccccgcuccccucgcuccccccgccgcaguccucagugucuaucguucccaucuuuauguccuuguguacccacagcaccauucuuuuugaagccugauuuacuuuauaucaauugaacuucagcagccacacugcagccuauggcugugugguaugaggggaaaaucacacugauugauuacaugugauuccaguucugguaccuuccuuuugcaccucaaaaaguuauaagaggaaucaaaacugugggacucugcaaacauaugcugguauucaugucuaaucuggguuagaucaacuacuacuguucuccccuuuauucugcuuuauaaguaccgcauucuguuucugagccaaaucuaauguauuucacccuuuauacacccucuuuagagaggcagguugguugucaguaaucaagccaugguuuuccaguguuucccaauuguauuuauuggucaaaagagaguaauucuuucuucagcucauaccucuucugacaacuuuuaguuccauccuuauaaccucuauuuuucuguuucuucaccucucauuccccuaccuccagauggccuuugguuacauuuauuaaaauauaggaaggaagacuagcucaccacauuuguaggauugacuggcuugcauuggaucagauucucuggugcacccuagguagccaggcaagcuuuccaucugaagauuagcuuuaaucaugggaaaaugagauauucuuuuuguaccauuuaaauccaaaaaucccaacuucacuuuuuauauuuuuuagaagacagccucacucugucacccaggcugaagugcaguggcgcgaucuuggcucacugcaaccucugccucccgggcucaagcaauucucgugccucagccucccgaguaccugggacuacagcgcauaccaccacgcccagcuaauuauuuuguauuuuaguagagaugagguuucaccauguuggccaggcuggucuugaacuccugaguucaggcaauccagcugccucccucggccucccaaaguguuuguuaggauuacaggugugagccacccugcccggccucagcuugacuuuucuuaaguguuuacuuguucuguuaucuucuuuaccuuuccuaauuuacuucaaguggaaaaccuucaaaauuuaaugaauaaguaagucaggcaaaaaaaaauaauguucaagauuuuuuuuuccuucuugagcuugccuagcuuagcuucacuguauaaaguuaaacuucauuucuuuaaaauaauacaaagccaucagaguuuaguaauuguauucuuucuuuaguuauuuacuuaucuaauaagaacuuuauguuuagcccauuuccuuuaacuuaaaaacaaacacugccuucauuguaccaaauuacucuucacaaucaugguucauuuaauucuggggguugucaggagagagcuuaauuaaaccaguaugaacuuagauuuccagagccaagugguuucggcuugccacaucaagccacaaucgugauuuuccaccagccauguuuacaguagccaaauauccuccucaaaaugucuuauuguagucagaauuguugugguaaacuaaauccuuaguaggaagucauaucccuucaaaaaucuaagaugaaguaacuauaaaaagacgugugaaaacaccucagaaaacuagcuuauuuuaaaaacaaugcaaucaaaacuuauuuuccuguuaucuuuacauuucuugguuuucauaaguuaaauauacaguauucacagaaauuaagcuggugguuaugaaucaccaggcagcaacagacaguauacauaauuauuugacgagugcauccaacauauuuuaaacuaaaaauugcaguacaaaaauaaaacuaacacuguuagcaucaucuucugagucuguagagucaaucuugagucaaguugauuacgagguuuuuuucuauaauguccuucaaaaagagcugcucugcagucacauugugauacgcguucuaaagaagaaaaauacaauuaccaucauucuuucccaaucucaaaguauuagcagcaccaauggaguacuuuauaucuaaaaaaauccgaauaaagaacucgaauguuaaguaacgaguugcauguacuuuuaacuuuugauagccuuuuaaauuacuuuccuugcugguucuugugcaaaagcuuucccuacagcccacucuuuccauuucaacucucacauaaguaagacuccuucauaucaaacccugguagaccgaaucaugguacaauacaaaucuggagaccaaaauuuugaguuguucacuuuaauggaagaagccccuagaaaucaguuuaaaaacaaacaaaaucagccuggagauaaacuauuauaaugccuggu

SEQ ID NO: 18140 - RNA, 927 nt, Homo sapiens
cauggcagaagaaaauaagauucuggugacucacuuuguccucacaggacucacagaucauccagggcugcaggcgccccuguuccugguguucuuggucaucuaccucaucacccuggugggcaaccuuggccugauggcucucaucuggaaggacccccaccuucacacccccauauacuuauuucuuggcaguuuagccuuugcagaugcaugcacuucauccucuguaacuucuaagaugcuuaucaauuuuuuuaucaaagaaucauaugcuauccauggcuaagugugccacccaguuuuacuuuuuugguuccaaugcaaccacagaaugcuuccugcugguagugauggccuaugaccgcuauguagccauaugcaaucccuugcuuuauccaguggugauguccaauagccucuguacucaguuuauagguauuucauauuuuauugguuuucugcauucagcgauucauguggguuuguuauuuagauuaacuuucugcagguccaauauuauacauuauuucuacugugaaauuuuacagcuguucaaaauuucuugcaccaauccuacaguuaauauacuucugauuuucaucuuuucagcauuuauacaagucuucacuuuuaugacucuuaucgucucuuacuccuauauucucucugccauccugaaaaagaagucugagaaggguagaagcaaagccuucucuacuugcagugcccaucugcucucugucucuuuguucuacggcacccucuucuucauguaugugaguucuaggucuggaucagcugcagaucaggccaaaauguauucuuuauuuuacacaauaauaauuccuuuacuaaauccuuuuauuuacagccuaaggaacaaagagguuauagaugcccugagaagaaucaugaagaaauaaa

SEQ ID NO: 18141 - RNA, 498 nt, Homo sapiens
gaaaguuagucgcaauaguaaacucacaugaaccagaggaugcaggaaaccaauuacauaugaaauacuuagcaacugagcgcugaguuuguuggacaucaucacuggauaaagcaagggauuacauauggcuacauagcggucauaggccaucaucaccaggaggaagcauucuguaguugcacuggaagcaaaaaaguaaaacugggugaugcacucagcuagggauaucauugcagucuugucuaagaaauugaccagcauccuagggguuauagagguugaaguacaagcaucugaaaaggcuaaaccaccaaggaauaaguacaugggcauaugaagaugggggucguuccaaauuagaacuaucaguccaagguugcccaccauggugaugagauagaccaccaaaaacacaacaaagaagaggacgugcagccauggucgaucuguaaguccugugagaacaaacucugucacaagagucuuauuucccuc

SEQ ID NO: 18142 - RNA, 27244 nt, Homo sapiens
uuuuuuccuccuucaaucucaggcuuuucuccaucuuuuaagcagccucuguaacucccuuuuguccauagguguugcgugccucucaucuguggggaaguauuauuuaauaaaauuuauguuacaggauaacuuuauuuuaaugggcaugggcuugucuauacacaaagguauguauauuuucauuauaaaaaaccaguuuaaaauuuuuucuuauuuuaauuguuugaaauuuuucuagagccaaagaagcucuuuaaagaaguuguuucuuccaaagaacaaagccagguuaaugacauucaauucuaaaugauacauuggaauugugccuuuucuaccacacuggauuaaauaaacuugucaaaauaugguuuugucauuuucugagacacuugguaauuugcuguucuuucuuucaugugcccguuaguacauuuggccaacugaccaccuguaacagggaggucucauguuuguuaguagauacgcagguaaggaaacuugaauucauccucuccucggcucaggucuuugcuuuucuuuuaauauaugcauauaaaauaguaggcauuugauucugcaaaggcacuagacuacuugaauuaaacauucuguccagagggauaauaccaggcuuuccuuuuccucaucuguaguaaguuucagguccuugacagaaauagcuggacuauuccaaauuugcuucagugcauccaaaugugacaaagggaagcgaaguccaugaaacugaaaggauaaauuuauuugucaaaauauauguauacuacuuaugucauugaaguagcauuuuccuguaaauuuauucuccauacaucauuauuuuugauaccccucaugaguauuuuagacacacuacaauuagauaacauaaaagaugccaacuucuauauaaaaggcauccuaauuuauguaguaagugauauuaguaauuugaaauguuuuacauuauaccauuccuauaaggcuacaggucccagcuaguaugucuuaaaacuggugugcauguaucacagaaaugucugacuuaaucauccccaugcaggagcucugugaguagugcaaaaugguuaaguccacagugcagccauaaaaagcauauuaccuguaaaucaaaaauaaucaauucuucccaaccaccacccaagucacaggauaggcauuuguuuucaguugaaacaaaccucuguuuccuccucauuucccaucaugugugucucucuacuauucuuuaaggaaugauagauguacaccaucuuuucuugagcuucauccuuuggggaaaaaauaaaugcauuaggccaucaacaacacaacacugaaggugucaguacuaggaagguuuuccaauaggucaacaccaaaaaaaauuucaaaagccuuggugcucaagugaaauuuauugaauacuguaaagaauccuuuuggcaaaaagugacgggugugugcauccacacaaugucuauacuucauuagucaccacagguuacuauuuguauguggcaauuaaugggcauucuaaguuguuaaaacagcuggagugcuaccuggaagagcaucuucaggauuuaaugaaaaagcagugauuuauguaucaacuuaucaaugaaauccucaguuuuuuuaaucauaccugcacuaucuuuuuugaauaaaaaaaucugacauuucuagguauaaacugacaauuuauaaucaugaagucauuaacuccugagaaauaccagcugugugaucgauaaaaaacuccauuucaauuacacuacccucccaaauggucccuaucucccuucacuccccauguuacacagugcaguuuauugucucuuccagagccuuuagucauucuuugucaccucuuagauaagggcaaaaaaaucuuagccuagcguacaaugucucaaacugacugguuaucagaaucacuauuuuuuuuuuagacagggauguaggaauguguacuuuugaggauguauauauauauauauauauaucuauucauguauauucauauauauauuccaacucuggcccugacggcuggaacaaucugguuaucgagacauguugagugccccucucaucccccuugaucauucaugggauagcuccuuagagagcugauuaggaggaaugagguggagccauaugguaugagaucguuccaaggucuuuaggacuguacagggagcucuaucaaaacauaaauccaaaggcuccaagaccagaugaaacccaggaauuuauaauuuuaaaaagcuuuccaauugacuccaugaucaguuagccaguuuggggaaucacugggcuaggaagcaaaauuacagaauauauacuuuguucuccauaaucuacaggauagaguuuaaggagaugcaacaauauccacaaaaccacauagaaauauagaucugcacaguguggaggacuggggcugagaaacucaggaaugaggucuguggcuguccaagcaagaacaguaaggcccgaaguaggaugagaagcaaagaccagacauuaaucaccacauaaaggggaugaaggaagguucugugaggaugagggcaagaaaauauggaauuggaacugugagauuuggucaucaucugaccugaagaaauggcauuaaacugaaugcagguggauuccuaaagaagggcagagaccagugguuaaucuaauaaccugaggccucugaugaaaaacacccugagaagacaggaaaucuccuccucuuggauacucacagauugaucuugauccggcaguacugugaggacaauguggucuuuaaacugcagucucacuacacuguccagccucgguaacuuuccaccuagaaaaccccaaagagagaaagccgaccuucaaaaaaggaaacaggcagauucaaacuugcuuauacauacacauaggaaacacauuuacuaacaauuuacaggugaauccaaacauggcauacacuccaacugaagaauuugcuuaccccaacauuguacugauauuauaguucacaucauuaugcagcucauucuuacagugaagacagacauagauaaauaauguaaguuuauaaguacaauaaauagacaaaaauaauaccaucgaaguacaguggcuaucauagcacauaaggcuguggugcuuucugcacagaacacucacuccuccagguucuguccucuacaagcuucucgcucaacauauggacucuggaaguacuaccugaguucaaaauugcacuacuccaccaauuauuaggugugugacccuggucaauuauucagucuauguaagucaagaauaguauccuauaaaagccaucuaauaaaguccacagaaaauuuuuuuuuuccaaauuggauuuaacuuaguggaacaauacccaauaaaaacagacuagccuuacagggucaucugcguggggaaggagucgugagggaucaucacuuuauugaguauaaugccuaagauaaggaaaacacugaaguagucugggccauaagcuggugcauaagcaaacuguucugcuaaagauuaaaccaugugcuuguaaaacauuugcuauuuugaauagauacaaucaaaaacaaauucuaagcuuccuccaaagacuaugauaaaaauguauauagaaucaguguuggaagggaccuuauagauuaucuaucucagugguucucucuuggucauaauuaagaguuuuauuaaaguuaguaaaaaauacucuuuucacucaacccugagaaagaacagcagccaaaaagcuggccuggcacucacagcuaggucuuuguguucuccuguugaacacaggcaauuccacagaaugcuaacaucagagaucacugucaccaugauaggucaaaacaaaacaccaccacuccguacauacucaugucuggacucaggcaaggcaagaacauauuccaaaccacaacacugaccgaacaucccccuacucuggcuaaugagugaccacuuccgcuuuaccauugauaacuucagccucauacauuccuccugccuaccagauaacauuuaggagacuuaaucauagaaucccuuccauuuccugacagcauccaauccagagcaaagcccugcuuccuugaacccucuccaaaaucaccuaacauacaccugaguccuauaagucuuuucuaacaccguuuuacugagaugcccugcaguucucaaugguguguggucuucccacugcaacaagucaauaaauccaauuucgucugaauucaggaguauguucuugguggucuuugcuauaggauacugacaucauccaucuggaagucaucaaugacaucauccauccaaaaguauguuauaucauuugcagccuaaaucugucauaaauuaggcaccugugccuuggagaagguugaugauaaucuuggacauuucuugaaucucacuggcugaugguaacaauuuuacccaugcuaugauuuggauguuugucccauccaaaucucauguucaaauuugauccccaguguggaggugcagccuaaggggagguguuugggucacauuguggggagcagaucccucaugaauagauaauucccugggguugggggcggugagugacuucuuguuccauuaguucccaugacagcugguguuaaaaagagccuggcacuucuccucgcucuugcuuccucucucaccauguguucugcaaaugccagcucccuuuccccuuccacugugaguagccugagguuuucuccaaaugcagauaccagcaccaugcuucuuguacagccugcagaccaugagccaaauaaacuucuuuucuauauaaauuacccagccucagguauuccuuuaagcaacacaaauaaagacaacccaacccugacuuaauuccaacaagauuauuucaauguucaaauuuugaaaacuuccugaagacuaugaauaccagaguaccuauaaauauacauauuucucacccaaaaggacagggcucuuauuucccaucagggugggauacaaguucuuuccaaaugacuucuaagauacagguugcuaaagguugagugcagcacaucucgucugcccauauucacuaaggauggaugugguccacauuaacacgaaagcacuucauacuuuccaucuguucaaaaaggagccuacccagaaaaaccguaaacauccugcauuagccucugaccacccagaagaaaacagcaagcuccaccugguguugacagcucugccccaucucccgcagaguaaggggggagucugugcauaauaaaauccuucuucaugucugaggaaagcaguucuuuggugcccuccagccggucugcaaguguccucaggaagccacuuaaucgucuuguagcaacaguuguggauuccaccugcuaggaacacagaagugaguccuggcccagaugccagcagaacuuacugcccagcucagucuccacaguagacugcaaaacugccagccaccggguauagacauuaauccaugucauuccaaaggggaagggacaaccugagccccuaagaaugauaucucaucauuuccuuauaaacacuguuaauucuaagcugccuauuguuugcaaaaaauuuucagaauuuugccuagaaauagagauccuuggaaauaugguacagucugagcucugccuuuuggaaagcaggucacuguccuaagaugaaugcuucagagaaagcaaccuuugcucaacucagcucuaauccacucaucucaaaacuaaucaaauaacacuccuguuucaaaauguaauaaaagaacaggaggccaacgaauacaccgaggccaggaucuccaguacagugaguuucucuuaacuaguaaucugaugugugcuaaaucuacaguucuccuggccguacuauucauuuacucaaccaacauuuucacacugccugcuacugccacugugaaauacagagcugucuguacaacaucacaguucuuuggaucaccacauaacacauggcacuccacucauucugcaagucacacagcucagcagugcagcacaguagacaagccuggcucauguuggaagaaguauccugggguccuuaagguaggacuucagcuggccugggcugcagcuaccauccuucauuccuaccugccuuuacuccuuaccaggagcagcugccgggguaugccgguccguaacuccacgucuuccuuugcaguaucaaauacaagccccgagaugguauccaaaaggaaaucuccccaugaacuaggauaugcaccaagggggaaaaaaaaaccaaaacagugagugcauacgaaauauacauaaaauacuuauugcuaguaaagccaaaagcuacaaauuggauuauggcuucccuguccaggcauuuugaguuccauuaauuggacauuacucagcauggaaaucuaagaccuucaucaaccacccuguuuccucccuccccguuccagacacucacuugcaaaguuaaaagugggaagcuaggcuucaauacugauuucucuuaaaagcucucagaaaauuaaccauagacuuucauaaaacaggaaguucaauggaccaaauuuuuaacaaaagugucuaugaggggagauuuguaggaaauuuaaacagucauuauaggaucuaaaaccaaauuuuaugugcaauaaauacaacaaauuugggguaacagcaagauaucuggauuguguaauuauuugaacaguuguauguuacauuuuccuugucacuuacaagggaugcuacuccuaaagaaaauaucuaccaucaauaauuccaaaacaauuaugucuagcagugguuuuaccgggggauagaagccagugacuaaaaauaacaucuagggacaaauaucccuauucaauuaccuuugcuuucucugggguaucuggaauuggcucauuccuaagugcgugccgguguaagaaaugcacucuguggggaugcucucuuuaaacauuucuuagcuauuuaaaauuuuccugugucaccagcagauuucaaauugccggcuaguagaaaauggaaauucacaguaugacuuuuacuucucacucaguaagcaaaauuaacacuguuaugcuucccucccagaaaaguugcaaaggaggacaaaagccacaugagagacacuuuucccaagacaucuacuaccuggcggccucacugcuuugugacuuaauguuauauccaacccugcaucuuuaauugagucucaacccggagggcacaugcagaucucucagcaccauacaauaugugcuuccuuugcagguuuauguagguggaagucauacagcaacagcucauggaggaauuuaguagaaguuaaauagugcuccucuaagagucagaauagauauugggacuucccacaauuuaggaauaucucuugaaggguccacuuugguaaaacaaccaaaucaacaacauacagcagacccccaaacacuccaacaaugcuaccuugacagguguuaggaagaggccccaaauauucaccuuuacaugguaccugaaggagcauuaggcucaaaacacaggaucauuucuggggagcaauggcccucaagucacaucuucucauucuagcuccagcaucacuguccaagacacaggucaaaauccagccuggacacauugaucaugguacccacccacaauccuaagcaggcaacuucuguaacuuaggaagcucuucccagccccagcugaaaagagaagaaaugaauaggacccaggggcagccggccaguuccucacucuugggauugggaaacagagagugagucagguccuuagcagaagcaaaagcuaacagggucaaugagauggaggucagaguagcaacuggugauggccuaauguuaugaguaaacagaagcugaagaaggaacagaagggagaaaacaccagucacuagaaaaccaguugguagcagcaagagaaauggaaaagagaauuacagaaagggaguaccugagaaacauuaacgaugggacacccacagaugcacggauauucaaagggccaaacuaugugguccagaacugcucugaauccagaauggacuucuaauuccagccucucuguagccuggaguuucuaggacucacucccucaagugacccugcacuucuugagcuggcuuuggugacuuucugucccuuaaaaugcaaggaaccuaccuagccaaagugaugagggcauuuuucaaaauggaagccuaauacaaacuugggccuucuacuugugggaaagauagcacuaaacuagggccaggccucagcuaauuccuccaguaagucuuuuaaauguagaggugaaauucacacugaaaagucugaugaggaagcagagguaugcuuacuaacuuguuuugcaaguucuggcccugaagguaggaggugacuugccgucccuuggaccuagaauguccucuccuacucugaucugcugacccaccccuacuuacucauccuuuaagacucacucagcauuggugucauuucugaaggcuucucuaaugccccuacuuagcuaaaugcauuccucuaugcuccaagagucuccucugcaaaccuacaauagaauuuaucacaccaucucuucuccuacaaccaauuccaaaguauaagcucucucaaaaccccuucgauaaaauccuugaauucccagcaacaaacacaaugucuaguacauauuuguuuaacacauuaacucaugacuaguauuuuuuuuuuuuuccugagacagggucucgcucugucgcccaggcuggagugcaguggcgugauuuggaucacugcaaccuccaccuccuguguucaagugauucuccugccucaaccuccagaguagcugggauuacaggugcacaccaccacaccuggcuaauauuuguauuuuuuuuaguagagaugggguuucaccauguuggccaggcuggucucaaacuucugaccucaagcgauccacccgccucagccucccaaagugcugggauuacaggagugagccaccacgccuggccaugauuaguauuuuuaaauaugauuuggaccagcaagguugcugcuuuuuggauauaacucacacagcacugccacccagugaggagguacuagcugaaaugaacaugauuuuaauuggaacugcugucagcacaugcacuuuaguuccugcuguuccagacugccuguccuacuuuaacuucauggacuguaaaaagagaaacccucaaagagaccaagagauuucaauggguacagaguuucuguuggaauaaacauguuuuagaaacgaauaguggugauggcugcacaagagugugaauguaauuaaugucaaacuaugcuuuaaaaugguuuaaaaugguauauuuuauguucuauauauuuuaucauauuaaaaaaaaagagagagaguaugagcccagccuggcaucacuaacacacugauguacccacagcuagucucuuucuuuccaaacuaugugacucucuauuugggcaaugccccacauccuacagagucagguucaugauguccccagaagcaaguccagagggaccagucacauacaugggacaucaaaggaauguggaagucaguaaaggacauaaacccugggguuugcauaggagguaggggccaacucccucauaucccuccugaauguggcugcugcaggccaggacucagagcuguccuagcaugugcagcugggaggcaguguuuacuuguucugguaggugcugauggucacgugaguagagugggccagccccgcaggaguguccgcuugaugaaugguuccucugggaaaguacaacaaaucacccggcuaaaggaaggaauaggaaaggguagagaaguuaauaaguauuccuucucaguccucuucauuucagggagauaaauaugggcuuugagucucaguucuccauucuagaaaccacaaccucaaggcacagucuauaugcugggcucaugucgugugcagcuagucuagcuucucuguguccgugagccugucacuguuaaccaugauccacgagaggcucucggugccugaagucacuaucuuuucauucucaagcugagacuagacucaccugagacuacccugcccugaugcagggaucaaggaagguaacauccugugccugggacgccugcuuccucccucuugcaugcuucagugguuaagaguaggagcuugaauuuagagucacacagacacagccacuuacuggcugaugaucuggcaauuuaccugcccaaagccucaguuucuuuaucuguaaaaugaaguuuaauagccccaaaccuuacaggauuauuuugaggauuagagaugcugcuuccaagcucuuagggcaaugaugggcaugugauuggauuauaugauuuuauccgccagucccccacuuccugauaauuuuugaguacuucuaggcgcagggucuguaucuuaccaucuugucuuucccagagccuacccuagcaaagcaccuagcacucaacacaggcucaaugaauguugggaugaauugaaaaacuauacaaucccuauuucaacugaaaaauaagauguaaucaaaaauucaucauuuucuugggcagcugagccuccucuacccuauuccaaguggguggaccaaaacauucuccccaaauuacuccugcccugagcugccuccuucccaaucccacucaggccaaaauauuccauguagcagcuaccuauggagaaaagagggaaucuugagggcagcucaucuucucucugcaacuacaagagguagucuagugcaaugguuaagaccaugagcccuggagaaagagcucaagaaaugccagcuuaaaaaaaaaaauuaagauucuccucaaagcaagaggaauauaucaugauauauauucauaagagcuaucuuaguugcaaauuuucccugaaugacaacaaacugacaguacuucaaguaaaugcuuuacugauaauuauaacuaucauuuacugagugucucugugccagccugagugagacucucagguauacagucacaugccacuuaacaaugggguuauguucugagaaaagugguaugucacugcgcaaacaucaguguacuuacaaaucuagguaguauaguguacuaccuacauuacaugguacagccuacugcuccuaggcuccaaaccuauacagcaugugacuguacugaauacuguagaaaacuguaacacaaugguguuuguguacuuaaauauaucuaaacguggacaagaaaaaacacaguauaaacaauaauaaaugguacaucuacauaggacuggaaguuacucugggugagcccgucagugaugguaagugaaugggagagccuagggcccuacuguacacuuuuauaugacuagcaaagaaguaggguuguuuagaccagcaucaccacaaacacgugaguaaugcguagcacuacaacauuuuacaauggcuacaauaacacuaggugauaggaauuuuucagcuucauuauaaccuuaugggacaacugucacauauacagucuguuguugacuaaaaugucaacuggcacaugacuauauuucauucauuucauacacauuugccccacccuccuggcuggaaaacguaaguaaacauucuccccuacagccuccugaaggaaugcaguacagcaacccuagagagaucccuuuuagucuccugaccuucagaagcauaaaauaaugaauuuauguuguuuuaaaccauugaguuugugguaauuugacaagaagcaacagaaaaacucagacagacauacagauauugccucuaaagauuuuuuuuuuuuuuugagacggaguuucguucuuguugcccaggcuggaaugcaauggcgugaucucggucacugcaaccuccaucuccuggguucaagugauucuccugccucagccuccugaguagcugggauuacaggcaugagccaccacgcccagcuaauuuuguauuuucaguagagaugggguuucuacauguuggucaggcuggucucgaacuccugaccucaggugauccaccugccucggccucccaaagugcugggauuacaggcgugagccaccgcaccccgccuaaagauuuauuguaaaggaggcagcaaaauaauauuuuucaauccucauagccugcaagguaaauaucaugaucucuguuuuaauaaagaggaaacugagacuuggauuaauaacuugaccaaggacauacagcuaauaagugacagcagcugaauucaaacucagaucugucagaucccugagccacagagugguguuuccaucacaggcgugaucucauccugggagucugggucugcagaugaacugcacgggcugccacuagcauaggggaaagaagcggauaagggcuccaagacccccacugucacccucccaugcccaucccucaaccacagccacuaagccuuucuauuucaucauugggcauugacacaagguuucgccugaagaggcccacugguuaaaagcucaaaugugggccaggcgcaguggcucacgccuguaaucccagcacuuugggaggccgaggcagguggaucacgaggucaggaguuugagaccagccuggccaacauggugaaaccgucucuacuaaagauacaaaaaauuagccgggcauggugguaggcagcuguaaucccagcuacucgggaggcugaggcaggagaauugcuugaacccgggaggcggagguuucagcuagcugaaaucacgccauugcacuccagccugggugacagggugagacucugucuuaaaaaaaaaaaaaaaaaaaugacaugcacauacacauacacacuugaacaauacuguacaacauggucuuucucuguccaggagacucagugcaucuccuaauggacucuguguugacuguuuaaugggcaugggcauggcaacaauacaaagaauccacacccuuuacacuuaaaggccacuaugaagccugaccuucucgggcagagcaaguagccaggucaccggccugaguaacucagcccugacuuccgagaguacagauggcuuagucuuuaaagauaaccaaccgugaaucuauguaaacaugaugcaacaaagcuggcaaccucugugaagagccaaauggaaagacaguacguauuuuugguuugcgggccaugugaucucuguggcaacuaguccgcucugcugguguaguaugaacacaggacauuaaggaauggguguggcuguguuccaauaaacuacuuacaaaaacaggcagcaggccagauuuucugguccaugggccacaguuugaugaccacugacuaaaagcauaaaaaaaaccaguaagguuaccuuuacuguuguuuauugauuuaagucuccuguaauauaggcacccauccuaaacagcaagauuguuucccuuaguuacugggagguagguaaggauuuugaaaucaagaaacacacaaggcauugaguaagaaacaggcuaauuauaacuucgagacacaagaaaaacaauaaguauaugcaaaugugucagguugguagaaucuuuggaaugguuuaaaauaacuauuguuuuauugcuaaaggaaauuaaguuacauguuuuaagaaagaguauaaaguugaauuauggaacuacuccuauccauguaacguucuuuuccucaacaaccucuucugcuggggauuggcuauguucccaucgauguuaacugcucaaagacagauuuucucagcagcaagaugccaaggaaccugcacaugauuaagccaccugaauccccagagaaggaauccucaagaacuuuccugauuacuacuguucugguaacuaugcagggggcacagagauagccugacauauaaccaggaugaaaaugagucacacuggaauuuuagcaacaacaacaaaaaaaacuaagggaucccuggcuauguucugccuaagcaacuuccagcccugugcugaccaucgucuuggauguggagaagcugcccaaggccagagcuuccauuuuuccucuagaggagucagugguucacugaauucucuuucuuccuguuggacuugaacuguacaugaaaacagguuauuugggaaaugaacuuaauacuuccuuaacccacuucuccaagugcaaaccaccaagacuccuucagaaauuacaugugcuggcugacagcaaugagaagcacccugcccugaaacccagggauauauucccacggggaccaucacacgaacucuaaaccuugagccugaacuugucuuagcaauaggggaaaccacaauggcucuaacaaugaggugcccacaacgguuaucacauaccuucagcauaaacucaugcaccggccugccgauccuuuccucggccuccacgcuguacucucgugccaggggcacaguggggugguagaggcgccaguguuucucucccuccagcugcaggaugaaaaccuagagacccacaaggcccaggagcaucagagagcuuccugacaacucacacacaaagugcuuccggacuauuagcccucuaaggggcuaauagacaaauauauaggugaaccuugaacaacacagguuuuuuuuuuuuuuuuuuuuuuuuaguuguuauagacagucucauucuccuggccaggcuggagugcagugucacaauuacagcucacugcagccucucaaacuccugggcuccaaugauccucuugcccuagcuuccuguguaguugggaagcuggcaugcaccacagcucccagcuaauuuaucuucuuuguagagauggggugucacuuuguugcccagaauggucuugaacuccuggcuuuaagcacuccucucaccugggccuccaaaagugauuacaggcgugagccaccacgccuggccuaacagcauggggaugaaccgugcagguccgcuuauaugcugauuuuuuucaauaaauuauauuggaaaauuuggaggagauuugcaacaauuugaaaaacaugaaaaauaucaaaagaauuaagaaugucauaaaugcaucaaauauaaaaacauauguagauacuagucuaucaucuacuaccauaaaauauucacaaaucuauuacagaagguuaaaauuuaucaaaacuuaccuauacaaauacuucuagaccaccauuugcagucaagaaauguaaacaaacuuaaagaugcaauauggaauagcugaauaaaauuaacuuuaguacauauuguacuacuguaauaauuuugugcuaccuccuguugcuauugccacgagcucaagugugaugcuaauuaucuccacaugagcaguuccucucuccagugaauuguguaucacaguaaaaaaugaucucucaacaguucuuguguauuuuucaucauguuuagugcaacaacuuaagccgugaauaacaccaugggacccauaugaugugccacuacugcuacugcaaguacucccgagaaacagaaaaaagucguaacguuacaagaaaaaguugaauugcuugauguguauuguagauuaaggccugcagcuguggcuacccaccauuucagauggacgauucagcuuguaaacaaaugauguaaacuuacgguacugauaaacacaauauuaaaaauacuuuucccuuucuuauaauuuuaauaacuuuucuccagguuccuuuacugaagaauaaaguauauaacacauauaacauacaaaauaaguguuaaccaauuuaugcuaucaguaagauaucuaggcaauggaaggcuacuaguaguuaaguuuuagggaagucaaaaguuacaagcagauuuuugacugcaugagguguuggcaccacuaacccccacacugcacaagggucaaguuuccgauaaaaaauaaaaaugaaagaugagaaaugcaugucauuccacaguuaaacaaaaguugccacuacuggguuuuauuuuuaaaaacggaaucgugaauccugacacuggauauucauucuuuucacuuucuuagagccucgcugaguucuuuauaucccacuaucucauuccuuuaaaucuucuaucagacagcuaaaagcccauaaucucugauggaaaagccaagcuucagauauuacugaaugucuaaauccugaauguugaaagggccuggggagauaggaaaacuucgaguuuuuuauucuuuauucagucaaagauauucuauuaaaaauauuaaaaauaacauuuugugaaaauguauugaugucaaauugcuaucaaaggagaaaaaggggacuuuuuaccaauaacucuguguuuacaccuuauauuaggacaaaaauaaaacuauggaauacauaagccaaagaguuaaauuuuuuuggaagccauaucagagugaaaucaacacuugucaagaugccaaugcuuaagugaaaccaugacccucauucaagcugccccaagauuuucacaaauggaaaauauauacauauuuuuggcagcuacugaaaaagaacaaaaugaaagcacaugaaggauuauuugugaccucaucuuauuaaagaccauacuuugugaaauuaaaggaaaagccaagcacaccuuucuguagauaaauucaauaaauacuuguuucagacgaauguguggcucuuuaaauuaguaagguuggaaacaagcuguuccuuugagacagagcaggaaaccaguuuagugggauuuacuuuggcccaacauuuugaugaaaucaauaucucagaaacugcacagaaagagcgaauacagaccuaagagccuuagagaauaaugugaacucacccugacaacucuacuaaaccaggcucucaacaacucauucuucccaacauggggcaauuuucuccaucucuuaccucgacaucaucauaauggggcggcaggcccugagauccugcgggaguuauguacacauucgagccaaccaaggagccaaaguaacauuccagcuucuccuggauccuccaaagcucauccuuuacaaaaaaggaaaaaagaaagggucggcgugggggagugaaaaauguauuagaaauaagaauaagagcauguucuuguucacuuaggaagucuuuacugcacaacuauuauacaccagauacugggaauuaugcaaugauacagccaauacccauggucucaaaaaucuuccauuccagugcagaaacaccauguaacagacgugaacagauaaagggaugacugacaaggugggcaauugggaguccggaaggcuuuuaagcagggaaggacacaauccaauuuacauuuuugaaagcucacccugguuauugugugaagaaugcacuguagaaaagaguggaagucagagagacuagugaggaagcuucucaggcagcagcucaagcgagaagugacuggggugguaagaaaggcaaggagggagguagaagagugggaugcacucuagaagcagcacagacaggacuugccgacagacucaauguaaaggagcggaguuaaaaaaaauacucuuggguuuuugacuugggcaaucaguuccccuuuccacguaacgagaugggaaaaacuuacuaaaaaacaaguuuucaggacaaaaaaaagaguuuuauauuaggaauguuaaguuuggaaugcuaagacccccccccccccccccacauggagaugucuuuaagucggucugaaguucuggcagaaacuaaggacugaagauuuacacuugggaauugccuacacaaaauggauauuuaaagcaaugggaacagaaaugauaacacgggaagaagguacagacagagaagaaauaacaggcuggguaauguuccuucucuccacuaucaacucuucagagcagacaucagacuuaggggccuagcgaugggccauauauucccaggagagagaaggaagucugauuuuaccaaggcuggugagaagagaggaggggggcaauuaggccauguagauauuagcacuuccuaugugccaggcacugucuccaagugcuuuacaaauaucaauuaugcaacccucacaauaacccugccucauaaagaggguacuaacauuaucuucaguuuacagaugaggaaacugaggcaugagaccaugcaacuaguaaaugauggagccaggauucaaauucaggcagcauggcuccaaaguccauaccuuucagagaauuuaagaaaagacaaaucacaaagggcacuaaagagacugaaguuuuaaacauaugaauguacagugccuggcacacagacugcaugacaacauauuuaaauacuugcugagcaaaccaauggccacagcuugggagucccuucuaccacaggagugaaaaagaauccacuguauuaaaaauaucaagugagaaagaacugggaagaacugggucaauaugaaaaaagacuuuuuuaagacauggucuugcucugucacccaggcugaagugcaguggugugaucacaaucacaguucacugcagccucgacaucccaggcuuaaaugauccucccaucucaaccucccaaguagcugggacugcaggugcaugcuaccaugcccggcuaauuuuuuucucuuauuuuguagagaugguggucucacuuuguugcccaggcuguugucaaacucuuggauucaagcuauccuccugcucugaccucccaaagugcugggauuacagaugugagccauggauuuagccaaggaccucuuuauacagaccacugggcuucucuauagaucucagaguuucuacuuaacacagaaaaaauaauuuaaugucaucugaauagcuccaaagaguuaacagagcuccaaaagggccuaaucuauuucagggaaaggccagcaggaccugguucuguaauuauuuuuauauaguaacuggaaccacuagaaaaccagggcuucucucucucucuuucucucucugaugguaugagaggucuuucaggacuguauaggugauuuuaugguucccgacccaacuaucaggguaacuaaugaauaugucucuuuucuucuuaaagguuacugaaaaugcuaucaauggcacaauuuuucuauuucaucuggaccuuuagccucugaaucugccaaccguggccuacuagaagagaucuggagucaaaccaccucgguucaaguuauaauuacaagcaaggugacuucaguuguuuaucuuuaagauaaagauauuaucacucccacucaaacacuguggcgaacagcauaaaacaacuuaucacaaauccuauuuaaauugcaaagcaguauacaagcgauauugcuuuacuaacauugacucaagcacaaacaaggcuccugaaaccugucuucuccuuuaccacaggauucgauauccagcgagcccaaggaggaccuagaacagugaaagggagaagguggaagucucucucccggcuggcugugaccuccucucuccacugaccuacccgucagaaucaaaacucaacgccauggcuaaaauagaagaccacguauaugccuaaagaaaggcaaaagcaaacauauaaaaagcccuacuaaauuucaauacaucuuucaaaguaugguaggaaaaugccuuaaauuuggagucagaaacccuuaucagcuuggaauaguuauggaaaggucacaucugugaacuccaguuuuuccacauacaaaauggaguccacggcugggugcgguggcucaugccuguaaucccagcauuuugggaggccgaggcagguggaucacaagaucaggaguucaaggccagccuggccaacauggugaaacccccaucucuacuaaaaaaaaaaauacaaaaauuagccgggcauaguggcaugcaccuguaaucccagcuacucaggagguccaaggcaggagaauugcuugaacccaggaggcggagguuguagugagccgagauugcgucacugcacuccagccugggugacagggcaagacucugucuuaaaaaaaaaaaaaaaaaaaaaaaaagaaggaaagaaaaaaaagaaaauggaacaaaagcugcccuauuucaaaugccuguuagaaagcucaaaaguuaaaauauaugaaauuacuugguaaacucuagccugcuaagcaaaaugcaaauaauugugauaauuccucucaccaggacuuuuaauauauggauuacugaaagcaaguccaaacaacuuauuauggcucccugguuaccuccuuacucguuuuuaaacuaacuauacuaauaagcugugcacagucugagacccaauaaacaaagggcugcauguucacucuaacagucucucaaccuggccagggauaaacuccuucuagacuuccucuguucugacguuaauaugcccauuacuaaagaaacacacacaaugccaaaccaccuuauaauauagcacuuagaauccagacucuaguguaagacggugagcuccuauggcuuauaggucucuccagcacgggugguacaaagagauuaaaaaaaaaaaaaaaaaaaggcccagcacaguggcucacgccuguaaucccagcacuuugggaagcugaggcggguggaucaccugagggcagaaguucgagaccagccuggccaacauggcgaaacccugucucuacuaaaaacacaaaaauuagccaggcauggugguaugugccuguaaucccagcuacuagggggacugaggcagaaggaucacuugaacccaggaggcagagguugcagugagccgagaucgugccacuguacuccagccugggcaacagagcaagacucugucucaaaaaaaaaaaaaaaaggcacauccuagucuggccugagggcugaauuugggcugagaaagcucauccuuccugcuuuaauaaacucagccagagccuagucaacaaggcaaaagaaacagguucuuggacacuggaaucccagacgaggaaugugcagcacuuaaguggaugagcagagaaaagcccugcgggggaugauucuaaaguagagaaaugacagccacaguggauaccacacauaugccaaauaucaucucucugcuggucuaugaccaaaguacacguaaucaaauucacugaauucauuuauguuuagaguucucagguuucuaaaaaccacucuuaaaagugcuacuucuagucaaggacuagcucagcgagaagcauuuuauugacgguguccauauuuucugaauucaaaucauaacuuggucugacaaaugauuuguaaauucuuuuugagugccuaggccacaagguuagcauuucagggacauuucaacuuuguaugauugcuugagauggaauagcuggaaucaggacucaucuugaaaaaucuaagagcacucauaccucauacagaguaugaauagguucaagaucuuuuagacaagaaagaaagggaagggcauucaccagaugaagcccaaugggauauaacaagccaccucaaguuaaaucacuggaaacacuauugguaacugacgacagagccccagaagccaucaauaaagccagaauccauuccucucaacauggaaccucacaaaccccucucuuucuccuccuauguugccauuuugauuuaaugaagggucacagaaggggguuucugaauggggauaaaaguuuaucuaaaauucagaacagccccucaccuauucugggccaucugucaugagaugagauacagaucucaaaccuugaggaaaacaaauuaguucauacuaaaucugcauuuuauaaauguagaaaccaagcauagaggaggcaaauuauuucccaaaugucaaucccugauauagaaaaaaauuuaaaaauuugccaauccucugcauuugcaaagcaaagauuuccuccaccuaugaagccuuaccaggagcaguuccagguaccucaaugucacccauucggguguuauuaagggugaagucucuuuauuggacuugcaucuagcaugugaucuggucauggcucugaagccuccauuuagaugcaggcaguaaagggaagcaacuucgggaaaaaaugaucaccuugaugcugucaugccuuaaauuacagugaugugacaaaccaaauagaaaugucuaucauauagaaaaacauaaacuggcucacagaacauacuccugcaguuguagugccacuuuaacaacuuuauaaacuugcaguauaauuaguuuugcagcucaaugauacccaacaaugucuacccugaguugcuggaguuucuaacaguccaaccaaacauaacacauaaucuuaauccuaguuagaaugcauuuagaccaaagaggugcuaccccuucucaaacuggcaagagacuaaccaucaucaaacuacguauucacccuugagcugauauguggccaaauguuaguacuuuaaaauguaugaggauucugcaauggggaaacugguuaccuuaaaucucugagguuggugaaacugaaucguugcccuuuucugaucaaaaucuuuucucagcugaagaaagugugcuuugccaucuuuauuuaaaaccuucuucuucccauugacacaccggcagacauucacaucucuuccauaguacaucccccggcugcacagacucuucagaucuguuagcuugaacagggacccauaguauguggccagugcagggucaucucucugaaugagaaggggcuucugcucccagaauuccuugaaaaaagucucugucuugaugggcgagauuaaacuuucaaagagacuacugggacugucaaaguuuaaagcugaaggccccccagcugcuucuaacuucaucugcuuacagggagccggccccucuuccuucccacucccuguaggcuuugcuuucuuuggcaucguucugucuucaagacaaagcaguaaggaaaugcaaaccuaccaaaagaacaaaacacacaugguuagguuuacaaggagugccagcauugguguuaguggaucgcgcgcacacacaacugaaugaccauuacaccuucgugagaacucuucauaggucaaagcuacuucccccaggauaggagacagccuuaagccaaugccauuucuucuaagauaugauucaagcucaaccaccacucagaugacauauucaucuaaagaagaacguguuuuucuuuuacacaagcacuaugucaugguauuauuuauuaggcaguauaauuaucccaaauaaaccuauucaacugucucagcaguuccuacucacagguuuagccuguggccacugacacagcaaagucaaauaucuuggauuuggcucccaucagcaucagggcccacaucuaauuagauguacucugaguuacaaacauuugacuagagaaaaacuaacagccgcccacugccaggugcuccucaccgcagcaccaccccaacuguugcgcaggucaaucaaugcgcccuggacccgcggugucuccugguggcuggagcaggccacugccuucuccugucuccacuaaccaccugaaccugcucacuuccaacucugagcuuauuccugaaaacggccacuuuuaucagaaacuccccuucguuuaaagaaauaaagccccuaaaggcugaaaagugaaggcuaaaaguaguuauaucuaaagccuugaaaaaacuauaacuuuuuaacugaagauuuuaaauaauaccaauaucauuagccccuaacacagcacuucuccaacuuuaaugugcacacagaucaccuuagcaucucaauaaaaugcaggauaugauccacuagcuccaaggugaagccugagguucugcauuucuaacaggcucccaggugaugcuucugcugcugacacugcugaguagucgaagccacacagccaagccuugcaaagcuccuucagaacugccuccaaaccacaacuauugauacuuagaggguagguuucccucaucuguuuccaagaacuguaauucaaauuauuuaaauuuccugagacugcaaaauucuaucuuaaaguccuuucccucugggaagggacuccaucacuuucaacagauucuuaaggaagucccuaucuccugacaagguuaagaaccacuguacuuauaaaaaccaaaauuucugaaagacuuguuauuuauaaaugguauaguuuccuacuuuggugaguuaucagaauugcaagaauacuguuuucuguucuuuugucauuauaacuaagcaguauuucagcuacacuguagacuaaguggaauuaauguucuggccugggaaguaagcauccuggaacgauguguugcauacugugugacguguugcaacuuauaaaagaaacuuuagauugaaacccagauguaaacugaacaaauuaagaaaggaaaugucaaaauauaaaacccucuaaacagcuccauuccuucaaaagaccaggugcuuuugauaaggaaacacaggacaugguggaagacuaacacaaacugauacuacaggagagggguaaagcuugaagcuuagaaaaaaaaaauaaacuuuaguguuuaggauauguggucaguaagacacauuuucugaaaauguuuccuuuaagugaaacagaccagcuugaauucuccaggaaagaauuaaggcuucaggaaggcacagcauugcuaguacauggaacucucaagugauggagaaauacaaagagauagaaaaauggauucgggaagggguacugcuuaugcagaagacguuccauagcaggccugacugcuauccuuugaaagugcagcuuguggccgaugucugagaacuuaagauuuugggagaguuuccaccaccauuaacugauaggaguggcucaccaugccuaaaauguacaaucauuacaguuuauaccaacaccugcuuuccucugggagucuggaaacguugguaugugccaggcagggguggccuaagugaaaagcccccaguaaaagcccugggcacugagucucuaacaagcuucgcagguuggcaacauuucacaaguguugacacaacuaguugcuggagcaacugagcacagccagugugaccgcucgaagacccuuggagccuugcacuugguauccccagaacuucacccaugugccucuucccuuugcugacugugcuugauaucuuuucccuguaauaaaucagccgaguccuccuagcaaauugcugaacuaaagauggccuuggggaccacagcacauugcucacguuuaauuuuuaaaaacuuagauugguuuauuagguuuguauuacuaaaggcacccuauagagucauuuuauauucagccacacaucucuuaucucucacaauuggucaguuuaaaauucauuuaaggggagagagcaggaggaagaugcaaacgaaaagcuuuucuuuaagcauaauauaugaauacaguauaagcacauucaccagaaaguguggcuaaucaaagaaugcaaaacacuuaagccaaaauaaaaucacuuaaaagaaucuuucccaucuacaaucacuaacaaaccccaauacuguauaacaaaugcuuuccuuagaauauaaauuucacuacccauacugccaaaaguuacaucauuuguuucucuguguucauguugaaaugauuugaggcucaguuaauuggagccuaagcuuagagguuucugggcaaauacauuauuucucugauucucacacuacucauacuguaagacaaccauuccucuuaacagcuuucuagagcagaggggagaauagaugaagcauccuaccacauuaaacauacaaaagucuuaagguacauaucauaauuucggaaacagcaagaaguaaaacacauaucuuagaauccaauacuauaguaauuaaagaagacaaugcuuugucuagaauaguacagccaacacaaccuugcccauaagccuuagagaccaccccaauaggaguaaauauuucuguaaaaucacagaaaaguuuuugaagagcaauuguuuuccauuugaguugacuauaagcauuaaauguaaaaagacuaaaagauuuacaguucauacuuuggugacuaccccacagauaaacccuauaagaaaaucaauguugacaaccauacuauaggcaacagacagacagucacuauauuuuaaagguacccuaaccuccuuuucuauaauauuugaggacaugaagacgugaggaagcucuugaaggaaaggauuuguauauccccggaaacaagcacggugugguacauaggagguccucaagaaaugucugcugaauuuuucacauuuucaucuuuugucuguauacaauuuuggagacaaaccacaaaggccuuacacaaaacaguuacggaaaaaacagauggccugugcagaggggauuauuuuucugauugcagcugucacuucaggauucaagaguaucguaaaagcuaaaaggcacuuuagacaucaguaguuauuacuaaaucggggagggaaguaugaauuucuacauccccugggcaguuuuacagaauguaguucagaguuaccagcaagguuguuagcaugcaaauuucugggcccucaucaagcccacuggauugccacuucugauggcugaggcccauaaucugcauuaacguaauacgcucucuagaugaauuuuagguccacuaauggaggacaacagucaaacgcagcucaguuaaacacacggcugucagaaauuauauauugcuuguaacaagguugcccagacugaucuaaaacauuucuuuuuggcucagagauauguuaaucaauccagagggaaaacugguucuccuauugaccuaaaggagugaucagcaguuaucuuuuuagucugauuuuagagaggaaacggacuauaccucaauguauuuucgugaccaugagguuacaaagcuugauguccaggaggcaaaaaccaguaccagcagaagaagcugaguaaaucagguuccucugcucaaagaugagcccagugacaugaaacccgaggcaccagauuuacagcuaaugaguggcgaaaucagauccucuuccucccagucuauccuuccugaaaacagugaauaaccuggucucaguaaccuguuggacaacccagcugucggc

SEQ ID NO: 18143 - RNA, 708 nt, Homo sapiens
gacccaaagcuuuaauaacuauuauuaauacaauaaacaaaauaacuuaccucuauaaaugggcucaaucugccugggcugucuugaacacggaaauauuuugacacugguuccugaaaaauuccaccaaaucuggcuccuuuuucugaggaaugacuuugggaagucugcagauacugaugauaagcacucuuuaaagaagaauguaguuuagaaguaaggucagauuucuggagaaacgaggucuuuucuggccacagaccaacuugcagauuggagguaguagguucauuuggcaucacauaugaauucuuagaaauuccaacgcucuccuggucaucaggguaaaaugugauggaaggaucuggcaacuggaagguaacacgcuccccacuuccagcucucagaucuccuuuaugcaauacugcugccuccuccuccucuucuuccucaucagcugccucucugucaucuucaucaaaauucaucuuuaaacguucugacacugacuggagaagggauaaaacagaagaggacugguuuucacugucucuugauuuccuggggccauggugaccaggugaaaccucacuagauagaauguccuccugugagcugucauccucauaaaugggagacaaugcuaaaggauaaauuuuguaccuuuuggccuccacugauaagaacauuucugaacuaucacuauca

SEQ ID NO: 18144 - RNA, 5577 nt, Homo sapiens
caacgcugagucugcucuuuaauggacaccgcccacuugucugcaccugacugaggcgggaacaggaggggucugggaaauggugccacugggccugggugccgcacagucugcucccuggggacagaaacccacagggucgagcccugcaggccucuccuuccaggaagggccacaacuagcagccgccugccuccucagccccagggagggcacacaggcuggguggcacccaguggccaggccccuuagcugggccgcaggcagcacugagccgccuggagguccgagguccguggagguggggagggggugcagauguccuggaggccaagguucaccccucacauguuggugcucauccgggacuggcuguuggcuggagucagcucccccuggcucccuucucugggcggggacugcaggggagacaaggagcagcucacagccaccaggccccacacgccgugcgccugcccccccucaagccagcccaccuugacauggaucugguugcggagcacagcugcccgcagcaucauggccuuggcgcggcgcuggaacuccuugcccaucaacagagacuucucaaagguggugcugcgcugauccacgucccgggcguauaggaucugugcaggcacaagcucagcggggcccaggcucacccccagcugcccccaccgccccgcagcccacagccaccuugcugugugaguccacacgggcacugaucagccccuccaggauuagcugcgucagcucguccuccagggcggccaccgugguauugaaggcugccgccauccuaugcaugucggcugacacguaggggcugaaauacugcagggcagagggaagucagcuccacagcccccugcaugcccgccugccgugugccagccugacccccacgcuuaccuggaugagggcacgguugcgaaucuggguguacaggguccugacauggggggccagauacauguccaggagcagguuguccuggggaaggggcuggucaggaccaggacaggaggccaggcagggccccaccucaccccuaccccaggcggggcccaccuucaucucguccagcaucuugagacaugaggcguacuuggacucguagaauuugaagaugaugucucggaccuguggcuccagcuccaagaacaacuugaaggagcuggugaggcagaccccucagaacucuguccucugccugccccucccuccaaguggccagugggacaccaguccccagacaaacaccugagaaaacgcuggggccagggggccaggacaugcaaggccgaagcagcagccacggagagggacggggacagccuucagggcugcaggaccggggcaccuaccugcuggagaugacauugcgcugcagcuccugccggucaaagguagccaaggcgcacaggccaccguagauggccacguugcugggggacagcagcugaggagcagagaccuggcgucacaggcagugaagggccaggccaccccugccugcccaucacccgcucggagaaugccuaagaccccauuugugagagaccucacccuccuacagaagcagccugacccaugagcccaugcucugccucccaaguccccagagggcuccucaccucagggaagucacagugaucaaaggaagccagcaggaggcacuuggcagccugcuuguacuuccuggcggccagcucugccaagccuaguggaaggagccgggggcggggaggggggagaggggguaagaccccagagccuggggaagccgcuaacgccuggaaaccagggagaacgcgaccaccagccggcucgcuggccucuccugccccgggagcuguuccucagcgcuggggacagauacucuagucacggguggaaagagccccaccaaugcugaggaggcucccugaagccaggcaugcagggaagcccuaggugcuagcagggcugcaaaggacaccccaguucagagcagcucgggcuggcagaccugccucacgcccacagugacagcagccagacccugaccacacgucacccacuggcuuccccggggcagacuuuaggcaccaccuacaccuguacaugugcccacaacauccugcgcccugccagggaaguuuucccuggcugaggcagggaccagccuacugcccugggcugggaggacuuagcaacaggggaacguggggucagcugggcgugacccaggcccucaccugcggcacacuugagcuuggugaggauggccugggucuggcugucacgcucuccucgcugcuguaggaggaagccacaugcgugaggcccaugcuccacauuuccuagagcucgaugcccagcccccagacugagaggggaugaaggcagauucagaucugggggagaaugaggugggggaggacaggaggggccagcaguggucaggaauccugggggcaaggucucugaggagguggcccguaccucggcaaucucugggguggacucagccuugcugacguagcugagcacaugagaccaauucugcaaguagacgcugaccuggcgggggggcgcagagccaagugagcccgggcgccccaauggcccagccaugcugcccacccccgcccgccgaggcaggccgaccuugaugacauugaggcacauguugaugacguguuuggcgcuggugcaguagucccgggcccgggaauagcacuugagggcguugcugagguccccacaguccagguaguggucgcccaggucgucguggccgcgccggaugcucucuuugauggaguugcccuuguaguucuucaggucuguguccagcuucuccagcuucagcagcgccuucuuccgcguggccuccacccaggccguguccagggcugggggcuccacgccgcucucagggauggcgucgggugcguucugcagcucccugagagaggaccuggccaucaggauggcggcggucacgggggccagggaggaggggaggaagccgccaaucucaggcugcccucaaaggcccaaccggcacacaggugggcaccucccgcuggccucaaaccccaccucuagggaccagucugcaccagggccacagagagaacugcugccccaggagccuacagccggguggggaaaccagcagggaggcggccccugagccacagucuccaacagcuccccuuggaaucaaagcccugcaugcacacacacagaagccacacacacacagggcacuuccacugcuggccaaaagagagcgagagcucuacccgcccgacuucccagcacaggggugggagaugcagggcacaggaagggggcccagucccagacacccgcgcucccuugguggccucugcuuccucucgccaagccccuggccucaccugguggccucugagagcuugcgguggaucuccucguacauguccacguuaaagguucucugcacgaaggagagggccaucuucagggccuccacccgcagcguggggcagugaucagcaaugaacugcagccguucgaugcgcaucaggccgcuguagcuggccgcguacuguuccagauccugggagcaggcacagacaagagucaggcaggaugggaggcaggacccuggccccaggcccugagggucaggaguuggggccugacuguccuagccagaaugucgcccugggcccauaaccagaaccgggcauggggguacgagacugacugcugucccaggagcuacgaagaccgcuggggugggccuggcgcaggagccucaggagugggacccugcacccgggggcuuucggggauagacacccacuagugacugcuggucgcuaggcugagcggggaggagaccugcccuggcuucuccaugagcagcaucugaagcugagcuacaagccucaugugagugcgcaaucagaaacgcugaugguuucggggucagaaaaagacgacagcgaucacugaggaggaucauucuaccugcugugcaggcugcagcggggagugugcccuggaccccucagcaggacugagacacccaagguccccccacugggcuccguaccaggcugggguucuccaccacguaguugacgucaggugcauucugcgggucuuccuggggguccacgucgaucugcaugggcuccacggcccccugcaacaugggccaggcaccuggcaccucguccuggggacugccccaggagggcgagagacccgcacuguucucugaggucagcucugcccaagaucuuccaggccagucggaccacacucccgccgcugcugucccccaggugugcccucccagucacccccgcccccacccaggcuccugugccaccacaucagggaggggucuccucacaagacucuaaggcucagaagcagaaaccccucgccugauucuagccgcucaucucugaaagccagaaagcagacaggggacaaccaacuacacaggggccucugagggccccuacacguucccagccaccauccugauguaguuuccuccaagccacggagaagaacgggacgccaccucaaccccaggaggcaggaggaccagcccccggaaucuguccugagcagcggagcagcaauacugggcugagagucacgccacggaguugggagaaggggaaaagagucaucucagggagccucauggcccccagcugggagacacagagaagccaggaccucggcuuaacacaaagcaggcuggaaaagccgccaugccgggcacucgccggacccgugggccucccgcgcuccuucgggaaaagcaccaagagcucggcucccuccgcaggccccgggcccaccggggcucccuccccuccugcgcuuggcacugagucccuguccucggccagcagagcagcaggggcccagccacagcaggggcggccggggcccugcuccccccucccucgcucgggggucccuguccuggaagguaccucguagagcagcguacaggccgacaggcuggcgcucaggcugaaguccccggccgugccgggcaggacgaggucugaccuacugcugugaggggugcaguacagaucugucacugacgaggaggccgagcugggggccgagcuaucccucauucuguccugacuuucugcaccccccgacccugacacagagcuggcuggcugcugaagggagaaagagcguuagcgucggggcggccgggaaccucucccgugagcugcugggaggggaggcggggcgggcgcggcccggcggcccccgaucgcagcgcgcagccacggcggagacgcgcccucggcccugcagcccccgacgcgcgcugcccgcggaggcccggcacggagcgugcccgaccgacuccuggcgcaggccccgcgccccugcucgaccucagcccggccccaguggcggggggcgcgggggcgcggaggcccggggcggccucggcucguuaccugcaaguuaaacaccugaaccggcagcggcaucuugcacccaccccgccgcggcgugccguccacuucc

SEQ ID NO: 18145 - RNA, 18175 nt, Homo sapiens
ucauaguaauuuuuauuuuuauuauugcauacuuucaguauugcaauauuuugccuucgccucuuuuaauaauuuuuucccuuuaagguuauuaucuuaagaaaaaauaaugacuuuuagugccuauuaaguguguauauaaaauacacaaaaugcuacaacuaauuaaguuaucauguuaucuguuuuguuuagauuaaggugauacuaauugguuugaaaagagaacaaugaaaacgguuucugauacauugcuuugugaugauuuuuuuugugcuuaagucuugcuuuaaaagcaguauguucuaauauaaaaugcugaaagaaaauaacuauuuuacaaauucaucuggauauaauuguacuaaugaauauuaaauaguacuuaauauuaucaguuuucaugauaaacaauuuaguaacaauuacaaacagguaucacuaaggcuguagaaaaaauuuuagaaggaacaacagagagacgucuaucacuagucagcuguggaguuuaucaucuuuuaaguuuaucuuuuuuuaauaauguuucuuaaauauuugaagcggagauacgugaaacaucuuuuucucuagcgaugcuugauaauugacaccauagaaagcucuucaauuuugugauauuuuauaaauuaaaaauuauuuuguauuguuuaugaaauacauauuuuacauauacaaauucagucauuucaaauaccucaaccucucuugacauauuuuccuucaucauacguaccuggaaaagccacugucuugcuuagacccagucaucuacacauucugugcuagcacacaaaugcuaaacaucgauagauuaguaauacgugacugugauggcugaucuuacauuaaaguuaucauaacugccugguuaucuucuuaucuuucuuagaauguuuguuguucucucaaaaugacaguuucccuccuuguccucucauucuguucucccuuaaacccacugugcuuucaguuuuugccugaguucuuuaaggaaauagaaaccaucgcacaagaguauucucauuuuuuccacuaccacauuuacucaacugucugcuuuuauuccuaaacccugccuuuucuucuauaguauggaagaaggguuucucuuucuacccaaguccagcuucugcauuugugcuucauacuccacuucuuucugcucuuacauaauaguaucccuucccuuucuuaugugaggaguuucucucucuggaucuuuccugucagcagaaugugcuuucauguuucuugccuggaaguauaguggaauccuuucacucuacauaucucucuagcuauugauuacuuuuuauaguaccuuauucaaacuucuggaaagaauugccuguaguggcugcuguauuucuucaugucacauucuuuccucugcagacuccauuugugcuucuguuucuauaauuccuugaaacugcucuucuugaagucaauaauugucuuugugcugccaaaucuauuguuauuuuacugcucuuauuuuaccuaaaguugacuguuucuucacauuuuucuuucuuuaaacucuccuuuugcauuggcuuuccuuguaccucauugacaguuucaguuaguuucuuuuauuaacuccucuucuucuuugagucuaaauuuugaaauacuccaggcccuuaucugcacuuccaguuuuuuacauccacauacuuuucauaccaccuuacauagcauuuauuuacuaaaaugacccaaaucuguacuucugguccugacauaucucaagcacuccuacugauauagcuaauauccuaaaaccuccacuuggaccuuuuaauagucauuucagauucucuggaccaagauagcaucuuugauuuccuucucauggccaauucugaaaccuucgucucugacuuuucccaugucaggaaauggcaucaucaucuaaucuguauccuguaauucuaccuuuuaaaucuaucagaaguuaaucuaacuuuuuccaccaccacuauauaguauguaguaagagaaugguuaagagcuguuucuggagucagacugccuggguucauaucccaauucacuaugugcaguuucugugaccuggaacagguuaguuaauuuuguugcaccucaguguucauauugguaaaauuguaaaaauagugucuacuucauacuuuaucuacucugaaauaauuggaacaaugaguaggacauugcgaauacuuuauuccucuuugauauuacuguuguugcugccaccaucaccaccuccucuuccauccuaguccaagccaccaucauuucuuccuacugcauuaacuuucuaauuguuuucuauaccuaugugcuugucuucuacucaccucucccaaauccauucuaacccauucuucauaugguagauagaaugaucuuuuucaaguguaaauuauauaauauuacuauuaggucuagaaaaaucugagauccuuguguugauuacacuugugugaacuucagacuucuuuccauggcuuacaaaaccuuacaucuagcccuugcugaccuuucuuaaccucaucucauaucucacugcucuuuucugacuaugccccagcuggauuguuauuuuucuuugcacagaguuagucagacccuccucagggucuuuguacuauuuguuuccuaugccuggaauuauacccucccuuguacucauucagaucuucaaguaaauuucaccuuucagaaaggucuucgcugacuacccaaucuaaagaagcaccccuugacagucucugucucauuucauugcccuuuuaagucucugcccagaacuuaacauuaucuaauauuuguauuuaucugcuuucuccauuagaaugugaguugcaaaacucuauucccguguugugugaauuuagacuguaucucuagcuuauaguauaguauagcauuaucuuaaagucauggcaaaauauucaagaauacaguugccuuuaauuugacuuuaucugccagucuguaauacauugcccuguauggacccaaguucaagaaagcaauaccuuaacucaucuucuuauuccuuaagcuagauucagcucccaguuacaaauuagauucuucaaguacauaguugaguuuucccugaucuguugacauugaguuaaguuaccuucugaggauaaaagauuugauaaagggcugggcaugguggcucacaccuguaauuccaacacuuugggaggcccaggggggcggaucacuggaggucaggaauuugagaccagccucgccaacauagcaaaaccacccccucuacuaaaaauacaaaaauuaaccgagugugguggugcacaccuguaaucccagcuacucaggaggcuaaggcacaagaaucgcuugaaacugggagguggagauugcagugagccaggaucaugccacugcacuccagccugggugacagagugaaacucugucucaaaagagaaaagauuugauaaagguucuaguuugguuuagcuuuauuguagcaugauucuuaacuauuaaaauauucuccagucagccaaauggauugccuagguagucauuacuacuuaacacaugagagaaauguauaauauagagcuugauaccugaccagaagacuaagauuaugcaucucauuuucaauaguuaauuugugaguugaugguaacuguauuuuuuuguacuuuaauuaaauaaaaguguguuuuauguaacuggcuacagaaguuucugaaauuuuaguggguuaggguuaaaggggaaaauuacaacuuaacagugaugaaagguaugugaguggauccaugagauggagaaaaacaauacaagacacugaaauauaagcuaucuuuuaccguaaagcuggaaaaaguuuuaaaauagcuucuuuauuuugagcuacagcauggacagcaccaacaacacaguacucugcaaggauuucuuuuuuuguauuuuacagcuaguccaaauuucucuuuaguauuguuaacauacucuuuuguacuauucacugucauuucaauauuguugaugcucucuccuuguuccucuacuaaaagagauaucugaaugaaaagaucccuuaaauccuuuauuugguucuccaaauuaacaaguuccuugugucucuguucaaucucugaaaguugugcuuuagugauauugauuucuguaaguaagcuuucauuaaaaacuucccauuuuccuugaugaagcauaucauuuacaucuucuucagacaucucuuuuccagcaacuucaagcugacguaaaauaaaugucuugcacuucucuugcuuugcugcuauugugucauuguauauaaacaugauuugcugaaaauggcggaacauugcagcaugcugagauuuaaguauccuugugaccacugaagauggaccauuuucaaccucugacuuuuuaacuucuuuaacuaaaucauucaaacuucuguugauguauucugccugaauuuuuaucuccuuuguaaugguagacucucucuuaaguagacuaaaccuucucauugaagccaccagacuuuucuguugcugcccaaauuuuugaacauuaucugccaaauuguuaauacuuuccuguaguuuuuggauuucauguaggugucucucagcuacaggcucucuuucauaaauaacagcuugcuguagaaacaccccuuguuccucuguuucuguaguugauacaugacugucucuagagaguucaauuuccuuuguucucugcuuuaguucuugaagucggucuuucaucuucccuuuccuccuaagaagcaaaaauuuuuguguugaacaaguagaaauuugguauuuuuccccaguagcaguugacuucacauaacugucuauaucccagcaaaaguucuccuaguuuucucaaaugagguuaaaaaguuagaaaaaaccaaugaguuuccucauaaaaaccauuuaaauagggaaagaaauauaaaauaauuuguaaguuacuuugcaugugagugcuauuuaguugugugcaauagcugagaaagcagugaugcagacacaguuggucaaaaauauuugucacaugauaguuuuuuuuuguaauaaagaaugcuuuugacuauaccuucaaccuauaggauuagucuucagaugccaaaaaugcccuuguuacuaaagauacuguuuccgguuaauuuggccaauguaauauuaaaaaauacucauuuugcuaaauaugcaucauucaguuaaaaccauuguagugacaguacagauuuuauaugagaacguuaagcuauauggauaauauugaauuuauuuuaaauuuuccgaagccucugaauuaacguauuacuuggcauaauguuuuuucuagcuguugcauauaugugaaaacauugguuugauuaugcugauuucucauucuuagcauucuuuugcaaagauauccagacugucuuagaacaaaauuuauaucaauuuguguuaggugauacuuuuauaaacaugagaauauauuuauauacaaucuuauuuuaggaguaauaaugauauugacacuuaucacaugcuguguugguaguuaucuguaagaaucaaauugauguacauaauuuauauuuaaugauauagauauauaugaaaugacauacauacauauaaaaugaagggaauaaaaagcaguaaaaugcuauuaucacagagcaacuugauuuuagaaaugucuuucaagacauuuuugaagauaagaagaggcuguuagggaguacagauagcucauuggaccacauauaauauuaauaucaaccagaaaaaaaaggucucugaaugugaugcuguuaugcuguaggacucaguguuugauauguuuauggaaauauuucuauuaaucuggauguugucauaggaggcauacuuaacaaauguguagaugguguaaaauuuggaggaaucuuuaguauguugaaguacaggguagggauucaaauauuaaaauaguguggaacuuuauacuaaaaauaacaaaaauauauuuaacaggaauagauuuaaaauauuucaucuagcuauaagaaaaauauuuucguaucuacagaguagaagacccuuggguucacaauagugucuaugaaaguauuggagauuuuaauuaauuaagcuuucuuuuuuuuuuuuuuggagauggagucuugcucugaugccccggcuggcaugcaguggugcgaccucagcucacugcaacuucugccucccggguuuaagugauucuccugccucagccuccugaguagcugggauuacaggugccugccaccaugcccggcuaauuuuuguauuuuugguagagacaggguuucaccauauuggccaggcuggucucaaacuccugaccucgugauccgcccaccuuggccucccaaagugcugggauuacaggugugagccaccgcucccagccuaauuaagcuuucugucagaaccaucagaauagucacuaugcuuuuauaaauaauagucugauguauggauagacuaaacucugccaacucuaugcuauucagagcaaauugcaaggguaaggggaacucaauaaacuucugagcauauuuugagauggaaguucuuaaguuaggaauuaccagacuagcauggaaaggaugagauuggaaaaccauaccaaauggagacucauugaaauaaaugguaauauuuguccuguaaaagagaagauguaggguguguauacagcugucuucuaaacaaaggucuguguaugcaagugagauuagacuuacuuggcauaacuccaaagggcaguggguggaaauuacauggaaagagguuugauucaauauaaagaagacuuuucaaacaaauauugcuuucccaagaugaaaugagcugcuucaugaggugcugaguuugccaucacuggacauuuucaagauguucuggaaugaugacuccaggcaggcauguuacagaaaugaugccuguuuuggguaaaagguuaaaccaauguccugguaauauuccuuugguuuuaaaggacugguauuuugugaaauagucauugaagucuuauauguauauaaguuuuaaaugcuguaauauauauuuaacauuuucuguccuugaggaauuuauaauuuagggugagaaggacaauauacaauuuaaaagauaaacgggauaauuuuagguuuugauacaauaaucaggcagggucucuaagcagauauuugagaugugagacugaauguugagaagccaggcagaugaagagccgagggaguguauuguaggucuaggaguuggguugccaaggcagugaaugagacugauauguuuuaggaacagaguuauugcauaagaacaaagugaauguagauagaaaggaaugagaggaguaacaugggaagaaugaaguagaaagguaggcauggaccacaucauaaaggacuugugggccaaaggaaggaguuuagauuuuauucuaggugcaguagaagacaguuaaaagauaaauaggauauugacaugauuuguauauauuuuuucauuuugauauguaauuuaaaaaaauuuuaaacugauacaggggugucccuauguuguccaggccggucuugaacuccugggcucaagccaucuguucgccuuguccucccagagugcuaagauuacaggcauaagccaccaugccuggcccugauuuauauuuuuaaaagauguuguugcuuucuauauagagaauaguuuccuggggagggggugggaguaguucacagaagagacuuuaaugauagagauggaguaaaugggaaccaucaggauauauuuuugaaacuagaagcaauaggacuugaugauuuuaacccaucagcacuuaacacaaucauuucuugagacacuuugaagaaaaguauuucuccuguuuuuuuucucuuaccuuuuuggcucuuccuuuaucacuauuuucuuuuuccuggcuacuccuuaucucccccaccuguaaauauuggaagauuuuagacugagucucauuuuuauccaucaucauuuuuuagucucauggcauuaaaugcuguuuguaagcugaugacccaaauuuguaucuccaguuuagguugcucuuaaaaaacugccuaccugacagcugcauuugaaugccucuauccaaaaugagcucauaaucuuccugugaacccguaaacugccccaucucucuucuggcaacucuauuuuuccaguugcucagaccagagacucagaagucuuuuuuuguuuguuuuuugagaccgagucucacucuguccccuaggccggagugcagugguguggucucggcucacugcaaccuccgccguccggguucaagcaauucuccugccucagccucccgaguggcugggacuacaggcaugugccaccacgcccagcuaauuuuuguauuuuuauuaacgacaggguuucaccauguuggccaggcuggucgcaaacuccugaucucaggcgauccgcccucuucggccucccaaagugcugggauuacagcugugagccaccgcgccuggcuggaagucauucuugacuuuuuuuuucuacauuucauaugcaagcacagcaaaucuugucaacaucucuuucaaaauguauuuggaucuagccaccucuuaccaucucccugguucaagucccuguuauuuuuguuaauuuuuuauuuuugagacagagucucccucuguugccuaggcuggagugcaguggcacaaucuuggcucacugcacccuccaucucccagguucaaucgauucuucugccucagccucccgaguagcugggacuacaggcacaugccaccaugccuggcuaauuuuuguauuuucaguagagauaggguuucaccauauuggucagguuggucuugaacucuugaccucaugauccgcccaucuuggcuucccaaagugcugggauuacaggcaugagccaccgcaacuggucaagucccuguuauuuuucaucuugauuguuaacgauagucuccuaaguguucuccuuguuuccuuuuugcaccaacuaccccccauccugcccccaccacaaaaccucuggucuuuucuuaacacagaauucagaguuaaaauguaggucagaccaugucauuccugugccuaaaauccuccuuuggcauuaucucuuagaggaaaaacuagagccuacaaagcuccacaaugacuucaccccuucuguuaccccuccgaccucaccuccuacaacucucccuuucucugcuucagucucacuguccuugcuguucucacacaaaucuggcaccaucuggcuuuagggccuuggcacuugccuucucuucuauuugaaguguucuuucccauguaguaugugacguuuuuccccaacccaguccuuacugaaaugucacuccugaguuaggauguucuuugucacccuauuuugaacuauaccuucuuucaacucucugacccuucccagcuuuauuuuucuuagcauuuuucacuauuuaacauaccauguauuuuacuuauuuauauuaacuuaauugucuacuuucuccucccaguauuaacuccaugagaucaaggguuuuuauucauucugguaccucauagaguuaauacuuagaggagaaaguagagggucuuuauucuuucccagcaccuugaugagucuuauauuuacuugaguucuuauguugagaucuugauaucuuagauuuacuugagcucuuaauaugugccaggcacuaaguguguuuuauguucuuauaagaacaaguauugucaugaucucuauucuauagauaaugaaauuacgaucucagcuuuaguaauugaaccauguugucagcuagugguagaguugagauucagauucuggcaguauaguuugaaggacucaacucuuuauacgacaguauagcauacuagagcauaguaacuucacuaugacauagcauagcuuuacuaugcuaugaagguuuuucagugguguuagaucauuuagggugaguucugaaaagaggcaauuaggucaguuaagugguugggaaaagagccagaucacaagggauaagaccuugaaaucuguuugugucaggaaaagguguuuuauagauauuaaaaguuuauucggaaacauuugcuguauuacuuuauugccacaugacuauauugcugagcauuuuaaguaccggugggaaacauuuaagagcaaguuuuuguugcugaaaugcacuuaaagcauucuacuauuuauuucaccuauuuuaaauacuuaauucaaauagccgguaaucuuuuguuuuugccacugauuugcuauaguaaagguaaaaaaguucagucaguacaauuuauguaaauaggggacuucuaagcuggaaggagauuccauacgccucuuccucugcauauuuuuauugucuauauucuacuuuacuggcaaggaacaguuucucuaccuucagaguagagcuaaccaaagcuaguguuucuauaagauccaaggaaaaaaaugagcuaugaaugauacuaaaccuggaacaauuaugaaaggaagauuagucaggaggaauauuagacgauacuauagaaagaauugccaguuuuagguguuaaaaaguuguuuuugucuuucguguuuaauauuauuauauauauauauauauaauuuuuuuuuugagacagggucucgcucuguuacccaggcuggagugcagugucaugaucucagcucacugcaaucuccaccuccuggguucgaagcgauucuccugcgucagccucccgaguuccugagacuacaggugcccaucaccaugcccagauaauuuuuguauuucugguagagacaagguuucaccauguuggccaggcucaucuugaacuccugaccucaagugaucugcccgccucagccucccaaagugcugggauuacagguacaaaccaccaugccuggccaaauauuguauaaaauauuugaugcuuauccagguauagauacuuaaagacauguaaaacuauugggaaguaauguggaaacuuuuuaccauguggcaacuuugugaaagcagaauuaucacccauguuuuauuauauacaucugauaagaacuagucuucuuuucaguauagagaaaauuugauguuaaaguagguuggcuuaguaauuuaucuuguauagcuuccuaguguucauuuugugguuuagugguauuuaugacucccuaaucuauaagcucuuucuaguauuacuauauugaugcugaaaauaaauuauuccccaaaguguugaagauaccaugucgcauuuaauauagccauaagcuuuuuaaauaagcuuuuuaaaaauguuauuuuuucccucaaauuaauaaugcauguacacagguuaacaagucaagucaugucaaggcuucuaaagauauauaucugacccuuaccugccguaccacauccccuuuccaauucuccauuccuuaaagacagucauaaaggcagucauuuucagcuccuuagcuauauguugcaucuaaacuccuguuucuagguaauuugcauguguagguauuuuugcuucuucaguuuuauuuuauuuuauuuuuuuugagacagaguuucgcuguugucacccaggcuggagugcaauggugugaucucaguucacugcaaccuccuccucccugguucaagugauuucuccuugccucagccuccugaguagcuggaauuacaggcgccugccaccacgcacagcuaauuuuuguauuuuuaauagagaugggguuuuaccauguuggccaggcuggucuugaacuccuaaccucaagugauccacccgccucagccucccaaagugcugggauuacaggugugagccaccgcacccggcugcuuuuuugguuuuaguuauuuuauugaauuucuucuauggaagauguggauuuaaucuucucucacacccccauucuucccucaccuucccccuuuuaauacaguuauaucacaaauuuugguuaaucaauauuuuguguuuacauuauugugacuacccaaauauuauuuauaugugagucaccuaagguacuguagcuguauuuccuuucucaaauaauuuuuuaaauuauuucuaaguuuuuucaauggauagagauagaaaaugaauauauuuaagaaaacuucuuauugacauauuuauauauacagaaagucccccagaacauaaauguauauuauggugauuuuucacaaaguaaauacauccauguaacuaccacauagaucaagaaacauauaacauuuaauuuuaagaaaauauuaauuaccaaaguuuuucaccugcuuaauuuuguacauacaucacuaauucauucuaaaacugaagugaauugaacauauccucuugacauauuuaaauauagaauauauauauuuuuauuucauuuuauucaucuuuugaggcuccuuuccuggaaacucuaauguaaccugauuguguuagaauuuucuuccucuuuuauauucucuauuuuugauuuccaauuccucaccuuucuugguuuaucuccuugauuugggaguguaccauagcuccuuuucaaaacauaaaugcaaugauaauuuucauuacugaaaauauuuuuauucuguccuauacuugaauacuauauuuucuguggauauaaguuucaguuggaaauuauauucccucaaaauuuugaaaguuuuguuacuacaucuucuaguuuuguuaccucugaauauucugcccuguguuuucugauauuuuguagaucuguuuuuauauuuccuuucaugaaauucuugaccuuuuuuucauauuccugguguucugaaauuucacaacaaugugaucugggguaggucuugaugcauuuauuugguaaacauauaguuggucuuuucaaccuagaaacucauguauuuacggucuugcuuuuuuuuuaaauaauuucuuuaagaacuuuauuuucuccauuuucuuuguauuauuuucauggccuuucagacauuaagaaaauuaaagaaacaguccaguccaagaaaagcaacguccaaauaaggggaauuuuaaagugacuugccuaaggccacacaacuaaaagguggcagauccuacguuuagacauaucuacuugauugcaaaucuguucuuuuuccccuauugucuauugaguagaaauugguuauccuagugaaauauacacaaauaauguuuaucuauaucaaauacuguauuauguuacuaauauacauacuauaucuauuuaaaagaaaaaauuuagcaggagauaauauagcauauaggaucuaaaauaauguuguuguuugaagcuuuauuaggaucuuuaauauaaucagaccaaauugaucacuuuacacuauaaaagaagaaaaauaauuuggaucucacagacugauguuuacagaaagucuaagaaauauugcauuuuauauuugguacuauauggagauugauauucuuauauuuucuucugcuucaacucauagucaucuaaccaaauuucuguuuccuucucuuguacuagcuugucacuaugaauuguuuuuuaaaaauuaauuaauuaaucaauuaauagagaaaggaucucgcucuuuuguccaggcuggucuugaacuccuagccucaagggauccuuccaccuugacuaugaauucuuaaaaauacagcauauauagcugaagugcuaguugccacauuauuauuuuuuaaacuggguugcacccguguaaauauagggaaaaagaaagaguaacaauguuagaagcucagaggcgagagaaagagaaaguggcaucaaacaaaacagauuuugauuuucuauccauaaaaauuaaguccuauauuuauacaaugguucaguagcuuuuaacaaucuuuaauuuucacauuccucaagaacuacaacaucuugaacuuucucuuugguugcaugguuuggaacaaauccugaaacaacucccucuaauguuuuuaugacuggaaagaucuuuguccuuuuuugggcguguuguuuuguuuuauuuuugagauaggaucucacucuaucacccaggcuagaguauaguggcucaauugcggcucacugcagccucuaccucccaggcucaagugauccuucucccucagccucccgaguagcugggacuacaguugcaugccacugugcuuggcugauuuuuuaaaauuuuuuguaaagaugaggucuugcuguguugcucaggcugaucucuaacuccugggcucaagcaaucuucccaccuccgccucccaaagugcugggauuauaggcaugagcuagugcacccagccucuuuuuuaaaaaaauuagaaauaaaguaaucaaaagccuuuuucuaaagcaucauaguuuaaaaauuuuuaagaaauagacuauuucaaauugcuauuggagcacaguguacacaggccucugggaaggugaauuuuccugugaagugccuuugagaaggugcauuuuacugccacugauuuuggaaagcaggauauuugagucugaccucuauaaagguuguuuuuuuccuggauuuuuauccauguaauaucauucccugaacaugcaccacacuuuuauauuugaauaaaagguacuuuaaggagcccuuuaaaauauauuaauauguccuuuuuauuaaucuuaaugaauuuacaagcaaaaaacaaaauauccuuuuuuuaauaucuguauacauuauugauauuaaaggcaaaacauggaaauagaaucagguuuccuuucaguguuauacaucauggcaaugcguauuauguaaacgauguuuaaagugagcuauaaagguuauacuguguuugucuugguuuauggauccuaugccuguauuucuuuugaacauuuagagaauauuuaugugaaagauccuuuacauuauuagguuauuucuaguuucuuaggaguaaauuccuauguuugcuguggccacggacuggugaccacucuguuaaaugugggcaaguguauuuagugaaauucgucaguagccuagcuucauuggggaguuauacaagaaugcucugaguguccugaucaauuauggauacauugaggcuauuuuuuugauugucacuaccaacgccccauggaguuugccccuuguagcccagguaguauuauguaggccuaauuuuucucuagugauuuuuauagccuaaguggauaucucacuuccugcuauaauccugggcaagucaacagaguuauuccugucuuuguauacagauuauguuguauuauuccuaguuaacuguuucaucuaggaaacucaguuuuaguucccuauaaugcaacaaacucuaaaccucagcuuuaagguaaaguauuugcccaguguaauuagcuuuaauuacuacucuucacuuuggcuuuaaguauguuuccucaucauuucuggcaccugaaaacuucucuuuuuuuuuuuuuuuugagacggagucucucucugucgcccaggcuggagugcaguggcaccaucucggcucacugcaagcuccgccuuccggguucacgccauucuccugccucagccuccagaguagcugggacuacaggcgcccgccaccacacccgacuaacuuuuuauauuuuuaguagagaugggguuucaccgugugagccaggagaaaacuucgcuuuuuuacucuaaaauuuagugauguuguuuuaaaauuugucuuuuuuaaacuuacgauuacaucaaauucuguauguuuagagaaagagggaguaacuucuguaucugugcauuuugacugaaagucacaguugcuuaucuuuauagaauuaacauaauugagaauguuucccuaaauccuuguucaucuguguagaaauugacuugauagguacucaaauauguuuauaugcuguauauaaauuacauuuucuaguaguugcauacucauaacuauauguauaacuauccaauuuauugaucuuauaucuucaugaauuagaauguuaggcaaaaugagacaaauaagcauguuagaauuuaaaacaugcaaggacaggauucauauaagcauaaaauaugaagcucauaguugugaaaucauuuaauugcuuagacuaggugaaauugaugaaauuacuauuuuaugcagucuguuauguaccuuaaauuuauuauguuggaagaguuauauacaaauaugaaucaucuuuuauuauguuuaacuugcagcauugcuauacaguuuugaauuuuacuagcaagaacuguaucugugagcuuaaacaugauauuuaaaaaagaaagaacacuaacucguauguaugauaaucaacuuggacaacuuguucugggaaauagaaaaguaaacuggugcgacucaaauaaaagguucucugcccuauuacagacacugaaaaucccuagaaacagaaacaugaguaaaaauuaccuuguacuuuuagaaauaugcccugggauagauacuuaguguauuuauagauuuuuuuaaaguaggccauuucuuuucauaguuacuguaaugauuaaauaaaacauuucaagaaauaugaccaguuuuuacccaagagaaaacagaauauucuguugcuuuuguauaugaagucaacuugccacauuuuucuagugcaagugaaagcagaggaucuuauuguaauauauuaaccucuuuggcuacuaaagugagggccaaauaguaguuucuaaaaacuaaaaaaaaauugcaaauugcauauauugucuaauuuugaaguaucugacuuuuuuugcaauguaaacuuucaaugcuuuuuucuacauuuuauuuagucuaaauaacuuauugaauuaacuuguauaacaacauuaagaucauuuuuguuuaaauaugauguauaauuuuugaacuuuuaucugauucaaguaagcuguacauacauaaaaugauuuuuauauuacauuuaaaacugcauagcugugaagauaauguguucgagguauuacguggccaauucucaaguccaccuuuaaaauacauauaaaagucauuauuauuuugauuugaaauggaauauuuauuaaauucuaacauaguaacaauuauaacuuugaaaguaucuaaccuaucuacauauguuguauuuaaaugaugcugauuuaaauuuuucaaacuaucaauuaaaugcuaacacuuacguuaaaugguauaacaaguauuuuuaauguacuaguugaaauauuauaaagguuagugaguacuucgauauuuucugguagcccuuucacaagauuauuuucucauuuuuucaauuuuagaagauucuaguaaacaacaaugaagcaauuaagaccauuauagcaaauuauuucagauuuuuaagguuauacguaugugucaaauuuggguauaagcugcuuuucagagugaaauauaaaaauguucucuaaaguaagcacauucauagucugucuauaaaagaaauaauuuuagaucuguuuuuacaucugacuuucuaguauuuuuuaaaugagagcuuacuuuuuaaaagacuuaaaaauuuuuucuuuccucuaaaguugauuuuuauuaucguagucuauuuucaagagcuuuauacccagaucccagucagcaugucaguaauauaugugaacaaaucagcuacugguaccccgguccaaaucugagcaaaacaaguaacccucauuauuuguugagugauuuuuaaauguaacaguguaaccagaugucagucuauggauaccucauauuaaaaaguacagaaaagagucauuauuuaccuuucuguuuucuuccuuuuguugguuuuccaccugcgguguuggaguccugccuuugagagaauaucugaauaucaucucauguuuugaacaaauuaucuaaaucucugucuuauagggcacagacuaauuucuguauaguuuucauguuguuaauuugaaagccaaauaaugaagucaaauaagagauaaaguuguacguuugcuguuaauagcaagugaaaauagauugcuuacuucacaccuggagaaucugguucugccuguuagacgccuauucuu

SEQ ID NO: 18146 - RNA, 5530 nt, Homo sapiens
ggacggaggaacagcaagguuuggaugaaggguuugacucucuuacagaucagagcacuggagagacugauccugaugauguaucuggagugcagccuaaaggucauauuaauacgaagaaaaaucuuacagcucucaguacuuccaaaguagaucacaaugucccaaggcaucguuguauguuauguaacaaggaauuuuuagguggucacauuguaaggcaugcccaggcucaucagaaaaaaggcaguuuugcauguguaauaugugguaggaaauuuagaaacagaggacuuaugcagaagcauuugaagaaucauguuaagaagauacagaggcagcaaauugcugcagcucaacaggaugaucaggaagucacugcuuuggaagaaauaaauuguucuaguucuuccauuucauuugaaaaugggaauucugauaguaaggauuuggaaguggagacacuuacugcuucuagugaaggaaacaaagaagucaucccugagcauguggcugaauucauugaaauucccauaaguguaccagaagauguuauugaaaauguuauugaaaauggcaguccuaauaauucuuuaaauaauguuuucaagccuuuaacugaauguggggaugauuaugaggaggaagaggaugaagaaggugauuaugaagaagaugauuaugaccugaaucaagaaacuucaguaauucauaaaaucaauggaacugugugccauccaaaagacauauaugccacagaucaagaaggaaacuuuaaguguccugcucuugguuguguccggauauuuaaaagaauuggguuucuaaauaaacaugcaaugaccguacauccaaccgauuuaaaugugcgacaaacaguaaugaaguggagcaaaggaaaaugcaaauuuugucaaaggcaauuugaagauucucaacauuuuauagaccaccuuaauagacauagcuauccaaauguguauuuuuguuugcauuuuaauugcaacgagucguuuaagcugccguuccagcuugcccagcacacaaaaagucacaggauauuucaggcucaguguaguuuuccagaaugccaugagcuuuuugaagaucuuccucugcuguaugaacaugaagcucaacacuauuuaaguaaaacaccagagucaucugcacaaccaagugaaacaauucuuugggauguucagacagacucaaauccuaaucaggaaaaagacucaucuaguaaugagaaacaaacuauuagucugccaguuucuacuagcaaaucaaggaaagagucuacagaaccaaagacauguauagaaaguauggaaaagaaaacagacaguuuaguucagaauggaaacgaacguucugaugacacuguuucaaauauaagcuugauagaccaaaagaugccugacauagagccaaauucugaaaauaauuguaguaguagugauauagucaauggacacagugaaauagagcaaacaccuuuaguuucaucagauccugcuuugaaaauugauacaaacagaaucaggacagaaaaugguuccauuuugcccaguguuguaccacaagaacacaacaccuugccaguaucucaggcaccuuccaaaccaaaucugacaagugaacauacuucauauggcuuaauuuuaacaaaaccauacgucagaccauugccucccaguuaccuugaugaacgguaucuuaguaugccaaaacgcagaaaauuucugacugauagaguagaugccuguucugaucaagauaacguguauaaaaaaucagugaaaagauuaagauguggcaaaugccugaccaccuacuguaaugcagaagcacuugaggcucaucuugcacaaaagaaaugucagacacucuuuggauuugauucagaugaugaaaguaagucuucugucuucuuaguagagguaucuguagaaagagaaaauggcauaaauaaaacuauuauagaucuuugagauuuaaaaaauugauauuuguguagcacagguagugaagcauuacuccauacauuauuuccuuuaauacauacaaccacuaugaggugauacuaauauuccuguuuuauagaucaagcaacugaaauucacaaguaauuugcauagggcuuugccuaugaacuugugcaaggcagaaccugaacacagguuuuucauauucuuugauuauacuucuucacuguaucaaagguuauucuucauuccaaguuucauauaauaaaaguuguaauuuugaugggaauuauuuuucauaugcauuccagaauauaaaucaagugaaucugugucucuguuacaaaaauagaaggagaaaaagaacagaaaauaauugagaaacaaaaucagaaaaagagcuugucugucuacuaauaucaauauccuuuaaaaugacaggguauaaauuaaacaggaaucugacuuggaauuccggucgaaugucaauaaaacuugcauuaacagauguguucuguuuuacaggugccugaugaaaacgguucagaaagaucugucaaucaagcaguagugugaaaaaagcacuauaagaaaaugcaucaucaguuugcuauuucccugauggccuuaauuuuagaguggucuuggauuacuaaagauaaagacaaagcacauuuucuagaaugaacucacagagaugugcuggcuuagacuccaaaaggauuauaaaacucccaaaguaccaguuuuccagaaaaccacauuuuacaguuuaugaugauuaauagcagcagcauguucaguuucgcuuauaugagaaacauguuuaggcaacuagucagaaaaccagcuauggccuuacagaaagggaaaaauuaacccauuauuaaaaaguguguguggggaggggggcugguuuacaauauuaaaccauuuaaaguauuuuauucuacaaaugggguuuguuuucuugucaugcauaaucagauuauguccccucccuucugguuaaacaugguuuaaggaaccgcugcuguuugguuugugauugauuuagaaacuuauacauuaacuuaccacagugcuaucaauuaaagauuguaacagguuuccagaugauuaauuaggucaaaguucaaugaauggcacgccagcauugaaaauuaaaaaacaaaacaaaaaaaaccacagugcuuugcuaauaagcucuugauagaaccucccacuaaccacuuuugugguacaaauuaguuaacauuuaaagggcagcagugucaauaaaauagaaaaaaaccgaucaguacucuggggagagaugaaaggaaucuaagacuuuacaggcuuuguaguugaaggaaaacacugaauugcaaauuauucaaugugaauaaugguaaaagcacacugggauacuucuguuuguguauauguugggacauugcuugaugauucauaguaagguccuuuagacauuaaugugaguuaucuaaguacaguccuauuaaaauaacuggcucaaaaaaucagcuaagaaucagguugagaaaucauucauuuuauucuauuaggagagguaauuccaaaauaagccauacuauuccuguuuuuuuaauucauuagugaugacucuggucugaacaguaauuuuuauauguaaaaggaaguauuuacacaaaacauuugcacaagaacacaguaagagauacauucaagcauuguuuuccuuagugauguuauuuuccuaagaagauuuuaacuuaauaaaguguuaaaacaauaaauauuuuuaaaaauacccucucagauguuuuccauuuguccauuauugaaaggaagaugcuuaaagacuuccuuuuacuaauaguguguaaaucuaaaacagggauuaaaauaacaaaaaggcaguguuucaaaacagaucuccuaaugucccaaugucaaauauuccaguuauucuaaauaauaaaaucuuuguucaaggcagauaaucucaucagacccuauuagagcuucuugaaugaggcuauuacggaaguggggaauuucuuccagguagcauccauauuuuauuaaauuaggauuuccagaucaugauagaucagaugauuuuuuuuuaauuucccgguuuuauugguuuaucaucagcauucacuacuaugcaaugauggucauaaguccauuccaaauuuaaauuuguuucuguuauguagccuauauuaggcuguggaauuuacauuuagguaacuaaacacagcucauaauuaaaaucuuuucuuuaaggucagcuaaaaaaaauguuuccuguauuucuugauacuaaaaauguaaugauuuuuauuuuaguucauucuaaaaguaugucuuguaauaaaaagucuguuuggaaacugguucauuuggacagugaagucuuuugaaauauuucugcuuuguacauuuuccagaaguuuaauauuuuaucacauuuuccacaaguuguaacaauugauauaaauccaugcccacaaaguauuccauuuucauuacuuuuacuguucaugccaagauguuucaaauauauuccauuuguaaucugucuuuaacuugagguuuauuucuacuuuuguguugcuaaaauuauuucugcaagacugagaucaaacugguuuauauauaacuaaaucaaggaauguuuuauaaaauucuauuugaccacacugucuuaaccucgguuuauauacuucucaaauagcuauugaaagaauguguucauuuuauuacaucugucuuuuaaaacauaaaccuacaucauuuugcuuuuauagggugcauaaacuuccaacaguucuaauuugagcgcuucagaagaaaaggaagcuugcuucuuauuccucagauucuucuuuuuuucuguuuugaggauguauucauccuacauggaccaaguuucaaaucuuuguuuuuaaauaaaaauuuccuucaaaaaauuaaauguuaaauuucugcugugugucaguaaggugaagaaaauagcaaaucugaauuuuugcugcucagauauuauggaggagguaaaaaggggaaucuccguggacaaggacacugguacuuugggcuuuagccauauucauuuuuuugaaaccaccaauuauauaauacuuaaauaauuuauaucauugaacuugugauucuuuucaaaucacacugaagguucagccguacuccuuucauguuugguuuaauacuguuguauggaugaaaaaccuaaaagggaugauaguguuuauuuuuuaauuuauuugguacuguaaaacaccuuuucagaaugaguaaaugcugcauaugcauuuuggaguuguuaauaugugaaagauauuacagauucagcaagaaaggaaauuugugcuuccuuguugaauguuaaauuauuuuacuuugcauuuuauaagaguacaaauuaaaacugagccauugaacugcaauaaaucaacaauagugucucauuucaagaaauuuuuuguacuguacauagauuuguucaauaaaacguccuuguugguaau

SEQ ID NO: 18147 - RNA, 1678 nt, Homo sapiens
uuauuugguuugugguauacuguaaagacaguuuguaaaaucagaccuucuaaucuugggucuuuuuugaugacuucuugaauguuaaauauagacagaauugccuauacucuuuuuugcuccuucuccuuucuauuucuggguggguggguugguauagaauuccuuuaggucuguuugaaugguaauccaagcccuauuagguaagauccaacagccucuuauuuauuuuuuaaaacuuauuuauuuauuauucauuugauuuuucuuuucuuuucuuuuuuuuuuuuuuguagagaugaggucugauaugguuuggcucuguguccccacccaaucucaucucuaauuguaauccccacaucucuaggaaaggaccuguaauacccauguguggagggaaaaggugauuggaucacgggggugguuuccuuaugcuguucucaugacagugagugaguucuuacgagaucuguugguuuuauaaguguuuggaaguucuuccuccacuucucugucuccugcugccuugugaagaagaugccugcuuccccuucugcaugauuguaaguuuccugaggccuucccagccaaguggaacugugagacaauaaaaccucuuuccuuuauaaauuagccagucucagggaaguucuuuuuagcagugugaaaaugaacuaauacuaggucuuacuauguugcccaggcugcucuugaauuccuggcuuugagugagccucccgccuccgucucccaaaaugcugauauuaggaaugugagccaucuugcccagccaaacuccuauucuaaacaggccauuuccccccauauauuucugcuuccaugguugauaacauguuggaauugggagaaauucuauaucuauuuuuuaaucaguugaauugggauagaagagcuaagacuuuuaaaauguaauuaaauuuuucuacuuaaacuaauccuguuucgccucaggcaaacuacuagcuuuacuauuuuauuuuuuuuaauaaaaugaggauaguaauuucuacuuuguugugcgguugguagcaaguguauacaugaaaagaaagugcuauaaaacaacuuggcaauaaauaugacauauagaaugaaaaaauuuggucauuagaauaaacuucuuccaaguucaagucccauucugcuucucuuucuguucauuucagcuauuacugaaugccugaagcauuucaggcuguaaucuagauacuggacauacaaagauggauaagucacagcucuggccuugaggagcucacagaucaaagagggauuuggaaauugaaucauauauguaaaaucauauagcucaacaacugaggcauuggaagggcucauuuauacaucacggcugcccuaagaacaaaacacaaaaucuagggaaguuauuaagauguagaacucaacaggagagauuccccaaaagcaccgagugugacaggagccaaaucauguucugaaaaucacagugagaggagauacugagaacaagaaaauuauugucaaauaaacccugggcaaaaaaaccccaggugaauuaaacaugcagaauuagcaaaagcuucugaucggcacagaucagaaaaagguuugguaaaagguuguaaaaguuugguauaggaugcuaguccuuuguuaaauagguuuaaaggga

SEQ ID NO: 18148 - RNA, 1164 nt, Homo sapiens
cuucuugaagagggacgccaugguuaaagacugcgcccgggcggcccggcucggcccgguccggcccaacgcuggcaaaggacaggaggaaaaggacaggaccuuggcggguucgggguggcggagcggagagacagcaggaggaggucggggucgccaggcaggacccgcggaaggcuuguauccgcagcuaccgcagccgcgucacccggagcucaggugaccgggaacuaacacacuuuuuggagaagucacuucuaggcggcgccugcgcguuguguggcgccugcgcacuacggaguuugaagccgcggccgcuuuccucacgucugcggcugccaguuccuccugcaccgggaguuggcagcggggcgagucuggagcuggcggggauaggagagcguggggccacggcuucugugcgcggguugggugaugauugaggacagugaucagccuugcuuagcgcuucaccccuugccccggggaaagcuggaugagggaucuccgggcuccuagacuaaguguggguugucccggaaccgccuguacccacuccgaguugauuuauuacggucccauugcuguuaguauuuuuguuguuguuguuguuguuguuuguuuguuuuuacucgaguaauccaggaacuggcggaaacguugaguuccguacccggugauuguuggccccuggaguucgcgguccuuucggcacugacugacucggcgaccucccccgcaccgcgcagaccccugcaggacccuagccgcucaccugccgcccccggcuccagacuccgacgacccagcgugggucuccggggauccagugucuagaguugggggggucucgaggacgaagggaaguuuuuuaaugcuacacuuuuuguuuaagguucuugccuggaaacauuaaaacacacacacacacacacacacacacacacacacacaaauuuguaggcuggucuaaaugucuccagcucuauuucuuaauuucuuguaaaucaugaaucauaaagugucauggcuauacggugauccuauuagaauuccucacagccguuuauuugggcuuuuugugaaaaacugcauaucauguuaaagaaaaaauguaaugaauuauuuaaagaauccuugcauguauaaaauggaaaauacaac

SEQ ID NO: 18149 - RNA, 1164 nt, Homo sapiens
guuguauuuuccauuuuauacaugcaaggauucuuuaaauaauucauuacauuuuuucuuuaacaugauaugcaguuuuucacaaaaagcccaaauaaacggcugugaggaauucuaauaggaucaccguauagccaugacacuuuaugauucaugauuuacaagaaauuaagaaauagagcuggagacauuuagaccagccuacaaauuuguguguguguguguguguguguguguguguguguguuuuaauguuuccaggcaagaaccuuaaacaaaaaguguagcauuaaaaaacuucccuucguccucgagacccccccaacucuagacacuggauccccggagacccacgcugggucgucggagucuggagccgggggcggcaggugagcggcuaggguccugcaggggucugcgcggugcgggggaggucgccgagucagucagugccgaaaggaccgcgaacuccaggggccaacaaucaccggguacggaacucaacguuuccgccaguuccuggauuacucgaguaaaaacaaacaaacaacaacaacaacaacaacaaaaauacuaacagcaaugggaccguaauaaaucaacucggaguggguacaggcgguuccgggacaacccacacuuagucuaggagcccggagaucccucauccagcuuuccccggggcaaggggugaagcgcuaagcaaggcugaucacuguccucaaucaucacccaacccgcgcacagaagccguggccccacgcucuccuauccccgccagcuccagacucgccccgcugccaacucccggugcaggaggaacuggcagccgcagacgugaggaaagcggccgcggcuucaaacuccguagugcgcaggcgccacacaacgcgcaggcgccgccuagaagugacuucuccaaaaaguguguuaguucccggucaccugagcuccgggugacgcggcugcgguagcugcggauacaagccuuccgcggguccugccuggcgaccccgaccuccuccugcugucucuccgcuccgccaccccgaacccgccaagguccuguccuuuuccuccuguccuuugccagcguugggccggaccgggccgagccgggccgcccgggcgcagucuuuaaccauggcgucccucuucaagaag

SEQ ID NO: 18150 - RNA, 12523 nt, Homo sapiens
cgggaggagugggggcggugccucacgucugguacagucaucacaagccuguucggcgggacugugauggccagagagaugacgaucuuagguggguucccggggguccuuguugcucuugcgggcguagaggcgaucugaggaugccagagugggcaggggugguugacucaccuccuggaucuagcuggagcagcggaaggggagucagaaaggugacuuagagacgguuuucggcuguucggaguggaugggggcggggacgccucuaggagggccccggccccugcaggccaagguaggauagacggcgaccagcuguguccaucccagggacaucaggcuuagggaggcguuccuuucaacagcaccuagguuuuugaauugccuguugaauuggggcaagcuauggaaggcugcgagaacgugcaccuccaggaccccuuuguggaggaagggggaggagcuacauccggaucugucggcucagggaugcugaauuuggaggcuuuuuccaucacaucggguuuggaauuaccuaucccccacccacacacacacccaccccgcgucuccaaggugaugaaaugcuucugaaauguugccuguagcuggaaguggaaagugggauucgcacuugguuuuauuucuuugaguuauguguugaugaggaugagcuaacaauuaguaacacagagcccugaaaauucauguuuugggucauauguaauaugagcggacacagguguauaacacagccuccugauaccaaauacgagauucauuaaaaacuaaaggggcaucuuucuucgcuuauguuuacaaucugcguggcauuuguuccuacucuuuuuucuuuuuuuuuuaaauuaguauuuguugggcaucugcuauuccuggucugggggauacaacagugaacgaaacuugucuucaagaagcuuucauagauguugccgucaggguugcccaccuuuaugcuucuucuccccuaaauauuaccacugcaagaaggaagucccuaguucauacuuaaauacauaaaaaguuaacuguguucuguuuugaagugacaguuucauaucuaaggaacuuucaaaaucauuuuaucccauuuauucauuucauccuuuugaaagggaaaaggaggugagauacgaggagagaauuuuagacuuauaaaauaauaaaguuuuucuugugagaauuuuaauaauggagcuuuuaaaaaaagauaaucgaagcuuuuuauaaagcuguaaaaucuaaauaucaauugaucaagaauauuagauuauaucuggcuuuugcuccagauaaauguuguuucuugucagcaucugcacaaauauuauugaaauauuuuuacauuuuauuacauuuauuagagaaugacacaaacauacaguuauaggguuuuuuguuguuuguguuuacuucauuuuaaauuuuauuauaaccaguuuacauuuugaaaaacuugcugucugagaggagugcuaucagcaguccuauaaaaaauuuugaaauuugucuuuuuuagccuuguuucaacgagugauauuaaagggacuuugcuacaguaauuuaguacauuguacuaguuugauaaaauacaucuuuuaauuuuccuuuauuucaggaucggcuguuuugacucuccuguuggccggcuauuuggcacaacaguauuuaccauugccuacuccuaaagugauugguauugaucuuggcaccaccuauuguucuguugggguguuuuuuccuggcacaggaaaaguaaaggugauuccagaugaaaaugggcauaucagcauacccagcauggugucuuuuacugacaaugauguauaugugggauaugaaagcguagagcuggcagauucaaauccucaaaacacaauauaugaugccaaaagauucauaggcaagauuuuuaccgcagaagaguuggaggcugaaauuggcagauacccauuuaagguaagugauuaaucuaaaaucuauauuaauuuuaguguacucuuuuaguuaaugcuuuggcuucaugucacaaaacauucuaucucgucuaguuuuaucuauuaauacaugaaaguucuguuaucucacauaaccagaaauuccacagcagcuauaggaucaguuaaucacugacuccauaaugcuaacagguacuuaaggccuugccauuuucuugcugucccauccucagcaugucuugcuuagcucuuucaagguagcaggaagguugaugaagcccuguguaccauagauagauauucuguguguguauguguacauauuuauauacauauaaagagaacauaccaggugugcuauuuuuugcuauuuaauaugucauggauaauuaauaggaucaugucauuaucuuuaaugauuuuguggaaugacuauuccauuauuaauuagacuagucucuaucaguguacuuuuuugugguuuuucacuaauguuggagauuccgguaauauccuuacuuaucuuuguacacuucucugaaaguuuccuaacuugaaugcuagaagucuaauugauaggucaaauguguacguuuuuaaggcuuuugauuuauuuuucugguuugcucaccagaaagguuauaugcucuuaaccauaauuuuuuagaguggcuguaucuucgcuaguuauuuuuuuuaaucuuuaacagucagauaagugaaaaauaguauccuguauuaauuuuuauuuauuuugauuuuuuuuagugagaucagaauuuuuagaauuuuauugauauuuuaauuuucuuuuaugguccauuuuucuuuguccuuuuuuguuuugguguguuuuucuuuuccuuagugagcuauaaaagaccuucauuauauguuuuuguuaucuuuuccuuaccuuuuuuuuuucacugauguuuuugagcuggaugucaaaguuuuaaauuuuugauuuuagacucuuaucauguuuacuguagccuaucccauccuauccacugcuacuuuuuuuucccucuuaauacguuuauguauuuguugguuuggauuucgcugcuuuuuuuuucuuuuaaacauuuaaagcuuuuuuccauguggaguuuuucuuggaaguuaugaagugaaauucuaaaugaagugaaauucuaaaugaauuaguuuuuguuuuuuuuuuugagacagucucauucugucucucaggcuggaaugcaauggcaugaucuuggcucacugcaaccucugccucccagguucaagugauucuccucccucagccucccaagcuggcauuacaggcgugugccaccacgccuggcuaauuuuuguauuuuuaguagagacgggauuucaccaugccggccauuauuuaguuucaaaauagacaguuguaucagugcugcuuauugaauaaaccuagccauaaaaauguucaaauuuuucauccguuuucaaagaaaaaaaaauugcucccugcauuucuuagguuuauuacuuuguuguuuuuugacuucuuuuuugggauucuuuacugacuuacaaucuuuaaugaaaaaaucaucuaaagcuauauaugcccucugaauuacagcuuuggguacguuacuuauugacccaaaaacuacuuaauguuucuaagugaucugauuuuuuuguuguuguuuuuguuucaugugggcacugaugguucugguauauuuguaucuuaguuuaauauuguccauguagcuucuuuauguuuuccccagacuagugaaguacuuuuuggaaggucaguuuuucaugauggaaaccuaacuaugaggccugaagugagaaaacauucuuauaauuucuuagauuaauucucuuuuuuauuuauauuaauagaaucuugguaaaacuaggauaguauuuuuuagaguuaaaauaguuuuuuaaauguacacccacauuaucggggacaaugagcuaaugcacaauacauguuuucaugggaaacaagaauguaaaugagauuugauucuuggauaaguacauaaugauguacuaaaauuauucuuguuaauauguacuagaaaauucuuucagcuauccauuacucuuagaaacaagaaauuugggaaaaaaagggaaaagauucugaguuacauacuugaaugagcaacuuuuauuucuuacauuucaucauuuauucuuucuuuauucagcaaaaauauauugagaaucuuuuguguucuagucaugugcguggugaugaauuuuauucugcuguuauuaaaaacuagugugggccaagcacgguggcuuucaccuguaaucccagcacuuugggaggcugaggugagcggaucacaaggucaggaguucaagaccaaccuggccaacauagugaaacccugucucuacuaaaaauacaaaaauuaaccaggcaugguggcacgcaucuguacucccagccacuugggaagcugaggcaggagaaucgcuugaacccaggaggcggagguuguggugagccgagaucaugccaccgcacuccagcgugggcaacagagcaagacuccaucucaaaaaaaaaaaaaguaaaacuaauauggauucauuguacagauuuuaauguauaacauuuaacaaguucuaaucuugguaaauguacuagauagauuucaaaugcauuuuuugauuuuguaaagauaaggguaaguucucaugaaaucuaguauuuauguauauauguaugucuguaugcuuuuacucuuuuauuuauuuacuuauuugcaaauccuauucacagguuuuaaacaaaaauggaaugguugaguuuucugugacaaguaaugagaccaucacaguguccccagaauauguuggcucucgacuauuguugaaguuaaaggaaauggcagaggcauaucuuggaaugccaguugccaaugcugucauuucuguaccagcagaauuugaucuaaaacagagaaauucaacaauugaagcugcuaaccuugcagguaacaguacccuugacugagaugcauuuuucucaaaauuguguuggguugaaaaccuucuguaguaagguuuaccacuucccaaaccacacaaccauagucaaaauaaacaaacuauaugguagguguauuaggguucucuagagggacaggacugauaguauauauguguauaugaaagggauuuuauuaagguguauugacucacacuaucacagggugaagucccacaguaggcuggcugcaagcugaggagcaaggaagccagucugagucccaaaaccucaaaaguagggaagccaacugugcagcuuuuagucuauggccgaaggcccgagagcccuuggcaaaccacugguguagguacaagaguccaaaagcuaaagaacuuagaguccgauguucaagggcaggaagcguccagcacgggagaaagauggaggccagaagacucaggcagucuaauccuccgacauucuucugccugcuuuuauuccaggcacacucuggcagcugauuagauggugcccacccagauugaggguggaucugccucugccaguccacugacucaaauguuacucuccuuuggcaauacccucacagacacacccaggaacaauacuuugcauccaucaauccaaucaagaugauaauauuaaccaucaauguagguaaaguagauagauuuuuauacagguuuauaauuuugaaagcucuauagcacaauauaaaauauguauuuaacaagaaccaaucagaugcuacaggacaaaggcucaaagagaaaauggacacauguuagcagugaggaauucuuucuucuaaauuccguuaauguuaaggugaauauaauuuuuuaaguaaaaucugagauagaucauuuaaugauuuaacauuuaaugccauugaaccaauauugagggccuuacuaaaaaaagaaagaaaucuuuguucucauggaacuuauguucuaccagagggaaacacagaaugagcauaaaagguaaauuuaauaauguuuucagccucuacauuacugauauuuugggccagauaauucuuuauuguggaggacuguccuguaaacuacaaaauauuuaacagcgucccuagccucuauucaccagaugcuagcagcgcccuccuccaccaaguggugacaaugaaaaaugucuccauauguugccagauuucuucuggagguaaaauccugucuuguugagagccacugauacaauguauaucagaaaguaaccacuaugaagaaaagagcaggcuaaugggucaagguugcuuuugguggucaggggauggaugacuuguagaauuuaaauagggugaucaggcaaaccucauugagaaaguaacauuuaagcacauuugaagaaagcaaaauacuuaaccaugcagacgcauggagaaaguguguuguaggaagaagagauggccacugcaacagccauaagcugggaauuugcugguacauagaggauaggaaguuggucaguguggccagaguagaauaagugguaaaaucagagagcugaagugaaggguguuaugaucucuggaauaauucuuuagaguuugaauguugucauagcuccugauacauaaugccauacuacuuugcauaccgcucauaaguauggcauuuaguuuaaagcaggaauuucauucaaagaaaccugaucuuuuaccugcucaacauaagccucuuuaauuuccauagcacuuagugauaguauauaaugauuaaauuuuuuauuuuuuuuuauuuuuugagacggagucucacucugcugcccaggcuggaguacaguggcgcgaucucggcucacugcaagcuccgccucccggguucacgccauucucccgccucagccucccuaguagcugggacuacgggcgcccgccaccacgcccggcucauuuuuuauauuuuuaguagagacgggguuucaccguguuagccaggagggucucuugaucuccugaccucgugauccgcccaccucggcauaaugauuaaauuuuuaucgcucauauauuccaaaguagaauaugaauguuagaaaaggcugggagacuuuuugaaaauuaaguguuaauuaauaaagaguagaaugacuuauugcacugaaccuuggauuuuauuucuuuauauuguaaucuuucagaauaauuuuaaagauagcauuuagaagagccuauguuuacuguucccauuucaugcuucuguucgguuugugacugcucucauuauuacucagugguggaguucaugucacagaagacacaaacaugcuguaagugggaagagauuacuugaucgcauccucucaugaauuuuucuucccuuaaccaaucuuacaggacugaagauuuugaggguaauaaaugaacccacagcagcagcuauggccuauggucuccacaaggcugacgucuuccacgucuuggugauagacuugggcggaggaacucuagaugugucuuuacugaauaaacaaggagggauguuucuaacccgagcaaugucugguaagaaaaaugcagggagaggcugggcgcaguggcucacgccuguaaucccagcacuuugggaggccgaggcggguggaucacgagauggggagaucgagaccauccuggcuaacacggugaaacccugucucuacuaaaaaaaaaaaaaaaaaaaaaauuacagaaaaaugcagggagaguugaagagguuugggcagugcuuucuuuaacauauccaauguguaaugcauccuuuuuuucccccagaauucuuugacuucauuuugauaguuuucuguauauguaauuuuauaccauuuguauauauuuacagcaaaaaguuaaaucucaaaaaaugcugggcauccuauaagucgcauaaauacauugccaguuacccaauuacggcucacauagccaguaggacuuuucauggugauggugaagaaagggaacagagggaagaaaaauuucuuuaaaaugaagggugaucaguauauuucauuuaauauguuuuauaaaguagaugucuuuagaaagucuaauuguauuuuucccuaggaaaugauaggauuaugcauucuaaacccuuuuuuaaacguuuuuauuuugucgaauuuagcuuaagggauucaaccuguuugacacguugaguuguaaguuacagguauucuaaccucugcauuuuuuuuucucuuuuucuaaucaaguuaaauaccaggaaauuauauuacacuacucuuuuccuuugaaauuauuuaucuaguuuucagguagaaaaguagaaagaccuuuucagguccuaaucaggcaagaaaaaaugaaaggaaaaaaagagauuaaauaccuacuuuuucauuauaagaagcacuuucuucuguugagaaugacauucaguguuuuuaaauagcuacuuauaagccaaucuguauucuuaaucucuauuuacugaaaaauuauuugauauugugaagagauacuuccuuuuauauaauuuaaaauuuugacccugaugugcacuaguuuuuaaauaguacuuauuuggguuaagauagcuuuaacccagucauuauuuuuuaaauuuuuauuuauugauuuauuuuauagaggcagggucuugcuauguuacccagucuggucuccaacuccuggccucaagcaacccucccaccucagccuuccaaaguucuaggauuacaggugugagacaccaugcccagcaacacaguuauuuuuaaccagucucuguaugaauaaaauuguaaugauacaugaaacagggauuuguuauucccagaauauaauuuuuacguauacauaauaacauacguguauacauacacacauauaugcauaacuauauuaaacuuuuauuuuucacucaggaaacaauaaacuuggaggacaggacuucaaucagagauugcuucaguacuuauauaaacagaucuaucaaacauauggcuucgugcccucuaggaaagaggaaauccacagauugagacaagcuguggaaauggucaaauuaaaucugacucuucaucaaucugcucaguugucaguauuacuaacgguggaggagcaggacaggaaggaaccucacaguagugacacugaacugccaaaagacaaacuuuccucagcagaugaccaucgcgugaacaguggguuuggacguggccuuucugauaagaaaaguggagaaagucagguuuuauuugaaacagaaauaucacggaaacucuuugauacccuuaaugaagaccucuuucagaaaauacugguacccauucagcaaguauugaaagaaggccaccuggaaaagacugagauugaugaggugguuuuaguugggggcuccacucguauuccucggauccgucaagucauucaagaguucuuuggaaaagaucccaacacaucuguagacccugaccuagcaguaguaacgggaguggcuauccaagcagggauugauggaggcucuuggccucuccaagucagugcuuuagaaauucccaauaagcauuuacaaaaaaccaacuucaacugaauucugcagaaauaaugguuauuugugaacuugucugaugaucucuucccauuuaucagauuaccuuuuccacaaaagaaagucucuaaaauaucacagauuuaccuagagggcaacauuuagauacaggaaaauuuuacauaguguuuugucuuaggauuagacgugaccagauugauccuguuugauuuuggagagauccuauucuaacaaauacucuaaaaugauaaaauugagguacaacucucuuaaaagaguauggauaacuauauuuucuggauucuggagguugauaaccauaugcacuuaacauuauauucuauaaacauuaaguagugccaguuaugagauucccaguucuuacuaaauuguauuagcaggagcugguaauuacuuguauuaucacauguaacuaauaauuugaacuauacuugaaggaccguguugaugucagguauuuacagugguuggaagauagcaguauuauuagcauaagcugcauacguaauauucaguaacugccauauuauauaacaaauuuacauucacaaauucaguauccuguuaagugucauauucuuguaaucugcauucuccaggaguuuuauguguuuaauagaugaauuuauuuuauuucuaaagguauucaaauguuucagcaccauauaauagaaauacccaauuauauucuaguuccuuuauguccuguacaucauucucugcuuggauuuccauuauucuguuugguuagagaauaaaauugguaauugcauuugaagaauguguuaaugucauaauaaagccaugauugcuaucuuauuuuuguuauccgagaccuuugcaaacauuggcaaauagcaucaauuaccuacuguauuuguuucuuuguuuauauuuucaguaagcccuggggaauauagcauggaauugagcuacuaaaugguuuugguuccguuuuacggagauuuuuccucauauuuaguuuugaaugaggaaaaugugcucaauuauaaaagcuguguuauuguuuucuauuauuauuuuuaaauaaucacacuuggacucuuuucaaacauuagguuaguuuguaaugaaagcaaaaaauuugugaauacuggaaguaacguggaaaucuaauguggaagccauuguggcaagguuucuacaaaucggcauuuggagcagaguuguuuguuuuuguuguuuguuuccuuuaagaaaaaccacagggaccaagaaagaaaauauaacaguuugauuucugucauacccauuguauuugaagauauauggauacagauuauauauauauauacauauuuuccuuaauagaggaaugcuucauauuauucaaaaauuauauccugaucaccuuuuuuuguuuuuuauuguaaaguaucucugcuuuauccauugcugaauucgauaggauguugaaaugcuggucaccaaaaaaggaaacugagcaaauucauuucaacaacaucaaaacuucagcuucucauaguaaaaagcugaauguuacuaauauuuuucauaucuaaaaaaaaauucuuagcaaugaaauugcuguuaaaacacaaauuucaaucaaauacuuuuguguauagaaaauauguauaguagguagauagaaaaguauaaaauguuuguugaaguaucuuauuuuagaaugaauggagaaaugccaaagaugaauccuucacugcauuaugaaaauauuucacauguucucuuggacuuuauauaaaucuguaauagauuuuagaauugaaaaauucuuugugaaggucuucuaaaaguguuccaauuuaucucaaaaucuccauauauaggaucagcuuaaaacauaaagaaaaccuugaauuucucaaauguuugagauguucaagacagucucuuaauccguuaaugcuuuuggaaacaauugacaaaauagggcaggcagcucaucucauguccugaaguuggaauuuaaauaauuccuauuugcaaauuagaaugacaguguuggaauuuggaggcaguaguugagcauauucucuaguauauagcuacaccuuuaauaaaaugaaggaaugucuucaaucauauuuuagugggcuauuuauaaauagucuugaagucaauuuaguuuauuuauuuaaaagauaaugcauccugaaagggaucauuuaugaauaacaaucugaagucuuuucauaaaaaaaauuaauaaacuuuaguuguacauuuagccaguguuauuugaaguauguaacuuuuaaaauauuaagugucuuguaugauuagaauaugugaaugaguaacuuauuuuguaucaggaauguuuugguacuguguuuucacucaaaccacugacuuaacagauacugcuguguauaacauguacuaaauauuacaguuauugugcauaacagauuguuccucuuauauuuguguguauacaggcaauucauguuuuaauguaaauaaauaccauuuugcaguuuguuuuuuaaacuauguacuuuuucauucaggacuagucuggaguauacuuuucaggcauauaaauaagaaagugaggauggaacugauuugaugccaaggcacucaaucucaguagcuguugccuaguuguucccgaaauguacauuucucuauauccuuucuauugcuuauaugcuuuccacuggcuucucuaauuuagaaaagacaacuuguagcauaugaacaguaucuucagaauucuaaauacuaauucauggcuucugaccacgauggagccagaaacuaagcuaaccuaaucuagcuaguuaguaaauaauccugcauaacaggauuccuuugguugaugguuaauaaauauuucucuaacaaaguuuauauuagucuuuggacaaaaaaacaauauauuauguuuugcuucuuuaagaaacucauuugauuaauguaaucuaagaugagccuuu

SEQ ID NO: 18151 - RNA, 11320 nt, Homo sapiens
auuugacaguuaugaaaugcauguuuauucugaaacuucuaacuaguuguacaacuaauccgugacaaauuaccagauuaauuuuacuuuauuucuucaggccugggguuuuucgaugacuucaaauuugggaucuaagaagagggggaaaaaagggucaagcuuagccaaauugcaauaaaauggauuauguagaaugcucaagauuuaacucaucaauuuucugauuuuuuuaguaaacacuguuuguaaacauuuacauagaaauauagcuaaacauuuaugcaacacuuucuaugagccaugcauuccauuaauugacuuugcauauauuaugucauuuaacuacauaugcagaagauacuauaauucuccccaaaugucagaugaggagacaugcaccaguuaauuacucaagauuacacagcugaaagugauuauaaggauucaagauugggcaguucgauuucagauccccaccauuuaaucacuauguuaugugaucuccuauacugcucuuauucuaacagcaaacauuuagccggcagcuucucaggcacacgucaugguccuaauaaauucacaugucaacacugucauucaguucucuaaaaauccagguaaguguaaauauucuucacuuaucccccacaagaaugaaucugugauuuauaagacguaccuucaaauuugaaggugggaaauguauucaugucugcauuaccaaacauuugcuugagcuuaaaaagcucccucuccagcucuugcugauacucugaacuagcaucaacagguccuccagauguccuguuaaguaaaugagcaaacaaaaauuaauuuuguguacuagcuuacaaaaacaaaauuacuuuucaccaccacauuccaacagaucuuuuuuuuuuuuucuuuuuugagacggagucuugcuuggucgccaggcuggagugcgguagcaugaucuuggcucucugcaaccuccgacucccugguucaagcgauucuccugucucagccucccaaguaacugggauuacaggcacacgccaccaugcccagcuaauuuuuguauuuuuaguagagaggggguuucaccauguuaaccaggauggucucgaucuccugaccucaugauccgcccgccucggccucccauaagugcucggauuacaggcgugagccaccacacccggccaauagaccuuuuuaaagcauucauguagucaaagaaaagacuucagaaagaaaauaaguauuucuacuucaauuucaauucaaacuauuuuauuacgaugagguuucacauaaaugagguauccucaaaccaaucucuaacauucaagguuucucagaaucacggacacucacuaagucagaauuucucagggucuaaguugcaaaagguguaucguuaagucuacaggcucuggagucaaagacugguccuguuugaguguaaguucaacuauucagcaacugcguaaaccugaguaaggcacagagcacucuaaauuuuaguuuccacaacuaaauaugaagguucuaccaaacgaggguguaaaugcacacguaccucuaagcacagugccuggcacacagugaguacucaauuauuaucuacuaauaucaucugcuuuaagucagccaucacuaaauggcuuuuaaagaccuuagacuuuuaaguuucuaccauagggguccuauuaaagaagcaaauuauuuccuacccucagagauuuugcaauuucgaagaaaaaaauuacauguuuacaaacauuuaugcuguaaaggagugaugugaugagcuucaaagacaugauuuaacaaaaagcuauucaaguugaggaagagauuacuuuugcuaagcuaaucagggaaaauuucauuuuaaaaagguggcauuugagaaacaucaggcaucuggggccaggguuuauuuugagaccuucuaagauggaaaaagcaaagacauagaggugguaagggauuggcuguauguggggaaugcuaaggagucuagauggaaaaaccagcagaccccagaucaugggaggcccggaauguuaagccugggaguuuguauuuuauuugccaagcaauaaaaugacaaaauuagacuugugcauuuugggaaaauaaauauagcauuauggaccagcagcagggccaacugggucucauuaauucuuugaagaaauucuucuguuuuugucauaaauacuacugccuaccuagcaaugaacaauauucuaaauguaaaaaaauguacacaugaaaauuccuucaaggguaauaacauuuuuacacaugccuaugaucaaaguauacagucuuauuuaaguuaaagaacaugcacaaaaaauacauagguggcuccaauuuaagaacuuguuaucaauauuucuuguuagagacccaauuuucuuuuagauuagcacuguccaauagaccuuuuugugauguuagaaacgcucucugucugugcuguccaguguggcagccacuagccauaucuggcuauugagcacuagaaauauagcuaacaugaaugagaaaaugagaaacugaauuuauaaauacacuuaauuguaauuagaauuugaauagucucauggauaacggcaaccaaaauggacacugcgguucuaaauagauccuucaacuagauacucuaauacugguuacagauggaugauggcuauuuuaacuuuaauaugcacucuugugauaaaaagaggccagaaaucaucuaccuccucaacugaauguaagucuugcugcuuaucuugcuuauuacuauauuccuaggcucucacaugaugccuaggacaaagcagucacucagaagauacuuguucauuucacuagcaaauacuaggcaugcuaauguauugaauaauuuaauuuuuauaauauccuaugaaauggguaaguacuaccaucauccuccuuuuacauaugagaaaacuguccuacagaaguuaaaccugcccaaggucauagagcuaauuaguggcagugcuggaugccagcccagggucuacccucagaacucuccauguguuuguuugcacaaacgaaugaaugacccacaaacaagacuccuuagauauaggguacaccuaagaauucacuucuuacuagauaggcuuuuaaagacaguuaaaaugaugcaaacagcaucaauacucuaauauaacaccacauuuggacagaagacacucaaaauucccugacgaguccugcacaucugguuacuuaacaguaugauuuuuggcaaauucuaacuuucagccuugguuuucucauauauaaaauugggguaacaucuauaggguuguugucagaguuucauuaccaugucuacaaagcacagaguaacuuacuacauuuuaaucccuucacuauuucuccuccucaguuuuggcaaugguaacaccuuuguuaguuaccucgccucaaaagucaguuuucuuuuauuguucccucuucuuccucuccagcagcucaccaaaaccaggcaucaguguuucaaugucuugacucugucacuuuuacauuaccacugcuauaaagucaagguucucaucaacuaaugcuuagguuacauuuugcuaacaugucugucuuugcucucuucucauuucaauccuuccaauacccugguuaaaauuauccuccuaauucagaguaaucuuccauccccacagucauguucaaaaagcuguaauuucucacaaaugccuaccacauaucuuacuugcucagucuacaaucaaggccuuccauaaucccucauucuaaccccauaccauccuuauacucuucauauacccuauacuccagggaaauagaauuauaccauucaccaaauauauuuugugcuuucuagcacaaacuaaggcauuuucaugccuuaguucacaccauucuuuccuccuaaaagauacucuccucuuacccucauuuaucuguccaaccuucauacacugaucuuuaaaaccuagaguaaaccccuggguguacaggucuacugaaggccuccuguggguuugagaacuguuucaugcuauaaggaaaaugaugugaguaaauucuucacguuuuuuucuuuaaacugggaagaugauccacaguuguccaugagauucucaagagggaugaguacccaaacacugccuuccaagaagccucuaaaaugccucuagcuggaaaggaguauucuuuccuaugaacuccccaagcacccagcguuucccuaccuuagcaccuaacucauuuuaccuuauauuguauuuauuugcuuagaagcuuucuacuccuaucggacuuuaagaauauuguaaaaaugcccuguggcccaucacgguuaauagccaagugcuuuacacacaguagacaacuauaugaaagaaaauggaacuaugaauuggugcgccucacuguuccuaagauuuggguuuggaccugaugacagcuaagguggucauuccuuuccaaaacuaugguucuacaauuguuuuucuuggacuuacauuaugucauuucagagucuuuuguccuuuaauauacauucucagagaucuguaacuauggaaauagccuuuuaaaaaaaagagcuguguuuauacauuucccccaaauuacaaugucacagaaaggccacuaaauugaggcuaaaauauacuuugauaauauauuuuuccccaauuaguuuuaugaucuucggcuaaucaaugucuaagggaguuacuuuuuucaaacuuagcugcuaaaugauuuccaagacccuauguauuucuauaaauugaugugguuuauaauacaugacaugacaguaagaauguauuuuaaacagcaauaaauuuaguaggauuuucccuuguaacucauauaaagauacaguuucugacuuaaaaaaaucaagauccuuaucuucuuuuuugagggcaccuaaugaaccucuaugucagagaugagcucagugaaggucuaauacuuucaaauaccaagucauuuuuauuaccaccuugaaacuuacauacuuugaauauuuauauuuacacuguaguuauuuauucacuuacugucgcuuagauuuguauucucuaaucuuguccacaaagaguuucuguauaggaucaaguuccuuauuaaaugccacugcuguaacaccaauguuccuccgcaaauggacugagacggcugaccgaaugacagaggagaaccugaagagccucugaagaaucaugcugauucuguuacagaaaacaagcagcagaaacguuaauauacuuauuauaaaucaccucuaaauauaucaugagaaucaaauucuacuaauugcuacagaauuacaucauaucagaucucagucuauaccugaccacaguucccuucuccuccuuauuccccauugcaaguuuuuuaggucuuaaccaaaaggcucugggauaauggaacaguuagaaacucaggccugaagcuucaucaggguuagagcacaaaaugugaggugagguauuucuucccccuugaacuuagucauggaucagagaaaacaguagagguagacuguugcaacacuguccgcuccuaacaggaaaaguacacuggcccccaaacuaauguacaagguuucccauaccucagccgggcaugacaaccugaaaauguguacuucacaggcccacagagggagaaacugcucugccuguuacaaauggauuccagccauuuaagaauacuguaacaacuaaaucaaaguccagaagaaccagcaaagaaaaacagcagccaguccaaaugagcugugcaugacaguggggaggauccggcaguccaacuuuaucagugaaauaaauuggugaaggagauggaagucugaauuuuaaaaauaaggacuuauggccaggugcagugguucacgccuguaaucccagcacuuugggaggcugaggcugguggaucaccugagguugggaauuugagaccagccugaccaacaaaaagaaacccugucucuauuaaaaauacaaaaauuagcugggcgugguggcgcaugccuguaaucccagcuacucaggaggcugaggcaggagaauugcuugaacccaggaggcagaggaugcagugagccgagauugugccauugcacuccagccugggcaacaagagcaagacuccgucucacaaaaaaaaaaaaaaaaaaaaaaaaaaaaaaaaaaaaaaagacuuaaagacuuucaaaucccuagacuuccuuaagcuaaaauauauuacuuucuaacuaaaacauuucaguagaggacaauuccuguugagauuuacuuuagugauuuaaagaucaaaugcaaaaaauaauccaaauuacaacaaauagguacaaacaggaauucuagaagaaaaggaauaaagagggccaggcacgguggcucauguguguaaucccagcacuucagcccgaggcagguggaucacuugaggucagagguucgagaccagccugcccaaaauggugaaacccugucuccacuaaacauacaaaaauaagucaggcgugcuagcgcgugccuguaaucccaguuauuugggaggcugaggcaggagaaucacuugaacucaggaggcggaggcugcagugagcccagaucacaccacugcacuccagccuggaugcagggcaagacucugucucaaaaagaaaaaaaaggaaaugauuaaaagagaccauaaauaauuaguagaauacauuuuucucagauuaaggccgagucuauaaacugacagggcuugccaaaccccauauuggaacggugacaaaaggcucacaaugcaccacagccugguacaauuucucaaucuuuuuuuuuuucagacagggucucacucuguugcccagaaugaacacggcucacuacagccucagccuccuggacucaugcaauccucccaccuuagccucccaaguagaugggagcacaguugugugccaucacaccaggcuaauuuuuacuuuuuuuuuuuuuuuguagagacgaggucuugccauauugcccuggcugguaaaauuucugaaucuucaagugaaaaucugauaugcuaacauguuucccaugcccuccccaaauuuccuaauagcaauacugucaucaucacauugacaccggacuucuacuaaguuauaauaggacuaguggaaguauacaaacuauguuauuggucuaaaguaauauagaaauuagauauaaguauuuagaggccaggcgagguggcucaugccuguaaucccagcacuuugggaggccgaggagggaggauuguuugaacucaggaguucaagaccagccugggaaacauggagagaaccugucucuaaaaaauuagagcuuguauuuuaagugacuucauuguuuuguuuuuuaaauuucauuucuuuuguaauucauuuucacuguauucaaaaguguccacaggagugggugugagaauggcccuuuaccacucagaguuugagcagcacuagcuagaaaacuguagagucgcacaauaguucucaaaauaggguugggggugggggaagaagugaguuuuuuucucuccaaggagacaucuggcaaugucuuuagacauuuuugguuguucucaccaagcugagugcuacuggcuuauaaugaguacaaagccaggaaugcugccaaacacuauaacgacaauaacagcccucccaccccuaagaauuaucuggucaaaaugucaauaaugccaagguugacaaacucuggaauggcauguaaaaauuaucaaaagaaaucuacaaugagccaggugcagcggaucaugccuguaaucccagcacuuuggaagaacaaggcaggaggaucacuuaagcccaggaauucaagaccagccugggcaacacaguaugaccccaucucuacagaaaaaaaaaaaauagccaagugcgguggugggugccuguagucccagguacuugggaggcugaggcuggaggaucacuugagcuugggagguagaagcugcagugagcugugauugcaccacugcauuccagccuguguuacagagugaaacccugucucaaaaaaaaaaaaaaagaaagaaagaaauccuacaaucaggccgggcgugauggcucacgccuguaaucccagcacuuuguuguaaucccagcacuuugggaggccaagguggguggaucaccugagguagggauucaagaucagccugaccaacauggagaaaccccgucucuaccaaaaauacaaaauuagccgggagugguggcacaugccuguaaucccagcuacucaggaggcugaggcaggagauuccuugaacccaggaggcggagguugcggugagccgagaucgcgccacugcacuccuccacccugggcaacaagagugaaacucugucucaaaaaaaaaaaaaaaaaaaaaaaaaaagaaauccuacuaucaaugcaaucaacaaaauaugcuucaccugacagaaugaaagcaaacuguuugaagaaauuaaagaauucauaacauaucacuuuuauaccccaucagggaaaaauacuugagaaaaggcuacaagcaaacaacaaaugaccucacaaggucaugugccacuuauuaucauuccuauguuuaaacacacagaaacugaggauuagaaguaucuggucaaaguggucgggcgcgguggcucacgcuuguaaucccagcacuuugggaggccgaggcgggcagaucacgaggucaggagaucgagaccauccuggcuaacacggugaaacccggucucuacugaaaaauacaaaaaauuagccaggcgugguggcgggcaccuguagucccagcuacuccggaggcugaggcagaagggcguaaaccuggaaaguggagcuuggagugagcagagaucgugccacugcaauccagccugggcgacagagcgagacucugucucaaaaaaaaaguaucuggucaaaguuacacagcaaaaucuaacuuaacacauauaugcaaaaaaaaaaauugugcaauucaaugccacuuucccuucuggcaaacuaaggacaugcuuaacauucagcaauagguucacccgacauuugcuuagcccuagauacugugcaaaguacuuccauauauauccuuuccuuguacccuuacagcaauacucucaaagaguuaaaguguucuuaucccugcuuuacagaugauaaaacuguaucuaagaaagauuaagcugcacguauucucacaguuaauuugcucuaagucugacugcauagauguuacuccuucugcaacacggguaaaauccacuuucauuguuucaauuauccaccauguaagugccuaugauuccccaaucgcauuucuaauuuuaguauucauccugagccccaaaucuauccacagcauucaacaguucucaucucccuuauaaguccuacgaacucauccaaaaaacgaacacauaaucccauaucaaaacuuguuccuucuccuuuaaucccuuucauuuuuuuucacugauuagugaaugcauauuguccacuaaaacgcagaagauagucauuacacaaauagcugugaaauaccaccugacauaaauucucuauuccaguaccaucgggugccacgagagcauaugauagcgucugacaugaucagaaagacuggggaaggcaacaguaagaaaacacuagucugagcagaggccuuguucugggugggagcaugguucuauuuauagugaugacugaccggccaaagguuaguagguucgcugccucuucagugcauauuccuaugaacaauccauaaagucgccuaaugaaguguuagcaccaucguuuuuaggugggaugcaaacuuucaauauuaugacuaauuuuuucccucuuaaugguacacguucugccuaaguagccuagacgcucccgugcgcccggggcggguaggccuggccgaaaaucucucccgcgcgccugaccuuggguugccccagccaggcugcgggcccgagacccccgggccucccugccccccgcgccgccccgauuugcccucagagaggguaucgaucuuauuucugggucuacggcaaacuccaaggucuacaaacguagaggucagcugugaccccgggccaggccgugaagguccccaggacacagagcugcucucuccuccuaguaaaggugagaggcagcccaggccucgugaaaaaacccagaacuggagucccaaaaggccacgcugaucuagcuacccucccagucaccuugcacucagucccgagcugccaaagccuccgccgccaccaccuccgcucuacuuccggcccuggcuccgcccccacacgccuacccgccaucgcaaugcauuaugggccgccguuucagucggucgacgcucaccggacaggaagcgucucggagacagucugcgaccggacgggucuaggugagacagaagccaaacaggaggaggaaguggaggguaagugcuuccggguccccuggcacagccuccgccaucuuuucuucgccuaauuugacccguucuuuuuccccuccuugaaaccuugcucuguacgcaugcgcucuuugaguggccuuuccccuaguucaagcuccccuccgagucagcguccuguucguuaggguuaucgaaguguauaaaggugcagggaaagugagacuguguaaaacaaagcggauuggggcguugugcuuccuuguaccucgugagccuccguugccuugggcggucguuuugcgcacccugccgggaguuguaguccuggacccgaaggugccugggaggcgggagggggguuggggcuucucagcgccgauuccgcgggaagggcccugggaccucacacuucuagucgcgggagcugcaggucuuacccggagagacgcugcacguggagcccucgccgcugccguucucagccggcucuggagugcgggcgggggcgacagggccgauuccggagugggugagugcggccgccggggaggaggggagcgcgggcccucgcgggccggccucguuccggggccuuuucccccacaagggcccccccgcggccgccucuguguuuuguuuccgcugguccccggcgcugugacucccauuuccguucguggagacuugagggagccggguggggaggggcgggagagcugugcggggagcgaaggggaggggcggggggcgagcggccuggagcccggggggaccgggcaccgccgggacccgugccggacgggucgccugucgc

SEQ ID NO: 18152 - RNA, 37541 nt, Homo sapiens
ucgcaaugcauuaugggccgccguuucagucggucgacgcucaccggacaggaagcgucucggagacagucugcgaccggacgggucuaggugagacagaagccaaacaggaggaggaaguggaggguaagugcuuccggguccccuggcacagccuccgccaucuuuucuucgccuaauuugacccguucuuuuuccccuccuugaaaccuugcucuguacgcaugcgcucuuugaguggccuuuccccuaguucaagcuccccuccgagucagcguccuguucguuaggguuaucgaaguguauaaaggugcagggaaagugagacuguguaaaacaaagcggauuggggcguugugcuuccuuguaccucgugagccuccguugccuugggcggucguuuugcgcacccugccgggaguuguaguccuggacccgaaggugccugggaggcgggagggggguuggggcuucucagcgccgauuccgcgggaagggcccugggaccucacacuucuagucgcgggagcugcaggucuuacccggagagacgcugcacguggagcccucgccgcugccguucucagccggcucuggagugcgggcgggggcgacagggccgauuccggagugggugagugcggccgccggggaggaggggagcgcgggcccucgcgggccggccucguuccggggccuuuucccccacaagggcccccccgcggccgccucuguguuuuguuuccgcugguccccggcgcugugacucccauuuccguucguggagacuugagggagccggguggggaggggcgggagagcugugcggggagcgaaggggaggggcggggggcgagcggccuggagcccggggggaccgggcaccgccgggacccgugccggacgggucgccugucgccgcucccuccuuuccgcguccccuccucgcccguccgcacuccucagcagucucagccugcucagcugggaugugguccugacgcccccgagauuuuaagagcaaaaugcagacccugucucaucgcgggacucagcgauucacucauuucaaauccgcucucuuuauagaacaacacacaccagaaucauuuaucagcguauaugguagccaucuggguuuguuuuuuuguuuuuaagcaaggaaguaaaccaaggagauaacaauggguugucuacuuggaaauuuuuuuguguacuagaagacacgcuguaugugcguguuuggauuuagggaccccaguuugaucagguuagcggaccgagaggacaaugccuaauauugcauugcaagaugauuagaaauuuagaaauaaaauucauuucauaaguaguuuccacuaauagcaguaggucugacucgugagaagagcaaagauuuagcaggauucacuugagcgaauuguagaacgaggcggugauaacauucuucgguaguguuaucuugaacuucagaagaaaccgcucaacucuuuagcaacugcuugagggacuagccugucucucaggguuccauccaggcuuuccaagcuucuuuauuuuuagacauacagugacgcugaguggacuucaagucaauuuuaccugaauuguguauacaagagcaucugucaugaggcauguauaguaaugaaguaauuaaaucaugagcuagauguuagguugaagcaaaucaucagaccgaguacuaaauuaaaacuguugacuuuagccuucccucaacucuuuauauauaaaacuccaaaccuacagaagaauuggggaaaaaaucaugcagugaacacgcagauacccuucaccugagggucccaacuguuaaucuuucacuguaugugcuuucucuuuuuauauuacauagauauguaugcuuugcuuuuucuuaacugcuaccuuuauuuuugaaaauaaaaaugucuuuuaauuuccucagacacagaaaagcauuugauaacuuaggaaaaugugcaguuaaucucgcagguacccccacacuccacuuauaauauauugggaacaaaauguucuaagcucuguaauaaugcucuccaaugaaggacaauucucaaauuuaucuguaguuucaaaagggaauguuacaccuaucuguauuuuaaaagacacuagccguucccagaauuuuucguuaaauucaaguuuaguuuguaucccaucuugugaaacauuccgaaccccagguuggauuuaauccagcagaaccagagugucaaaguauaugaaauuguucugugcaguucuggcgggggcagcccuuagacggagaaacugcaaguaauuuucucucaguuuuccuaaguauugacauagaagccugaggaauugguuucagaaaaagagauaagacucacucaaaaacugauaugaaagauuuggacuauuucucaaaucucuguuuugcuucucuggacuaagcauagagaaccaggagagaaagaaagauuuaagagacugaguaauauuuuuugacagaucauuuaagaaacugaguaauuuuuuuuuucuccaaaagggcauggguuuuuguuuuguuuuguuuuuucucuauuuggcacuuucuagggauuggucuauaaauuuuuugaaagaucauaggauaaauuucuuuguagcaacuuccuauuuuaguguuuauguuaggggagccccaggugucccugcugauacgccauuagggccacuucucagccucuggcuacaucauaaugcuuuuuuuucuaucuugccaaaguuuccagaaaauuuauguuuucuaauuuuaaaaaaauugguuguggagaugggaguggaccucuuuauaagcccugaaaauaagugauuuuuuuuaagugcuauucugcuauaaaccugauucucacuuuuuucuguagacaacaguuuuuuauaauauaucuauuuuguguggacauuauuuccuuuuaaccaauacugaaauuccauaguguauacuuucuccacauuuucuuugauuaauacuuucuuaaaauagacacuuggauuggcaccagcugucaccaauaaagcugcccugaacauugucaaucaauccuguuaaccaauuugagaauuuuucuggaaugcuuaguuagggaugaaauugcuggguuauagguaugaguaugcuugauauacuuuucuccagaaugucuacaccuguguguacaccacaucuccagagauaggggaaucuuaugucccugcuaacugcucucguuauuuaauuuucugacauuugccgccgccgccgcccccugcccccaacacacacaugguauaaagugguaguuucuuguuuuaaauugaacuuuugaaugauuugaauuugggcauuucuuuguauccugaguuauuuugguuucccguuaugugaauauccuuuuccuaugcuuuaacuacuuuucuaauuugucccuuuuuuugguuaucaaauuccaggccauugucuauuccaucgucacuuuuggguauuggaaacaucuuuccauucuguagccugucuguugaacauaaaucuugauuuuuauguaaucagauuuuucuccuuacgguuauguucuuggaauuuuauuuaagaaaucuuuuucuauccugagaccacaaaaauguccccaccauuuucuucuguuucauaguuuugccuuguauguuuaauccuuuaaggcauguguaguucauuuuauauggugugaaauaguucuuauucauuuauucaacacauauugguggagugccugcugaagguaguacucuucagaguacuuuguauauauuugugaacacauauucuugcccuggaagcuuauguuguccuucaagguagaucccuacucgguuuccaccuguuuucuucagcccucaggaugaauuccacaauuuuacacauagcaccaguuaaggaauaggcuuuauuggagaaaaggaaggcuuauuagaccagcaucagcaagaaaaaaaaaaaccaaaaacagagggucuucauuucuucaucauccccaaaaaagccugcuggagccugcgcauucugcuagauaugcacgugaacagaaucugcgcagucggcuagaugugcuugugaacggagccugcgcagucugcuccauaugcaugcguccaucccaguggagaaccuuacccuuuuauuguucguccuuaaagggcaagccugagagcaaccuuaauuacgugggaaaaauuagaucauuuuguaucaggcagucuagauuugggugccagcuauuugucagaaaaccagcuaccccauaguuggagauauugagaacuuaggagaguuauagcccuuucuaaagugggaagggagacucaguuucuuaaugcuaguguaacaaauuaugcaaauuuaguggcuuaaaaacaccaccuguuuauuaucuuacaguuuuggagucagaaauaugaaguaggucucugggcuaaaaugagguguugccagugcuguuuuucuagagccuucgagggagaauccguuccuugucuagcuuucagaagcuaccugcauuccuuggcucaaagcuccuuuccuccaucuucaaagccagucacagcuaaccggcagaucuucacauugaaucacucuggcucucucuuccaauuuccucuucuacuuuuaaggaccuucuacuuuuauuuauuuguuucaagagauagggucucgcuguugcccaggagggagugcaguggcacgaucaucauugacugcagccucgacuccuggucucaagcgaucuucucacuucagccucccaaguagcuaggacaacaguugcacaccaccaugccuggcuaauuuuaaaaauguuuuuauaggagacagguucuuuuuauguugcccaggcuggucuugaacucauggguucaaacaguccucucuccucgaucucccagaguauuaggauuacaggcaugaggcaccguaucuggcccuagcugcguuuuaaaaacgaucacacucuggccguuguauugacugagaauagacugugaggggacaagaguggacacagggacccccuuuaggagauuguugcaguacuccagguaagggguggugguggcuguuguacugauauacgcaauacagagccuauauuuggacaaccaugguucauccccaucuggaaugauaccuacuuagguugauacaccaaaacugugacauggagccacaagugguuuagccucaccucugaauagcguucguaugagauggagcucaaaauaagauugcucuaugcaaagcauuugaaugcagugccugaugcucggcgaguaaugguuaauacaaaugaacauuuaaauucuucauuuagugaaaucuuguaagugggagcacaacucuuuuguaaaugucgaaauaccaaauuuaguggagcguuccuuuuaaagguacgccucuuuuuagaugugguaguacgcuuagaauaacuacucagaaggugcuguggacugaaagugcguauggaauucaaagacauucauugaccuacugcgagguaguuaauaacagaaccugguacuuaacaguauuaacaccucagacauguccacaaagaaauaucuauguauauuagcuauuuguguauucuuuagcauuuuuaaaauucuaauguuuuuguaucagugguuuuaagcaauagauaaaaauuuuacaugggauaauuaaaaacugaaguaguggucuguuuaaaauaaaaccaccucugaaaaaaucauuaaaaauuuucuacuguguguaaucagggaaauaaugugcauaucuguaauuuguuacuuuguuuugcuguuuuauaauauucuugcauuuauaagagacaucauuuguaccaaauccuagcugauuaauuugcauaucauuguaucagugugauacuuugcaguaaauucugcuacuaagguacaacuuucagcugaauaaacauaguucaucuccauguuaagcuucagguuugaaucuguuauugagacugaguugcuuuaauauaguuaacagacccuuaacuuaauuuugagguaacuuguugauugcaauuggucccgaaaacaucucaguaaauccaguagauuaaugaaguugucaugucagguuaauaaacaccaguuuuuuaaaaaauuaguuuauaaaugucauuuguggauuuucuuuauuuuauuuuucaaacagggucucuugucgcccauacuggagugcaguggugcgaucauggcucacugcagccucagccuccugggcucaggugauccucccaccucagccuccgaaguauuaauagcugggacuacaggcgcgugccaccacgcccugcucauuuuuguauuuuuaguagagacaggauuucgccaaguuacccaggcugauuucaaacuccugggcucaagcaaucugccugccuuggccucccaaaguccugggauuagagacaugagccaccacacccagcugauuuucuucuauauguaaagacuacuucccccucuucugcuuggcguuugcuuuuuauuuggauugggucucuacuucuugugugucauuucguuuauguggauaguuuuaaaauaucuuaaaaagucacucuugcaggacugauccuuugaaauacuccagccaugacuaaaagagaagcagaggagcugauagaaauugagauugauggaacagagaaagcagagugcacagaagaaagguugguguuucugaauuuaucauuuuuuuucaaaauaucaauauaccuaauuaaaaccaggaaacaagucauaguucuuuuggacugucuuuuuuuaacuguucucaguauuuuagggaauaauguauuguuuuauuuccucugacuuaaugugguuguagcugagagggaaagacaguuuuaaacuaaugguaguaaaaggguaaaugaaaucaaaagcaauugcuuucaauaguuuucuccuuuggggcauuugauucuuuauucuuuuccucagcacugguugcuuuaauuucagaaauaguuuaauucaaccugaacucauuuaacaaauauuuaugaguaacuguuguaaacaacuaauugacaagaauaugugaauaaauaagauacuaaucugcccuuauaaaggccacguuguauuugaggagacauacagguauaugaguacuuacgggaccaguacuaagcauaaaauguagugaaaaguguuaauucuuggaauaauaguggaaucauacuuauuugaaaggaggacaguaguaaugaguucagaauccaggagagaacauggguagaaauagacuuugggagucaacaagaagacugaggaaaguaguaguuaauggucccuauuguacuccgugaaguaggaggugagauaauaagcugaaaguaaaagggauugaaaaguacuagagaucucuguggaguaacaaagguuuagaaguuucugcaguggaacuggacaagauaauuaagguuaaggaggauacugaguauugagaguacaguugagauuuaaaaucuuaaauuuuuaauagagcuuuucaacuuguuuaucccaguuuuuccagcauaagaaagagggaaugcaugcuucuguggaauuucauguauagauauuuguguuagaaauuaccccaaaauucagaaacuaaaaaugcguaacauucagccagaugcaguggcucaugccuguagucccaacaguuugggaggcugaggugggcagaucacuugagcccaggaguucaagaccagccugggcagcauggcaaaacccugucucuacaaaacauacaaaaaaaaaaaaaaauagccuggccuggugacaugugccuaagucccagcuacucuggaggcugaggugagaggauugcuugagcccaggaguucaaggcugcagugagccaugauugugccaucguugugccauugcauuccagcuuuagugacaggacaaggugcggucucaaaaaaaaaaaaaaagcccaacauuuuuuauugcucauuguuucucagagaaaccugggagcaacuuaccuggguggaucugucucggguauuucaugaguuugcaaugaagcugucagcccaggcugcagucuuguaaagacuugacuagggcuagggugucugcguccaaagucaugcuugagacucucagcaagaugccucaguuccucaucacaugacucucucuagggcugcucaugggauggcagcuggcuucccuuaaagcaaauggucugagagacagaauggcaaaguagaaagccccagugucuuuuuuaaguaaucuaagaagugacauaucacuuugucuuagucuucuggucacacaguccaacccuaguacagugcuggagggaacuuuaaaagggcaugaauuuaagaaucauuggcagcccucuuggagucuagcaugcauauauuuauacaugcaugcacacagaugguccacaaagucuaaaguauguacuaucugaccuuuuguggauagucuagguuaggcgacagauugguaauuaauauguaugaccuaugugaaggaggcaguaauugucguucaccuaacguagauuuuugcugugcaagaauuuaggucuaguaguaugagaucaucuuuuuuuuuuuuuuuuaagagaaauugguacuuuagauauuugaggucuuccaagguuuaaaugauagcaauaaaaacuuuuuaaaaauguuuaauguucagcuaguauaaaguaguucuuuaaaaauuuguuuuaaaagugacauuugaaucuuaagaguaauuguuacaaaaaaagaaaaaacuggccugacacaguggcucaugcuuguaaucccagcacuuugggaggccaaggcaggugaaucacgaggucaagagaucgagaccauccuggccaacaugccagucucuacaaaaaauacaaaaauuagcuaggcaugguggcgcaugccuguagucccagauacucgggaggcugaggcaggagaaucgcuugaacucgggaggcggagguuguagugagccaagaucgcgccacugcaccccagccuaggaacagagcgagacucugucucaaaaaaaaaaaaaaaaaaaaaccuaccaggcuauagcugaagaguuugguaaaaaggcuuacuuaaaguuuuuuuuuaccuuaacaaauaacaauaguagacuaguauuuuuaaauaagcuuguuuuuaaucaugaggguucuauuuuauaaauuuuaaauguuuuaagucaagugcaauggcacacaccuguagucccagcuacuugggaggcugaggugggaagaucaguugagcucaggaguuugaggccggccuggugugaacauagggagacucucucuaaaauuaaaauauaaauaaauauuuuagaaaaaaguuuaagcuauauacauucauugaauaucauguauguaucucauuuuacuuguaauuuaugugaaaacuugacagauuuuuaaugcauacuguuuuugacaaucacaaauaagauuuaaaucauauuuaaauuaaacauguuggaauacuuaauugaauuccacauucaccaauucagcaaauauuacuuaguauuugucuauuuggcccuauauaaggauuuguaagaguuauguaggauuacuuaccaaagauuuuaacccuuuugaauucaaagugugaaauaauaugaaagagcacuaagacaguuuuuaggaagaauauacauuuuuuuuuuaaacguugagcuguccugauuauaaccaguuguguucauauuaaauuaaagggaaagucuuuuauuuaacuuauucuauuuuuauaucuuucuuuuuuuuuauguggggaagggaaauugacuaguagagauggcauacagauuuugaggagacaaugugucuuccuuucugggucuaaaauucuucaaaauaacuugaaaauguaaugcaaaugcaaacauaauguaugugcaauguuuauauguguacacauacacacauauguauguacauacauaaugaggcauauuuacaaggaugcuuuaaauuucaagcuuagcauuucucuaugaaauucaguguucauuuuggcaacacuaguuggugaugagccugccacaguaucuauguagaaaugacuuuucaaagaccagaaauguguuuugguuugggauuguguuuuuagcauauuguugcuuugaaauccaggguaaaaaauguaacuguuagcacuuacaucuuuaacauuuagcauuguagaacaaaccuacgcgccagcugaauguguaagccaggccauagacaucaaugaaccaauaggcaauuuaaagaaacugcuagaaccaagacuacaguguucuuuggaugcucaugaaauuugucugcaagauauccagguaauuuuuauuuuuguaaauuucuauugcaacauuuuagucugcauaggaauauuuuuuguuagccuuuucuuuauagcuauagacuuuaucucuguaagaagauuugaccuguauuacuguaaaauuuaaguguuuagaaauaaaaagguuuuuaagcaaaguuuucuccauuuaaaguuauauuuuaaauauuuaguacuaaaacaaaugaaacauuuguuuuuuacuuucacaaauauaaaacgagaaguuuaaauaaauuagaaucaaagcuuaaauauaaguaguaacaguaggaagcccauugacuuuugaagcugaaguguauuucuagccagcuuuuaacuucucaaacguaucauuuaacuaaaugauuucuacauuucuguuuuaccuuuauuuucucuaacaguaaguuuuggauaagaauuuaaauaucaacugauagguccuggaauuuauuguaaaaggauuuuacccaugguaguaguauaauauguuaugucugaaacauaucccgagucauauuuuacaguauguuuuaaagauagguaguacuuuuauguaugaaagguagcagccuaaauaggauugcccauacaguuuuccaugaccuuccuuaaacauaugauuaaauacuagaguuuuauacuuuuuuuuuuucuuuuuuuugaaauggagucucguucugucacccaggcuuuagugcagucguguaguuucgggucacugcaaccuccaccucccagguucaaacgauccuccugccucagccuccugaguagcugggacuacuacaggccgaugcuuccacaccuggcuaauuuucguauuuuuaguagacacgggguuuugcuguguuggccaggcugcucuugaacuccugaucucaagugauccgccugccuuggccucccaaagugcuaggauuacaggugugagccagcgugccuggcugaguuuuauacuauuuuuauauuaacuuagauuaauguauauuguuucaucuucuggaucguuugauuuauuuuauucuuuacuccuuccccugccugccuugugauauggguauucuguauauuacagaacuuuuuuauuaguuuuuuaaaaauucaaaucaucauaugcugcuacuauuuuuaauaagauauuguuguacaauaaguugaaguguuuuaacaaaauuugugcauuuuauuugccuuuuaaccauacuuuaaucuuuucauuucaauauaaaucuaguaauuggugguggguagggaagauagagugccucuaaaacuagggcaugugggaaagucuaguaguguuacaaauuuuaggauuuaaaguuuuuuucucuuaacaaugagaggaugaguuagcuuagucuuuuuggaagaccaccucccauuuaauaucuguuaauguuaaaugugaaauuccuaacaguuccacuucagcaaauuauuccuacagaaaugcucacuuggguagguaaagauauaugcaugaagauguucauggcuuugcaaaaacugaaaacaccucaaauguuccaaaaaugagauuugauagaauagaauucgagguagccauuaaaaacuggugaacuugagcuauaugggcaagguacguugagugaaaaaaauacuuacaaaacacucuaauucucucacguaaucuucacaucagucuuugaaaucagcauauuuuuagucacauucugcagauguagaaacagauuuaaagagguuaaauaauuugcccaauguguggcuacaaaaggguauacuggaauuugaacccagaccucuguggcuccagaacucucuucacuuguuugagacgaaaaaacaaaaaacuuuuuuaaagguuuauagugaauauaacucagugucacuggacuuugccugguuuugcucauauguaaaauaaaggagaaucuggacuugaucucuuaguugucuuucagcuguaacauuuauugcuuucuuuauaacacuugaccuauccaaaaugaaaguauggccugcagauuacccaggcucuuccaaguucucagaaaauaauaguuggauaaaugguaauauuuauaauucauauugucauagaauucagggcuagcuuuggaucuaagggcauuuugcauuacuccuugucccccuuuccuccuuaaaaaggauaugaggaccacacugacauguucuucaugucaaugcaaacauacauuucagucagaagucuugcugcuuaugguaaugcugugggcugacuugaaagcugagggaacaacagcuaaguugcacuuuuuugaagaguguuaacacaagaucaaauaccaggcuugaguuuuguccuuguucuggcuuuuagugaacuugcuaauauguucaguaccugagagcuuauacuuucagaguuacauuugccauagcuucuaauggauaauaccaguguccaccagacaaggagaaaaaaacuugacauuaagacaauuuuuaaugaaauguauauuaauggaugaaacugucauauuuaaucuaucugucuacaagguuacaagguuuuuuuuuguuuuguuuuguuuuuuuggagauggagucuugcuguauugcccagacugagugcaguggcgcucacugcaacguccgccuaccgggucuaagcaauuuucaugccucagccucccaaguagcugggauuacaggcaugcgccaccacuccuagcuaauuuuuguauuuguguauagacaggguuucuccauguugcccaggcuggucucgaacuucagaccucaggugauccaccugccuuggacucccaaagugcugggauuacaagugugagccaccaugcccagccguacacaguuugucuucuccccuguucaaguuagauucauagucauuugucauguguuugugccaugacgacaccaucaguugaauucuugggaaugcgaguaggacaugcagcuuuaugacaugcagacacaguuauaaauuaugcaagaugauuauaauggaagccugucuuuaagcugaugacagaaagugucugaaagucagaauuaauguuuuaucaucaauuugccauagugugaaaugcauucuauaaggauauaugaaggaaaaaacacuaauacugaaaugauauagaauuaggauucaagauauucauagcuagguuagguaguaaggucauaagugcuuuaauuuuauuaacuuuaugaugagagauuuagaguaaacccuuaucuucaauauguagcauugauuacaaggcagauaugacaagaauauguuaauauauuuagauaaauuaucaugacuaauuaaacacuuuuacuuauucaugacagauauagcauuaccuucuacuuuaaauacauuucagaaugaauaauugccuuuuggaauuauuuaaaaucccaaacuagacuccagagguagagaaaacugacaugacaaauuuggugguaugcuguccucaauuacuuccucaguggugaaaauauuuuagauuuuggcaaagaauuaaauaugacaagcuaaauaauguguucuuauaauuuaauuaguauguucaguaauuaaguucuguuugguacauccauuuauucuaaaccaaaggcaagggacuuaaucuaaugauugcacugaaauaaucuuacucauuuuauccaugguuagcuggauccagaacgaaguuuauuugaccaaggaguaaaaacagauggaacuguacagcuuaguguacagguaauuucuuaccaagguaaguuacuuuucaugauaguuauuuaaaauuuuagcucauguuuuucugauacaauuuauaaguuuuuagguguuuucgaugguugucuacauuacuugauaugauauaauagccaaaauucaugcuuuggguuuaguaguuuuauuugacagggugaaacagauaguacaacacauucuacuuaguucaaucauaaaaggauauauuauaugguaguaaauagcagaaucagagagaguacuggaagucagcagguugcagcugacuuccuaagaguaccucagccacacugcagaacuggacugcuaaggaagcugcugcccugccaugaucuggaaaauacaacaccuggaagcuaccaugguagcugucacuuuaaccauguugccuuuacagugauccacacuagucaaaaaaauagaugucugcuggcugcgggggcucacgccuguaauccuaccacuuugggaggcugaggugggcagaucauuugaggucaagaguuugagaacagccuggccaacauggugcaaccccaucucuacuaaaaauacagaauaagcugggugugguggcacaugccuguaaucccagcuacuugggaggcuaagacaggaaaaucacuugaacccaggaaguggagguugcagugagcagagauugugucacuacacugcaucuugggcaacaagaggaaaacucugucucaaucagucaaucaauaaaaaaauagauguuaucugccucaaugguccccaaccuuuuuuggcaccagggaccaguuucacagaagacaguuuuuccguggauuggggcaggggaauucaagcgcauuacauuauggugugcuuuguaucuauuauuacuacauuguaguguauagugaaauaauuauacaacucaccauaauguagaaucaguggaagccuugaguuuguuucccugcaacuagacaguuucaucuggaggugaugggagacagugacagaguaucaggcauuaaauucucauaaggaacacgcaaccuagauaccucgcaugugcagcucacaguaggguuugugcuccuaugagaauuuaaugcuaccacugaucugacaggaagugaagcucaggcgguaaugugagugaaagggagcgacuguaaauacagaugaaacuuuauccacucgccugccagucaccuccuguuguguggucuguggccugggguuuggggaccucugaucugccugcuuguccucucuuaacccuuuuccaaauagaaggcuuauaccagugauucuaaagcauuggucacgccuggaacccuagcugcaaagaaauccaaccaguacaguuuagcacagagagaagaauuuguaauagacauagagucauccagucaaccuuauucauuacaguauuuuacuaaacuuguauaaguacccaaguuagaaaagaaaauuaggaaacuguuuuugguagguugaauuuuagcuuuuuaaaauuuagaauaauuucaucucugaacauauauuguucacaauuauguuucacaaaccacauuuuucuucagacucugacaaugguaguuacguacuucugauccuuaauucccucaggacugauuauugggaauaggaaauaaauuaguaguuuuuaucuuuaaaagccuagugaccucuugaugcaaguauguuuaagaagaguucgcuuaaagccauuaaaguaugaaaucuagaugaaggauuaggaaauagauuuuaacaaaaaauauuuuugauucugauuguuuuuaucauguauauuugaaaaaugauucucuuuaaacuaccugagaaugauaguaguaguuucuugcaauacugguuuucacagaagaucgaaguugaguugugcuuuuucuuuaagcuguacuuugauugaauuuugauauagauuguaauagauucaguaagaaacagaagcaguuauguaauaugacagugucuuagagcugucauuuuagacugagguuauuucguaaagggcuaauuccauuuugaauagauaaauaaaaguauaucuuauagagaguacugcacacauaaugaaauaacuguuuuuauggcauaauuucuuggcuuaauuauaauuuaauuagguauaaucaaauuauaauuuaauaguuuaaauguguuuuaaacuauccagaauuaaaucaaaaucagaauuuugauuuaauucuggauaguugaggagccuuuguauuaauaaauuauuuauuuuuauuuuuuauuuuuuccauaggaauuacaguucuuaacaccuuuauacuaggagcuuaaaauauucaggauuuggguuuuucuucaucucauuuaaaaugaaauuuagaauuuaaugguuaauuuaauuuaguaaauuuggcauaauuuuuaacacaucuacuuuguccuuuaaaaagaaaaacugagucaguaaauaauaauuuuaauuugcuuagaaggauuuuuuaaaauuccaaggauagguagcugcucauuuauacucugccuagucuaauuuuuauuguuucguauugguaauuuuuauuuuuauuuaucuauuuauuuuauugugguaagaacugguacuucuuuuuuucuaaugauguuuauagguaggguuugugugugugucuuauuuuuuauaaaauuauuuuaaacuuguagaaaaguugcaagacuaguaaaagaauucuugaauauccuucacccagauuccccaaauguuaacuuuuacuacauuugcuuuauucgauguaguuuuucucuaccauuugggaacauauaaacuaaauuauuuuuuggugacuucugcguuuucauuuagauuuacaauuuuuuuuuauccacuguucaggaauugaaccaaaguuaaacauccuugaaauuguuaaaccugcggacacuguugagguuguuauugauccagaugcccaccaugcugaaucagaagcacaucuuguugaagaagcucaagugauaacucuugauggcacaaaacacaucacaaccauuucagaugaaacuucagaacaagugacaagaugggcugcugcacuggaaggcuauaggaaagaacaagaacgccuugggauacccuaugguaauaaaaugcauaauucuauauuggguagaauaauaggaauuaagcuugacauagaagacacuaggguaaguuauaaucuauuuuacauguagaguuauuaggaugaauguugauuuucuguaucucucuuuuaauuguaacgcacauuuaagcucaugugguggacaaauucuguccugcgugcaggaaauacaaagaagucuaaaaaauuucugcucuuaggguguugagaguguaguugaagagagagaagauagaugaaaagagaugauugccauaaaagguaacauguuuuuaaacugccaguaacucuuguagaaguaugcuauuggaaucucaaagagaucauaguugcccugagggaaagcugaaaagaguuuauuauaaauaagauaccauugggcagagaaagacauuuaagacaggaaauguuaugugcaaagcuuagaccuggggguaugcaugaguagugagaaaauggagugguuaaggaguuacucuguagcauuacagaacuguuuuugauugaugaaaaugauaauugaaaaaugaauaugguggcaauauauggcauaaguuggaacagguagagacuaagugaagggaaaacaggagcauauuauuauaguugugacuggaugauaaugucuacauuagcccagacuccagaugauuucuuugggaguagcaaggaaaaaguggaugaaaacagugauaggacugagcagauugacagauuuuaugaggguagagagggaagauacaaguauugaucuaacuucucaagcuucaucuuggugacuaaaacaguaauaaucuugauaaaaauugguuccaucaucauuacauauuuagugaacacuaccguacaccaggcaccauguuaaaugcugggcuuaauuaagauggugcacuaugaagagcaugcuuucaaaagcccaguuggggaaguagagaagucugguauaggaaauguuuuuuucaagagaagguggauagcacuugauuuugauguggaaguuuauauucagcuggagguuagccagaaaaugguuucaguuauauaagauuugggcuggagacaaagauguuauaugagacucauucccacugaauuuauauuugaagcuauaaaagucuacguagucccugauggaaagcgagaaauggaaaagaacacacaacuaaaggcauauacacuugacccuguaaacauuuaggguuggagaaaagggagacaagaaauaacugaagagacagaaagaaaguaauaacuuauauguauagugucacugaaauugaggggagaguuuggauggucaagacucucagaugcugcugagaaagucaaagaaugcugacugauaucuauuaaauuugaugaucagaggauuauucuuaaauuuagacagaaguaacuagaguuggcgagacaaaacagaauuauaagaaauagauaucuuagaaaugggggcagaugaggaagaaugcugggguaacaaauaaauaauacugaucuuccaagaguuggcggggaccugaguguauuuguaaaugaaacaguauugucggguuuuuguccuuuuuuuauuuuuuauuuuuagagacaagguuguaccuggggagcagggcugaugacagaaaggcuguauuguagaaccacuguuuucccuaggacauuuuuuuucuuucuuuaaaccaaaccuaaaagauacacaguaaaugagagagcuuacccauggaacugaaagagagcuauggaaccagacagcuaauguagaauuucagucugucccuccgcugcccaguacuguagccacuaaucacacgucagcacuugaagugucucuggucaaaauuaagauggguuguaaauguaaaaauacccauuaaaagaaaaaguauaaaaucuuuucuaauuuuuuauauuaauuaccaguugaaauaacauuuggaacauuaaguuaaaauaaauucauuauuaagauguauuugaccaacuuuuuaaauguaacuauuagaaaauuuaaaauuacauaauggucugcauuguauuucuguuggacagcccugaucuugauaauuguagccuucaguucuggauguucuuacugcauuauuuugauaaauaccuguguucuuuuugcuggaacuccuguugaaucucuugaguugaucugcugcaucuuuuuucuuguuuauuuuucaucuuaccuaucugcacuacuuucugccagauuuucuuguguuuuuaauauaaccuaucugauuuuuaauuuacaagggcucuucauuuuuguuuguuccuuucuguagcauucugaucuuauauugccaauaucguguuuucuccuacuucucugaguauauugauuauauauuuuuuuuuaacuuuuaaaaagcuuuaccgugguauaucuguuucuuguggauucuguuuuucuugugguuuuuguuuguguuguuuuuaaccuuucccaaguaucuaauuauuuuugcccaucuuuucauauuuaagaauuaaucacuuuaggccaggcacaguggcucaugccuguaaucccagcacuuugggaggcugaggcaggugggucacuugaggccaggaguuugagaccagccuggcuaacaugguaaaaccuguuucuacuaaaaacacaaaaauuagcugggcguggugguacaugccuguaaucccagcuacuugggaggcugaggcacaagaaucucuugaaccugggaggcggacguugcagugagccgaaauugcaccagugcacuccagccugggcaacaaagugagacuccaucucgaaagaaaaaaaauaagaguaaauaacuuuaaagcuaauuaaugcgaaguucugaaggauuugauaacuauaugcugauaaaacgaggcauugacuauuucauuaaaagaauuucaggccagguguguuggcucaugccuauaaucccagcacguugggaggcugaggugagaggguuucuugaggccaggaguuugagaccagccugggcuauauagccagacugucuccaaaaaauagaaaaaagagcugggcaugguggcauacaccaauauccuaggaggcuaagcugggaaaauugcuugagcucuggagcuugaggcuauagagagcuuugauggcaccacuauacuccagccuggguggcaaagcaagacugucuaaaaaaaaaaaaaaaaaaaaagggcaaagaaaagaguuucaaacgugucaauauuuauagaucuuuuugcagauaccugucagcaguagaagauaggggugagcauuugggguagguguguaugugaauacuguguuguggaacuggaaaaggaaguagagcagggaggagguagagaagguggagacggucucacucuucaguuuauaggcuuuuauuacugggaauuguucucucagugucuguucgugucucuccccaucuauuaauaaauguuuucccgguguccacauguguggggugcacucauuuaacuggccccccaaaugaaagagagacccuggagguucuaaccacaccaucuacuuuaaaucugucuccuuauuuucagcuuuaagccucuugcuacucagaaccaccaugacuugaaccagugaaggggguucugcaggcaggaauucucucacuucuuacuggcauccuccuuggcaaacauuuuaggucauaguuuuccccuccuaugccaaaucgauuaccacucugcuuauugucuucaaaacauuagauuaaaucuuucauccaugccugucacuuuguacucauguuccuaugauuuugcaucuuuuaaaaauuccuuuacuguuguuuuacuagagucuuagagaaaggaggcagaacauggguggacaauuaguuauguuaaaccagaaguccugauauuugagaaaacaaaucagacaaauuauauuuuucccugaguuuuuuuuauuuuuaaauuuuuaugugaaauuaacuuuguuuuucuuuuaaaagagguguguuucaggauagcuuuucuauuuaacucugcuucuguuguuuucaaguaguauaguacucacagauaaggcaacuuucuuuuucaguucuugucgacuuuuaccugggccuucuccucuuuccuuuuccuuggcgucccucugcugcucacuucuaguuccacucugccaguuucuccuuacugugggccauucuccugaaagugguucuuggcucaguuugacaaacacccaggugcuacauugcuucagcccuuuaaaucuuaacacacacugcagcuauuggauugggcgaaacugcuuuuuagcguugcuuucaucuuguccuguuguacuuugaaugcaugcuucuuggcugcgcucagguuuuccuaugaucagagugggucacacuucccuugcuucccuuugcuuucuccugcacacaagcuaagaccauggaggucuuauagcuguuauugcuuugucuuuacccucuuguaucuugagguccaugaagauaucuugucaccugguuuuauguaaauguucguggguuuuugguuuuguucuccagucacuuuuuuauguuuauguguacaauucagaaaaauuaaaaaacuuugccaccaucuuccuagaauccucacuuaacaacuuuauggaaaaauuuuaaaauauauauucuguggcuauuaauccuguauucuuagaaugcuugcuuuugccuuuugaggcuagggcaccucuguuccuuuagucucaaauggaauaguuucaguuucaauagcacuuugccucuuugaagaacuuuuauaaaauucuuauguuugauuuauuuucacuauaauuugcccucgauaccuaaauguuauuuuuuuucuacuuuucuuauugaauagcauuuauuuauuggguauauaaccaauauuauuugaauagaucaucuucuuaaagugggaguaccagaaccaaaacuaauuuagcuaauauguauuaaacuuacacagauagaaugcucuauuaggugcgggugauacagcaauguaauauuuauagauauuggccauauuuuuuuauuuaugaauucaauuagguaguaaaugauagggaaaaggaaaauuauuuggauauacucuuuaagauuaaacaaguguaugagcaaggcacuguuagguucuaaagauagaaugguuuacaagacacauuucuuguauuucuuaguguguugugaggggacagcugaguaaaacaggcaauuaccauguuuauuuauuuauuggaaaugcaucauaaggguaaaugcaggagcagccagcuuuuuacaggaaggaaaagggaggaaaaaggauaugguucauaguuuggagaauaaagcuagcuucuuagaauccccuuuugauuuuuuuucaaugcaacugcaaauuuuuuuaaacuuggauaauuuacuuuauucucuccagaauaaucucauauuuuauucuuucauuuggcccacuggagagcaguuuugcauuuuguuuuucuugauacaguuccagcugagguugaaccaagugacugcaucagaaauuuagauuaagaaauuggaaaggagcugaggaaaaaauuacagcauaauuuuuuuuuuuuuuuuuuuuuuugcuucauauaguaaguuuaccucauauacuuggggaaagaaaacaucuguguguauguguguguauugagaaguuaacuguaaauuuacacaguaucuaaaauggaacuaggcuaaagugaauauuuuucuuucuagaucccauacagugguccacagaccaaguccugcauugggugguuuggguaaugaaggaauucagcaugaccgauauagaccucaccacacucaacauuucggggagagaauuauguagucucaaccaagaagauuuuuuucagcggguuccucggggagaaauucucuggagucaucuggaacuucuccgaaaauguaugaaauuacaguuauuucuuuacauuguaauuuaagcuuaauuuuauuuccuuguaacuuuguuuucaucuuaguuguuuauugauaaugauaaguaauaagcaauaauaauuaacauuuauuuacuguauaaugcuaugcugaaagcucuauauguucuuuaauuccuauaguaacaccauaagucauuacuuugcuuauuuuuuagauaggaaagugaggcuuugagagccccauaaagucacagcuaggaaguggcagagccaggauucaagcccaggcuaacauuagaauccaaguucuuaaaucagaugcugugcccuacacuuagcccucuucauauauuccauuuguugccuucuguuugaucagcucuuacauuuacugcucaucuagaaacggaagagaucauuuguuuacagguggcuuccuacccauucucuucauuauugaugagauuaaaucuuuuuugaagucuuuacuauuaauugaauagagucuuaagagggaaggaaguguaugcagccaccuuuuggcauuggaagccauugguuauaaguuuuuccacuuauaacuuguaaggcuucagacauuauuaugauuaagugaccauguaaagaaauuggaugaggcaggcagaucacuugagguuagaaguucgagaccagccuggccaacguggugaaaccccaucuccacuaaaaauacaaaaaauaggcggacaagguggugcgugucuguaguccuaccuacuugggagguugaggcgagaggauagccugaaccugaaaggcggagguugcagugagcugagacugcgccacuacacuccagcauggugacagagcaagagucucaauuggaaaaaaaagagagagagaaguuuggaaacuacuuggcuguccaagaaaacaaggcacaaauguaaauuauuuuugcuugaauuuuaauccaucuuauauuucagucacuguuaagacaccgaaagcaacccauuccuugacaguuuugcauaucagaaaugcuagccagacccacauauuuuucagaacacaugacuacaacauacucugacuuugcuuuuguaucaguuauggaugaaaauguuaaugauagcauuuuguuuuauuauauacccaauaaggagagagcucugguggagggauuuuuccaccguaauucaaugcuugcaguuuucauucaaggugcuuucucuggccaggugcaguggcucacuccuguaaccccagcacuuugggagucuggggugggcagaucacuugagaugaggaguugaaagugcuuucucugcuggugaauaagaaaugagcucuggagagaggcauuucuuaauuguuuauaauuuuauucuugugaggauucucccagauguuuuuuuuaaguaucuaugauacuaaaagacuuaguacauucauuguauuugcagcauuuauuuccaauuuccauucuuacuagauaaguaaguugaauguccugguugaagcuuuguccuugguuucacagauuuccuucccugcagagguuuugaaaugaauaagguagauucugaauugugaaacaugugagucauguuuauugaaacacuuucuuauaagaaaucucaagaacacaacaaagauagugcauagaugguaguuucauuuuucccaaauccacguuuuuuccagucuuucccaggucagcuguuuguuguggcugucucuuucugguucucuuauugcuucucaaacuuuaaagcuuauucauaggcuuuucccagaacagaagucaaaggugucuuguguaucuuuccauuuccaugcaguugaaugagucuuccucagaaaagcucugcucuggaaccauugcuuugucuuuuaaagcaacaaagucccacagccuagaugagugucucacggaauuucuuggugauccagccaugguucuucacucugccgggguagggaaaucccaucugcuuuggaaaucuagugcucaguucagaauugggagaugggcaggaugauguguaaggguauuucuaacagacuuucuagaauucacaagucuuacuucucagaauaggguuuuuugagcucaguguaguuaguacucuggucccuucuguagagagaagucugcagccuaucugcgaaaggcacugauucugggacagaacuguuaauaacccagccucuauuauccauccucagugaucucucaagaagcagcaguacugaagagguagggcuccuucuucagauauuuguaugagauuauucaccugagccaccaccugccugcaguccccccuauguugaaacuacauccaagucccacuauacaugggaggauaauuaggaaaugucccaguacuaccaguuccaugauguccuucucggugugaaucucugucuucugucaccaaaggcaaaugaaguucucaguuugcuaaggguuuuauuuaggaaaaauaauuguuuuauuccuguagugucuaauguuucuucauaaaauggcuccauaucccccagggcuuugccucucaagacugcuuacuuuguguguagcaaggauuuggagguuucagggaggaaugugauauucagagugccuguacuuugaagagauuggucuuggaccagucuuucaaaaacuuuuuuuuuuucccccuguggucugccuucugucuugagaguuuccaggaaacagaccaaacuccaaucugagaauuaggacuuagaaggugauuuuacaaguugauuaugccugugcugugugauggugaugcuuucguuugccucuuuugaggcuagguuccuuuagucucaaauaguuccucuuugaggaacuuuuauaaaauucugaggaaaauuuacuacaaacauaaagugcguauuuuuuuuaucaagagagaccacaguucuggaggagaaugcucagaacuaggagucuggauaaaacagugagguugucaguugacugaaaaaguaacuguuuugugcacugugcuuuuuaaaaacauguuucuuuaauccucacaauaaccucaugaggcaguaaguauaggugucuaauuuaaacuugaagaaguuaauguugaaagaggucgguaauuuuaccaaagucauauagucaguaagagcuaagaacuaaauccagaucugucugaagccagucccauauaauucuuaaguccucagucuucagacccucaaagcucccaucugauaggauucugaccucuuuuuacuuccccaaccuuuuccagcucugcgugucuggaacuggauccuggcaaggcacccuuagcggagucuucuugggagcccaggccucaguacccagaaugauugcuggaggguauaguuucaauuucaagagagaggcaugcaauuugugaugggcacaaaguaggcugaaguaauagagacugggaugugcaauucuugugagagguaaagaauaacaucuaaguagggaauaacaacagauaaguaaugaaugguucuguaaagccuuaucucaggaccuuuauaguauuuuuauuuugggaacuauauuuuuaaaugugaaauuauuuaguuuaauugagacauuuaggacugcuacaauuguguugaaaauuugcugucuuuaaguagaagcauuauaaagcuuaagcagcuuuagucaaaaguggauguuauaacaaauaaugggaaggaggccuuuuugguggagauacguaccuaaauaauuuaauuuugguguauauuuuaucuuugaucugaucuugaagauuuccauauuuuuacauggcuuuauguggauuucaauacaaauguuuacauuuagaaaaccauaguucucugcagaacuuuacugaacacuaaaagacauuggagcuuuucccuguguuauuucucuuaagguaucuuuuccuuuuaaagugacuaucaaauauuuuuaagguuuuuaugccaguaaguuucaguucaguguuuugguuuuaauuguggaguucuuuuuaaaagaaccauguuuauuaaguugaguuuuauuggauugggguuuuuauauuuuugguuuuaaauaaaaacaaaaaauuuuuguuuuuuucagauguauuggcaagucaagaacaacagaugaaugaaauaguuacaauugaucaacgugaguauuuguaccuauauuugcccuuuuauuaauaagaaauguuuauuugauaccgcaagguaauaaaaaggaaaauuauuuaaaaaaauuuuuuuucuacacacaaaauaucuuuuguucuguggaaugaaagcucgacacaaguacuuuauaagauccacucauguguuuuuaaaugauacgauuaacauaacagcuugcuuuguaucucaguucaccaaaauuuguuaggacaucauuuguuucaucuuuacugacuguuaauuaccaaguuguaagaacaauucuaaccacauucauaccugacagaacuuucaugccugauaauaacuggauauuagguagcauccaauugaaauaucaguauagguuggauacagcagagaaaauauucaaguguccaaaacaaacuugaggaguuacaauggguuugaaaugaagaaaaaaggccaaguuaaaauaggaaaacaaauaguuuucauuuggugggaguugcaaucaaaguauacaguuguauacauucuaauggaucaucugucccauguggcauuuuccaaggcuugaagagucuaccagggcaaacccuucgccgccuccacuacuuuugcuuggcuuuuccccuuucuuuucucucgcuuugccuucagcuuuauucuuuaccuuugauucaucuauauuggguacuguacuugcuagaaguacagucuagaagagucuuuuuguuucucuuaauauccaucuccauuuucaugucaucuuuuccaucuuuuaccucauguugcauuuucucuuggcauguuuggguuuggguaccaccacaguugcugucucuuaaacaucuuucauuaaaacauuacugucuaguuugagaauacuuuuaagccugcugagcucuuuuggggcauuuuuccccccuuuucagcaugcaucuuucuuuuccgcuuaugccauaagcuuuuagcuauguuuuaccugagguacgaacacacacgucacaagaucaucccaaccggcuaaaauuuuuaaugaggaauuugagauacacaaagaaaguauaacuaacaccuguguacaucauuagaaauaaaauuuuuuacaccaaguauaccuguuguagguuucauuuuccucucuccuaccagagaacuaucuugaauuuuauguuuauuacugucugcauauuuuauauuuuuaccaacuauguaaucguaaacacuguauagcauuguuuuccacauguuuaaacauuguuuguaaaauaauacauuguacauauuauuuuauaacuuuuuuaucauuugagaauuacucauguugauacuugcagcuguuucauucauuuucacugcuguaucuuuuaaaugcugugaaaacaucauugaaugaauauuuguaagaacaugugugagauguucgugucauaggguuucuauccuuucagccuuacuccagauauugccagauucucaaagugguggugugaauucucauuuguccacauuuaguacaauauauuugacaaaccguuuuuaugaacaaauguuuuaagaacaaacauguuuaaauacucuuugucuaauguguaugcaucacuaaguuauuuccaaacaagaauacuagcucuuacuaagaugcacaaacuauaaugcaagcguuauacuuuaccaucugaacuuuuuuguuauuuuguuugaaauuguggauugaggcuuucuguagugaaguacuuucuuggggguaauucauagggcauuaguuaaagugauaaugucuuucaguaauuuuuuuuuuuuccugcuuguauuggaagaaaaaaaauuucuccuugucugucuuugcagcugugcaaauuauuccagcaucagugcaaucugcuacaccuacuaccauuaaaguuauaaauaguagugcgaaagcagccaaaguacaaagagcgccgaggauuucaggagaagauagaagcucaccugggaacagaacagguauuuuuguauuuucuuguauuuauaaaauauaucuaucuaauuagguauauuuuguuguauuuuacuguaugaaaaaugugaauuuggacuaucccucuggcaguuuuuagacagcauuucuagaaaaacaaaaauuguuuuugccauggcugagauuuaaaccacgggaccaguuuguugucuuugccuugggcuaaucuauaacacuauagcuaaugcuuuguuccucuuaccaauuuaggaaacaauggccaaauccaacuauggcaguuuuugcuagaacuucuuacugauaaggacgcucgagacugcauuucuuggguuggugaugaaggugaauuuaagcuaaaucagccugaacugguugcacagaaauggggacagcguaaaaauaagccuacgaugaacuaugagaaacucagucgugcauuaagguaagccuuuauuacuuuuuuuucuguuaucaaaaauagaaacuuucuaaaaaauaguuucuuauucuagauguaauaagcauuguuauguaaugauauuaaaaacuuguuuauguuuuuuucuuuacauauuaaaaaaccuuuuuaaaaagaucuuaauaauuucgagguacaguuuuuuuuuuacaaaauuacucuaagauuguuuguuuuuaucugauuugaaagcuauaauacucugucccaaaaaaaaauguuuaauuuuugagguuuuuauuauuugcauagaugaauugaguguuaguuuuuaaugaguaagcagaaacuguccucuguuuuuacaauuacaagcagaauauugacccauuuucuacacaaucugccuaaaucuggauauccaaucuuuacauugauacaaacucuccguaaguaguauaagguuuuuugacagaaauuacuaucagaaauuaugccuacuacagugauggaaauucaacagguacauuuaaguaucugagaagaaggauauauaagaauaucacggaauuaugucugauuuuuugggagauugaauauaguaaaauaguucugcaauucacgaguuuuucuaaauagcaugcuuuuacugcuucuucauguuucacuuggccauuuucacacugaaagauuauaauuuagcucacacacacacacucucccuuccccuuuccaucccuucaucucaguaucccaauauaauuauauggaaauuuugguucagcgaguauucauuguuacaguauuacggccauguaacuauuauuacauaguuggcugugauuauuuuucuuuuccugaaugacccuuuuuuucucagaguucaugaguaacuaaaauguuuaguuuucaaaaugcuuauccuuuaccauucagucucaaacacauugccaacugucuaaagauucuucguuuauaaucauaauuaaagcugccauuuuugagaguugauacagauuguauacauacaaguccccucaaaauuacagguaaauuguuagaguuaauaauuaagaugucaguucccccccagauugaucuaaguuucagugcagcaacuuaguuuaauuugaaaaaucaaacuaaguuuuucauagaacuugagaagauaauuguaaaauuuacaugggacuauaaaguaccaugguagucaggacaccugaagauuagcaaaguggaaagacuugucccacaggauauugagacugacucuaaaguuacaguaauaagacaguuaugcuauuuucucaagacaaauaggccauacaguagaauagggagccaaaauagaaccaggaauauguaagcauuugauuuaaagaaauggcaguggggagaaaacauaugaggaaacgaccugcuuuucaauaaucagugcugggauaauuuacucuccaucucuggggaaaaguaaaaguugaccucuugcuuaugccguaccaaaaaucaauuccauguagcuuguagcucuacauguaaaaaguaaaauagaaaaggaucuagaaauacuuucauaacuucuggugguagggagacauuuaaacagaaucaaaaggacuaauucuaaagggaaagaucaauaaacuggacuauauuuaaauuaggaauuucuguucguugaaagccuuauuaagagagccacacaugucggacagaaguaucuagaauaucuaaccaauucuuacaaaucaauuuuuuaaugggcaagagacuugaauagacaccucaggcuagagauuauccaaauggccaaugaauauaugcaaagguguacggccucauuaguauucagaguaaugcaauugaaaaccauaauuaaaugguacaacucacccccuagaguggcuacaauuuaaaagauugccagaacuaagcucuguugaggauauggagcaaugggaaugcuucuacccuuuugauaggaauguaaauuguaacaguugcuccccuaagcaacuguuucauacacaucaaacagagauguacuucuaugcccauacacauguucauagcagauuauuuauaacauccaaaccccagaaacaaccagauaucuaucaacaguagagugaaugaaucauuuaugguauauucauacaagaauaccuugcauucuugaaaacuaagcuccugcuacaaacaaugaccagugaaccucacaaacauaauguucagugacagaauccagacccaaaagaccaaauucuguaugauuacauuuauuuaguaaaguucaaaaaacaggaaaauuaaauuucaguauuuagggaugcauguuugggugauaaaaauauaaagaaaaagcagucaaauuacuaucaugauacaggcuuguguuuaccuuuuagagccaggauuuggggagugauugggaggggacauaaaggggauucuagaugcuggcaguguucuguuucuugaccugagugauacuuaacaggugagugaauguucacuuuguaauaaaucacugaacuguucacuucuguguccuuuuguuugugugauauauuugcaauuaaaaaguuuaaaaaaauacaaguuuaaaaaaaaagagggaagaaaagaaaucauauccaugaaauacagguauuguguaucuuucauuuuagggaggcaacaaguggaauaaaugcuacuauauacaguugugugaugcaucuacuagaucaaaagaaguauucaguaaaauucaaauuuauguguguauauucuuuuuuaucaccucuuaccaagaaauaugauuaugccaacuccauuuuccuccuagaauuauaaaaccucuuuccuuuuccauuuuccuuuuuuuccccacguauagucuuacauauuaauguagaaauuuuuuaaagcaauugauaugccuauagcauuuuuaacuggauggcaaggaauuguugguuuaugagcugaaauccaaauucuguacuaauguaauugacauaaauggaaacuacaagacugcccaauguguuauaucucuuacugggaaaucaaacauaacuauuuuucuuuugcuauucuggaauuagggaaagaugacaauuuccuguauauaggucaguccuuucauuaauagacucuugauuaagccaagugacuuuuauccugcuaaaugugauaguuuauaucugguacuuuugcaaauaguuguuucuuuuauaauagcccuuugucagugggcagugcaauuuuaaaauaagggcuuugcaaucugccagucguggaaagagcuugacuugccucuuuuuccuguuguuggaauuagcaauacauaguguguguuuaaauaaagucuguuuuccaaaggaaacauaaauccagcuccauuugcaucucuauagaaugcagcaguaaacuagauuucuagaaugauugccggaacucugcuuguguacguuuagaaacauugucucuuugcaauguccuuuaccuguuuuucuguauccucuguuucuuuuagaccuuuuccuuagacuuaaagcucccuauugggcuuggauaauuuaucugaaauuuggaaagcguuuacauagugaaauaauaaagaugaagacaugacuucaucauauaggauucuuuacaagacagaaaagaaguggaauauauguauuaauuuuuuuuauauuaucgauuuuuauuaacauagcuuauauuuuguagagggcugugugccagucauuguauacuaagcacuuuacaaagauuaucccuuuaauccucaacaaugauaugaggguauaagcacuguuaaccucacuuuauagaugaggaauaaaagcuuugagaaaauaugacuccuguggucucaaaaauguuagguuuugaaucuuggcuuucugacuccaaagcucuuguucuuaggcucuucuacugcucucaagguuuuuuguuuuguuuaauaauuauuuuuaaaucaauguuuuauucuaauuguugaaaauauguuuugaaaguuuaauguauagaguuuuggaguagugagcauugaaauuuuaguaaauaauguugggauguuucauuugauaguagcauuaaauauucuacauagcuucaauauuaauugcuauuguggcggaugcaguacucuacuaggcuucugcuuauggaauagucuguaaauuauuguaagaagucucauuuuuucugaagucucuaauuuuuuuuucucuuuuugaagauauuauuacgauggggacaugauuuguaaaguucaaggcaagagauuuguguacaaguuugucugugacuugaagacucuuauuggauacagugcagcggaguugaaccguuuggucacagaaugugaacagaagaaacuugcaaagaugcagcuccauggaauugcccagccagucacagcaguagcucuggcuacugcuucucugcaaacggaaaaggauaauugagccccaggacauucugagacuccaaagucuuucuuaaaauguuuagagcaaguauagcucuuaccuuuauuacugaauuugaaucuucuuuuauuucuaggcuguacagucugaugcaugauuuuuuuauaaauauuucauacucuugugaauuuggaucuuuuuacuuugagcauauauuuuagaauauguguauguuaaaggaucuccacaaugucugcagugugaaggcagguucauuguggaauaguuuaacagucaggaaggcuaaacuggucaguauuaauguguagcccuaccaaaaauagccaguaguaucugaaaaugaaaaauaaaugaaguaucucuaggaaacagucuggcuuaacuauuuuugaaaauauaacuguuuccccucucugcugcuuuagauguugcuuuacauagaaccagaaaauggaauuucucagcuaaagcaugugugccuguuucaucuaaucaagcagagcuaaaauguucauaccgaauaaauuuauauuaauaaauuacuaaacuaagaguaucagguuauuuauauauuugcaagcaaaggacaguaagaaguugacuggcaaaagagcagugcugaaggaggagauccagguuuaaaucuggcuuauuaacucaagccaauuuuaaggauuuucuguauagauuacucaugucagaccaagaauuuaaauuauuuugagagaggcauuuaauucuaauaaaccagcuguuauaaaaauuauaaaaugaucucuguuuuuccugucagagauuuaaaaaacugaaaagguauaccucaacccaaaaauaaagguuuguuuugguuuguuauggcuuccuuuuuuaaaaaauuacccuguagugccaguuuauuaugcaaagcagcuuauauuccuuuguuucugauaaaaugaagacuuuaaaucagucaguaguacuuuaccuuucaaggcauuaguaaauuacuugcaaauaguuuuaaaaggaaaauacgaccuuuguuauaggcagucuucucuuuaagacaauacuuuuccacuuguuuuccuuuuccauauuauauauguguauucauauagcuguauacauauucaguugaucauuuuauaaacauaugaaggcauaaagauauacagaagaaaaauuauuaaacaacucauuuuaagauucaaauuaacuaauuccugcauauaugacauuccuuacauaagcgaacacuaaacaaaaauggcuagaaaugucuuuuucuuucuuuucucucuuuguuguuuaagguauuaagcacgaauuauuacaugagacuggcagauagcuauuaauccucuuacagauuugagaaaguugauucucaaauauuuaugcaccuucuccuucauuguuuucuuuaaaucuguccucuuaaaaagcuucuuaagagcucaguuaaugcuuuugacuuaacuaggagaaaaaggcaugauaauacaggcaagauggcauuguuagcaauucugguagugguuuggaaugaauccuaagaggcagggaucuuaaggacaaggaagagaagagagagagggagggaucuuugaucucuuucucugguaaucuuaaugcauaauuuuacuaauacauguucucaauucauucauauuauuaagcucuuccugcaguugauaucugagcagaguaagauuuguauuuccauuuuuacuuuuuugaaagagaauauauggacagauuauuaguacaauuugggcacugugguuuuaagaauaucugaguaaaauaacaauaugaaauaauaaacagaagcucuaacgucagguaacaaauagacagcaagaaagguuuugcaccauccucuuacggccuagagaguugacaaguugcuuguaguuuuaaaaaaauaauaaaguauacccuucugguauaucaucaagagcuuaagaaucuuggcuuucauauuuaaaaugcuuuuggggagacauauauuaaaauuuuagccaagaugauagacaugucucaauuauauauguguguguauguuuuuaaagcuaaaaacauuacuuuuagaucccuagaaugaaaauuuuuuucucaucuaugcaauucccauaugguuuuuuuuuaaaucauauuuuauucauuuucucccuuuagcaauuuucauuuuauuucucauaauuugaacagagacaguucucauacaugaucagaugcuuuuuuuuucuucuuaccaucauuuaugcaugacauagguaaugugacuaauuucuccaguugauucaagaaacucauuacuuugccucaaauuauauguaaaauauuuguuuuacuuagguuacaguuaucagaaagguaguuuuuuucuucuauuaaaauauaacauugugaaagaaaauaaaauuuaugcuauucuuugcuuuguuuuuauaaaugaauuuuucauagaauuuacaguauauucaaaggaagaaagauaaaauuauuggucaucauuuguaccuuagaaguacaagaauuuaaguaaaagaaauguucauuuuuguuuuaaaauuuguuuuccaugugaaguuuuuauugagccaacuuucauacauaucuugcuagccuaaagucuaaauauuuguguuggcaucagaaaaacaaaugaggcagaauugcuaugugugguugaucuucagauaaauugacugaucacaguuauuuuuguaucagucuauguuauuaggaaaaauuguuuaguuguuuucuccccugauuaauggugauauucaaguaugauacaaaaagaauuguaccaccaaauauuuuugugaggucugcuguuuuccauauucauuuuaugcuacugccuuuaagaaagaacuaguguauccuugaaauagcacaaaaauguuuuaaaauucauaauugcaaaacaaaucugugacuaacuuaaugucuucagaucuaaaggguguaaaaauauugauacuucaauauuucacuugcugccaggaaaaacaaaauucucaaucuuuuguaaaugggaggaggacuuuugcauacauuuuuacucuuuaaauaacgacaacgacacuuauacugucauaauaacaauuauguauuucuuugugguuuuaauuuuuuuuguaauuuuacauaaaacaguuauuuucuauuuuuacgcagauaaauauuugugcauaaaauguaaaaauaguaaaaugagaaaaauaaaacuauuauacaguauguuucuguguugcuuaaaaguuuu
